US008114976B2

(12) United States Patent
Buck et al.

(10) Patent No.: US 8,114,976 B2
(45) Date of Patent: Feb. 14, 2012

(54) CRYPTOSPORIDIUM HOMINIS GENES AND GENE PRODUCTS FOR CHEMOTHERAPEUTIC, IMMUNOPROPHYLACTIC AND DIAGNOSTIC APPLICATIONS

(75) Inventors: Gregory Buck, Richmond, VA (US); Luis Shozo Ozaki, Richmond, VA (US); Yingping Wang, Richmond, VA (US); Ping Xu, Richmond, VA (US); Myma Garcia Serrano, Richmond, VA (US); Patrico A. Manque, Richmond, VA (US); Joao Marcelo Pereira Alves, Richmond, VA (US); Daniela Puiu, Montgomery Village, MD (US)

(73) Assignee: Virginia Commonwealth University, Richmond, VA (US)

( * ) Notice: Subject to any disclaimer, the term of this patent is extended or adjusted under 35 U.S.C. 154(b) by 709 days.

(21) Appl. No.: 11/575,245

(22) PCT Filed: Sep. 7, 2005

(86) PCT No.: PCT/US2005/031657
§ 371 (c)(1),
(2), (4) Date: Jun. 23, 2009

(87) PCT Pub. No.: WO2006/044045
PCT Pub. Date: Apr. 27, 2006

(65) Prior Publication Data
US 2009/0304732 A1 Dec. 10, 2009

Related U.S. Application Data

(60) Provisional application No. 60/607,356, filed on Sep. 7, 2004.

(51) Int. Cl.
*C07H 21/04* (2006.01)
*C12P 21/06* (2006.01)
(52) U.S. Cl. .................... 536/23.7; 435/69.1; 435/252.3
(58) Field of Classification Search .................... None
See application file for complete search history.

(56) References Cited

U.S. PATENT DOCUMENTS
6,514,697 B1    2/2003  Petersen et al.

OTHER PUBLICATIONS

Crystal RG. Science 270:404-410.1995.*
Orkin SH and Motulsky AG. Report and Recommendations of the Panel to Assess the NIH investment in research on gene therapy, 1995.*
Verma IM and Somia N. Nature 389: 239-242. 1997.*
Anderson WF. Nature 392 (SUPP):25-30, 1998.*
Kmiec EB. American Scientist 87:240-247, 1999.*
Romano et al. Stem Cells 2000; 18:19-39.*
Genembl database of nucleic acid sequences derived from GenBank and EMBL. Accession No. AAEL010000029/AAEL 010000000, Jun. 2004. Abrahamsen et al. Complete Genome Sequence of the Apicomplexan, Cryptosporidium parvum Science Apr. 16, 2004, vol. 304, issue 5669; pp. 441-445.
Ping Xu, et al. The Genome of Cryptosporidum homonis; Nature, Oct. 2004, vol. 431, No. 7012, pp. 1107-1112.

* cited by examiner

*Primary Examiner* — Padma Baskar
(74) *Attorney, Agent, or Firm* — Whitham Curtis Christofferson & Cook, PC

(57) ABSTRACT

*Cryptosporidium hominis* genes and gene products are provided. The genes and gene products are useful for chemotherapeutic, immunotherapeutic, immunoprophylactic and diagnostic applications.

2 Claims, 2 Drawing Sheets

Figure 1:
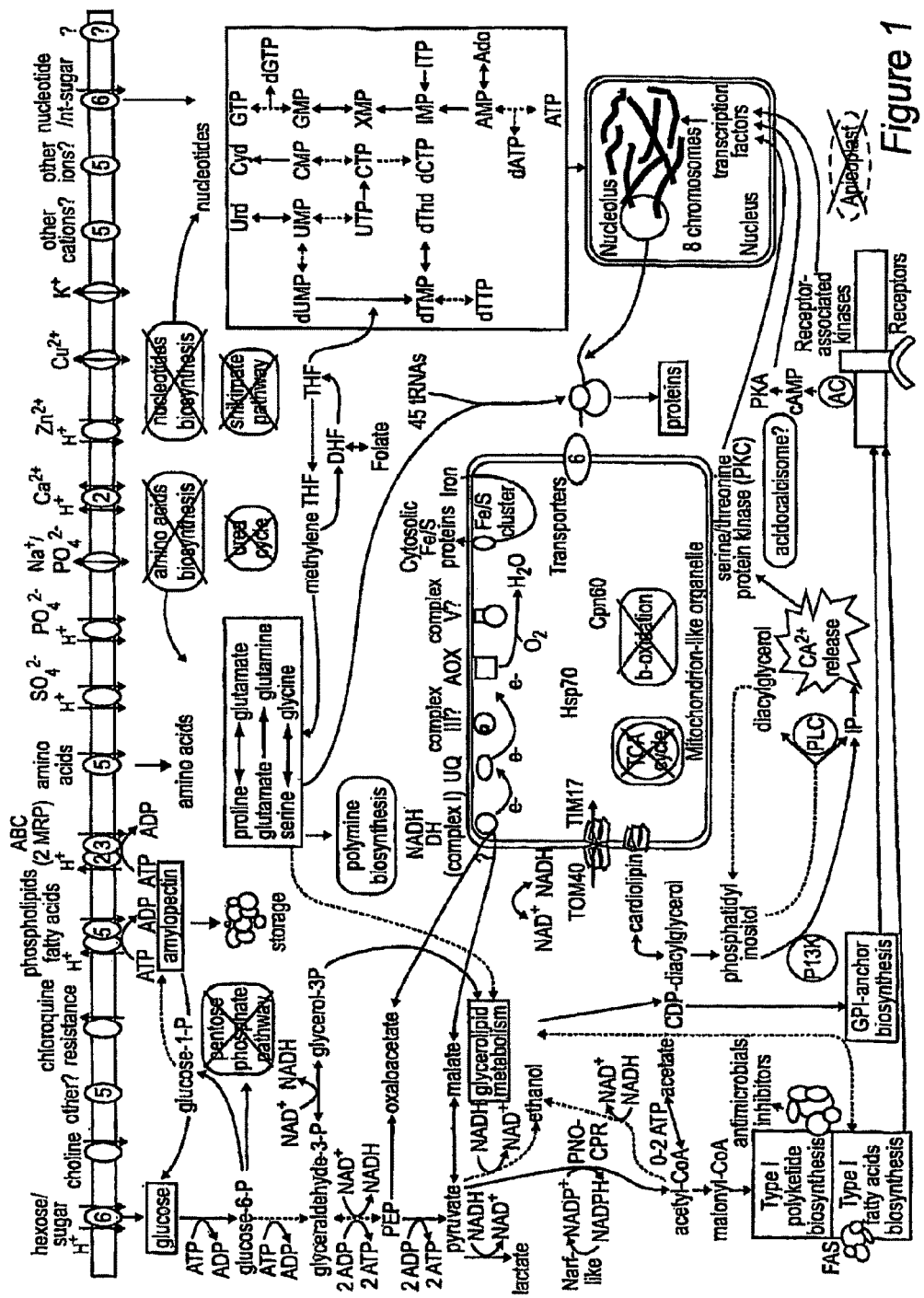

CRYPTOSPORIDIUM HOMINIS GENES AND GENE PRODUCTS FOR CHEMOTHERAPEUTIC, IMMUNOPROPHYLACTIC AND DIAGNOSTIC APPLICATIONS

BACKGROUND OF THE INVENTION

This application is a national stage entry of PCT/US05/31657, International Filing Date: Sep. 7, 2005 and claims priority to Provisional Application 60/607,356, filed Sep. 7, 2004.

STATEMENT OF GOVERNMENT INTEREST

This invention was made with government support under Contract Number 5u1a146416 awarded by the National Institutes of Health, NIAID. The Government has certain rights in the invention.

FIELD OF THE INVENTION

The invention generally relates to *Cryptosporidium hominis* genes and gene products In particular, the invention provides *Cryptosporidium hominis* genes and gene products for use in chemotherapeutic, immunotherapeutic, immunoprophylactic and diagnostic applications.

BACKGROUND OF THE INVENTION

*Cryptosporidium* species are the causative agent of cryptosporidiosis, a disease that is characterized by acute gastro-enteritis and diarrhea. The disease is rampant in many developing countries (e.g. in Latin America, Africa, and Asia). However, incidents of cryptosporidiosis occur worldwide and developing countries are not immune to such incidents. For example, an outbreak in Milwaukee, Wis. in the mid 1990's caused over 400,000 human infections. Thus, no site on earth is free from the threat of serious outbreaks of cryptosporidiosis. Further, the National Institutes of Health and the Center for Disease Control classify *Cryptosporidium* as an important "Category B" agent of potential biological terrorism.

*Cryptosporidium* species are members of the Apicomplexa. These protozoan pathogens invade host cells using a specialized apical complex, and are usually transmitted by an invertebrate vector or intermediate host. Unlike most Apicomplexans, *Cryptosporidium* completes its life cycle in a single host and is transmitted by ingestion of oocysts. Two species, *C. hominis*, and *C. parvum*, which differ in host range, genotype and pathogenicity, are most relevant to humans. *C. hominis* is restricted to humans whereas *C. parvum* also infects other mammal species.

Currently, there are no effective treatments for cryptosporidiosis, and control focuses on eliminating oocysts from water supplies. However, the resistance of the organism to common inexpensive water treatments seriously hampers this method of control. Despite decades of sophisticated molecular analysis of this and related organisms (e.g., Plasmodia (malaria parasites), *Babesia, Eimeria, Toxoplasma*, etc.), no significant advances have been found in treatment or prevention. Thus, traditional approaches of the prior art have thus far failed to identify the proverbial 'Achilles heel' of *Cryptosporidium*, and to provide viable therapies for the prevention or treatment of cryptosporidiosis.

SUMMARY OF THE INVENTION

The present invention is based on the determination of the sequence of the eight chromosome ~9.2 Mb genome of *C. hominis*, and the analysis of that sequence. Using genomics and bioinformatic approaches, a wide array of new targets for therapeutic and diagnostic applications has been identified. Moreover, an accurate view of the overall metabolism of the organism has been obtained, permitting a realistic approach to identification of critical points of attack for therapeutics.

The complement of *C. hominis* protein-coding genes shows a striking concordance with the requirements imposed by the environmental niches the parasite inhabits. Energy metabolism is largely from glycolysis. Options for both aerobic and anaerobic metabolism are available, the former requiring an alternative electron transport system in a simplified mitochondrion. Biosynthesis capabilities are limited, explaining an extensive array of transporters. Evidence of an apicoplast is absent, but genes associated with apical complex organelles are present. *C. hominis* and *C. parvum* exhibit very similar gene complements and phenotypic differences between these parasites must be due to subtle sequence divergence.

The invention thus provides newly identified genes and gene products of *C. hominis* that are of use in chemo and immunotherapy, immunoprophylaxis, and diagnostic applications.

It is an object of this invention to provide amino acid sequences as represented in SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, and SEQ ID NO: 24. It is a further object of this invention to provide nucleotide sequences as represented in SEQ ID NO: 1, SEQ ID NO: 3, SEQ ID NO: 5, SEQ ID NO: 7, SEQ ID NO: 9, and SEQ ID NO: 11, SEQ ID NO: 13, SEQ ID NO: 15, SEQ ID NO: 17, SEQ ID NO: 19, SEQ ID NO: 21, SEQ ID NO: 23 and SEQ ID NOS: 25-4000.

The invention further provides a method of detecting and diagnosing *C. hominis* infection in a patient in need thereof. The method comprises the step of obtaining a biological sample from said patient, and amplifying nucleotide sequences from said sample, and determining infection based on whether there are one or more amplicons are produced.

The invention further provides a method for immunizing a patient against *C. hominis* infection. The method comprises the step of administering to the patient a non-virulent *C. hominis* peptide or nucleotide in an amount sufficient to permit the patient to mount an antibody response to the non-virulent *C. hominis* peptide or nucleotide. By non-virulent, we mean that the peptide or nucleotide does not cause pathology (e.g. symptoms of *C. hominis* infection).

The invention further provides a method for detecting *Cryptosporidium* such as *C. hominis* in a sample, for example, of detecting contamination of a water supply by *Cryptosporidium*. The method comprises the steps of 1) obtaining a sample; 2) amplifying nucleotide sequences from the sample; and 3) detecting amplicons produced in the step of amplifying. The production of amplicons in the amplifying step indicates the presence of *C. hominis* in the sample. The method may further include the step of quantifying the amount of amplicons that is produced. This amount will be indicative of the amount of *Cryptosporidium* (e.g. *C. hominis*) in the sample. The method may be used, for example, to detect *Cryptosporidium* contamination in environmental samples such as water. In some embodiments, the sample may include several *Cryptosporidium* species other than *C. hominis*. In this case, the determining step permits discrimination between *C. hominis* and other *Cryptosporidium* species in the sample.

The invention further provides arrays for assessing the presence or expression of genes in *C. hominis*, and for detecting the interaction (e.g. binding) of *C. hominis* macromolecules. The array is a device comprising macromolecules such as nucleic acid probes, peptides, proteins, or antibodies, all of which originate from nucleic acid sequences of *C. hominis*, i.e. they are identical to or homologous to *C. hominis* genomic sequences; or are encoded by *C. hominis* genome sequences; or, in the case of antibodies, they bind to such macromolecules. In particular, the nucleic acid probes include nucleotide sequences homologous to nucleotide sequences of *C. hominis*. In one embodiment, the nucleic acid probes are at least 70 nucleotides in length.

BRIEF DESCRIPTION OF THE DRAWINGS

FIG. 1. Schematic representation of putative cellular components and metabolic pathways in *C. hominis*. The cytoplasmic membrane is indicated by a broad stripe at the top of the figure, and the intracellular compartment is below the stripe. Arrows and lines indicate pathways that are present. Dotted lines indicate multi-step reactions. Numbers indicate the quantity of transporters found for a given class when there is more than one. Important components or pathways that are clearly not present in *C. hominis* are crossed-out. Steps or components about which the exact nature is unknown or is questionable are shown with question marks. Arrows (⇛) and names indicate proposed aerobic parts of the energy metabolism. Abbreviations: ABC, ATP-binding cassette; MRP, multi-drug resistance protein; PEP, phosphoenolpyruvate; THF, tetrahydrofolate; DHF, dihydrofolate; AOX, alternative oxidase; UQ, ubiquinone; NADH DH, NADH dehydrogenase; Hsp70, heat-shock protein 70; Cpn60, chaperone 60; TIM17, translocase of the inner mitochondrial membrane 17; TOM40, translocase of the outer mitochondrial membrane 40; FAS, fatty-acid synthase; PKS, polyketide synthase; GPI, glycosylphosphatidylinositol; IP, inositol phosphate; PLC, phospholipase C; PKA, protein kinase A; PKC, protein kinase C; PI3K, phosphatidylinositol 3-kinase; AC, adenilate cyclase; Ado, adenosine; Cyd, cytidine; dThd, deoxythymidine; Urd, uridine; PNO-CPR, pyruvate:NADP+ oxidoreductase fused to cytochrome P450 reductase domain; Narf-like, nuclear prelamin A recognition factor like protein.

FIGS. 2A and B. A, typical amplification curve plots; B, standard curve plot of known amount of *C. hominis* rRNA.

DETAILED DESCRIPTION OF THE PREFERRED EMBODIMENTS OF THE INVENTION

The genetic sequence of the eight chromosome ~9.2 Mb genome of *C. hominis* has been determined and analyzed (see Table 1). By using genomics and bioinformatic approaches, a wide array of new targets for therapeutic and diagnostic applications has been identified. In addition, the overall metabolism of the organism has been elucidated, permitting a realistic approach to identification of critical points of attack (i.e. therapeutic targets) for therapeutics directed to the prevention or treatment of cryptosporidiosis. By "therapeutic target" we mean a molecule or pathway, the function of which can be targeted for intervention (e.g. blocking or inhibition) by the administration of agents such as drugs, or by stimulation of a specific immune response (by induction or passive administration (such as an antibody production. Such an intervention results in a decreased ability of the parasite to cause disease or disease symptoms. For example, such intervention may result in total or partial inhibition of the parasite's ability to carry out normal metabolism, to reproduce, to infect cells, to escape from infected cells, to proceed through a normal life cycle, to resist treatment with other disease alleviation agents, to navigate successfully, or to otherwise exert its pathological effects and cause disease.

In addition, *C. hominis* proteins that have been identified (or non-toxic or inactive fragments thereof) are useful for stimulating an immune system response to antigenic determinants of the proteins in an individual to whom they are administered. The nucleotide sequences and selected amino acid sequences of such proteins are provided in the Sequence Listing, the complete contents of which is hereby incorporated by reference. An immune system response may include increased antibody titers and/or increased cellular immunity, and, in a preferred embodiment, results in immunity to *C. hominis*. In other words, the proteins, or regions of the proteins encompassing antigenic determinants may be administered as vaccines for immuno prophylaxis. Alternatively, antibodies to antigenic determinants of the *C. hominis* proteins may also be administered directly to individuals in order to treat or prevent disease symptoms caused by *C. hominis*, i.e. immuno therapy. In addition, such antibodies may be useful as diagnostic or laboratory tools.

The highly tailored physiology of *C. hominis* suggests several potential therapeutic targets, examples of which include but are not limited to: 1) transport systems for peptides, amino acids, nucleosides, and sugars; 2) components of glycolysis; 3) the unique prokaryotic FAS1 (fatty acid synthase 1) and PKS1 (polyketide synthase 1); 4) starch and amylopectin biosynthesis or catabolism; 5) nucleic acid or amino acid metabolism; 6) the AOX (alternate oxidase) electron transport system; 7) the TS-DHFR (thymidine synthase-dihydrofolate reductase); and 8) the diverged polyamine synthesis enzymes. Importantly, and unlike other protozoan parasites, no extensive arrays of potentially variant surface proteins were observed, suggesting a possible role for immunoprophylaxis for prevention of cryptosporidiosis.

In addition, the invention provides the DNA sequences that encode numerous ribosomal RNA (rRNA) molecules (SEQ ID NOS: 4003-4014; see Table 14) and transfer RNA (tRNA) molecules (SEQ ID NOS: 4015-4059; see Table 13). These sequences are also provided in the Sequence Listing, the complete contents of which is hereby incorporated by reference. Those of skill in the art will recognize that rRNA and tRNA sequences may have many uses, including but not limited to: detection of *Cryptosporidium* in clinical samples, diagnosis of cryptosporidiosis in humans and animals, identification of *cryptosporidium* carriers, detection of *Cryptosporidium* in water supplies, detection of *Cryptosporidium* contamination in lakes, rivers or other environmental sites, etc. These targets, in particular the rRNA targets, are very useful for discrimination of *Cryptosporidium* strains; e.g., *C. hominis* and *C. parvum*. Finally, these targets are useful for quantification of *Cryptosporidium* in any of the above, or other, clinical, water or environmental samples. An example of this is shown in Example 6 below.

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); *the Methods* in *Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology*, Volumes I-IV (D. M. Weir and C. C. Blackwell eds 1986).

Standard abbreviations for nucleotides and amino acids are used in this specification.

The present invention provides nucleic acid sequences from *Cryptosporidium hominis*, as provided in the Sequence Listing (and see Table 1). Those of skill in the art will recognize that such sequences may be used for a variety of purposes, including but not limited to translation of the amino acid sequences encoded therein, as probes for diagnostic assay for the detection of *C. hominis*, for expression in bacterial systems, for expression in fungal or insect cell systems, for generation of recombinant and subunit vaccines or immuno therapeutics, for generation of active enzymes, for purification for structural determination (e.g., standard biochemical and biophysical applications such as NMR, MS, XRay crystallography), for the construction of RNA and protein microarrays, for the construction of nucleic acid libraries, for comparative genome analysis, for phylogeny and taxonomy, for prediction of putative blocking peptide domains, etc. With respect to the nucleic acid sequences disclosed herein, those of skill in the art will recognize that many variants (derivatives) of the sequences may exist or be constructed which would still be suitable for use in the practice of the present invention. For example, with respect to the translation of amino acid sequences from the nucleic acid sequences, due to the redundancy of the genetic code, more than one codon may be used to code for an amino acid. Further, as described below, changes in the amino acid primary sequence may be desired, and this would necessitate changes in the encoding nucleic acid sequences. In addition, those of skill in the art will recognize that many variations of the nucleic acid sequences may be constructed for purposes related to other aspects of the invention, for example: for cloning strategies (e.g. the introduction of restriction enzyme cleavage sites for ease of manipulation of a sequence for insertion into a vector, for rendering the sequence compatible with the cloning system vector or host, for enabling fluorescent or affinity labeling technologies, etc.), for purposes of modifying transcription (e.g. the introduction of specific promoter or enhancer sequences, insertion or deletion of splice signals, for enhancing or negatively regulating transcription levels, for regulating polyadenylation, for controlling termination, and the like), or for modification of active or inactive domains, for elimination or modification of certain activities or domains, for optimizing expression due to codon usage or other compositional biases, for addition of immunologically relevant (enhancing or inhibiting) sequences or for any other suitable purpose. All such variants of the nucleic acid sequences disclosed herein are intended to be encompassed by the present invention, provided the sequences display identity in the range of about 50 to 100%, and preferably about 60 to 100%, or more preferably about 70 to 100%, or even more preferably about 80 to 100%, or most preferably about 90 to 100% or about 95 to 100% to the disclosed sequences. The identity is with reference to the portion of the nucleic acid sequence that corresponds to the original sequence, and is not intended to cover additional elements such as promoters, vector-derived sequences, restriction enzyme cleavage sites, etc. derived from other sources. Those of skill in the art are well-acquainted with methods to determine nucleic acid similarity or identity using simple software alignment tools such as FASTA, the BLAST suite of programs, CLUSTAW, Lineup, Pileup (GCG), or many others.

In addition, the nucleic acids of the present invention are not limited to DNA, but are intended to encompass other nucleic acids as well, such as RNA (e.g. mRNA, tRNA, rRNA, etc.), RNA-DNA hybrids, and various modified forms of DNA and RNA known to those of skill in the art. For example, for use in vivo, nucleic acids may be modified to resist degradation via structural modification (e.g. by the introduction of secondary structures, such as stem loops, or via phosphate backbone modifications, etc.). Alternatively, the nucleic acids may include phosphothioate or phosphodithioate rather than phosphodiesterase linkages within the backbone of the molecule, or methylphosphorothiate terminal linkages. Other variations include but are not limited to: nontraditional bases such as inosine and queosine; acetyl-, thio- and similarly modified forms of adenine, cytidine, guanine, thymine and uridine; stabilized nucleic acid molecules such as nonionic DNA analogs, alkyl- and aryl phosphonates; nucleic acid molecules which contain a diol, such as tetrahyleneglycol or hexaethyleneglycol, at either or both termini; etc. Further, the nucleic acid molecules may be either single or double stranded, or may comprise segments of both single and double strand nucleic acid.

The invention also provides vectors comprising nucleic acid sequences of the invention. Those of skill in the art are well-acquainted with various vectors that may be used e.g. for manipulation of nucleic acid sequences during genetic engineering procedures, for storage of stocks of the nucleic acid, for expression of an amino acid sequence encoded by the nucleic acid, for expression in bacterial, fungal, insect or other host systems, for delivery of DNA vaccines, for amplification of the DNA, for sequence analysis, for molecular interaction studies, etc. Many such vectors are known to those of skill in the art, and include but are not limited to plasmids, adenoviral vectors, various expression vectors (e.g. PTRIEX4, PET41, PET44, and others of the PET series, the pUC vector series, the BlueScript series, derivatives of pBR322 with ColE1 origin of replication, the TOPO vector series, the Gateway vectors, the TET repressor vectors, BAC vectors [pBeloBACs, pCC1BAC, etc.], pcDNA301 and related plasmids with the CMV promoter, pBAC insect vectors, pIEX for insect cells, and many others).

Many of the nucleotide sequences of the present invention represent open reading frames (ORFs) that encode for amino acid sequences, e.g. peptides, polypeptides, and proteins, all of which are also intended to be encompassed by the present invention. In general, for the purposes of the present invention, a peptide comprises about 15 or fewer amino acids, a polypeptide comprises from about 15 to about 100 amino acids, and a protein comprises about 100 or more amino acids, although the terms may be used interchangeably herein. The peptides, polypeptides and proteins of the present invention are generally provided as recombinant molecules, although the amino acid sequences may also be produced synthetically via known peptide synthesis techniques. The peptides, polypeptides and proteins of the present invention are provided in a substantially purified form, i.e. they are generally free of extraneous materials (such as other proteins, nucleic acids, lipids, cellular debris, etc.) and will generally be at least about 75% pure, preferably about 85% pure, and most preferably at least about 90-95% or more pure, as would be understood by one of ordinary skill in the art.

Importantly, the present invention comprehends all amino acid sequences that may be translated from the nucleic acid sequences of the present invention. In general, proteins/polypeptides that are so-translated will be translated from an open reading frame. The invention also encompasses variants (derivatives) of such proteins/polypeptides. For example, variants may exist or be constructed which display: conservative amino acid substitutions; non-conservative amino acid substitutions; truncation by, for example, deletion of amino acids at the amino or carboxy terminus, or internally within the molecule; or by addition of amino acids at the amino or carboxy terminus, or internally within the molecule (e.g. the addition of a histidine tag for purposes of facilitating protein isolation, the substitution of residues to alter solubility properties, the replacement of residues which comprise protease cleavage sites to eliminate cleavage and increase stability, the replacement of residues to form a convenient protease cleavage site, the addition or elimination of glycosylation sites, and the like, for any reason). Such variants may be naturally occurring (e.g. as the result of natural variations between species or between individuals, or as a result of different expression systems used to produce the amino acid sequence, etc.); or they may be purposefully introduced (e.g. in a laboratory setting using genetic engineering techniques). The amino acid sequences may be in a variety of forms, including a neutral (uncharged) forms, or forms which are salts, and may contain modifications such as glycosylation, side chain oxidation or deamidation, phosphorylation and the like. Also included are amino acid sequences modified by additional substituents such as glycosyl units, lipids, or inorganic ions such as phosphates, as well as modifications relating to chemical conversions or the chains, such as oxidation of sulfhydryl groups.

Strategies for improving solubility of cloned proteins are known to those of skill in the art. Such strategies may be used in the practice of this invention, and include: modifying expression conditions (temperature, buffer, nutrients), modification of the promoter or its activity, linking the protein to a different fusion protein that helps it maintain its solubility, expression in the yeast system *Pichia pastoris*, the insect baculovirus system, or in another eukaryotic organism, etc. Expression of soluble proteins is difficult in bacterial systems, but success is much more common in *Pichia*, baculovirus or mammalian expression systems.

All such variants of the sequences disclosed herein are intended to be encompassed by the teachings of the present invention, provided the variant protein/polypeptide displays sufficient identity to the original sequences, the original sequence being a sequence as disclosed herein, or an amino acid sequence that can be translated from a nucleic acid sequence disclosed herein, (e.g. from an ORF or portion thereof). Preferably, amino acid identity will be in the range of about 50 to 100%, and preferably about 60 to 100%, or more preferably about 70 to 100%, or even more preferably about 80 to 100%, or most preferably about 90 to 100%, or even 95 to 100%, of the disclosed sequences. The identity is with reference to the portion of the amino acid sequence that corresponds to the original amino acid sequence as translated directly from the nucleic acid sequences disclosed herein, i.e. not including additional elements that might be added, such as sequences added to form chimeric proteins, histidine tags, etc. Those of skill in the art are well acquainted with the methods available for determining the identity between amino acid sequences, for example, FASTA, FASTP, the BLAST suite of comparison software, ClustalW, Lineup, Pileup, or many other alignment software packages.

In addition, such protein/polypeptide variants retain at least about 50 to 100% or more of the activity of the original polypeptide, and preferably about 60 to 100% or more, or more preferably about 70 to 100% or more, or even more preferably about 80 to 100% or more, and most preferably about 90 to 100% or more of the activity of the original sequence. By "activity" we mean the activity or role of the amino acid sequence in *C. hominis*, which may include but is not limited to: enzymatic activity, activity as a structural component, activity as a transporter protein, activity in signal transduction, role as a membrane component, binding activity, activating activity, transport activity, etc.

In general, the amino acid sequences of the invention are produced in recombinant expression systems. In a preferred embodiment of the present invention, the recombinant system is an *E. coli* recombinant system, which can be expressed as well in mammalian cells for use, for example, as a DNA vaccine. However, the amino acid sequences may be produced in a variety of other recombinant expression systems. For example, yeast, insect cells (using for example, a baculovirus expression vector), plant cells (e.g. tobacco, potato, corn, etc.), transgenic animals, or mammalian cell culture systems can be used for expression of recombinant proteins. Any appropriate expression system that suitably produces the amino acid sequences of the invention may be used in the practice of the invention. Such systems and their use for the production of recombinant proteins are well known to those of ordinary skill in the art.

In some embodiments, vectors containing nucleic acid sequences (e.g. DNA) that encode the amino acid sequences of the invention will encode a single protein. However, this need not always be the case. Such vectors may contain DNA encoding more than one nucleic acid of the invention, either as separate, discrete sequences, or combined into a single chimeric sequence. For example, in the case of an expression vector, two or more nucleic acids according to the invention may be present in the vector, and the nucleic acids may be expressed separately, resulting in the translation of one amino acid sequence for each nucleic acid. Alternatively, a single polypeptide chain containing more than one amino acid sequence of the invention, or portions of more than one amino acid sequence of the invention, may be combined in tandem. For example, one or more highly antigenic proteins or regions of proteins of the invention may be expressed as a chimera from a single DNA sequence. Alternatively, the amino acid sequences of the invention may be expressed as part of a chimeric protein comprising amino acid sequences from another source, e.g. antigenic sequences known to be useful as adjuvants (e.g. PADRE [and other Pan-DR T helper cell epitope], hepatitis B core antigen, DNA sequences CPG, other chemokines, CTB or cholera toxin B subunit, Ricin B and other plant toxin subunits, LPS or lipopolysaccharide, KLH [key hole limpet hemocyanin], Freund's complete and Freund's incomplete adjuvant, and many other reagents, etc.), sequences that permit targeting of the protein to a specific location within the cell (e.g. nucleus, nucleolus or nuclear membrane, mitochondrion/mitosome/mitochondria-like organelle, membrane, endoplasmic reticulum, golgi, rhoptry, dense granules, calcisomes or acidocalcisomes, and other subcellular organelles compartments, etc.).

The invention also comprehends a cell or cells containing the nucleic acids and/or the amino acid sequences of the invention. For example, the cell may be a host cell that harbors one or more vectors containing nucleic acid sequences of the invention (e.g. DNA or RNA) and/or amino acid sequences of the invention translated from such vectors. Such cells may contain multiple vectors, and the vectors may be the same or different. Further, the cells may be either in vitro or in vivo.

The invention also provides antibodies directed to the amino acid sequences of the present invention. As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows binding of the antibody with the antigen. "Antibody" includes, for example, vertebrate antibodies, hybrid antibodies, chimeric antibodies, humanised antibodies, altered antibodies, univalent antibodies, Fab proteins and fragments, and single domain antibodies. Antibodies to the proteins of the invention, both polyclonal and monoclonal, may be prepared by conventional methods that are well-known to those of skill in the art. If desired, the antibodies (whether polyclonal or monoclonal) may also be labeled using conventional techniques.

Such antibodies may be used, for example, for affinity chromatography, immunoassays, and for distinguishing or identifying *C. hominis* proteins or portions thereof. In a preferred embodiment of the invention, such antibodies may be used therapeutically, e.g. for administration to patients suffering from cryptosporidiosis, or prophylactically in order to prevent cryptosporidiosis in patients at risk for developing the disease.

The invention also comprehends pharmaceutical compositions. The pharmaceutical compositions can comprise polypeptides, antibodies, or nucleic acids of the invention, or combinations of these. The pharmaceutical compositions will comprise a therapeutically effective amount of a polypeptide, antibody, or polynucleotide of the invention. The term "therapeutically effective amount" as used herein refers to an amount of a therapeutic agent that is sufficient to treat, ameliorate, or prevent a desired disease or condition, or to exhibit a detectable therapeutic or preventative effect. The effect can be detected by, for example, chemical markers or antigen levels. Therapeutic effects also include reduction of physical symptoms of cryptosporidiosis. The precise effective amount for a subject will depend upon several parameters, including the subject's size, general health, gender, age, etc., and the therapeutics or combination of therapeutics selected for administration. Thus, it is not useful to specify an exact effective amount in advance. However, the effective amount for a given situation can be determined by routine experimentation and is within the judgement of those of skill in the art, e.g. a physician. For purposes of the present invention, an effective dose will be from about 0.01 mg/kg to 50 mg/kg or about 0.05 mg/kg to about 10 mg/kg of active, therapeutic agent.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art. Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

In addition, pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Once formulated, the compositions of the invention can be administered to the subject. The subjects to be treated can be animals; in particular, human subjects can be treated. Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and intranasal, transdermal or transcutaneous applications (eg. see WO98/20734), needles, and gene guns or hyposprays. Dosage treatment may be a single dose schedule or a multiple dose schedule.

The present invention also encompasses vaccines that provide immunity to disease caused by *C. hominis*. By "immunity" we mean that administration of one or more proteins, polypeptides or peptides of the present invention to an individual either prevents the development of disease symptoms in that individual when exposed to or infected by *C. hominis*, or the disease symptoms that develop in the individual are milder than those that would otherwise develop, for example, the disease symptoms that would develop in a matched control individual. Those of skill in the art are well acquainted with the use and meaning of "controls" when comparing results of individuals or populations that have been exposed to different variables (e.g. vaccinated or not).

According to the invention, the vaccine may either be prophylactic (i.e. to prevent or attenuate symptoms of infection) or therapeutic (i.e. to treat disease after infection). Such vaccines comprise one or more of: immunizing antigen(s), immunogen(s), polypeptide(s), protein(s) and nucleic acid(s) from *C. hominis* (as described herein), usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens. Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+ CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (eg. IL-1, IL-2, IL-4, IL-5, IL-6, IL-7, IL-12, etc.), interferons (eg. gamma interferon), macrophage colony stimulating factor (M-CSF), tumor necrosis factor c[NF), etc; and (6) other substances that act as immunostimulating agents to enhance the effectiveness of the composition. Alum and MF59™ are preferred.

The immunogenic compositions (eg. the immunizing antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles. Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for eliciting the production of antibodies, for eliciting a cellular immune response, (or both), and/or for treatment or prevention of disease. This amount varies depending upon the health and physical condition of the individual to be treated, the taxonomic group of individual to be treated (e.g. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials. The immunogenic compositions are conventionally administered parenterally, eg. by injection, either subcutaneously, intramuscularly, intranasally, or transdermally/transcutaneously. Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents. As an alternative to protein-based vaccines, DNA vaccination may be employed [eg. Robinson & Torres (1997) *Seminars in Immunology* 9:271-283; Donnelly et al. (1997) *Annu Rev Immunol* 15:617-648].

In a preferred embodiment of the invention, the proteins that are used in an immunogenic preparation or vaccine of the present invention include at least one of the proteins represented by SEQ ID NOS: 2, 4, 6, 8, 10, 12, 14, 16, 18, 20, 22 and 24 (see Example 2 below).

The present invention also provides tools and methods for the diagnosis of *C. hominis* infections. Such tools include primers containing nucleotide sequences that specifically hybridize to nucleic acid sequences that are unique to the genome of the *C. hominis* species. Hybridization of the primers to such a unique sequence permits amplification of the unique sequence (for example, by polymerase chain reaction (PCR)), thus providing a means to specifically identify the presence of *C. hominis* in biological samples (blood, feces, sputum, urine, bronchoaveolar lavage, etc.). Amplification may be directly from the genome of the organism located in the sample, or from RNA, e.g. from ribosomal RNA (rRNA), which is typically highly expressed and thus more sensitive than DNA as a target. Because the sequences that are amplified are unique to *C. hominis*, it is possible to distinguish infection by *C. hominis* from infection with even closely related parasites. By "primer" we mean a nucleotide sequence that hybridizes to another nucleotide sequence of interest, the primer typically being a relatively short nucleotide sequence (e.g. from about 10 to about 100 base pairs) and the nucleotide sequence of interest typically being transcribed from the genome of an organism. PCR amplification techniques are well-known to those of skill in the art In general, two primers are selected that target sites that flank the sequence of interest for diagnostics or identification. These primers are designed to recognize only the target sequence; i.e., they will hybridize only to the target sequence and to no other sequences. Thus, the sequence is screened against all other known sequences to ensure that there is no other known sequence to which it will hybridize. The primers generally range from 18-30 nucleotides in length (but can be longer or shorter), have Tm's (melting temperatures) that are selected to be compatible with both amplification conditions and with specificity, have little or no internal structure (stemloop structures caused by internal complementarity), little or not ability to dimerize with themselves, little or no ability to dimerize with the other primer, have few homopolymeric stretches, etc. Many computer programs (e.g., Primer3, Oligo, etc.) are available for these purposes. At times, an internal fluorescent probe is also included for specific use in even more sensitive and automated tests. The internal probe is fluorescently labeled such that it is specifically degraded and therefore fluoresces only if it specifically hybridizes to the target sequence. Alternately, other fluorescent probes can be designed that only fluoresce upon binding specifically to an amplified specific sequence. Thus, several alternative approaches are available for the generation and detection of specific sequences amplified by PCR, and any of these can be applied for diagnostic or identification purposes. (See, for example: Mullis, K., F. Faloona, S. Scharf, R. Saki, G. Horn, and H. Erlich. (1986) Specific enzymatic amplication of DNA in vitro: The Polymerase Chain Reaction. Cold Spring Harbor Symposia on Quantitative Biology 51: 263; Saiki, R. K., D. H. Gelfand, S. Stoffel, S. J. Scharf, R. Higuchi, G. T. Horn, K. B. Mullis, and H. A. Erlich. (1988) Primer-directed enzymatic amplification of DNA with a thermostable DNA polymerase. Science 239: 487; Schutzbank T E, Stern H J. (1993) Principles and applications of the polymerase chain reaction. J Int Fed Clin Chem. 1993 July; 5(3):96-105; Erlich H A. (1999) Principles and applications of the polymerase chain reaction. Rev Immunogenet. 1(2): 127-34; Wang, A. M., Doyle, M. V., and D. F. Mark. (1989) Quantitation of mRNA by the polymerase chain reaction. Proc Natl Acad Sci USA. 1989 December; 86(24): 9717-9721; Kawasaki, E. S., and A. M. Wang. (1989) Detection of gene expression. In: Erlich, H. A., ed., PCR Technology: Principles and Applications of DNA Amplification. Stockton Press, Inc., New York, N.Y., pp. 89-97; Dieter Klein (2002) Quantification using real-time PCR technology: applications and limitations. Trends in Molecular Medicine, 8(6):257-260; Buck G E. (1996) The polymerase chain reaction: a revolutionary new procedure for the laboratory diagnosis of infectious disease. J Ky Med. Assoc. April; 94(4):148-52.)

Because the nucleotide sequences that are being amplified are unique to C. hominis, a positive amplification result is indicative of the presence of C. hominis in the biological sample, and thus of infection by C. hominis. In contrast to current methods of C. hominis detection, the present invention, by elucidating the entire genome of C. hominis, allows the design of a much larger number of such primers. Further, primers provided by the present invention hybridize to sequences that are highly diverse from species closely related to C. hominis. Thus, the accuracy of the diagnostic methods of the present invention are superior to those of the prior art, resulting in very few false positives, and very few missed diagnoses.

The present invention also provides arrays of nucleotide or modified nucleotide, or protein or modified protein sequences, or antibodies to the nucleotides or proteins, for use as probes for assessing the presence or absence of genes, the expression of specific genes, the presence or absence of proteins or immune responses in *C. hominis* or other *Cryptosporidium* species. In particular, the arrays of the invention may be used to specifically assess the differential expression of genes any of the various stages of the life cycle of *C. hominis*, for example, during the sporozoite stage. In order to do so, a biological sample containing *C. hominis* parasites at a particular stage of development is provided and analyzed using the array. Alternatively, such arrays may be used to monitor *C. hominis* parasites under other conditions of interest, for example, to monitor gene expression in response to an external stimulus or variable, such as introduction of a drug or other agent into a culture of the parasites; or to monitor the course of a *C. hominis* infection, either in culture, or in an infected individual. Similarly, the arrays can be used for comparative genome analyses in which the presence or absence of specific genes are probed in different isolates of *Cryptosporidium*. In order to do so, DNA from the isolate of interest is analyzed using the array. Presence or absence of a particular gene is assessed via hybridization. Using this approach, the array can also be designed to detect specific polymorphisms in genes that have clinical or other relevance. This approach can have diagnostic and clinical importance, or other relevance to infection, treatment or contamination (e.g., water contamination with *C. hominis* is much more serious than water contamination with other species of *Cryptosporidium*. The nucleotide probes (usually DNA or a derivative thereof) in an array typically have a length in the range of about 50 to about 90 nucleotides, and preferably about 60 to about 80 nucleotides, and most preferably the probes have a length of about 70 nucleotides. These arrays can be comprehensive; i.e., be comprised of probes for all genes/gene sequences in a genome, or targeted to specific subsets of genes/gene sequences, depending on the application. Peptides, proteins or derivatives thereof (or antibodies thereto) can also be used in similar arrays. In this case, synthetic peptides, proteins (recombinant or otherwise) or derivatives are designed from the gene sequences (Table 1 and others) and used in the array. Again, these peptide/protein arrays can be of various lengths (number of amino acids or derivatives), and they can be comprehensive and include probes for all genes/proteins in the genome, or targeted to specific subsets of genes. These probes, nucleotides, peptides or derivatives thereof, are bound to solid phase surfaces (glass slides, microplates, micro- or nano-beads, etc.) and used to screen processed biological samples for interacting macromolecules. In the case of nucleotide arrays, interactions are usually detecting complementary sequences in a sample by hybridization. In the case of protein/peptide arrays, and in some cases for nucleotide arrays, the array will be used for detection of interacting macromolecules (proteins, antibodies, other nucleic acids, etc.).

EXAMPLES

Example 1

Herein, the ~9.2 Mb genome of *C. hominis* is described. The genome has 32% GC content, ~3,994 protein-coding genes, 45 tRNAs, and at least four rRNAs. There is a strikingly high concordance between the genome complement of *C. hominis* and the requirements imposed by the environmental niches it inhabits. Energy is derived largely from glycolysis and catabolism of starch or amylopectin. Options for both aerobic and anaerobic metabolism are available, the latter requiring an alternative electron transport system in a simplified mitochondrion. Biosynthesis capabilities are quite limited, but an extensive complement of transporters is encoded. Evidence of an apicoplast is absent, but rhoptry, microneme, dense granule, and acidocalcisome related genes are present. A panel of hypothetical signal transduction systems was identified. Comparison of the genomes of the human pathogen *C. hominis* and the bovine isolate *C. parvum* shows a high degree of synteny with no evidence of different gene complements. Phenotypic differences between these two parasites therefore seem to be due to very subtle sequence divergences.

The Genome Composition

A ~12 fold sequence and ~8 fold BAC clone coverage of the genome of *C. hominis* isolate TU502[1] is presented. Alignment[2] of these sequences with the HAPPY map[3] and chromosomes of the *C. parvum* genome[4] covered 9.1 Mb of the ~9.2 Mb. The eight chromosomes range from ~0.9-~1.4 Mb, and exhibit 31.7% GC content compared to 30.3% and 19.4% for *C. parvum* and *P. falciparum*[5]. The density of repeats of 2-50 bp was approximately one per 2800 bp. The distribution of repeats is biased toward chromosome ends as over 85% are in the telomere proximal thirds of five of the chromosomes. Two octamers, TGGCGCCA and TGCATGCA, over-represented in other apicomplexans[3], are ~40 and 15 fold over-represented in *C. hominis*. Interestingly, over 80% of the octamers are localized in non-coding sequences, suggesting a regulatory or other conserved function. 45 tRNAs, 4 or 5 rRNA operons—at least one of each of the two known types, and two clusters of three tandem 5S rRNA genes are present. Like *P. falciparum*[5], two methionine tRNAs are present, suggesting discrete roles in initiation and extension. We estimate 3,994 genes in *C. hominis*, compared to 3,952 genes in *C. parvum* and 5,268 in *P. falciparum* 5 (Table 2). Approximately 60% exhibit similarity to known genes. The distribution of GO annotations for *Cryptosporidium, Plasmodium*, and *Saccharomyces*, is remarkably similar, suggesting their phenotypic differences are a reflection of non-conserved or novel gene families of unknown function rather than to functional specialization of conserved gene families. Using ESTs as a guide, we estimate that 5-20% of *C. hominis* genes have introns.

Energy Metabolism.

*C. hominis* possesses a highly tailored glycolysis-based metabolism dependent on the host for nutrients and exquisitely adapted for its parasitic life cycle (see FIG. 1). Glycolytic enzymes are present, but the TCA cycle and oxidative phosphorylation (OxPhos) are not. Both an anaerobic pathway using pyruvate: NADP+ oxidoreductase (PNO) and an aerobic pathway using an alternative oxidase (AOX) are available for recycling NAD+ to NADH. In the former, pyruvate is fermented to acetyl-CoA producing NADPH which is then reduced to NADP+, releasing hydrogen, by a Narf like [FE]-hydrogenase, as for Trichomonas 6. Acetyl-CoA is processed by acetate CoAsynthase to produce acetate and ATP, as in Giardia[7], yielding four ATP per glucose.

Acetyl-CoA can also be processed to ethanol yielding no additional ATP. Under glucose-limited conditions, conversion of acetyl-CoA to acetate, generating two extra ATP per glucose, might be favored. In excess glucose, pyruvate can be converted to lactate or ethanol to regenerate NAD+ but no additional ATP. C. hominis can also generate ATP by metabolism of glycerol using glycerol-3-phosphate dehydrogenase and triose phosphate isomerase.

C. hominis can convert pyruvate to malate and subsequently to oxaloacetate (OAA), regenerating NAD+. However, malate shuttle enzymes (e.g., aspartate amino transferase) which process OAA to aspartic acid for export from the mitochondrion, are absent. We propose that cytoplasmic malate may be converted to OAA by a mitochondrial membrane bound malate dehydrogenase, like the lactate shuttle of Euglena gracilis[8], passing electrons from malate to an electron transport system comprised of elements of Complexes I and III and an alternative oxidase system (AOX) with $O_2$ as electron acceptor and producing no additional ATP.

Enzymes for metabolism of glycogen, starch and amylopectin are present, consistent with suggestions that amylopectin represents an energy reserve for sporozoites[9]. Lack of glucose-6-phosphate-1-dehydrogenase and other enzymes of the pentose phosphate pathway suggests that, unlike P. falciparum and other apicomplexans[10], C. hominis cannot metabolize five-carbon sugars or nucleotides. Components of beta-oxidation (e.g., enoyl-CoA hydratase and acetyl-CoA C-acyltransferase) are also absent, precluding ATP generation from fatty acids. Enzymes for catabolism of proteins are also absent. Major TCA cycle enzymes—isocitrate dehydrogenase, succinyl-CoA synthetase, succinate dehydrogenase—are absent in C. hominis. Despite the presence of ubiquinol-cytochrome C reductase, NADH dehydrogenase (ubiquinone), H(+)-transporting ATPase, iron-sulfur cluster-like proteins, etc., key components of Complexes II and IV are absent, precluding ATP generation by 0× Phos. Components of 0× Phos that are present (parts of Complexes I and III) probably re-oxidize NADH in a simplified electron-transport chain, as in some plants and protozoa[11].

Biosynthesis.

Consistent with previous suggestions (c.f. 12), Cryptosporidium lack enzymes for synthesis of key biochemical building blocks—simple sugars, amino acids and nucleotides. However, starch, amylopectin and fatty acids can be generated from precursors. Interestingly, these C. hominis enzymes exhibit minimal similarity to the known biosynthetic enzymes and therefore represent potential therapeutic targets.

Enzymes of the TCA, urea and nitrogen cycles, and the shikimate pathway are absent, suggesting that Cryptosporidium is an amino acid auxotroph. The shikimate pathway has been proposed as a potential target for glyphosate-based chemotherapy in other parasites including Cryptosporidium[13]. We found no evidence to support this hypothesis. Enzymes able to interconvert amino acids are encoded in C. hominis. However, unlike P. falciparum[5], C. hominis seems to have a full complement of amino acid transporters.

C. hominis lacks enzymes to synthesize bases or nucleosides, but encodes enzymes that convert nucleosides into nucleotides and interconvert nucleotides. As in other parasites, thymidylate synthase and dihydrofolate reductase (DHFR) of C. hominis are encoded as a bifunctional polypeptide, and novel polymorphisms at crucial sites have been proposed to explain Cryptosporidium's resistance to antifolates (c.f. 14). As previously suggested[12], several nucleotide conversion enzymes seem to have prokaryotic origin. Fatty acid biosynthesis in apicomplexans occurs in the apicoplast via a type II system including fatty acid synthase (FAS)[15]. However, consistent with absence of an apicoplast in Cryptosporidium[16], C. hominis encodes large FAS and polyketide synthase (PKS) enzymes, suggesting a type I mechanism (c.f. 17). As previously suggested[18], the type I FAS and PKS enzymes of C. hominis have prokaryotic characteristics.

Glycerolipid and phospholipid metabolic pathways for phosphatidylinositol (PI) biosynthesis are available in C. hominis. 1,2-diacylglycerol, an intermediate, is precursor for glycosylphosphatidylinositol (GPI) anchor synthesis. Consistent with previous observations 19, all enzymes required for synthesis of these anchors are encoded in the genome. Polyamines; e.g., putrescine, spermine and spermidine, are critical for cellular viability, and enzymes required for their synthesis are attractive therapeutic targets[20]. Cryptosporidium can synthesize polyamines using arginine decarboxylase rather than ornithine decarboxylase[21] The putative arginine decarboxylase, spermidine synthase and other relevant enzymes encoded by C. hominis are significantly diverged from their homologs and represent potential therapeutic targets.

Signaling and Control Pathways

C. hominis encodes adenylate cyclase, cAMP phosphodiesterase and protein kinase A, suggesting the presence of the cAMP-mediated signalling pathway (Tab.S7). Trimeric G protein, often involved in activation of cAMP mediated signalling, was not found in C. hominis, suggesting that, as for the Kinetoplastida[22] and reminiscent of plants, this pathway is independent of this complex in C. hominis. The presence of phosphatidylinositol 3-kinase and phospholipase C suggests that C. hominis utilizes phosphatidylinositol phosphate and $Ca^{2+}$-mediated regulatory mechanisms. The presence of putative $Ca^{2+}$ transporters, enzymes associated with acidocalcisomes, and calmodulin imply that $Ca^{2+}$ transport and sequestering are functional. Protein kinase C receptors suggest that C. hominis has the ability to signal by activation of soluble cytoplasmic receptor-associated kinases.

Organelles

No mitochondrial DNA sequences were found in C. hominis, and both the TCA cycle and OxPhos are absent. However, a double membrane bound organelle generates a proton gradient using cardiolipin and performs some related mitochondrial functions, and mitochondrial marker chaperonin[60] was localized to this structure[23]. Core enzymes of [Fe—S] cluster biosynthesis; i.e. CpFd1, IscU, IscS, mt-HSP70, mtFNR and frataxin, have been reported in Cryptosporidium[24], and we were not surprised to observe proteins involved in electron transport. We also used the CDART 25 to identify [Fe—S] domains in HscB (JAC) and ATM1, which are possibly involved in chaperonin activity of Hsp40/DnaJ type and ABC transport. Thus, C. hominis, like another obligate intracellular parasite, the microsporidian Encephalitozoon cuniculi[26], contains a minimal set of these proteins. These results imply significant mitochondrial function in C. hominis, and that the previously reported organelle[27] is an atypical mitochondrion.

Cryptosporidium apparently lacks an apicoplast[16,28], and searches of the C. hominis genome identified no clear apicoplast-encoded genes. Some putative nuclear-encoded apicoplast genes; e.g., *T. gondii* acetyl-CoA carboxylase 1 precursor[29], and *P. falciparum* adenylyl cyclase[30], are present. Others; such as the conserved apicoplast 50S ribosomal protein L33 of *Plasmodium*, the ribosomal L28 and S9 precursor[15] proteins of *Toxoplasma*, were not found. Together, our data suggest that *Cryptosporidium* lost an ancestral apicoplast. The presence of D-glucose-6-phosphate ketol-isomerase and 2-phospho-D-glycerate hydrolase that have highest similarity to plant genes and may be derived from ancient algal endosymbionts[31] is also suggestive that engulfment of the alga that gave rise to the apicoplast[32] preceded divergence of *Cryptosporidium* from other apicomplexans.

The *C. hominis* genome encodes multiple proteins specific for components of the apical complex including micronemes and rhoptries. No specific dense granule-associated proteins were observed, probably because these proteins diverge rapidly[33]. However, proteins implicated in the regulation of transport and enhancement of release of dense granule proteins[34] are present. As for *Plasmodium*, a typical Golgi structure is not apparent in *C. hominis* 28. However, the presence of secretory organelles implies the existence of a functional endoplasmic reticulum (ER) and Golgi, and *C. hominis* encodes proteins similar to many related components; including the NSF/SNAP/SNARE/Rab machinery which participates in dense granule release[35] and the rhoptry biogenesis mediator AP-1[36], involved in ER-Golgi-organelle protein traffic. Therefore, the ER-Golgi-organelle machinery of *C. hominis* is conserved and similar to that of other apicomplexans.

Transporters.

*C. hominis* exhibits very limited biosynthetic capabilities and is apparently supremely dependent on its ability to import essential nutrients. The genome encodes >80 genes with strong similarity to known transporters and several hundred genes with transporter-like properties. At least twelve sugar or nucleotide-sugar transporters, five putative amino acid transporters, three fatty acid transporters, 23 ABC family transporters including possible multiple drug resistance proteins[37], and several putative mitochondrial transporters are present. Other putative transporters for choline uptake, aminophospholipid transport, ATP/ADP transporters, and others with unclear function, were also identified. These transporters represent ideal therapeutic targets.

Comparison of *C. hominis* and *C. parvum* Genomes.

Comparison of the genomes of *C. hominis* and *C. parvum* showed that the two genomes are very similar; exhibiting only 3-5% sequence divergence with no large insertions, deletions or rearrangements evident. In fact, the gene complements of the two species are essentially identical since the few *C. parvum* genes not found in *C. hominis* are proximal to known sequence gaps. Thus, we conclude that the significant phenotypic differences between these parasites are due to functionally significant polymorphisms in relevant protein-coding genes and subtle gene regulatory differences.

Conclusions.

A striking feature of the *C. hominis* genome is the concordance between its gene complement and metabolic requirements in the environmental niches of its two primary life cycle stages—the quiescent oocyst in the nutrient-poor aerobic environment of contaminated water, and the vegetative parasites in the nutrient-rich anaerobic or microaerophilic environment of the host. Oocysts probably persist by processing stores of complex carbohydrates. Metabolism is likely aerobic via the alternative electron transport system in the unconventional mitochondrion. Consistent with the lack of an energy generating TCA cycle, OxPhos, β-oxidation, and the pentose phosphate pathway, oocysts are relatively inactive, and the two ATP per glucose from glycolysis may provide sufficient energy. In the host, the parasite can import sugars to directly fuel glycolysis, netting two ATP per hexose. In limiting glucose, an additional two ATP per hexose can be generated by converting acetyl-CoA to acetate or via glycerol metabolism. The residual mitochondrion lacks the TCA cycle and OxPhos as expected in an organism that replicates in the anaerobic/microaerophilic environments, and a simplified electron transport system for regenerating reducing power is available. Thus, a glycolysis-based metabolism is sufficient to support *Cryptosporidium* in all life cycle stages.

Also consistent with the highly tailored *Cryptosporidium* metabolism are its limited biosynthetic options; i.e., amino acids, nucleotides, and simple sugars cannot be synthesized. The parasite must import these building blocks probably explaining the significant array of transporters present in the genome.

As expected, apicoplast-specific activities are lacking in *Cryptosporidium*. One hypothesis is that acquisition of the type 1 FAS by a progenitor organism obviated the fatty acid synthesis capabilities of the apicoplast[38]. Since some apicoplast-related genes remain, our observations suggest that *Cryptosporidium* diverged from other apicomplexans prior to loss of this organelle.

As previously noted, our analysis shows that *Cryptosporidium* is a mosaic of sequences from diverse progenitors, including the hypothetical endosymbiont alga which formed the apicoplast, the mitochondrion, and numerous genes acquired from prokaryotes by lateral transfer. *Cryptosporidium* also exhibits modular gene loss. We assume, based on inference from other apicomplexans and earlier diverging groups like the Euglenozoa, the Heterolobosea, and the jakobids[39], that *Cryptosporidium* progenitors exhibited the TCA cycle, beta-oxidation, OxPhos, amino acid, nucleotide and sugar biosynthesis, fully competent mitochondria, and a functional apicoplast.

Genes associated with these functions are dispersed throughout the genome in *Plasmodium* and, we assume, in the progenitor. However, these systems seem to have been deleted cleanly in *Cryptosporidium*, leaving few residual genes or pseudogenes. Thus, its genome is a mosaic resulting from multiple lateral gene transfers and a complex pattern of selective gene deletion.

The highly tailored physiology of *C. hominis* suggests attractive therapeutic targets. Examples include: 1) transport systems for peptides, amino acids, nucleosides, and sugars, 2) components of glycolysis; 3) the unique prokaryotic FAS1 and PKS1; 4) starch and amylopectin biosynthesis or catabolism; 5) nucleic acid or amino acid metabolism; 6) the AOX electron transport system; 7) the TS-DHFR; and 8) the diverged polyamine synthesis enzymes. Finally, many potential vaccine targets were identified in the *C. hominis* genome (not shown), and unlike other protozoan parasites, no extensive arrays of potentially variant surface proteins were observed, suggesting a possible role for immunoprophylaxis for cryptosporidiosis.

The availability of the genome sequence of the human pathogen *C. hominis* represents a critical step forward in our understanding of the biology of this parasite. The gene complement provides very significant insight into its physiology and metabolism, validating previous hypotheses and suggesting others. New obvious targets for chemo- and immunotherapy are already apparent. In short, we anticipate that the availability of the sequence of *C. hominis* will stimulate very rapid progress in research on this organism, its pathogenicity, and strategies for intervention in the diseases it causes.

REFERENCES FOR EXAMPLE 1

1. Akiyoshi, D. E., Feng, X., Buckholt, M. A., Widmer, G. & Tzipori, S. Genetic analysis of a *Cryptosporidium parvum* human genotype 1 isolate passaged through different host species. *Infect. Immun.* 70, 5670-5675 (2002).
2. Gordon, D., Abajian, C. & Green, P. Consed: a graphical tool for sequence finishing. *Genome Res.* 8, 195-202 (1998).
3. Bankier, A. T. et al. Integrated mapping, chromosomal sequencing and sequence analysis of *Cryptosporidium parvum*. *Genome Res.* 13, 1787-1799 (2003).
4. Abrahamsen, M. S. et al. Complete genome sequence of the apicomplexan, *Cryptosporidium parvum*. *Science* 304, 441-445 (2004).
5. Gardner, M. J. et al. Genome sequence of the human malaria parasite *Plasmodium alciparum*. *Nature* 419, 498-511 (2002).
6. Muller, M. Evolutionary relationships among Protozoa. Coombs, G. H., Vickerman, K., Sleigh, M. A. & Warren, A. (eds.), pp. 109-131 (Kluwer Academic Publishers, 1998).
7. Sanchez, L. B., Galperin, M. Y. & Muller, M. Acetyl-CoA synthetase from the amitochondriate eukaryote *Giardia lamblia* belongs to the newly recognized superfamily of acyl-CoA synthetases (Nucleoside diphosphate-forming). *J. Biol. Chem.* 275, 5794-5803 (2000).
8. Jasso-Chavez, R. & Moreno-Sanchez, R. Cytosol-mitochondria transfer of reducing equivalents by a lactate shuttle in heterotrophic Euglena. *Eur. J. Biochem.* 270, 4942-4951 (2003).
9. Petry, F. & Harris, J. R. Ultrastructure, fractionation and biochemical analysis of *Cryptosporidium parvum* sporozoites. *Int. J. Parasitol.* 29, 1249-1260 (1999).
10. Barrett, M. P. The pentose phosphate pathway and parasitic protozoa. *Parasitol Today* 13, 11-16 (1997).
11. Nihei, C., Fukai, Y. & Kita, K. Trypanosome alternative oxidase as a target of chemotherapy. *Biochim. Biophys. Acta* 1587, 234-239 (2002).
12. Striepen, B. et al. Gene transfer in the evolution of parasite nucleotide biosynthesis. *Proc. Natl. Acad. Sci. U. S. A* 101, 3154-3159 (2004).
13. Roberts, C. W. et al. The shikimate pathway and its branches in apicomplexan parasites. *J. Infect. Dis.* 185 Suppl 1, S25-S36 (2002).
14. Atreya, C. E. & Anderson, K. S. Kinetic characterization of bifunctional thymidylate synthase-dihydrofolate reductase (TS-DBFR) from *Cryptosporidium hominis*: A paradigm shift for TS activity and channeling behavior. *J. Biol. Chem.* (2004).
15. Waller, R. F. et al. Nuclear-encoded proteins target to the plastid in *Toxoplasma gondii* and *Plasmodium falciparum*. *Proc. Natl. Acad. Sci. U. S. A* 95, 12352-12357 (1998).
16. Zhu, G., Marchewka, M. J. & Keithly, J. S. *Cryptosporidium parvum* appears to lack a plastid genome. *Microbiology* 146 (Pt 2), 315-321 (2000).
17. Zhu, G. et al. Expression and functional characterization of a giant Type I fatty acid synthase (CpFAS1) gene from *Cryptosporidium parvum*. *Mol. Biochem. Parasitol.* 134, 127-135 (2004).
18. Zhu, G., Marchewka, M. J., Woods, K. M., Upton, S. J. & Keithly, J. S. Molecular analysis of a Type I fatty acid synthase in *Cryptosporidium parvum*. *Mol. Biochem. Parasitol.* 105, 253-260 (2000).
19. Priest, J. W., Xie, L. T., Arrowood, M. J. & Lammie, P. J. The immunodominant 17-kDa antigen from *Cryptosporidium parvum* is glycosylphosphatidylinositol-anchored. *Mol. Biochem. Parasitol.* 113, 117-126 (2001).
20. Bacchi, C. J. & Yarlett, N. in *Biochemistry and Molecular Biology of Parasites*. Marr, J. J. & Müller, M. (eds.), pp. 119-131 (Academic Press, New York, 1995).
21. Keithly, J. S. et al. Polyamine biosynthesis in *Cryptosporidium parvum* and its implications for chemotherapy. *Mol. Biochem. Parasitol.* 88, 35-42 (1997).
22. Parsons, M. & Ruben, L. Pathways involved in environmental sensing in trypanosomatids. *Parasitol. Today* 16, 56-62 (2000).
23. Crawford, M. J., Fraunholz, M. J. & Roos, D. S. in *Molecular Medical Parasitology*. Marr, J. J., Nilsen, T. W. & Komuniecki, R. W. (eds.), pp. 154-169 (Academic Press, New York, 2003).
24. LaGier, M. J., Tachezy, J., Stejskal, F., Kutisova, K. & Keithly, J. S. Mitochondrial-type iron-sulfur cluster biosynthesis genes (IscS and IscU) in the apicomplexan *Cryptosporidium parvum*. *Microbiology* 149, 3519-3530 (2003).
25. Geer, L. Y., Domrachev, M., Lipman, D. J. & Bryant, S. H. CDART: protein homology by domain architecture. *Genome Res.* 12, 1619-1623 (2002).
26. Katinka, M. D. et al. Genome sequence and gene compaction of the eukaryote parasite *Encephalitozoon cuniculi*. *Nature* 414, 450-453 (2001).
27. Riordan, C. E., Ault, J. G., Langreth, S. G. & Keithly, J. S. *Cryptosporidium parvum* Cpn60 targets a relict organelle. *Curr. Genet.* 44, 138-147 (2003).
28. Tetley, L., Brown, S. M., McDonald, V. & Coombs, G. H. Ultrastructural analysis of the sporozoite of *Cryptosporidium parvum*. *Microbiology* 144 (Pt 12), 3249-3255 (1998).
29. Zuther, E., Johnson, J. J., Haselkorn, R, McLeod, R. & Gornicki, P. Growth of *Toxoplasma gondii* is inhibited by aryloxyphenoxypropionate herbicides targeting acetyl-CoA carboxylase. *Proc. Natl. Acad. Sci. U. S. A* 96, 13387-13392 (1999).
30. Muhia, D. K. et al. Multiple splice variants encode a novel adenylyl cyclase of possible plastid origin expressed in the sexual stage of the malaria parasite *Plasmodium falciparum*. *J. Biol. Chem.* 278, 22014-22022 (2003).
31. Dzierszinski, F. et al. The protozoan parasite *Toxoplasma gondii* expresses two functional plant-like glycolytic enzymes. Implications for evolutionary origin of apicomplexans. *J. Biol. Chem.* 274, 24888-24895 (1999).
32. Fast, N. M., Kissinger, J. C., Roos, D. S. & Keeling, P. J. Nuclear-encoded, plastid-targeted genes suggest a single common origin for apicomplexan and dinoflagellate plastids. *Mol. Biol. Evol.* 18, 418-426 (2001).
33. Beyer, T. V., Svezhova, N. V., Radchenko, A. I. & Sidorenko, N. V. Parasitophorous vacuole: morphofunctional diversity in different coccidian genera (a short insight into the problem). *Cell Biol Int.* 26, 861-871 (2002).
34. Stedman, T. T., Sussmann, A. R. & Joiner, K. A. *Toxoplasma gondii* Rab6 mediates a retrograde pathway for sorting of constitutively secreted proteins to the Golgi complex. *J. Biol. Chem.* 278, 5433-5443 (2003).
35. Chaturvedi, S. et al Constitutive calcium-independent release of *Toxoplasma gondii* dense granules occurs through the NSF/SNAP/SNARE/Rab machinery. *J. Biol. Chem.* 274, 2424-2431 (1999).
36. Ngo, H. M. et al. AP-1 in *Toxoplasma gondii* mediates biogenesis of the rhoptry secretory organelle from a post-Golgi compartment. *J. Biol. Chem.* 278, 5343-5352 (2003).
37. Zapata, F., Perkins, M. E., Riojas, Y. A., Wu, T. W. & Le Blancq, S. M. The *Cryptosporidium parvum* ABC protein family. *Mol. Biochem. Parasitol.* 120, 157-161 (2002).

38. Zhu, G. et al. *Cryptosporidium parvum*: the first protist known to encode a putative polyketide synthase. *Gene* 298, 79-89 (2002).
39. Simpson, A. G. et al. Evolutionary history of "early-diverging" eukaryotes: the excavate taxon *Carpediemonas* is a close relative of *Giardia*. *Mol. Biol. Evol.* 19, 1782-1791 (2002).

Example 2

Identification of Categories of Genes and Proteins of *C. hominis*

Introduction

Genomic sequences from pathogenic microorganisms provide fundamentally new approaches for development of vaccines and chemotherapeutic agents. Thus, reverse vaccinology invokes bioinformatics analyses to identify potential candidates from the genome data by "in silico" analysis. This approach has been successfully applied to identify putative vaccine candidates from bacterial genomes that traditional vaccine development methods have not detected. This approach (see Scarsellie et al, 2005, for review) has recently been applied in several bacterial systems including for example group B streptococci and *Neisseria meningitidis*. See, for example, the following references: 1) Maione D, Margarit I, Rinaudo C D, Masignani V, Mora M, Scarselli M, Tettelin H, Brettoni C, Iacobini E T, Rosini R, D'Agostino N, Miorin L, Buccato S, Mariani M, Galli G, Nogarotto R, Nardi Dei V, Vegni F, Fraser C, Mancuso G, Teti G, Madoff L C, Paoletti L C, Rappuoli R, Kasper D L, Telford J L, Grandi G. Identification of a universal Group B *streptococcus* vaccine by multiple genome screen. *Science.* 2005 Jul. 1; 309(5731): 148-50; 2) Scarselli M, Giuliani M M, Adu-Bobie J, Pizza M, Rappuoli R. The impact of genomics on vaccine design. Trends Biotechnol. 2005 February; 23(2):84-91; 3) Serruto D, Adu-Bobie J, Capecchi B, Rappuoli R, Pizza M, Masignani V. Biotechnology and vaccines: application of functional genomics to *Neisseria meningitidis* and other bacterial pathogens. J. Biotechnol. 2004 Sep. 30; 113(1-3):15-32. Review; 4) Kurz S, Hubner C, Aepinus C, Theiss S, Guckenberger M, Panzner U, Weber J, Frosch M, Dietrich G. Transcriptome-based antigen identification for *Neisseria meningitidis*. Vaccine. 2003 Jan. 30; 21(7-8):768-75; and, 5) Pizza M, Scarlato V, Masignani V, Giuliani M M, Arico B, Comanducci M, Jennings G T, Baldi L, Bartolini E, Capecchi B, Galeotti C L, Luzzi E, Manetti R, Marchetti E, Mora M, Nuti S, Ratti G, Santini L, Savino S, Scarselli M, Storni E, Zuo P, Broeker M, Hundt E, Knapp B, Blair E, Mason T, Tettelin H, Hood D W, Jeffries A C, Saunders N J, Granoff D M, Venter J C, Moxon E R, Grandi G, Rappuoli R. Identification of vaccine candidates against serogroup B *meningococcus* by whole-genome sequencing. Science. 2000 Mar. 10; 287(5459):1816-20.

Similarly, systems wide analyses of these pathogens using genomic data leads to identification of potential 'weak links' or 'Achille's Heels' in the biological processes of the pathogen, which can be exploited for the development of inhibitors of processes essential to the parasite. Gene expression and proteomic technologies complement the "in silico" analysis of the genome data to identify potential vaccine and chemotherapeutic targets. Similar approaches lead to the identification of new biomarkers for the detection of these pathogens and diagnosis of disease caused by them.

*C. hominis* genes of several types that are of great potential as chemo- or immuno-therapeutics, immuno-prophylactics, and/or detection/diagnostics/quantification agents, have been identified. These genes fall into several general classes: 1) transporters; 2) receptors; 3) surface and secreted proteins; 4) organellar proteins; 5) signal transduction proteins and kinases; 6) critical metabolic enzymes; and 7) specifies specific sequence differences. The application for each of these is outlined briefly below.

Transporters. *C. hominis* lacks genes and consequently the enzymes and metabolic pathways required for several essential functions: e.g. biosynthesis of simple sugars, amino acids, nucleotides, fatty acids, etc. Thus, these important pathogens are dependent on their environment or host for these essential compounds, and these compounds must be transported across the parasite's membrane by a host of essential transporters. A list of these transporters is given in Table 3.

Knowledge of the sequence of these transporter genes and consequently the protein sequences permits us to predict their functions and to some degree their cellular locations and structures. Specific knowledge of the function of a transporter; e.g., a nucleotide-sugar transporter, provides a means to block the activity of that molecule. Blocking the activity of an essential transporter will prevent the parasite from importing essential compounds and the parasite will die. Thus, these transporters represent ideal targets for chemotherapeutic development.

Similarly, transporters must function at the host-parasite interface; i.e., the parasite membrane exposed to the extracellular domain. This exposed location makes these molecules ideal targets for immunoprophylaxis or immunotherapy. Vaccines developed against these proteins could: 1) protect relevant human populations or animal populations; 2) provide a means to treat infections. Thus, active or passive immunization against pools of these proteins could: 1) prevent infection; 2) provide a therapy for the cryptosporidiosis. The therapeutic effect could result from: 1) killing the parasite via normal immune mechanisms activated by immunization; 2) blocking the activity of the molecule via immune mechanisms and thereby starving the parasite until it is cleared by normal mechanisms. Thus, transporters are ideal targets for vaccines, and could be used for both immuno-prophylaxis and immuno-therapy.

Receptors. Receptors are essential for cell-cell signalling, sensing of the environment, host parasite interactions, uptake of essential nutrients, etc. Receptors by definition are located on the membrane surface in some contact with the extracellular environment. A list of *C. hominis* receptors is given in Table 4. Blocking of the function of these macromolecules would likely be lethal to the parasite. The extracellular location of these receptors renders them available for attack by the host or passive immune mechanisms, and available for chemotherapeutics unable to cross most membranes. Thus, receptors are excellent targets for immuno-prophylaxis and therapy, or chemotherapy.

Surface and secreted proteins. There are many parasite proteins associated with the surface of the cell, and some that are secreted into the extracellular milieu. A list of over 1000 *C. hominis* proteins that are associated with the membrane or secreted is given in Table 5. Receptors and transporters will also be members of this group of proteins. Independent of the actual function of these macromolecules, they are amenable to attack by the host immune system or by passive immunization. Thus, these molecules are also idea targets for active or passive immuno-therapy or prophylaxis.

Organellar proteins. *C. hominis* is a member of the Apicomplexan parasites, and therefore encodes genes that generate apical complex organelles responsible for invasion and pathogenesis of the parasites, and other organelles required for its survival. A list of genes which are involved in organellar biosynthesis and function is given in Table 6. Since these organelles, systems and enzymes are specific to these parasites, they represent ideal targets for therapeutics.

Signal transduction proteins and kinases. These proteins are required for proper, responsive and sensitive gene regulation in the parasite. Lacking the function of these proteins and enzymes, the parasites are unable to respond to their environment properly, or to differentiate correctly. Therefore, these enzymes are required for the viability of this parasite and thereby represent ideal targets for therapeutic (chemo- or immuno-) attack. A list of these proteins and enzymes is given in Table 7.

Critical metabolic enzymes. As outlined above, we have developed a fairly comprehensive understanding of the metabolism of *Cryptosporidium* simply by analysis of the genes encoded in its genome. Thus, we can see that the parasite is highly dependent on glycolysis for energy, for amino acid interconversion for generation of amino acids, for fatty acid biosynthesis and degradation, for nucleotide synthesis. Blockage or inhibition of these processes would likely be lethal for the parasite. A list of such essential metabolic enzymes and proteins is given in Table 8. These enzymes represent ideal targets for specific chemotherapeutics.

Species specific sequence differences. We now know nearly the entire genome sequence of *C. hominis*. Thus, we can now easily compare all of its genes to those of related parasites and pathogens. DNA/RNA of these genes provide very specific and easily readable signatures, and these signatures are generally species-specific. Thus, we have identified many sequences that can be useful for identifying *C. hominis*, and discriminating this parasite from other microbes (Table 9). These signature sequences can also be used for detection, quanitification and diagnostics, as well as for chemotherapeutic targets.

The *C. hominis* genes disclosed herein and the proteins they encode are newly discovered and have not been used as targets for possible immunotherapeutic purposes, or as targets for chemotherapeutic agents, or as tools for detection/diagnosis of the parasites. As outlined above, there is no immuno- or chemotherapy available for *C. hominis*. It is essential to develop such therapies. The newly identified genes and the proteins they encode provide a new approach to chemo- and/or immunotherapy. Their advantages include one or more of the following:
1. they are essential for viability of the parasite
2. they are localized on the surface of the parasite
3. they should be accessible to the host immune system or to blocking agents
4. much is known about these processes (e.g., transport, metabolism, etc.) and analogs that block them can be designed
5. the proteins/peptides thereof can be synthesized chemically or in recombinant bacteria
6. the peptides differ significantly from host molecules (both host and parasite homologs have been fully sequenced), and analogs that block the parasite version can be designed so that they do not block any host function.
7. vaccinogens can be designed so that the host immune response will act only on the parasite protein.

In short, these new genes present novel targets for chemo- and immunotherapy and prophylaxis for Cryptosporidiosis, a disease for which no such agents currently exist. Genome Annotation. The DNA sequence of *C. hominis* was annotated using a suite of analysis programs to identify important genes. Protein genes and their structural and functional annotations were derived. Approximately 4,000 genes were identified Table 1). Similarly, structural RNA genes (tRNA, rRNA) were identified (not shown).

Vaccinology.

One focus of research in the *Cryptosporidium* vaccinology project has been application of "in silico" genome analysis to identify potential vaccine candidates from the complete genome sequence of *Cryptosporidium hominis*. The general steps that are followed are:
1. Apply bioinformatics tools to predict possible antigens from the whole genomic sequence.
2. Focus searches for possible antigens by gene expression analysis, proteomics, and other "systems" approaches.
3. Clone, express, and purify putative candidates.
4. Validate the possible protective or biological role of the candidates in animal and "in vitro" models.
5. Select antigens with positive results for further testing in animals and eventually in humans.

Reverse Vaccinology in *Cryptosporidium*

Identification of potential target antigens using bioinformatics: The initial step was to apply bioinformatic tools to scan the whole genome sequence of *C. hominis* focusing on proteins that are predicted to be secreted, ER localized, surface-exposed and/or contain antigenic motifs, and that therefore represent potential vaccine targets. Since these proteins are most likely to be exposed to the immune system, they constitute the initial target of the project. This approach has been successfully used for several ne recombinant vaccines (see, for example, Scarsellie et al, 2005, fore review.) Screening of the genome has been carried out using various programs that predict the following characteristics:
   presence of a signal peptide
   possible membrane protein by presence of transmembrane domains
   GPI—anchor domains
   antigenicity
   similarity to virulence factors characterized in other pathogens
   no similarity to human proteins.
   role in transport of ions or essential metabolitesions or essential metabolites.

Using various bioinformatics tools, close to 500 *Cryptosporidium* candidate proteins that are most likely exposed to the immune system were identified (Table 10). Priority is given to those that present a single transmembrane domain, as those are less likely to be toxic to *E. coli* or other vector hosts used for cloning and expression of the recombinant proteins.

Focus Searches Using Gene Expression and Proteomics

The best antigens for vaccines are likely to be those associated with the membrane during sporozoite stages in the development of the parasite. The sporozoite form of the parasite is responsible for invasion of the intestinal epithelium causing pathology. To identify those proteins, a microarray that targets every gene in the *C. hominis* genome has been generated. The arrays are used to identify those genes that are expressed in *C. hominis* sporozoites. These arrays detect mRNAs transcribed from the genes. Therefore, in parallel with the gene expression array work, proteomics analyses are performed. A database containing all *C. hominis* proteins has been constructed, and *C. hominis* oocysts and sporozoites are analyzed for those proteins that are expressed in those stages of the parasite. This information permits identification of proteins for vaccinogens.

The array in its current configuration consists of ~4,000 70 base synthetic oligonucleotides bound to glass slides. Each of the ~4,000 *C. hominis* genes is represented by a single, specific oligonucleotide in the array. In order to assess expression of these genes in a specific stage, a biological sample containing C. hominis parasites at that stage of development is provided. Total RNA is isolated by standard technology, labeled with fluorescent dyes, and hybridized to the array. A similar RNA sample derived from an alternative stage of the parasite's life cycle is used is labeled with an alternative fluorescent dye and used as a control. Both labeled RNAs are hybridized to the same oligonucleotide array, and the arrays are washed and scanned in a fluorescence scanner. The readout of the scanner provides an estimate of the amount of RNA for each gene that is present in the initial sample and a comparison between the two samples provides an estimate of the relative expression level of each gene in the two samples. Thus, genes that are up or down regulated relative to the control can be identified.

In addition to examining gene expression differences in various life cycle stages, these arrays may be used to monitor C. hominis parasites under other conditions of interest, for example, to monitor gene expression in response to an external stimulus or variable, such as introduction of a drug or other agent into a culture of the parasites; or to monitor the course of a C. hominis infection, either in culture, or in an infected individual.

The 70 base oligonucleotides in the array were designed by ArrayOligoSelector™ version 3.8.2, (http://arrayoligosel-.sourceforge.net/), which selects optimal sequences by:

1. Examining every possible 70 mer sequence from every gene;
2. Using BLASTN (against the whole genome) to check the uniqueness of each 70 mer.
3. Uniqueness is scored as the theoretical binding energy of a candidate oligo to its most similar genome sequence. The binding energy is calculated using a nearest-neighbour model with the established thermodynamic parameters;
4. Using the LZW compression algorithm to calculate the sequence complexity score in bytes between the oligo sequence and the its compressed version;
5. Determining the self-annealing score, calculated as the alignment score of the optimum local alignment between the oligo sequence and its reverse compliment using the Smith-Waterman algorithm;
6. Calculating the GC content of the oligo;
7. Choosing, for each gene, the oligo that maximizes uniqueness and sequence complexity, minimizes self-annealing and has GC content closest to specified by the user; also tries to minimize distance to the 3' end of the gene.

The oligos were synthesized commercially and validated in the lab, and the process is ongoing. Initial tests were performed as follows:

The oligos were reconstituted to 100 pmoles with sterile distilled water;

Several dilutions (10, 25 and 50 pmoles) were tested for the best printing conditions;

Two test plates were printed on Corning UltraGAPS slides (amino-silane coated);

These slides were stained in SYBR Green II and hybridized with Cy-dye labeled RNAs.

The results of the initial prints indicated that the oligos were intact and the hybrodization was strong. The relatively even staining indicated that that hybridization of each gene was essentially equivalent. Finally, lack of hybridization to the negative control confirms specificity of the hybridization. Thus, use of the array to identify genes that are expressed in *C. hominis* sporozoites by detecting transcribed mRNAs was validated.

Cloning and Expression of Protein Candidates in *Escherichia coli*

In parallel with the gene expression array work, proteomics analyses have also been performed. A database containing all *C. hominis* proteins has been constructed, and *C. hominis* oocysts and sporozoites are characterized for those proteins that are expressed in those stages of the parasite. This information permits us to focus on the most likely proteins for vaccinogens.

The cloning and expression of the candidates has been carried out using the pET system from Novagen that allows the cloning of PCR products in a ligase-independent reaction (Ek/LIC cloning). The proteins of interest are expressed as fusion proteins to an epitope tag that permits their detection and purification. Various tags (e.g. His-Tag, GST-tag and Nus-Tag, etc.) are known and available. In addition the Ek/LIC cloning system can be adapted and used in a high throughput pipeline for the cloning and expression of recombinant proteins.

The cloning of PCR products by LIC requires the presence of non-complementary single-stranded overhangs in the vector that anneal to complementary single stranded overhangs on the PCR fragment. In order to create these overhangs the LIC method uses the 3'-5' exonuclease activity of T4 DNA polymerase, which in the presence of a single deoxyribonucleotide creates very specific 13-14 base single stranded overhangs in both vector and PCR fragment. The primers used in the PCR reaction include 5' extensions that after the treatment with T4 DNA polymerase generate the overhangs complementary in the fragment to the overhangs created in the vector.

```
Sense primer:
                                          (SEQ ID NO: 4001)
5' GAC GAC GAC AAG ATX-insert specific sequence 3'

Antisense primer:
                                          (SEQ ID NO: 4002)
5' GAG GAG AAG CCC GGT-insert specific sequence 3'
```

After treatment with T4 DNA polymerase in the presence of dATP the PCR fragment is flanked by the overhangs as shown below:

```
                                          (SEQ ID NO: 4001)
     5' GACGACGACAAGATX-Target protein-xxA (SEQ ID NO: 4002)
     AX-Target protein-xxTGGCCCGAAGAGGAG 3'
```

As a first step, the genes encoding thirteen of these antigens were PCR amplified from genomic DNA. The PCR products were purified and cloned into the vector pTriEX-4, a vector that allows the expression of the proteins as 6X-His and S-tag fusion products in both prokaryotic and eukaryotic hosts. The His-tagged products can be purified through nickel-activated columns. The recombinant plasmids were characterized by restriction enzyme analysis and DNA sequencing to confirm the presence of the *Cryptosporidium* target gene. Protein overexpression: The recombinant plasmids were used to transform the *Escherichia coli* strain BL21 (DE3) or other appropriate vector for expression of the fusion proteins. The target genes are cloned into pTriEX-4 under the control of the bacteriophage T7 promoter. Transcription is initiated by the enzyme T7 RNA polymerase which is present in the chromosome of the bacterial host and is under the control of an inducible promoter. In the presence of the inductor, IPTG, T7 RNA polymerase is produced in the bacterial host resulting in the expression of the target protein. This gives this system an excellent way to regulate the production of the target protein under controlled conditions, which is a point to consider in case that the protein has a toxic effect in *E. coli*. The level of expression is very high and can be 50% of the total protein present in the bacterial host. The expression of the recombinant genes was carried out by culturing bacteria in 3 ml of Overnight Express Instant Tb medium (Novagen) at 37° C. for 12-13 hours. This medium is designed to achieve a high level of expression with IPTG-inducible bacterial systems without the need of monitor cell growth. Expression has been achieved for all but the Zn++ transporter and the Thrombospondin-containing gene TSP1. The Zn transporter seems to be toxic for *E. coli* as bacterial cultures containing the Zn-transporter clones start to lyse after they reach early stationary phase. Most of the proteins were expressed in *E. coli* in an insoluble form as inclusion bodies. The exception is the gene encoding the Profilin-like protein.

Therefore, these proteins were expressed using a different vector since the same PCR product can be cloned in different vectors. Two additional epitope tags were assayed, GST and NUS. The proteins expressed from clones in the GST-tag vector were also insoluble. The proteins obtained from the NUS-tag expressed the protein in higher amount compared to the previous two vectors and the fusion proteins can be detected in the soluble fraction by Western blot. Very high levels of expression have been achieved with the Nus-tag clones which results in proteins becoming soluble as detected by gel staining. The results for the experiments are summarized in Table 11.

The nucleotide sequences that encode the proteins, and amino acid sequences of the proteins, are as follows:

1) Zinc transporter (Chro.10338, start position 677, end position 2053) is encoded by the nucleotide sequence:

```
                                                  (SEQ ID NO: 1)
ATGAAAGACTCAGGTCTGGAAAAGCCATTACTTAATGGGAATGGATTTAA

AATATTTGCAAGTACAGAGAGTGTTCAGAAGAGGTTAATATATGCAATCT

TTTTCTGTCTAGTCTTTACATTGATAGAGGTTGTTGTGGGTATATTATCA

AACTCACTGGCACTAATATCAGATGCATCTCACCTCATTTCAGATATATG

TAGCTATTTCATTTCTCTGCTTGGTATCCACCTTTCCAAAAGAAAGGCCA

CAAACACAATGTCATTTGGTTATAACAGAGCTGAAATATTAGGGGCTTTG

TTAAGCATTCTACTAATATGGTTCATGACAATCATGCTTGTTTACGAGGC

TATTCAAAGAATGTTATATCCTGTGAATGTTGATGGGTTTTCTATGTTTA

TTACCGCTATTTTTGGTACTTTGTCCAACTTATTTATTAGCTTTGTGTTA

TCTGTTCACAATCATGGAATAGGTTCAATTGGAGCAGATTGTACCCAACA

CAATCATACACATGAACATATGCATGAACACGACTGTAAGCAAGCTCAAA

CTCATTTTCAGGATGATTCACTGTATTGCAAAGATCAACAACTAGTAGAA

AATCAAGAACAAATTGGAGGAATTAACACTACTTTACTTGAATACCACCA

TAGAAGCCAAATGAGAACTAAGGATTTAGATCATGAACTTAATAATTATA

CTAATTTAATGAACTCTCCAGTTATAAGAAGAGTCAATTCTGGTTTAAAA

GAGTGTTCAGAACGTCAAAATGACTATTCTCATCTCCATAGTAATAATCA

CTATCCAAGTAAACATTCCTCTGAACAAGAAAGCTTAGCGCTTAAGTCTG
```

-continued
```
CTTATATCCATGTTTTAGGGGATATTTTACAGAACATCGGAGTAATGATT

GCTGGATTACTGATTTTATACAATCCAGCATGGACAATCGCCGATCCTCT

ATGTACTATTCTATTCTCCTTCTTTGTCCTCGCAACAACCATCAAAATCC

TAAAAGATTCCGCCAATGTTCTAATGGAAGGAGCCCCTATAGGAATTGAT

TGTGAATCCATTCAAAACGACTTTCTAAAGCTTTCTTCAGTGCTTGAAGT

TCACGATCTACATGTTTGGTCTGTATCTGTTGGAGTTCCTGCATTATCTT

GTCATATTGTCGTAGCATCAGAAGATAATGCTAGATTTACATTAAGATAT

GCAACGGATCTCTGTCAAAAGAAATATGGAATATTTCACACCACCATTCA

AATTGACTATTCTCCAAATAAAGCCACTTGTGAAACAATACATCATCAAA

AATGTCTAGTTGGCTCTAATAACCAAAATAAAAGTGAAATTCACCAAATA

ATTCATCCCGTTGACTATTCTGCTTAG
``` and has amino acid sequence:

```
                                                  (SEQ ID NO. 2)
MKDSGLEKPLLNGNGFKIFASTESVQKRLIYAIFFCLVFTLIEVVVGILS

NSLALISDASHLISDICSYFISLLGIHLSKRKATNTMSFGYNRAEILGAL

LSILLIWFMTIMLVYEAIQRMLYPVNVDGFSMFITAIFGTLSNLFISFVL

SVHNHGIGSIGADCTQHNHTHEHMHEHDCKQAQTHFQDDSLYCKDQQLVE

NQEQIGGINTTLLEYHHRSQMRTKDLDHELNNYTNLMNSPVIRRVNSGLK

ECSERQNDYSHLHSNNHYPSKHSSEQESLALKSAYIHVLGDILQNIGVMI

AGLLILYNPAWTIADPLCTILFSFFVLATTIKILKDSANVLMEGAPIGID

CESIQNDFLKLSSVLEVHDLHVWSVSVGVPALSCHIVVASEDNARFTLRY

ATDLCQKKYGIFHTTIQIDYSPNKATCETIHHQKCLVGSNNQNKSEIHQI

IHPVDYSA;
```

2) Ribosomal protein S19 (CP15) (Chro.60368, start position 13760, end position 14197) is encoded by the nucleotide sequence:

```
                                                  (SEQ ID NO. 3)
ATGGCAGATACTGAACAAAAGAAGAGAACCTTCAGAACTTATAGTTACAG

AGGTGTTGACCTCGACAAGCTCCTTACCATGAAATTGGATGAGGTTGTTG

AGCTTTTACCAGCACGTAAAAGACGTAAGATAGCCAGAGGTTGTCTTAAC

AGAAGAACTGCAGCTTTTATCGCAAAGCTTCGCAAATCTAAGGCTGAATG

TCCAATGGGTGAGAAACCTGTTGCTGTTCGTACCCATTTACGTAATATGG

TTATCCTCCCAGAAATGGTTGGTTCTGTTGCAGGTGTCTACAATGGTAAG

ACTTATGTTACCGTTGAAATTAAGCCAGAAATGATTGGGATGTACCTTGG

AGAGTTCTCTATCACCTACAAGCCAGTACGTCATGGTAAGCCAGGTGTTG

GTTCAACCAGTTCTTCCAGATTCATTCCTCTAAAGTAA
``` and has amino acid sequence:

```
                                                  (SEQ ID NO. 4)
MADTEQKKRTFRTYSYRGVDLDKLLTMKLDEVVELLPARKRRKIARGCLN

RRTAAFIAKLRKSKAECPMGEKPVAVRTHLRNMVILPEMVGSVAGVYNGK

TYVTVEIKPEMIGMYLGEFSITYKPVRHGKPGVGSTSSSRFIPLK;
```

53) Mucin-like glycoprotein 900 (Chro.70447, start position 855, end position 3963) is encoded by the nucleotide sequence:

(SEQ ID NO. 5)
ATGACAACAACAACAACACCACCATTACCTGATATCGGTGACATTGAAAT
TACACCAATCCCAATTGAAAAGATGTTGGATAAGTATACAAGAATGATTT
ATGACTATAACAGTGGTTTATTATTAGACTCTAATGATGAACCAATTCCA
GGTTCTCAAGCAGGACAAATAGCTGATACAAGCAATTTATTCCCAACTCA
AACTCACAAGAGTACTGGTTTACCAATTGATCCAATGGTTGGTCTTCCAT
TTGATCCAAAATCAGGTAATTTAGTACATCCATATACCAATCAAACAATG
TCTGGTTTATCAGTATCATATCTTGCTGCTAAGAATTTGACAGTTGATAC
TGATGAAACCTACGGTTTACCAATTGATACACTCACTGGTTACCCATTAG
ATCCAGTTAGTTTGATTCCATTCAATCCAGAAACTGGTGAATTGTTTGAT
CCAATCTCAGATGAGATCATGAATGGAACAATTGCAGGTATTGTTTCAGG
AATTTCTGCAAGTGAGTCATTATTATCTCAGAAATCAGCTCAAATCGACC
CAGCAACAAATATGGTTGTTGGCGAATTTGGTGGATTGTTGAACCCAGCA
ACAGGAGTGATGATTCCAGGTTCTTTAGGTCCATCAGAGCAAACTCCATT
CTCCCCTGAAATTGAAGATGGTGGTATTATTCCTCCAGAAGTAGCAGCAG
CAAATGCTGATAAATTCAAGTTATCTATTCCTCCAAGCGTACCAGAATCA
ATTCCAGAAAAGGATCAGAAGATCGATTCTATTTCTGAATTGATGTATGA
TATTGAGTCAGGTAGACTTATTGGTCAAGTATCAAAGAGACCAATCCCAG
GTTCAATTGCTGGTGATTTGAACCCAATAATGAAGACACCAACACAAACT
GACAGTGTAACTGGTAAGCCAATCGATCCAACCACAGGTTTACCTTTCAA
TCCACCAACTGGTCATTTGATTAACCCAACAAATAATAATACCATGGATT
CTTCATTTGCTGGTGCATACAAATATGCAGTTTCAAATGGTATCAAGACT
GATAATGTTTATGGTTTACCAGTTGATGAAATAACAGGTTTGCCAAAGGA
TCCAGTCTCAGATATTCCATTTAACTCAACTACAGGTGAATTGGTTGATC
CATCAACAGGAAAGCCAATTGACAATTCTACTGCTGGTATTATTAGTGGA
AAACCTGGCTTACCACCTATTAAAGATGAAAATGGCAATTTGTTTGATCC
ATCAACTAACTTGCCAATAGATGGTAATAACCAATTAATTAACCCAGAAA
CCAACAGTACTGTCCCAGGATCAACTTCAGGTTACTACAAAACCAAAGCC
AGGAATTCCAGTCAATGGTGGAGGTGTTGTACCTAATGAAGAAGCTAAAG
ATCAAGCTGATAAGGGTAAGGATGGATTAATTGTTCCACCAACTAATTCT
ATCAATAAGGATCCAGTAACAAATGCTCAATACAGTAATAGTACTGGTAA
CATTATTAACCCAGAAACAGGAAAAGTTATTCCAGGCTCACTTCCAGGCT
CTCTCAACTATCCATCATTCAATACTCCACAACAAACTGATGAGATTACA
GGAAAGCCAGTTGATACTGTTACTGGTTTGCCATATGATCCATCTACAGG
TGAAATTATCGATCCAGCAACTAAATTACCAATTCCAGGATCGGTTGCAG
GTGATGAAATTCTCACTGAAGTATTGAACATTACAACAGATGAAGTAACA
GGTTTGCCAATTGATCCTGAAACCGGTCTTCCAAGAGATCCAGTATCAGG
ACTCCCACAACTTCCAAATGGTACTTTGGTTGATCCATCAAATAAAAAAC
CAATTCCAGGTTCACATTCTGGATTTATTAATGGTACATCTGGAGAACAA

TCACACGAGAAAGATCCAGGTACTGGTAAGCCACTTGATCCAAATACAGG
TTTACCATTCGATGAAGATTCTGGTAGTTTAATTAACCCAGAGACTGGAG
ATAAACTTCAAGGATCACATTCTGGTACATTTATGCCAGTGCCAGGTAAG
CCACAAGGTGAAAATGGAGGTATCATGACACCTGAGCAGATATTGGAAGC
ATTAAATAAATTGCCAACAAGTAATGAAGCAAAATATTTCACCAAAACCA
AGTTCAGATGCTGTTCCAGACAAACCAACAAATACTTGGTGGAATAAGAT
TTCTGGTCAAACCTACCAGGTTGATGGAGAGAAGACTATTCCAGGTTCTG
CAGCTTCAGTAATTCACACTGCTCTTGGAACACCAACTCAAACTGATCCA
ACAACAGGACTTCCATCTGATCCATCAACAGGTTTACCATTCATTCCAGG
ATTTAACGTACTTGTAGATCCTCAGACTGGAGAGCAAATGAAGGGTTCTG
TTCCTTATGTTTCATTGTACGTTAAGGAAAAGAACATTGTAACAGAAGCT
GCTTATGGTCTACCAGTTGATCCAAAGACTGGTTTCCCAATTGATCCAAT
TAGTTACCTCCCATTTGCTAAGAATGGTGAATTAATTGATCCTATCTCTG
GTAAATATTTCAGTGGTTCAATTGCTGGATTCATTTCTGGTAAAGCTGGT
ACACAATCTAAATCATCTGATGAGTCAGGTAATCCAATTGATCCATCAAC
AAATATGCCTTACGATCCAAAAACAGGCAAATTAATTGATCCAGAATCTG
GCATTGCTATTGATAATTCTATTTCAGGTGTATTTGCAACTGTACCTGGT
ACTGCTGCACCGAAAAAGGGTGGTGTCATTCCAGAGTCAGTTGCAGCTGA
GGCAGCAAAGAAATACTTTGCAGCCAATGTTGAAGGAGGAGAAGGAGAAA
AAGTTCCACCACCACCAGAATCATCTAGTAACATTGCAATCCAAGCTGCT
GGTGGTGCTTCTGCTGCTGTAGGTCTCGTAGCTGCTGGTGTTGGTGCATG
GTATGCAAGCAGAAACAGACAAGAAGGAGAAGATGATGATGACTATGCAG
ATGGATTTGAAGCAGAATATGAAGAAGAAGAGGAAGAAGAGGGTGATGAA
GCAGCAAATGAAACTGTTGTTACAATTGAGCGTGATTCATCATTCTGGAA
CGAATCTTAA and has amino acid sequence:

(SEQ ID NO. 6)
MTTTTTPPLPDIGDIEITPIPIEKMLDKYTRMIYDYNSGLLLLDSNDEPIP
GSQAGQIADTSNLFPTQTHKSTGLPIDPMVGLPFDPKSGNLVHPYTNQTM
SGLSVSYLAAKNLTVDTDETYGLPIDTLTGYPLDPVSLIPFNPETGELFD
PISDEIMNGTIAGIVSGISASESLLSQKSAQIDPATNMVVGEFGGLLNPA
TGVMIPGSLGPSEQTPFSPEIEDGGIIPPEVAAANADKFKLSIPPSVPES
IPEKDQKIDSISELMYDIESGRLIGQVSKRPIPGSIAGDLNPIMKTPTQT
DSVTGKPIDPTTGLPFNPPTGHLINPTNNNTMDSSFAGAYKYAVSNGIKT
DNVYGLPVDEITGLPKDPVSDIPFNSTTGELVDPSTGKPIDNSTAGIISG
KPGLPPIKDENGNLFDPSTNLPIDGNNQLINPETNSTVPGSTSGTTKPKP
GIPVNGGGVVPNEEAKDQADKGKDGLIVPPTNSINKDPVTNAQYSNSTGN
IINPETGKVIPGSLPGSLNYPSFNTPQQTDEITGKPVDTVTGLPYDPSTG
EIIDPATKLPIPGSVAGDEILTEVLNITTDEVTGLPIDPETGLPRDPVSG
LPQLPNGTLVDPSNKKPIPGSHSGFINGTSGEQSHEKDPGTGKPLDPNTG

-continued

LPFDEDSGSLINPETGDKLQGSHSGTFMPVPGKPQGENGGIMTPEQILEA

LNKLPTSNEAKYFTKTKFRCCSRQTNKYLVEMKQNISPKPSSDAVPDKPT

NTWWNKISGQTYQVDGEKTIPGSAASVIHTALGTPTQTDPTTGLPSDPST

GLPFIPGFNVLVDPQTGEQMKGSVPYVSLYVKEKNIVTEAAYGLPVDPKT

GFPIDPISYLPFAKNGELIDPISGKYFSGSIAGFISGKAGTQSKSSDESG

NPIDPSTNMPYDPKTGKLIDPESGIAIDNSISGVFATVPGTAAPKKGGVI

PESVAAEAAKKYFAANVEGGEGEKVPPPPESSSNIAIQAAGGASAAVGLV

AAGVGAWYASRNRQEGEDDDDYADGFEAEYEEEEEEEGDEAANETVVTIE

RDSSFWNES;

4) CP15/60 (Chro.40225, start position 10793, end position 12259) is encoded by the nucleotide sequence:

(SEQ ID NO. 7)
ATGTTCGAGTTTATTTCAGAAATGTTTCATTCATGTTGCAAATTAAAAAA

AAATCAAAGAATGATGAATACATTTTTATCTTGTGCCCTACCCCAAGTG

ATTTAGAAGAGGAATATATTGATCAAGAAGGAAATGTCAAAAAAAGAAG

CTCGAAAAAATTAGAGGAACTGCCAGAAATATTGTCGATAAGGAAATTGT

CAGGGAGTGGAGTGGAAGGGAAATTGGAAGCTGTATTTGCTGTCATTTAA

TATATGAAGACGAAATGAATGTTTATAGAGCTGATAAATATGGCAGACAT

ATTGGTAAGGACCATGAAGAATATGAAGGTAGCCAAACAAGAGAAGAAAA

CCGTGTTAACTCAGTTGAATCTCTGAGCTCATATGGCTCAAGAAAACATT

TTTCTGAGGAGCCAAATAGCGCAGATTCCAACTCTACCTCAATAAGTTCA

GATGAAAATAATAATGCAGTTGAGAATAAGAGTAAAAAAACAAGAGAAAG

GAGGAAGTTAAATATCAGTAGATCCCCAAGCGTAATTGAGAAGGAAATAG

ATGAAAAAGAAAAGAAGAACAAAAAACTAAAAGAAACAAAAGATGCCAAT

AATAAAGAATGCTCCACAATTAGTTCTGATATAAATAATGATATCCATAA

CGCGGATGAGAAAACAACTGATAATAGAAATAACAAAAAGCTAGAGAATA

CTAATGTAAAGAATGACGAGCAAATTCCATTCTCCGATCAAAAAAAATAT

TCTAAATCTTCTCCACTCTCAAAGAATCAATGCCCTCCAAAGTTAGGAAA

AAGGCCACCCATGAAGAATGAATTATTGGCTATGAATGGTCAGAAAAACA

ATTCACTTAAGTCATCAATTGCAAATAGTAAAAAAATGTAGTAAAAAAATA

TCAAGTACTCCGAAAAATGAATTTAACAAAATAATTTTGGAAAAAGAAAA

GGTAGAAAGTAATTCTCGCGATACTCATAAAGATGACAAAAATCAAACTG

GAAATAATAATGACCAGCAAATCAACCACATTACTAGCAGTTCTAATTCT

GATAAAGAAATGATTGATAACAGTGGGGAATTAAATATGAAGAGGAAGA

GATGAAGTTTAACAAAGATATTTCTTCGAAAATAATACGTCACAGAGCAT

TAATAGGAATTCAAGCCGAAATTATTCTAAAAGATGGATCGACAACGGAC

TGTAAAGTTAGCTTCTCAGATGAGGAAGATGATCTTTCATTTATTTGCAA

CGATAAAGTTAAAGCTGTTCCTTGGAGTAACATTAAAGAGATTTTTACAA

CAAAAAGTGAACTTAGAATGGTGAATACACGAGCACCTATTTTTAAAGAC

CCAACATTAATTATTGCACTACATTTAAAAGATACAGGAAATTGTATACC

TTTGAAATTTGATTCTAAGAAAAGCAAAGAAGATTTTTTAAATTTCGCCC

TCAGAATGATTGGGTAA and has amino acid sequence:

(SEQ D NO. 8)
MFEFISEMPHSCCKLKKNQKNDEYIFILCPTPSDLEEEYIDQEGNVKKKK

LEKIRTARNIVDKEIVREWSGREIGSCICCHLIYEDEMNVYRADKYGRHI

GKDHEEYEGSQTREENRVNSVESLSSYGSRKHFSEEPNSADSNSTSISSD

ENNNAVENKSKKTRERRKLNISRSPSVIEKEDEKEKKNKKLKETKDANNK

ECSTISSDINNDIHNADEKTTDNRNNKKLENTNVKNDEQIPFSDQKKYSK

SSPLSKNQCPPKLGKRPPMKNELLAMNGQKNNSLKSSIANSKKCSKKISS

TPKNEFNKIILEKEKVESNSRDTHKDDKNQTGNNNDQQINHITSSSNSDK

EMIDNSGEIKYEEEEMKFNKDISSKIIRALIGIQAEIILKDGSTTDCKVS

FSDEEDDLSFICNDKVKAVPWSNIKEIFTTKSELRMVNTRAPIFKDPTLI

IALHLKDTGNCIPLKFDSKKSKLEDFLNFALRMIG

5) Thrombospondin related adhesive protein (TRAP C1) (Chro.10390, start position 4021, end position 6078) is encoded by the nucleotide sequence:

(SEQ ID NO. 9)
ATGAAAAAGTTAATACTTTATTTAGTATTACTACATATATATATTGTTCA

GAAATATGTAATATGTTCAAAATTAACTCATTATTCAGTAGGTGGTCATG

CATCAACATCAAGAGTGAAGGGAAGAAGTAGTAGTGGTAGTAGTAGTAGT

AGTGGCGATTTTAATGTACCAGGATTAAATGGATATTTATGTCCAAGCTA

TAATAGAGACCCAAGAGGATTTGGTTGTTTTGGTATGAATACAGCATATA

CGGTTAAAAAGAATAGTTGGCAAGAATGTGCAAATCAATGCTATTGGAGT

AAATATACAGTATTTGGTAATTGTCAAAGATCTGTATATAATTCAAATAA

TAAAGATTGCTATATTAAAAGTGGTGATAACAGATGCGTGAAGTCTCCAG

ATGGAATGATTTTAACAAATAGGCAATCATATATGATCGGAGAGTGTGCG

ACAACATGTACTGTTTCAACTTGGTCAAGTTGGACTACATGCTCAGGGGT

ATGTGGTGAGATGAGATCAAGAACAAGAAGTGTGTTATCATTTCCAAGAT

ACGATTATGAATATTGTCCACATCTGATAGAGTATTCAAATTGTGTAGTA

CAAAATAAATGCCCAGAAAATTGCCCACAGTATGGGGTTTCAATATTGGG

ATGGGGATGTCAGTTTGAATCAACTTTTTCATTTAATAAAAATTTATTTG

TTAGTTATGAAGAAGATTGGAGGGGTTGCATGTCAACTTGCAAACAGGAT

CCATTTTGTGTAGCTTGGTCGTATAATGCAACTTTATCAGAAGGACCAGA

TTCTGTTGGATTTTCAAGAGAATATCGTCCATGTTATACACATAGATTTG

CTTCAGGATGTCAAGCTTTAGCACCAGGATGGGTATCAGGTAATAAGAAT

ACAATAAATGTTGATTGTGAAACTGGTACTTGTATACATAATGAATGGTC

ATCTTGGACAACATGTAAAGATCCTTGTAGTAATACTGAAACAATGAGTA

GAAATAGGACAGTAAAGACTGTATCTCAGAATTGGGCAAGTACACCTTGT

AGGGATGAGACTCAAATTCAACTTTGTTCAGAAAACCCACAAAGTATTGA

AACTTGTAAAACTTGTTTAGTAGGTGGTTGGTCAGAATGGTCAGATTGTT

-continued

```
CAACAAGTTGTGGAGAAGGTAATAGAGTTAGAACACGTGAAGTTACTAAA
CCTCCATTGAATGGAGATGATTCAACATGCCCAGAATTAATTGAGAAAGA
AAGTTGTAATAAAGATGTGGAATGTCCACATGTTCAATGTGATTGGGAGA
ATGGTCTTCTTGGTCACCTTGTAGTGTAACTTGTGGATGCGGAACAACTA
CAAGAAATAGGGAAGTAAAGGGAGAGAATTGTACAGAATTATCAACAGAA
TCAAAGAAGTGTAATTTGGCAAATTGTGACGATAACTCTGCATCATGTAC
TGCAGTTATGTCAGTTTGGTCAGAATGGTCAGTTTGTAGTGAGAAATGTG
ATCAGGGAGTAGTAAGAAGGTATCGTGATTTTGATTTTACAAAAATTGGG
GTTTTTGGTTATAATCCACCCGGTACATCAGAAGAACAAAATAAAGTGAG
AGAAATATGCAAGGATACTCCAACATTAGAAGAGGAGCCATGTACTTCAG
GAGTTGCATGTACTCCAGGATGTAAATATACTGAATGGAGTACTTGGTCA
AGCTGTGATTGTTCTGGAACTCAAACTAGAGATAGAGTTGTTACTTTCCC
TGAAGGTGTAATTGATGCAACTTGTCAGAGTTCTAAAGATACAAGATCAT
GTAGCAAGCCTGAAGGTTGTACAGAAACTGCTCCAGATTCTGGAGACGCT
ACACTTGCCATTGCTATTGGATTACCAGTTGGTATTCTTGGATTATGCAT
TATTGCTGGTTCTTTGTTTTTAATTGGTGGGAGATCAGGTGATCAGGAGG
AGGATGAGACAAGTTATCAATACTTTGATCAACCTTCTGCTACTTTAGAT
CAAGACTCAGAATATGTTCAAGAAATTGGTCCAGAGAGTCAGAACTGGGC
TAGTTGA
``` and has amino acid sequence:

```
                                        (SEQ ID NO. 10)
MKKLILYLVLLHIYIVQKYVICSKLTHYSVGGHASTSRVKGRSSSGSSSS
SGDFNVPGLNGYLCPSYNRDPRGFGCFGMNTAYTVKKNSWQECANQCYWS
KYTVFGNCQRSVYNSNNKDCYIKSGDNRCVKSPDGMILTNRQSYMIGECA
TTCTVSTWSSWTTCSGVCGEMRSRTRSVLSFPRYDYEYCPHLIEYSNCVV
QNKCPENCPQYGVSILGWGCQFESTFSFNKNLFVSYEEDWRGCMSTCKQD
PFCVAWSYNATLSEGPDSVGFSREYRPCYTHRFASGCQALAPGWVSGNKN
TINVDCETGTCIHNEWSSWTTCKPCSNTETMSRNRTVKTVSQNWASTPCR
DETQIQLCSENPQSIETCKTCLVGGWSWSDCSTSCGEGNRVRTREVTKPP
LNGDDSTCPELIEKESCNKDVECPHVQCELGEWSSWSPCSVTCGCGTTTR
NREVKGENCTELSTESKKCNLANCDDNSASCTAVMSVWSEWSVCSEKCDQ
GVVRRYRDFDFTKIGVFGYNPPGTSEEQNKVREICKDT
```

6) TSP1 domain-containing protein TSP7 precursor (Chrom 60103, start position 12, end position 1982) is encoded by the nucleotide sequence:

```
                                        (SEQ ID NO. 11)
ATGGATTCAATTAACTTTAGAAGCATTTATATTCCATCAGCAGTGAGGTA
TATTATATTACTTTTATTATGGACAATATTTACAAAAAATGTTTATAGTG
AAAGTAGTGAAGAAACTTTATTGGGAAGATCAGTATTGGATTTAAACAAG
AAAAATACATGTGAATACTATGGAGAGCAGGATGGTATGTTTACTGATTC
ATTTCATTCAAGAATATGTATAGTTCCAGAAGATGGATTACATGGAAAAA
GGGAATATGAAAATCATCAAAAAAAAACATTTGGAACAATTAGACCAAAT
AATAAACAATTATCTGATAATAAATTATATAGGAAAGATGATGATTTAAC
TTCTTCAATTGCAGATTTTGATAGTAATTCTGTGAGAATACAGAGAAAAA
ACGTGGATTTAGAAGCTATGTTTGGAATAGGAAAAGATAACAACAGAATG
AATCTTAATAATGAAGCAATTCAAAGTTTCTATTCAAATAATGAAACAGA
AAGCCAAGATAAGAATGCGACAAACGACTATTTTTTATTTAAAGAAGGAC
TTTTGAAATTTCAAGAGAAAAAGATATTAAGATATTATTTATATGATGTA
GGAAATAAAGTCTATTCAGATACTATAGCTTATCCAGAAAATGTTATATC
AGAAAACTGTGCATTTAACTATTTGGGGAATTATGTAGATGTTTATGAAA
TTAGTAAAGTATCAGATCCACCAGTAATTTCATGGCCAAATAATCACATA
GTTTTTATACACTCTCAGGTAAAATCTGATGGTACATTTAAATTTCAAGT
ATATACTAGCTCAGGAGAGATAGGATTTTATTTTGAAGTAACTGATAATA
GTTATAAAACAGGTTGTGGTAGTTATTCTAGAGTTGATAAAAGCAAATTT
ACTCACTCTGCAAATTCTTTAATTCAAGTTCAATTAGTAAGAAGAAAGTT
TGGATTTAATGTATTTGTTGATGGTACTAGAAGAACACAACTAGATATAA
TTGATTGTATTGCAAGTGTTCCAACTAAAGTTCAAATAACTAGTGGATCA
GGATCACAAATTTATCCAAAAGTAGAAGATTGTCAAATTTCACAGTGGAC
AGATTGGTCAACTTGTTCAAAAACTTGCTCAACTGGTTCAAAAGCTAGAT
ACCGTTCAGTAATTATGCCAAGTATGAATGGTGGTTTACCATGTCCTAAA
TTACTTGATTCAAGTCCTTGTAATGCTGATATTTCATGCTCATCATGCCA
ATATTCGGAATGGACAATGTGGGGTGAGTGCTCAGCTACTTGTGGATCAG
GATCAACAACCAGAACAAGAAAGTTATTAAGTGCAGCATATTTTATTGAA
AGCTGTATTGATACATTCCAATTAAAATCTTGCCATGGTGTTTCTTGCGC
TAGTGATTGTATTGTAACAGAATGGTCAGATTGGAGCGAATGTAGTACAA
CTTGCGGTGTTGGAAGTCAAATTTCCACAAGATCCATAGTTGTTCCAGAA
CAAAATGGTGGAAAATGTGATTATGATCTTAGCAAAATCCAAGAATGCAA
TGTTTCTGTTTGCTCCAAGTCTTGTGATCCTTCTCCATGCTTAAATGGCG
GTATTTGTAGTGAACTACCAAAGTCAAACTTCGCTTGTACATGCCCGCCA
TTTTACGGAGGTGAAACTTGTGATCAATTTGAATTTCCTTGGTGGTTTTA
TAGTGTTATAATTGTTTTAGTTGTTTTGGCTATTGGGATATTTTATAAGT
CACAAATTTCAAATATAGTTACTCCAAATACAATGGATCCTTCATATGCA
GGAGATGGGGATTATGCCTTCAGTCAAGGCCCTGGTCCCCCAGATCCATT
GCAAGCAGCAAATGGACAACCTCAATACTACCAAAATACGTATAATTACA
ACTATGGGTATTATGACAATTCTAATGAAGGATATTTGGTAAATAATGAT
GAAGGAAATTGGATGTACTAG
``` and has amino acid sequence:

```
                                        (SEQ ID NO. 12)
MDSINFRSIYIPSAVRYIILLLLWTIFTKNVYSESSEETLLGRSVLDLNK
KNTCEYYGEQDGMFTDSFHSRICIVPEDGLHGKREYENHQKKTFGTIRPN
```

-continued
NKQLSDNKLYRKDDHLTSSIADFDSNSVRIQRKNVDLEAMFGIGKDNNRM

NLNNEAIQSFYSNNETESQDKNATNDYFLFKBGLLKFQEKKILRYYLYDV

GNKVYSDTIAYPENVISENSAFNYLGNYVDVYEISKVSDPPVISWPNMHI

VFIHSQVKSDGTFKFQVYTSSGEIGFYFEVTDNSYKTGCGSYSRVDKSKF

THSANSLIQVQLVRRKFGFNVFVDGTRRTQLDIIDCIASVPTKVQITSGS

GSQIYPKVEDCQISQWTDWSTCSKTCSTGSKARYRSVIMPSMNGGLPCPK

LLDSSPCNADISCSSCQYSEWTMWGECSATCGSGSTTRTRKLLSAAYFIE

SCIDTFQLKSCHGVSCASDCIVTEWSDWSECSTTCGVGSQISTRSIVVPE

QNGGKCDYDLSKIQECNVSVCSKSCDPSPCLNGGICSELPKSNFACTCPP

FYGGETCDQFEFPWWFYSVIIVLVVLAIGIFYKSQISNIVTPNTMDPSYA

GDGDYAFSQGPAPPDPLQAANGQPQYYQNTYNYNYGYYDNSNEGYLVNND

EGNWMY

7) Protein similar to riken cDNA 5830420c20 gene (Chrom 60194, start position 15004, end position 16041) is encoded by the nucleotide sequence:

(SEQ ID NO. 13)
ATGAAAGAATCAGGCACAATTAATTATCTAATAACATTTACATTCATTAT

TCCTTTCGTACTTTCCCAGTCAACATTATTAAATCTTGGTGCAGGGGTA

TACAGGAAAGGAGGGTTTGCACTGACGAAATGCCATGTAACTTTAGATTG

GTTGCTGATTTAGATATGAAGTCAAAGCCAGGGAGTGGGGAAAAGAATTA

CAAAAGTTTATTTCAAAAAGGGTCAATAATACAAGACAAAAGGGGCAACT

ATCGAGTGTACTGGGGAGAAAGTCTGGAACTTAAAAGCGGATATAATGAA

TATGGGAGAGGGATGGAATTAAGTGAGTTGATTTCATATAATGGAATGAT

GCTTGCGGGCGACGACCGTACAGGAATAATTTTTGAAATAACTGATGATG

GAAAAGGAGTAGCACCAAGATATATATTATCTGAAGGTAATGGAAGAACA

GCTAAGGGAATGAAGATTGAGTGGTTTGCTGTAAGAGATGGAATATTGTG

GGTTGGCAGTTTTGGAAAAGAGTTCGTATCAAACGGCATAATAGAAAAAA

GAGATAAATATGTGGGTAGCCACAATTGATAAAAGAGGATATGTTTCACGA

TTTAATTGGAGTTTTGTTTATGAAAAAATTAGGAATTCACTGGGGCGCA

ATATCCAGGTTATTGCATTCATGAAGCAGTGATTTGGAGTCATTTAATGA

GAAAGTGGATATTTTTACCAAGAAGAGTTAGCTTCGATGAGTATGATGAG

GAGAAAGACGAAAAGAGAGGTTCCAATAAAATGATAATTATGACAGATGA

TTTTGAAATTCTTGAAATTATTGACGTAGGATTGATAATACCTGAAAGAG

GTTTTTCTTCTTTAAAATTTCTTCCTGGGTCGTTTGACCAGATAATAGTT

GCAACAAAAAGCGTTGAAGAATCAATTTCAGACACTCAAAAGTCTTTCTT

AACTATATTCACAATAAATGGAAAAATTTTAATGGAAGATTTAGAAGTGC

CTGGAGACTACAAATACGAGGGGATAGAATTTATATAG and has amino acid sequence:

(SEQ ED NO. 14)
MKESGTINYLITFTFIIPFVLSQSTLLNLGAGGIQERRVCTDEMPCNFRL

VADLDMKSKPGSGEKNYKSLFQKGSIIQDKRGNYRVYWGESLELKSGYNE

YGRGMELSELISYNGMMLAGDDRTGIIFEITDDGKGVAPRYILSEGNGRT

AKGMKIEWFAVRDGILWVGSFGKEFVSNGIIEKRDNMWVATIDKRGYVSR

FNWSFVYEKIRNSLGAQYPGYCIHEAVIWSHLMRKWIFLPRRVSFDEYDE

EKDEKRGSNKMIIMTDDFEILEIIDVGLIIPERGFSSLKFLPGSFDQIIV

ATKSVEESISDTQKSFLTIFTINGKILMEDLEVPGDYKYEGIEFI

8) SPFH domain/Band 7 family protein (Chrom 50147, start position 5008, end position 5850) is encoded by the nucleotide sequence:

(SEQ ID NO. 15)
ATGTCGAGAATTGAAAAAGGTTTTAACATCTTAGCTAACTTGGGGATAAT

GCTGGTTGCAGGTGGAAGCATTTTGGCGTCTAATAGTATGTATAACGTGG

ATGCTGGACACAGAGCAATAAAGTTCTCAAGAATACATGGAGTTCAAAAA

AGGATTATGGAGAAGGAACTGATTTTATGCTACCTTGGATTGAAAGACC

AGTGATATTTGACATCAGAGCGAGACCTCGAGTTGTTGTATCTCTAACGG

GAAGTAAAGATCTTCAAATGGTGAATATTACGTGCAGAGTTTTATCAAGG

CCTGATAAAGATAAGCTGGTGGAAATATATAGAAATATAGGGCTGGATCA

CGATGAGAAGATTCTTCCATCAATAATTAATGAAGTGCTAAAATCAGTAG

TGGCTCAGTATAATGCTTCTCAACTACTAACTATGAGAGAAGACGTGAGC

AAAACAATCCGAGATTTACTGGTAAAAAGAGCCCAAGAGTTTAATATTAT

TCTGGATGATGTCTCTTTAACCCATTTAAGCTTTTCTCAGGATTATGAAA

AGGCTGTAGAGTCCAAGCAAGTTGCTCAACAACAAGCAGAAAGAGCGAAA

TATCTTGTTCTCAAGGCAAACGAAGAGAAAAAAAGTACTATTATTAAGGC

TGAAGGCGAAGCAAAAGCTGCAAAACTAATTGGAGATGCGATAAATGAGA

ATCCTGCCTTTATTGCTGTTAAACAGGTGGAGACTTATAGAGAAATCTCT

AATATTTTAGCAAAATCAACTTCTAAATCGCTTATAAATCTTTCATCATT

TTTGCCAAACCTCCCAAATAGTAATTTACAATCATCTTGTTAG and has amino acid sequence:

(SEQ ID NO. 16)
MSRIEKGFNILANLGIMLVAGGSILASNSMYNVDAGHRAIKFSRIHGVQK

RIYGEGTHFMLPWIERPVIFDIRARPRVVVSLTGSKDLQMVNITCRVLSR

PDKDKLVEIYRNIGLDHDEKILPSIINEVLKSVVAQYNASQLLTMREDVS

KTIRDLLVKRAQEFNIILDDVSLTHLSFSQDYEKAVESKQVAQQQAERAK

YLVLKANEEKKSTIIKAEGEAKAAKLIGDAINENPAFIALKQVETYREIS

NILAKSTSKSLINLSSFLPNLPNSNLQSSC

9) UDP-N-acetyl-D-galactosamine:polypeptide N-acetylgalactosaminyltransferase T4 protein (Chrom 70457, start position 44914, end position 46158) is encoded by the nucleotide sequence:

(SEQ ID NO. 17)
ATGAGGAACGCATTCCCTCTCGGGCTGTCAATATGTTATTTGATGTTGAA

AGTTGCATTGACTACTTTTGTTTTTGGGTCAAAAGAAGAGTTTACAACAC

-continued
TCCCTAGAGAATTAATAAACTCTTGGTTGGAAGAAAATGAATATGCTGGA

TTATATGGAAAATCAGATATTTTTTCAATTGTAATAATACCAGACTGTGA

AGATAATGAATTGATTGATGTTACAATAAATAGTATACTTTTGACTGCAA

ATCGAAATTTACTTCATGAAATAATAATTATTTCAAATGATTGTCAAGAC

TCTGGAAAAGATATTAAAAGTTATTTGGGTGAGAAATTCTTGGATAAGCC

TTTGATTAAAATAATTGAGACTGAATTACAAGAATTGGGAGAATTACAGA

ATCTTGGAGCAAATAATTGAACTGGGGAAATCATTTTATTTGTTCCGTCT

GCAACTCTTTTTCCAAAAAATTGGATGTCACCAATAATGAGGAGTTTAAG

TGATAATTATAAATCAATAATAGTTCCAAGATTTAAAAAATTGAATAAAA

ACAAATGGGCATTTTCGAACAATGATCCTGTATATTCACCAAAAATGATG

TTCACAAAAGAATTTGAATTAACAAATATCCATACATTAGATAATAAAGT

TCCAATGTTCTATTCAAAAATCTTTGCAATAACAAAATCATGGTGGTTAA

ATATATCAAAGCTTTCAGATCCAACAATTAACCTGATATTCAAAACGAGT

ATTAACTTTGATATTTCTCTAAGATCATGGAATTGTGGTGGGCGAGTAGC

TCAGATAGCAGAACTGTCATTTGGTGTAACTAAGGTAAAAATCTCACAAC

CTTCGTTAGAAATAAGACAAGTTCTATTGGAATCTTGGATAGATGAGCCA

ACCAAGCAGATGATTATGAATAATAGTGAGAAGCTGGCTAACTATATGAA

ACTATCATCAGGATTATTTGAGGTATTGATAAATAAACGTAAGGAACTCA

TTAAAGAGTATGAATGTGACCAAAAGTCAATATTTACTTCAAAATTTTAT

AATGAGTTGAGCGAATTTGGACTAATAGAATATCCAAAAAGTCAAATAGT

TTTTAGTGGTAATGGCAAATGCTTCACATTAATTGGGAACGAGAAAAAAA

GTGGAGAAAAGAATTTCGAGTTAAAGTTATCAGAATGTAAACCAATGAA

AATGCACAAATATTCTACATTGACAATGAGAGTAAGTTGATCTAG and has amino acid sequence:

(SEQ ID NO. 18)
MRNAFPLGLSICYLMLKVALTTFVFGSKEEFTTLPRELINSWLEENEYAG

LYGKSDIFSIVIIPDCEDNELIDVTINSILLTANRNLLHEIIISNDCQD

SGKDIKSYLGEKFLDKPLIKIIETELQELGELQNLGANNSTGEIIILFVP

SATLFPKNWMSPIMRSLSDNYKSIIVPRFKKLNKNKWAFSNNDPVYSPKM

MFTKEFELTNIHTLDNKVPMFYSKIFAITKSWWLNISKLSDPTINLIFKT

SINFDISLRSWNCGGRVAQIAELSFGVTKVKISQPSLEIRQVLLESWIDE

PTKQMIMNNSEKLANYMKLSSGLFEVLINKRKELIKEYECDQKSIFTSKF

YNELSEFGLIEYPKSQIVFSGNGKCFTLIGNEKKSGEKNFELKLSECKPN

ENAQIFYIDNESKLI

10) ABC transporter ATP-binding protein (Chro.70309, start position 5325, end position 7046) is encoded by the nucleotide sequence:

(SEQ ID NO. 19)
ATGCTTATTATAAACGGAGCAATTAATTGTGCTAGAACTGATATGTCGAT

TCGAATTCAAATTGATTTAAGGATGTGGCTAACTAATTTGATTTTGAAAC

AATATTATTCTGATTTAACTTACTATCAGTTCTCAATAAATAAAACGATT

GATAATCCTGACCAAAGAATTGGAGAGGACATTTCACTGTTTTCATCACA

TTTATTATTGTTAATATGTCGTTGTATAGACAACTTATTTGACTTTTTTG

TTTATTCAATCTTGCTATACAATGTTAATTTCAAATTGTTTATTTCAGCA

ATTATTTATTCTTGTTTTGGCACATTTTTAACTGCTAAATTAGGCATGAA

TATAATATTATTAAAAGTTCAAGAAAAAAAGCTTGAAAGTGATTTTAGAT

ATTCAATTATGAGAGTTGGTGAAAATGCAGAAAATGTTGCAATGTATGGA

GGAGCTCAGTGCGAGATGGAAAGACATGAACAAATTTTAAATTCATTGCT

TCTCAACTTAACTACGAAAAGATCATTTGAATCTAAAATGGGACTCTTTG

GAAGTATTTTTAGAAACCTAATACGTGTTCTGCCTATTGCGGTTATTTCA

GGAGACTACTTTTCAGGAAATATCCAACTTGGAAGAATTAATCAGTGTAG

CCTTGCATTTAACAGTATAGTTGAAGATATTTCAATTTTGGTCAATACTT

TTAGAGAAATAAGTAATCTACTTTCTTCAATAGATAGAGTAGGACATTTT

ATTGCATTGATGGCAGATAACTATATTGAATCTCAATCTATAAATATTGG

AGAGAAATTGATTAGTAGTTTTGAGAGTGATTCTAAAACTAGCAAAAAAA

TTGATTTCTTACATCTTGAAAGCGAGTTTTCAAGACAAATGAAGGAAAAA

TCTTTAGAATTTAAACTTAATTTCTCGACAGGAATTGCTTCTAAGTCATT

AAAAAATTGTGTTAAATTAGAATTTACAAACACTCAGGGGAAATCTTCGG

TTAATATACGTGGAAAAATTAGATCAGTAATATGGCCAGAACCAAAAATT

AAGTTTGAAAGTGTATCGATTAATACTCCGGAAGAATATCCCAGGAAACT

TCTTTTTAATATAAACTTTATGATTGAACAAAGCGATAAAGTCTTAATAA

CAGGGGACTCCGGTGTTGGGAAATCATCACTCTTAAAGGTAATTTGTGGG

ATTTGGAATAATGGGTCAGGAAATATTTATAGGCCACCTTCTAGTGAATT

ATTATTTATACCGCAAAAACCCTACTGTACCCAAGCAACGCTAAGGGAAC

AACTGTTTTATCCGCAAATACCCTCAATTAAAACTAATGGTTATGAATAT

AAAAATAAGGAAGAACTAGATTCATATCTATTGAAAATTCTTGAGGAAGT

TGGGCTGAAATATCTATGTGATCGACTTTCTGAAAGTGAAACAGTTAATT

GCTTAGACACCATTAAAGACTGGTCAACAATACTTTCGCTTGGAGAACAG

CAAAGACTTGCATTTGCAAGAATATTTATTTTCAAACCATCTATTTGTTT

CCTTGATGAAGCTACAAGTGCGTTAGACATGGAGACTGAAACAAAATTAT

ATTCAATGCTAAATAAAAAAAACTTTACATACGTTAGTGTAGGTCACAGG

CCCTCAATATCAATATTTCACAACAAAAAAGTCCTTATAAAAAATGGTAA

TATAATTTTTGAATGTATATGA and has amino acid sequence:

(SEQ ID NO. 20)
MLIINGAINCARTDMSIRIQIDLRMWLTNLILKQYYSDLTYYQFSINKTI

DNPDQRIGEDISLFSSHLLLLICRCIDNLFDFFVYSILLYNVNFKLFISA

IIYSCFGTFLTAKLGMNIILLKVQEKKLESDFRYSIMRVGENAENVAMYG

GAQCEMRRHEQILNSLLLNLTTKRSFESKMGLFGSIFRNLIRVLPIAVIS

GDYFSGNIQLGRINQCSLAFNSIVEDISILVNTFREISNLLSSIDRVGLF

IALMADNYIESQSINIGEKLISSFESDSKTSKKIDFLHLESEFSRQMKEK

-continued

SLEFKLNFSTGIASKSLKNCVKLEFTNTQGKSSVNIRGKIRSVIWPEPKI

KFESVSINTPEEYPRKLLFNINFMIEQSDKVLITGDSGVGKSSLLKVICG

IWNNGSGNIYRPPSSELLFIPQKPYCTQATLREQLFYPQIFSIKTNGYEY

KNKEELDSYLLKILEEVGLKYLCDRLSESETVNCLDTIKDWSTILSLGEQ

QRLAFARIFIFKPSICFLDEATSALDMETETKLYSMLNKKNFTYVSVGHR

PSISIFHNKKVLIKNGNIIFECI

11) Sporozoite cysteine-rich protein (Chro.60102, start position 11337, end position 12380) is encoded by the nucleotide sequence:

(SEQ ID NO. 21)
ATGTTAGAATTTAGACAATATGATTTAAAGTTTATGAAAATGAAAGAAT

TTTGTATTTTATATTAATACATATTCTTATATTTAATATTTTAGAAATAA

ATTCTTTACCACCAAGTTTTAGTTGGACAAAAGCATGGAAAGATATTACC

AGTGAAGGGTTAGTATATACATTTAGTTCAAATAAGCTACCTTGGTATTC

TGGAGTATCTTTTAGGATTGTGGGTAAATTTAACGCAGAAAATGATAAAG

AAACTTTGGTAACAATTCAGAATGGTGATTTATACCACTGTAAGTTGATT

ATAAATTTTGCAGCACAAACAGTAGATGTGGAATCTACAGGATATACTGC

AGAAGAGAGATGGGCTAGATCTTATGCTTACTTTCCATTTCCATATAAGC

CAAAATTGATGGATCTTGACTTGGTAGTTGAGAAATTAAGATGGCCAGGA

GGGTTTTACTTTTATATTTCAGGAAGTGGACCATATTATCCTTGTCATAG

CATAGTGTATTCAAATGTGAATAAATTAACTTTTGGTAATGGACAAAATA

ACTTTAGTAAATATAAAATTACAAGAAATGTTCCTTTGGCAGATCCTTAT

AGAAGGACTTATTTCTGGGACGAATTTCAACAAAGATACTATTTTGATGA

TAAAAATTTGTATTATGTAAATAGCACCGGAATTGATGAGAAAATCTGGA

GTACCAAATGGTGATAGAATTCCAAAACATTATAAATCTTGGCCAGAAGA

ACTAGAAATACATGTACATTCAGCAAGTATGTACCCAGTTAATGATAAAA

GATACGGATGGGGAGGTACGGTAGCAGTATTTACAAGCGATCAGAGTCAG

TTTTATTATAGAATGAATGGATTTTTTGCAACTTTGTCAAGTAATTCATA

TTGTTTAAGTTCGAGTGTATTATTAAGTGGGACAAGTTATACAGTTAGTG

GAGATTATCCTTTTGATTTTGATAATCCAGGTCAACCTTTCAATGTAAGT

TTACTTATGATTATTAAGATAATAAGCCTATTTATTATGAGGTAG and has amino acid sequence:

(SEQ ID NO. 22)
MLEFRQYDLKFMKMKRILYFILIHILIFNILEINSLPPSFSWTKAWKDIT

SEGLVYTFSSNKLPWYSGVSFRIVGKFNAENDKETLVTIQNGDLYHCKLI

INFAAQTVDVESTGYTAEERWARSYAYFPFPYKPKLMDLDLVVEKLRWPG

GFYFYISGSGPYYPCHSIVYSNVNKLTFGNGQNNFSKYKITRNVPLADPY

RRTYFWDEFQQRYYFDDKNLYYVNSTGIDEKSGVPNGDRIPKHYKSWPEE

LEIHVHSASMYPVNDKRYGWGGTVAVFTSDQSQFYYRMNGFFATLSSNSY

CLSSSVLLSGTSYTVSGDYPFDFDNPGQPFNVSLLMIIKIISLFIMR 12) 19K sporozoite antigen "profilin" (Chro.30189 start position 2297, end position 2785) is encoded by the nucleotide sequence:

(SEQ ID NO. 23)
ATGTCTGAATGGGATGATATGGTCAAAGAATGGTTAATTGACACCGGTAG

TGTATGTGCTGGTGGTCTTTGTTCAATAGATGGTGCATTCTATGCTGCTT

CTGCTGATCAAGGTGATGCCTGGAAGACTCTTGTTAGAGAAGATCATGAA

GAAAATGTTATTCAATCCGACGGAGTTTCAGAGGCTGCTGAATTAATTAA

TGATCAAACTACACTATGCCAAGCTATCTCTGAGGGTAAGGCACCAAACG

GCGTTTGGGTCGGAGGAAACAAATATAAGATTATCCGCGTAGAGAAGGAC

TTCCAACAAAACGATGCTATTGTTAATGTTACATTCTGTAACAAACCTCA

AGGTGGATGTTTTTTAGTTGATACTCAAAACGGTACTGTTGTCGTTGCGG

TTTACGACGAATCCAAAGATCAATCATCAGGTAATTGCAAGAAGGTTGCT

TTGCAACTGGCCGAGTACCTCGTATCTCAGGGATACTAA and has amino acid sequence:

(SEQ ID NO. 24)
MSEWDDMVKEWLIDTGSVCAGGLCSIDGAFYAASADQGDAWKTLVREDHE

ENVIQSDGVSEAAELINDQTTLCQAISEGKAPNGVWVGGNKYKIIRVEKD

FQQNDAIVNVTFCNKPQGGCFLVDTQNGTVVVAVYDESKDQSSGNCKKVA

LQLAEYLVSQGY

Example 3

Immunotherapy

*C. hominis* proteins have been overexpressed in *E. coli* and isolated, and are tested in model systems to examine their abilities to induce a protective immune response. Animal models of *Cryptosporidium* infection have demonstrated the role of both cell and humoral immune responses (1, 2). Thus, mice with targeted disruptions of genes encoding immunological important molecules have established the role of these proteins in the immune response against *Cryptosporidium* (1-7). Other studies of the immune response against *Cryptosporidium* use neonatal mice and mice lacking functional T or B cell responses (1, 8, 9). These studies have demonstrated how an immune response is induced in mice that are not immuno-competent. Adult mice are resistant to the infection with *Cryptosporidium* but the injection of an antibody against Interferon Gamma (IFN γ) prior to infection render them susceptible to *Cryptosporidium* (10, 13). IFN γ plays an important role in the induction of an immune response against many microorganisms, and many studies have shown that it is one of the key components of the immune response against *Cryptosporidium* infections (11-17). Thus the temporary neutralization of IFN γ by the administration of the antibody in adult mice is an excellent tool to study and characterize the immune response in the context of an immunocompetent animal (10).

The IFN knockdown mouse model follows a pattern of infection very similar to that seen in severe clinical infections (10). During the infection the animals lost weight and then regained it during recovery. This is also similar to what is observed in metabolically stressed children during and after diarrheal diseases. The predominant site of infection was the small intestine as it has been observed in animal and human severe infections. No parasites can be detected by day 30, thus the level of infection achieved is enough to generate an immune response, which also it is demonstrated by the detection of cellular responses against *Cryptosporidium* antigen extracts and proteins with lymphocytes obtained from the treated animals. Thus this model offers the possibility to study the potential role of *Cryptosporidium* as the animal can mount a parasite specific immune response (10).

We use this model (and alternative models such as a malnourished mouse model, unpublished) to study the potential role of *Cryptosporidium* recombinant proteins and plasmid DNA containing *Cryptosporidium* genes to induce an immune response. Our protocol to carry out this study is outlined in brief below. Subject mice are divided in groups: Group I mice are immunized with a pool of recombinant antigens (or plasmids in the case of DNA vaccine) in adjuvant (Freund's or other as appropriate); Group II (control animals) are immunized with Freund's adjuvant alone (or plasmid with no insert in the case of a DNA vaccine). The immunological responses in each group are followed and the response to challenge is measured. A sample immunization schedule is outlined below:

1) Day 0: Immunization with a pool of recombinant antigens (2-3 μg each), DNA (20-100 μg) or controls. Immunization is performed intraperitoneally or intranasally.
2) Day 14: Boost Immunization with the same antigens (protein, DNA, control). Boost is administered intranasally.
3) Day 28: Anti-IFN-γ Ab inoculation, intraperitoneally, 2 h prior to *Cryptosporidium* infection.
4) Day 28 (2 hr after inoculation of anti-IFN-γ Ab): Infection with *Cryptosporidium.*

The immune response and protection to infection is monitored. A sample protocol is outlined below:

1) Serum samples are collected at day 0, 7, 14 and 28 to monitor the immune response. Antibody levels against fusion proteins and *Cryptosporidium* extract are measured by immunoblotting and indirect immunofluorescence.
2) Fecal IgA responses are measured before and after vaccination and infection.
3) Fecal shedding of *Cryptosporidium* is monitored by fluorescent microscopy and real time PCR three times per week after infection
4) Cytokine and lymphoproliferation responses are examined by isolation of mesenteric lymphocyte node and spleen cells to detect cytokine responses and lymphoproliferation against antigens (those that can be purified) and against a *Cryptosporidium* preparation.

These results indicate proteins which induce an antibody (mucosal or humoral) or cellular immune response. More important, these results indicate which immune response is protective and reduces infection (and shedding) by the exposed animal.

REFERENCES FOR EXAMPLE 3

1. Riggs M W. Recent advances in cryptosporidiosis: the immune response. Microbes Infect. 2002. (10): 1067-80.
2. Lean I S, McDonald V, Pollok R C. The role of cytolines in the pathogenesis of *Cryptosporidium* infection. Curr Opin Infect Dis. 2002. 15(3): 229-34.
3. Ehigiator H N, Romagnoli P, Borgelt K, Fernandez M, McNair N, Secor W E, Mead J R. Mucosal cytokine and antigen-specific responses to *Cryptosporidium parvum* in IL-12p40 KO mice. Parasite Immunol. 2005. 27(1-2): 17-28.
4. Chen W, Harp J A, Harmsen A G. *Cryptosporidium parvum* infection in gene-targeted B cell-deficient mice. J. Parasitol. 2003. 89(2): 391-3.
5. Davami M H, Bancroft G J, McDonald V. *Cryptosporidium* infection in major histocompatibility complex congeneic strains of mice: variation in susceptibility and the role of T-cell cytokine responses. Parasitol Res. 1997. 83(3): 257-63.
6: Lacroix S, Mancassola R, Naciri M, Laurent F. *Cryptosporidium parvum*-specific mucosal immune response in C57BL/6 neonatal and gamma interferon-deficient mice: role of tumor necrosis factor alpha in protection. Infect Immun. 2001. 69(3): 1635-42.
7. McDonald S A, O'Grady J E, Bajaj-Elliott M, Notley C A, Alexander J, Brombacher F, McDonald V. Protection against the early acute phase of *Cryptosporidium parvum* infection conferred by interleukin-4-induced expression of T helper 1 cytokines. J Infect Dis. 2004. 190(5): 1019-25.
8. McDonald V, Deer R, Uni S, Iseki M, Bancroft G J. Immune responses to *Cryptosporidium muris* and *Cryptosporidium parvum* in adult immunocompetent or immunocompromised (nude and SCID) mice. Infect Immun. 1992. 60(8): 3325-31.
9. Kuhls T L, Greenfield R A, Mosier D A, Crawford D L, Joyce W A. Cryptosporidiosis in adult and neonatal mice with severe combined immunodeficiency. J. Comp Pathol. 1992. 106(4): 399-410.
10. Theodos C M, Sullivan K L, Griffiths J K, Tzipori S. Profiles of healing and nonhealing *Cryptosporidium parvum* infection in C57BL/6 mice with functional B and T lymphocytes: the extent of gamma interferon modulation determines the outcome of infection. Infect Immun. 1997 65(11): 4761-9.
11. You X, Mead J R. Characterization of experimental *Cryptosporidium parvum* infection in IFN-gamma knockout mice. Parasitology. 1998. 117: 525-31.
12. Mead J R, You X. Susceptibility differences to *Cryptosporidium parvum* infection in two strains of gamma interferon knockout mice. J. Parasitol. 1998. 84(5): 1045-8
13. Griffiths J K, Theodos C, Paris M, Tzipori S. The gamma interferon gene knockout mouse: a highly sensitive model for evaluation of therapeutic agents against *Cryptosporidium parvum*. J Clin Microbiol. 1998. 36(9): 2503-8.
14. Pollok R C, Farthing M J, Bajaj-Elliott M, Sanderson I R, McDonald V. Interferon gamma induces enterocyte resistance against infection by the intracellular pathogen *Cryptosporidium parvum*. Gastroenterology. 2001. 20: 99-107.
15. Aguirre S A, Perryman L E, Davis W C, McGuire T C. IL-4 protects adult C57BL/6 mice from prolonged *Cryptosporidium parvum* infection: analysis of CD4+alpha beta+IFN− gamma+ and CD4+alpha beta+IL-4+lymphocytes in gut-associated lymphoid tissue during resolution of infection. J. Immunol. 1998. 161: 1891-900.
16: Lehmann J, Enssle K H, Lehmann I, Emmendorfer A, Lohmann-Matthes M L. The capacity to produce IFN-gamma rather than the presence of interleukin-4 determines the resistance and the degree of susceptibility to *Leishmania donovani* infection in mice. J Interferon Cytokine Res. 2000. 20: 63-77.
17. Lacroix S, Mancassola R, Naciri M, Laurent F. *Cryptosporidium parvum*-specific mucosal immune response in C57BL/6 neonatal and gamma interferon-deficient mice: role of tumor necrosis factor alpha in protection. Infect Immun. 2001. 69: 1635-42.

Example 4

Development of Chemotherapeutic Agents

The approach to the development of chemotherapeutic intervention strategies parallels the selection of candidate vaccinogens using genome sequence data and informatics approaches. The rationale is that weak links in the parasite's biology can be identified by examining its genome. For example, several hundred likely essential transporter proteins that are responsible for importing essential nutrients into the parasite have been identified (see Table 3). Without these transporters, the parasite is unable to obtain required building blocks and therefore is unable to survive. Inhibition of one or more transporters (for example, by small molecule inhibitors or by antibodies) is a useful strategy for prevention or treatment of the *C. hominis* related disease.

The process for development of these agents includes the following steps:

1) Informatic pathway annotation and analysis to identify the processes known to be active in the parasite. This work has been completed, although updates are included with technology advances.
2) Network and topological analysis are applied to identify nodes that are considered 'critical elements' or 'essential steps'. This analysis involves a series of mathematical and computational steps to identify those proteins that, when inhibited, are most likely to result in death or growth inhibition of the parasite. Examples of such 'critical elements' include transporters for essential nutrients (ions, amino acids, nucleotides, sugars, etc.) for which no substitute is available, essential steps in energy metabolism (e.g., glycolysis, regeneration of NADP, etc.), intermediary metabolism (e.g., carbohydrate anabolism and catabolism), biosynthesis (nucleotide interconversion, amino acid interconversion, synthesis of amylopectin, fatty acid biosynthesis), and other essential pathways.
3) Genes that encode proteins that are deemed likely to be 'critical elements' according to step 2, are cloned and expressed in bacterial systems as outlined above. The gene products (proteins) are then tested for activity and examined for inhibition by libraries of potential inhibitory compounds. This is performed in collaboration with pharmaceutical companies that maintain batteries of such compounds.
4) In parallel with #3, the proteins are crystallized and subjected to X-Ray crystallography to identify their 3D structures.
5) The 3D structures are used in 'rational drug design' to identify categories of potentially inhibitory compounds.

For example, we have identified the zinc transporter (see above) as a focus of these investigations. *Cryptosporidium*, like all living organisms, requires divalent cations like zinc. This compound must be actively imported into the cell. In the absence of zinc, or if the organism is unable to import it from its surroundings, *Cryptosporidium* will die. Thus, we have cloned and expressed the *Cryptosporidium* zinc transporter and will now search for compounds that inhibit its activity. In parallel, the structure of the transporter will be determined to further guide selection of potential inhibitory compounds.

Example 5

Development of DNA Vaccine

Plasmid DNA was also isolated using the EndoFree plasmid Giga Kit (Qiagen) and is used as an antigen to be injected in mice to test their protective role against *Cryptosporidium*. Animal models of *Cryptosporidium* infection have demonstrated the role of both cell and humoral immune responses (1, 2). Thus, mice with targeted disruptions of genes encoding immunological important molecules have established the role of these proteins in the immune response against *Cryptosporidium* (1-7). Other studies of the immune response against *Cryptosporidium* use neonatal mice and mice lacking functional T or B cell responses (1, 8, 9). These studies have demonstrated how an immune response is induced in mice that are not immuno-competent. Adult mice are resistant to the infection with *Cryptosporidium* but the injection of an antibody against Interferon Gamma (IFN γ) prior to infection render them susceptible to *Cryptosporidium* (10, 13). IFN γ plays an important role in the induction of an immune response against many microorganisms, and many studies have shown that it is one of the key components of the immune response against *Cryptosporidium* infections (11-17). Thus the temporary neutralization of IFN γ by the administration of the antibody in adult mice is an excellent tool to study and characterize the immune response in the context of an immunocompetent animal (c.f., 10).

The IFN knockdown mouse model follows a pattern of infection very similar to that seen in severe clinical infections (10). During the infection the animals lost weight and then regained it during recovery. This is also similar to what is observed in metabolically stressed children during and after diarrheal diseases. The predominant site of infection was the small intestine as it has been observed in animal and human severe infections. No parasites can be detected by day 30, thus the level of infection achieved is enough to generate an immune response, which also it is demonstrated by the detection of cellular responses against *Cryptosporidium* antigen extracts and proteins with lymphocytes obtained from the treated animals. Thus this model offers the possibility to study the potential role of *Cryptosporidium* as the animal can mount a parasite specific immune response (10).

We use this model (and alternative models such as a malnourished mouse model, unpublished) to study the potential role of *Cryptosporidium* recombinant proteins and plasmid DNA containing *Cryptosporidium* genes to induce an immune response. Our protocol to carry out this study is outlined in brief below. Subject mice are divided in groups: Group I mice are immunized with a pool of recombinant antigens (or plasmids in the case of DNA vaccine) in adjuvant (Freund's or other as appropriate); Group II (control animals) are immunized with Freund's adjuvant alone (or plasmid with no insert in the case of a DNA vaccine). The immunological responses in each group are followed and the response to challenge is measured. A sample immunization schedule is outlined below:

1) Day 0: Immunization with a pool of recombinant antigens (2-3 μg each), DNA (20-100 μg) or controls. Immunization is performed intraperitoneally or intranasally.
2) Day 14: Boost Immunization with the same antigens (protein, DNA, control). Boost is administered intranasally.
3) Day 28: Anti-IFN-γ Ab inoculation, intraperitoneally, 2 h prior to *Cryptosporidium* infection.
4) Day 28 (2 hr after inoculation of anti-IFN-γ Ab): Infection with *Cryptosporidium.*

The immune response and protection to infection is subsequently monitored. A sample protocol is outlined below:
5) Serum samples are collected at day 0, 7, 14 and 28 to monitor the immune response. Antibody levels against fusion proteins and *Cryptosporidium* extract are measured by immunoblotting and indirect immunofluorescence.
6) Fecal IgA responses are measured before and after vaccination and infection.
7) Fecal shedding of *Cryptosporidium* is monitored by fluorescent microscopy and real time PCR three times per week after infection
8) Cytokine and lymphoproliferation responses are examined by isolation of mesenteric lymphocyte node and spleen cells to detect cytokine responses and lymphoproliferation against antigens (those that can be purified) and against a *Cryptosporidium* preparation.

These results indicate proteins which induce an antibody (mucosal or humoral) or cellular immune response. More important, these results indicate which immune response is protective and reduces infection (and shedding) by the exposed animal.

REFERENCES FOR EXAMPLE 5

1. Aguilar-Be I, da Silva Zardo R, Paraguai de Souza E, Borja-Cabrera G P, Rosado-Vallado M, Mut-Martin M, Garcia-Miss Mdel R, Palatnik de Sousa C B, Dumonteil E. Cross-protective efficacy of a prophylactic *Leishmania donovani* DNA vaccine against visceral and cutaneous murine leishmaniasis. Infect Immun. 2005 February; 73(2):812-9.
2. Aguiar J C, LaBaer J, Blair P L, Shamailova V Y, Koundinya M, Russell J A, Huang F, Mar W, Anthony R M, Witney A, Caruana S R, Brizuela L, Sacci J B Jr, Hoffman S L, Carucci D J. High-throughput generation of *P. falciparum* functional molecules by recombinational cloning. Genome Res. 2004 October; 14(10B):2076-82.
3. Wu S Q, Wang M, Liu Q, Zhu Y J, Suo X, Jiang J S. Construction of DNA vaccines and their induced protective immunity against experimental *Eimeria tenella* infection. Parasitol Res. 2004 November; 94(5):332-6.
4. Tborra S, Soto M, Carrion J, Alonso C, Requena J M. Vaccination with a plasmid DNA cocktail encoding the nucleosomal histones of *Leishmania* confers protection against murine cutaneous leishmaniosis. Vaccine. 2004 Sep. 28; 22(29-30):3865-76.
5. Sagodira S, Iochmann S, Mevelec M N, Dimier-Poisson I, Bout D. Nasal immunization of mice with *Cryptosporidium parvum* DNA induces systemic and intestinal immune responses. Parasite Immunol. 1999 October; 21(10):507-16.
6. Sagodira S, Buzoni-Gatel D, Iochmann S, Naciri M, Bout D. Protection of kids against *Cryptosporidium parvum* infection after immunization of dams with CP15-DNA. Vaccine. 1999 May 14; 17(19):2346-55.
7. Jenkins M, Kerr D, Fayer R, Wall R. Serum and colostrum antibody responses induced by jet-injection of sheep with DNA encoding a *Cryptosporidium parvum* antigen. Vaccine. 1995 December; 13(17):1658-64.
8. Huygen K. Plasmid DNA vaccination. Microbes Infect. 2005 May; 7(5-6):932-8.
9. Barouch D H, Letvin N L, Seder R A. The role of cytokine DNAs as vaccine adjuvants for optimizing cellular immune responses. Immunol Rev. 2004 December; 202: 266-74.
10. Sukumaran B, Madhubala R. Leishmaniasis: current status of vaccine development. Curr Mol. Med. 2004 September; 4(6):667-79.
11. Barry M A, Howell D P, Andersson H A, Chen J L, Singh R A. Expression library immunization to discover and improve vaccine antigens. Immunol Rev. 2004 June; 199: 68-83.
12. Leifert J A, Rodriguez-Carreno M P, Rodriguez F, Whitton J L. Targeting plasmid-encoded proteins to the antigen presentation pathways. Immunol Rev. 2004 June; 199:40-53.
13. Howarth M, Elliott T. The processing of antigens delivered as DNA vaccines. Immunol Rev. 2004 June; 199:27-39.
14. Xu F, Ulmer J B. Attenuated *salmonella* and *Shigella* as carriers for DNA vaccines. J Drug Target. 2003; 11(8-10): 481-8.
15. Aguirre S A, Perryman L E, Davis W C, McGuire T C. IL-4 protects adult C57BL/6 mice from prolonged *Cryptosporidium parvum* infection: analysis of CD4+alpha beta+IFN-gamma+ and CD4+alpha beta+IL-4+lymphocytes in gut-associated lymphoid tissue during resolution of infection. J Immunol. 1998. 161: 1891-900.
16. Lehmann J, Enssle K H, Lehmann I, Emmendorfer A, Lohmann-Matthes M L. The capacity to produce IFN-gamma rather than the presence of interleukin-4 determines the resistance and the degree of susceptibility to *Leishmania donovani* infection in mice. J Interferon Cytokine Res. 2000. 20(1): 63-77.

Example 6

Detection and Diagnostics

Detection and diagnosis of *C. hominis* infection are very difficult and are typically based on microscopic examination (of water supplied or stool, etc.). A small number of previously characterized genes are now used for detection and diagnosis. These genes differ from their homologs in closely related parasites and therefore form the basis of a genetic signature. However, current protocols are limited in scope and could result in errors in identification. We have compared all the genes of *C. hominis* to many other related parasites, have identified important signature nucleotide sequences, which serve as the basis for the development of improved diagnostic tools. The signature nucleotide sequences are unique to *C. hominis* (see Table 9). Detection of the unique, signature sequences using nucleotide probes specific for them, provides a highly reliable method of detecting the presence of *C. hominis* in abiological sample, and thus for the diagnosis of a *C. hominis* infection.

As important as detection and diagnosis, it is important to quantify *Cryptosporidium* in an infected sample to assess the seriousness of the disease or contamination. Thus, *Cryptosporidium* are common in the environment and small quantities of the organism in water samples or in fecal samples are not uncommon. Using the signature nucleotide sequences described in Table 9, it is possible to both specifically identify and to accurately quantify levels of *Cryptosporidium* in essentially any biological or environmental sample. An example of such use is described below.

Real Time PCR(RT-PCR) Analysis of Detection, Quantification and Diagnosis

The example below used TaqMan® assay system technology (Applied Biosystems, Foster City, Calif.), but any fluorescent real time PCR technology (of many that are commercially available) can be similarly applied (1, 2, 3). In brief, oligonucleotide primers and probes specific for sequences of *Cryptosporidium* small subunit ribosomal RNA gene and the pyruvate kinase genes were designed (4, 5) using Primer Express® version 2.0 software. These sequences were selected among the many available in Table 9 because of historical precedent. However, nearly all of the sequences described in Table 9 could be used by one trained in the art as specific targets in these analyses. For each target, two primers (forward and reverse) flanking one internal probe are synthesized. The primers are synthesized without modified bases or labels. The probes are synthesized with 5' end linked FAM (6-carboxyfluoresceine) and 3' end fluorescent TAMRA (6-carboxytetramethylrhodamine) dyes. These fluorescent dyes are commonly used for TaqMan® assay system technology, but many other labeling systems are equally applicable. Primers and Probes for the Small Subunit rRNA Gene and the Pyruvate Kinase Gene.

```
Small Subunit rRNA
Name (forward): 18S#2-295F
Sequence:
CAGCTTTAGACGGTAGGGTATTGG     (SEQ ID NO: 4060)

Name (reverse): 18S#2-368R
Sequence:
TCTCCGGAATCGAACCCTAAT        (SEQ ID NO: 4061)

Name (probe): 18S#2-324T
Sequence:
CCCGTTACCCGTCATTGCCACG       (SEQ ID NO: 4062)

Pyruvate kinase
Name (forward): pyruvate kinase-1016F
Sequence:
GGCCAACAAGGGCAGAAA           (SEQ ID NO: 4063)

Name (reverse): pyruvate kinase-1091R
Sequence:
TCTCCAGATAGCATAACACAATCTGA   (SEQ ID NO: 4064)

Name (probe): pyruvate kinase-1040T
Sequence:
ATGTTGCAAACGCTGTTTTAGATG     (SEQ ID NO: 4065)
```

Synthesis of all primers and probes were performed at the VCU Nucleic Acids Research Facilities.

We tested the effectiveness of the primers above to detect parasite sequences in total RNA of the human cell line HCT-8 infected with *Cryptosporidium*. However, with insignificant modifications, this procedure is equally effective for detection and quantification of *Cryptosporidium* in other samples (e.g., water samples, fecal samples, sputum or bronchalveolar lavage, serum, etc.). In addition, this procedure is equally effective if the target is DNA instead of RNA. Thus, this example is provided as a general validation of this approach to *Cryptosporidium* detection and quantification.

Live (LV) and heat inactivated (HI) parasites were used to infect monolayers of cultured HCT-8 human cell line. RNA was isolated from these infected cell lines using standard procedures for purification of total RNA. Assays to quantify the *Cryptosporidium* RNA in these cells using the primers described above were performed in VCU's Nucleic Acids Research Facilities in an ABI Prism® 7900 Sequence Detection System (SDS) (Applied Biosystems, Foster City, Calif.) using the TaqMan® One Step PCR Master Mix Reagents Kit (P/N: 4309169). Again, any other real time PCR system would be equally applicable to this technological approach. All samples were processed in triplicate following standard procedures established in the Nucleic Acids Research Facilities.

Figure 2A:
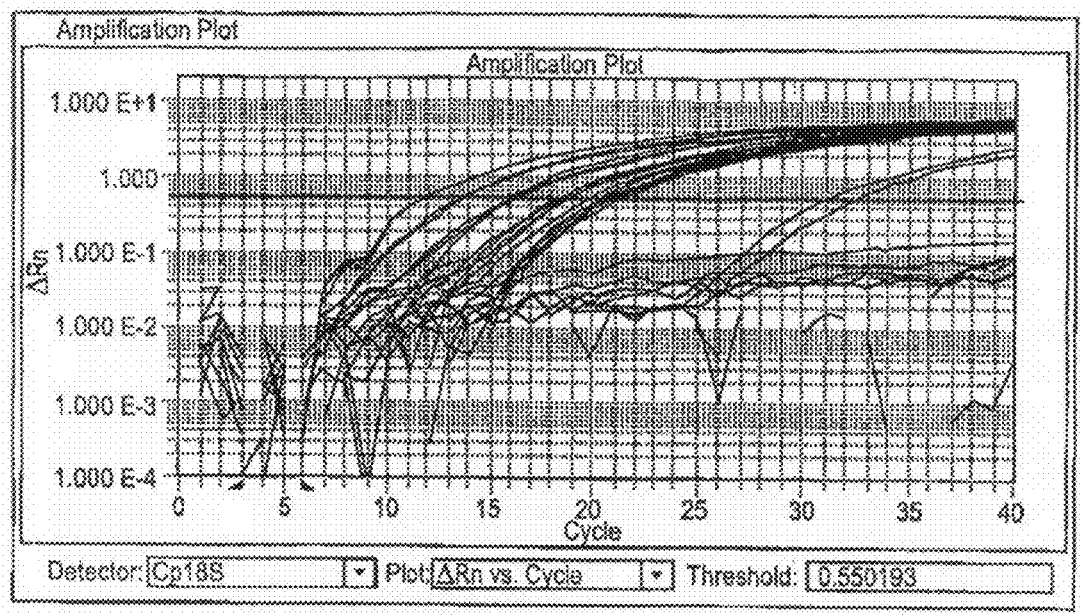
Figure 2B:
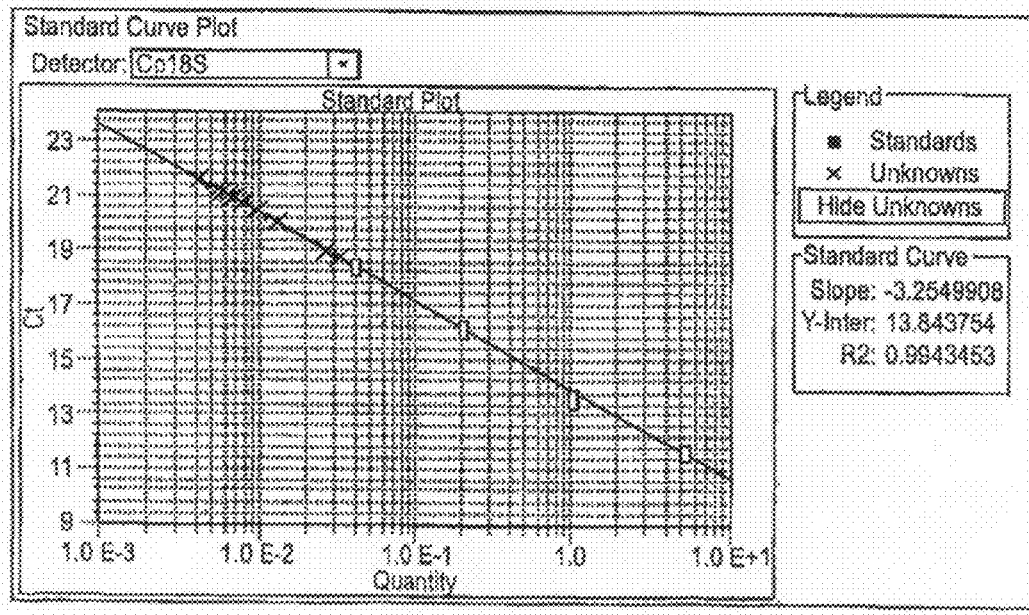

The FIG. 2 shows typical amplification curve plots (A) generated by these samples and a standard curve plot of known amounts of *Cryptosporidium* rRNA, for measuring the absolute quantities of *Cryptosporidium* small sufigurebunit rRNA in the samples (B). The table below shows the numerical results of the parasite RNA quantification. These results showed that the *Cryptosporidium* RNA is present only in the samples in which infection was mediated with live parasites. As expected, heat inactivated parasites do not infect, and no parasite RNA is observed. Moreover, the results indicate that the amount of *Cryptosporidium* RNA present varies from approximately 5-30 picograms, permitting a direct calculation of the number of parasites present in the sample.

*C. hominis* is the primary agent of human cryptosporidiosis. *C. parvum* is a common cause of disease in animals, and an occasional problem in humans. It is important to differentiate between these two (and other) strains of *Cryptosporidium*. Our technology enables the ready discrimination of these isolates. Thus, we have demonstrated that we can use the sequences we have described in Table 9 for differentiating *C. parvum* from *C. hominis*. In brief, the same technology outlined above; e.g., RT PCR using primer and probe sets specific for *C. hominis* or *C. parvum* are used to amplify RNA (or DNA) purified from a sample (water, fecal material, other sample). In these amplifications, we can not only detect and discriminate different *Cryptosporidium* strains (e.g., *C. hominis* from *C. parvum*), but each can be concurrently quantified.

REFERENCES FOR EXAMPLE 6

1. Wang, A. M., Doyle, M. V., and D. F. Mark. (1989) Quantitation of mRNA by the polymerase chain reaction. Proc Natl Acad Sci USA. 1989 December; 86(24): 9717-9721.
2. Kawasaki, E. S., and A. M. Wang. (1989) Detection of gene expression. In: Erlich, H. A., ed., PCR Technology: Principles and Applications of DNA Amplification. Stockton Press, Inc., New York, N.Y., pp. 89-97.
3. Dieter Klein (2002) Quantification using real-time PCR technology: applications and limitations. Trends in Molecular Medicine, 8(6):257-260.
4. Xu P, Widmer G, Wang Y, Ozaki L S, Alves J M, Serrano M G, Puiu D, Manque P, Akiyoshi D, Mackey A J, Pearson W R, Dear P H, Bankier A T, Peterson D L, Abrahamsen M S, Kapur V, Tzipori S, Buck G A. (2004) The genome of *Cryptosporidium hominis*. Nature 431:1107-12.
5. Abrahamsen M S, Templeton T J, Enomoto S, Abrahante J E, Zhu G, Lancto C A, Deng M, Liu C, Widmer G, Tzipori S, Buck G A, Xu P, Bankier A T, Dear P H, Konfortov B A, Spriggs B F, Iyer L, Anantharaman V, Aravind L, Kapur V. (2004) Complete genome sequence of the apicomplexan, *Cryptosporidium parvum*. Science 304(5669):441-5.

Example 7

Nucleotide Arrays for Detection of *Cryptosporidium* Genes

The array consists of ~4,000 70 base synthetic oligonucleotides bound to glass slides. Each of the ~4,000 *C. hominis* genes is represented by a single, specific oligonucleotide in the array. In order to assess presence or absence of these genes in a biological sample containing putative *Cryptosporidium* parasites, DNA is isolated by standard technology, labeled with fluorescent dyes, and hybridized to the array. A similar DNA sample derived from a known *Cryptosporidium* sample is labeled with an alternative fluorescent dye and used as a control. Both labeled DNAs are hybridized to the same oligonucleotide array, and the arrays are washed and scanned in a fluorescence scanner. The readout of the scanner provides an estimate of the amount of DNA for each gene that is present in the initial sample and a comparison between the two samples. Thus, *Cryptosporidium* genes that are present or absent are determined relative to the control.

The 70 base oligonucleotides in the array were designed by ArrayOligoSelector™ version 3.8.2, (http://arrayoligosel.sourceforge.net/), which selects optimal sequences by:
1. Examining every possible 70 mer sequence from every gene;
2. Using BLASTN (against the whole genome) to check the uniqueness of each 70 mer.
3. Uniqueness is scored as the theoretical binding energy of a candidate oligo to its most similar genome sequence. The binding energy is calculated using a nearest-neighbour model with the established thermodynamic parameters;
4. Using the LZW compression algorithm to calculate the sequence complexity score in bytes between the oligo sequence and the its compressed version;
5. Determining the self-annealing score, calculated as the alignment score of the optimum local alignment between the oligo sequence and its reverse compliment using the Smith-Waterman algorithm;
6. Calculating the GC content of the oligo;
7. Choosing, for each gene, the oligo that maximizes uniqueness and sequence complexity, minimizes self-annealing and has GC content closest to specified by the user; also tries to minimize distance to the 3' end of the gene.

The approximately 4000 oligos and controls designed in this fashion were synthesized commercially and validated in the lab. In the FIG. 3, a hybridization of the array with DNA from *C. hominis* and *C. parvum* was performed to identify *C. hominis* genes that are present or absent in *C. parvum*. Therefore, DNA was purified from *C. hominis* and *C. parvum*, labeled with the fluorescent dyes Cy3 and Cy5, respectively, by indirectly incorporating amino-allyl (aa)-dUTP (Ambion) followed by coupling with fluorescent dyes. Briefly, four micrograms of genomic DNA from each of the two *Cryptosporidium* species was digested with restriction enzyme Hae III, translated with Klenow Exonuclease-free polymerase using random hexamers (pdN6 from Pharmacia) in the presence of aminoallyl-dUTP, and purified to remove the unincorporated nucleotides. The amino-allyl-dUTP labeled DNA samples were dried, dissolved in 0.1 M NaHCO$_3$, pH 9.0, and fluorescently labeled by coupling of the amino allyl-dUTP to Cy3 or Cy5 dyes essentially as described by the manufacturer (Amersham Pharmacia Biotech). The labeled DNAs were hybridized to the oligonucleotide array, which contains approximately 4000 probes representing each of the known *C. hominis* genes. These results demonstrate that the gene complements of *C. hominis* and *C. parvum* show expected similarities, but permit identification of specific genetic differences.

While the invention has been described in terms of its preferred embodiments, those skilled in the art will recognize that the invention can be practiced with modification within the spirit and scope of the appended claims. Accordingly, the present invention should not be limited to the embodiments as described above, but should further include all modifications and equivalents thereof within the spirit and scope of the description provided herein.

Lengthy table referenced here

US08114976-20120214-T00001

Please refer to the end of the specification for access instructions.

Lengthy table referenced here

US08114976-20120214-T00002

Please refer to the end of the specification for access instructions.

Lengthy table referenced here

US08114976-20120214-T00003

Please refer to the end of the specification for access instructions.

Lengthy table referenced here

US08114976-20120214-T00004

Please refer to the end of the specification for access instructions.

Lengthy table referenced here

US08114976-20120214-T00005

Please refer to the end of the specification for access instructions.

Lengthy table referenced here

US08114976-20120214-T00006

Please refer to the end of the specification for access instructions.

Lengthy table referenced here

US08114976-20120214-T00007

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US08114976B2). An electronic copy of the table will also be available from the USPTO upon request and payment of the fee set forth in 37 CFR 1.19(b)(3).

SEQUENCE LISTING (4063 sequences)

SEQ ID NO: 1 - DNA, 1377 bp, Cryptosporidium hominis
atgaaagactcaggtctggaaaagccattacttaatgggaatggatttaaaatatttgcaagtacagagagtgttcagaagaggttaatatatgcaatctttttctgtctagtctttacattgatagaggttgttgtgggtatattatcaaactcactggcactaatatcagatgcatctcacctcatttcagatatatgtagctatttcatttctctgcttggtatccacctttccaaaagaaaggccacaaacacaatgtcatttggttataacagagctgaaatattaggggctttgttaagcattctactaatatggttcatgacaatcatgcttgtttacgaggctattcaaagaatgttatatcctgtgaatgttgatgggttttctatgtttattaccgctatttttggtactttgtccaacttatttattagctttgtgttatctgttcacaatcatggaataggttcaattggagcagattgtacccaacacaatcatacacatgaacatatgcatgaacacgactgtaagcaagctcaaactcattttcaggatgattcactgtattgcaaagatcaacaactagtagaaaatcaagaacaaattggaggaattaacactactttacttgaataccaccatagaagccaaatgagaactaaggatttagatcatgaacttaataattatactaatttaatgaactctccagttataagaagagtcaattctggtttaaaagagtgttcagaacgtcaaaatgactattctcatctccatagtaataatcactatccaagtaaacattcctctgaacaagaaagcttagcgcttaagtctgcttatatccatgttttaggggatattttacagaacatcggagtaatgattgctggattactgattttatacaatccagcatggacaatcgccgatcctctatgtactattctattctccttctttgtcctcgcaacaaccatcaaaatcctaaaagattccgccaatgttctaatggaaggagcccctataggaattgattgtgaatccattcaaaacgactttctaaagctttcttcagtgcttgaagttcacgatctacatgtttggtctgtatctgttggagttcctgcattatcttgtcatattgtcgtagcatcagaagataatgctagatttacattaagatatgcaacggatctctgtcaaaagaaatatggaatatttcacaccaccattcaaattgactattctccaaataaagccacttgtgaaacaatacatcatcaaaaatgtctagttggctctaataaccaaaataaaagtgaaattcaccaaataattcatcccgttgactattctgcttag

SEQ ID NO: 2 - protein, 458 aa, Cryptosporidium hominis
MKDSGLEKPLLNGNGFKIFASTESVQKRLIYAIFFCLVFTLIEVVVGILSNSLALISDASHLISDICSYFISLLGIHLSKRKATNTMSFGYNRAEILGALLSILLIWFMTIMLVYEAIQRMLYPVNVDGFSMFITAIFGTLSNLFISFVLSVHNHGIGSIGADCTQHNHTHEHMHEHDCKQAQTHFQDDSLYCKDQQLVENQEQIGGINTTLLEYHHRSQMRTKDLDHELNNYTNLMNSPVIRRVNSGLKECSERQNDYSHLHSNNHYPSKHSSEQESLALKSAYIHVLGDILQNIGVMIAGLLILYNPAWTIADPLCTILFSFFVLATTIKILKDSANVLMEGAPIGIDCESIQNDFLKLSSVLEVHDLHVWSVSVGVPALSCHIVVASEDNARFTLRYATDLCQKKYGIFHTTIQIDYSPNKATCETIHHQKCLVGSNNQNKSEIHQIIHPVDYSA

SEQ ID NO: 3 - DNA, 438 bp, Cryptosporidium hominis
atggcagatactgaacaaaagaagagaaccttcagaacttatagttacagaggtgttgacctcgacaagctccttaccatgaaattggatgaggttgttgagcttttaccagcacgtaaaagacgtaagatagccagaggttgtcttaacagaagaactgcagcttttatcgcaaagcttcgcaaatctaaggctgaatgtccaatgggtgagaaacctgttgctgttcgtacccatttacgtaatatggttatcctcccagaaatggttggttctgttgcaggtgtctacaatggtaagacttatgttaccgttgaaattaagccagaaatgattgggatgtaccttggagagttctctatcacctacaagccagtacgtcatggtaagccaggtgttggttcaaccagttcttccagattcattcctctaaagtaa

SEQ ID NO: 4 - protein, 145 aa, Cryptosporidium hominis
MADTEQKKRTFRTYSYRGVDLDKLLTMKLDEVVELLPARKRRKIARGCLNRRTAAFIAKLRKSKAECPMGEKPVAVRTHLRNMVILPEMVGSVAGVYNGKTYVTVEIKPEMIGMYLGEFSITYKPVRHGKPGVGSTSSSRFIPLK

SEQ ID NO: 5 - DNA, 3109 bp, Cryptosporidium hominis
atgacaacaacaacaacaccaccattacctgatatcggtgacattgaaattacaccaatcccaattgaaaagatgttggataagtatacaagaatgatttatgactataacagtggtttattattagactctaatgatgaaccaattccaggttctcaagcaggacaaatagctgatacaagcaatttattcccaactcaaactcacaagagtactggtttaccaattgatccaatggttggtcttccatttgatccaaaatcaggtaatttagtacatccatataccaatcaaacaatgtctggtttatcagtatcatatcttgctgctaagaatttgacagttgatactgatgaaacctacggtttaccaattgatacactcactggttacccattagatccagttagtttgattccattcaatccagaaactggtgaattgtttgatccaatctcagatgagatcatgaatggaacaattgcaggtattgtttcaggaatttctgcaagtgagtcattattatctcagaaatcagctcaaatcgacccagcaacaaatatggttgttggcgaatttggtggattgttgaacccagcaacaggagtgatgattccaggttctttaggtccatcagagcaaactccattctcccctgaaattgaagatggtggtattattcctccagaagtagcagcagcaaatgctgataaattcaagttatctattcctccaagcgtaccagaatcaattccagaaaaggatcagaagatcgattctatttctgaattgatgtatgatattgagtcaggtagacttattggtcaagtatcaaagagaccaatcccaggttcaattgctggtgatttgaacccaataatgaagacaccaacacaaactgacagtgtaactggtaagccaatcgatccaaccacaggtttacctttcaatccaccaactggtcatttgattaacccaacaaataataataccatggattcttcatttgctggtgcatacaaatatgcagtttcaaatggtatcaagactgataatgtttatggtttaccagttgatgaaataacaggtttgccaaaggatccagtctcagatattccatttaactcaactacaggtgaattggttgatccatcaacaggaaagccaattgacaattctactgctggtattattagtggaaaacctggcttaccacctattaaagatgaaaatggcaatttgtttgatccatcaactaacttgccaatagatggtaataaccaattaattaacccagaaaccaacagtactgtcccaggatcaacttcaggtactacaaaaccaaagccaggaattccagtcaatggtggaggtgttgtacctaatgaagaagctaaagatcaagctgataagggtaaggatggattaattgttccaccaactaattctatcaataaggatccagtaacaaatgctcaatacagtaatagtactggtaacattattaacccagaaacaggaaaagttattccaggctcacttccaggctctctcaactatccatcattcaatactccacaacaaactgatgagattacaggaaagccagttgatactgttactggtttgccatatgatccatctacaggtgaaattatcgatccagcaactaaattaccaattccaggatcggttgcaggtgatgaaattctcactgaagtattgaacattacaacagatgaagtaacaggtttgccaattgatcctgaaaccggtcttccaagagatccagtatcaggactcccacaacttccaaatggtactttggttgatccatcaaataaaaaaccaattccaggttcacattctggatttattaatggtacatctggagaacaatcacacgagaaagatccaggtactggtaagccacttgatccaaatacaggtttaccattcgatgaagattctggtagtttaattaacccagagactggagataaacttcaaggatcacattctggtacatttatgccagtgccaggtaagccacaaggtgaaaatggaggtatcatgacacctgagcagatattggaagcattaaataaattgccaacaagtaatgaagcaaaatatttcaccaaaaccaagttcagatgctgttccagacaaaccaacaaatacttggtggaataagatttctggtcaaacctaccaggttgatggagagaagactattccaggttctgcagcttcagtaattcacactgctcttggaacaccaactcaaactgatccaacaacaggacttccatctgatccatcaacaggtttaccattcattccaggatttaacgtacttgtagatcctcagactggagagcaaatgaagggttctgttccttatgtttcattgtacgttaaggaaaagaacattgtaacagaagctgcttatggtctaccagttgatccaaagactggtttcccaattgatccaattagttacctcccatttgctaagaatggtgaattaattgatcctatctctggtaaatatttcagtggttcaattgctggattcatttctggtaaagctggtacacaatctaaatcatctgatgagtcaggtaatccaattgatccatcaacaaatatgccttacgatccaaaaacaggcaaattaattgatccagaatctggcattgctattgataattctatttcaggtgtatttgcaactgtacctggtactgctgcaccgaaaaagggtggtgtcattccagagtcagttgcagctgaggcagcaaagaaatactttgcagccaatgttgaaggaggagaaggagaaaaagttccaccaccaccagaatcatctagtaacattgcaatccaagctgctggtggtgcttctgctgctgtaggtctcgtagctgctggtgttggtgcatggtatgcaagcagaaacagacaagaaggagaagatgatgatgactatgcagatggatttgaagcagaatatgaagaagaagaggaagaagagggtgatgaagcagcaaatgaaactgttgttacaattgagcgtgattcatcattctggaacgaatcttaa

SEQ ID NO: 6 - protein, 1059 aa, Cryptosporidium hominis
MTTTTTPPLPDIGDIEITPIPIEKMLDKYTRMIYDYNSGLLLDSNDEPIPGSQAGQIADTSNLFPTQTHKSTGLPIDPMVGLPFDPKSGNLVHPYTNQTMSGLSVSYLAAKNLTVDTDETYGLPIDTLTGYPLDPVSLIPFNPETGELFDPISDEIMNGTIAGIVSGISASESLLSQKSAQIDPATNMVVGEFGGLLNPATGVMIPGSLGPSEQTPFSPEIEDGGIIPPEVAAANADKFKLSIPPSVPESIPEKDQKIDSISELMYDIESGRLIGQVSKRPIPGSIAGDLNPIMKTPTQTDSVTGKPIDPTTGLPFNPPTGHLINPTNNNTMDSSFAGAYKYAVSNGIKTDNVYGLPVDEITGLPKDPVSDIPFNSTTGELVDPSTGKPIDNSTAGIISGKPGLPPIKDENGNLFDPSTNLPIDGNNQLINPETNSTVPGSTSGTTKPKPGIPVNGGGVVPNEEAKDQADKGKDGLIVPPTNSINKDPVTNAQYSNSTGNIINPETGKVIPGSLPGSLNYPSFNTPQQTDEITGKPVDTVTGLPYDPSTGEIIDPATKLPIPGSVAGDEILTEVLNITTDEVTGLPIDPETGLPRDPVSGLPQLPNGTLVDPSNKKPIPGSHSGFINGTSGEQSHEKDPGTGKPLDPNTGLPFDEDSGSLINPETGDKLQGSHSGTFMPVPGKPQGENGGIMTPEQILEALNKLPTSNEAKYFTKTKFRCCSRQTNKYLVEMKQNISPKPSSDAVPDKPTNTWWNKISGQTYQVDGEKTIPGSAASVIHTALGTPTQTDPTTGLPSDPSTGLPFIPGFNVLVDPQTGEQMKGSVPYVSLYVKEKNIVTEAAYGLPVDPKTGFPIDPISYLPFAKNGELIDPISGKYFSGSIAGFISGKAGTQSKSSDESGNPIDPSTNMPYDPKTGKLIDPESGIAIDNSISGVFATVPGTAAPKKGGVIPESVAAEAAKKYFAANVEGGEGEKVPPPPESSSNIAIQAAGGASAAVGLVAAGVGAWYASRNRQEGEDDDDYADGFEAEYEEEEEEEGDEAANETVVTIERDSSFWNES

SEQ ID NO: 7 - DNA, 1467 bp, Cryptosporidium hominis
atgttcgagtttatttcagaaatgtttcattcatgttgcaaattaaaaaaaaatcaaaagaatgatgaatacatttttatcttgtgccctaccccaagtgatttagaagaggaatatattgatcaagaaggaaatgtcaaaaaaaagaagctcgaaaaaattagaggaactgccagaaatattgtcgataaggaaattgtcagggagtggagtggaagggaaattggaagctgtatttgctgtcatttaatatatgaagacgaaatgaatgtttatagagctgataaatatggcagacatattggtaaggaccatgaagaatatgaaggtagccaaacaagagaagaaaaccgtgttaactcagttgaatctctgagctcatatggctcaagaaaacatttttctgaggagccaaatagcgcagattccaactctacctcaataagttcagatgaaaataataatgcagttgagaataagagtaaaaaaacaagagaaaggaggaagttaaatatcagtagatccccaagcgtaattgagaaggaaatagatgaaaaagaaaagaagaacaaaaaactaaaagaaacaaaagatgccaataataaagaatgctccacaattagttctgatataaataatgatatccataacgcggatgagaaaacaactgataatagaaataacaaaaagctagagaatactaatgtaaagaatgacgagcaaattccattctccgatcaaaaaaaatattctaaatcttctccactctcaaagaatcaatgccctccaaagttaggaaaaaggccacccatgaagaatgaattattggctatgaatggtcagaaaaacaattcacttaagtcatcaattgcaaatagtaaaaaatgtagtaaaaaaatatcaagtactccgaaaaatgaatttaacaaaataattttggaaaaagaaaaggtagaaagtaattctcgcgatactcataaagatgacaaaaatcaaactggaaataataatgaccagcaaatcaaccacattactagcagttctaattctgataaagaaatgattgataacagtggggaaattaaatatgaagaggaagagatgaagtttaacaaagatatttcttcgaaaataatacgtcacagagcattaataggaattcaagccgaaattattctaaaagatggatcgacaacggactgtaaagttagcttctcagatgaggaagatgatctttcatttatttgcaacgataaagttaaagctgttccttggagtaacattaaagagatttttacaacaaaaagtgaacttagaatggtgaatacacgagcacctatttttaaagacccaacattaattattgcactacatttaaaagatacaggaaattgtatacctttgaaatttgattctaagaaaagcaaagaagattttttaaatttcgccctcagaatgattgggtaa

SEQ ID NO: 8 - protein, 487 aa, Cryptosporidium hominis
MFEFISEMFHSCCKLKKNQKNDEYIFILCPTPSDLEEEYIDQEGNVKKKKLEKIRTARNIVDKEIVREWSGREIGSCICCHLIYEDEMNVYRADKYGRHIGKDHEEYEGSQTREENRVNSVESLSSYGSRKHFSEEPNSADSNSTSISSDENNNAVENKSKKTRERRKLNISRSPSVIEKEIDEKEKKNKKLKETKDANNKECSTISSDINNDIHNADEKTTDNRNNKKLENTNVKNDEQIPFSDQKKYSKSSPLSKNQCPPKLGKRPPMKNELLAMNGQKNNSLKSSIANSKKCSKKISSTPKNEFNKIILEKEKVESNSRDTHKDDKNQTGNNNDQQINHITSSSNSDKEMIDNSGEIKYEEEEMKFNKDISSKIIRHRALIGIQAEIILKDGSTTDCKVSFSDEEDDLSFICNDKVKAVPWSNIKEIFTTKSELRMVNTRAPIFKDPTLIIALHLKDTGNCIPLKFDSKKSKEDFLNFALRMIG

SEQ ID NO: 9 - DNA, 2058 bp, Cryptosporidium hominis
atgaaaaagttaatactttatttagtattactacatatatatattgttcagaaatatgtaatatgttcaaaattaactcattattcagtaggtggtcatgcatcaacatcaagagtgaagggaagaagtagtagtggtagtagtagtagtagtggcgattttaatgtaccaggattaaatggatatttatgtccaagctataatagagacccaagaggatttggttgttttggtatgaatacagcatatacggttaaaaagaatagttggcaagaatgtgcaaatcaatgctattggagtaaatatacagtatttggtaattgtcaaagatctgtatataattcaaataataaagattgctatattaaaagtggtgataacagatgcgtgaagtctccagatggaatgattttaacaaataggcaatcatatatgatcggagagtgtgcgacaacatgtactgtttcaacttggtcaagttggactacatgctcaggggtatgtggtgagatgagatcaagaacaagaagtgtgttatcatttccaagatacgattatgaatattgtccacatctgatagagtattcaaattgtgtagtacaaaataaatgcccagaaaattgcccacagtatggggtttcaatattgggatggggatgtcagtttgaatcaactttttcatttaataaaaatttatttgttagttatgaagaagattggaggggttgcatgtcaacttgcaaacaggatccattttgtgtagcttggtcgtataatgcaactttatcagaaggaccagattctgttggattttcaagagaatatcgtccatgttatacacatagatttgcttcaggatgtcaagctttagcaccaggatgggtatcaggtaataagaatacaataaatgttgattgtgaaactggtacttgtatacataatgaatggtcatcttggacaacatgtaaagatccttgtagtaatactgaaacaatgagtagaaataggacagtaaagactgtatctcagaattgggcaagtacaccttgtagggatgagactcaaattcaactttgttcagaaaacccacaaagtattgaaacttgtaaaacttgtttagtaggtggttggtcagaatggtcagattgttcaacaagttgtggagaaggtaatagagttagaacacgtgaagttactaaacctccattgaatggagatgattcaacatgcccagaattaattgagaaagaaagttgtaataaagatgtggaatgtccacatgttcaatgtgaattgggagaatggtcttcttggtcaccttgtagtgtaacttgtggatgcggaacaactacaagaaatagggaagtaaagggagagaattgtacagaattatcaacagaatcaaagaagtgtaatttggcaaattgtgacgataactctgcatcatgtactgcagttatgtcagtttggtcagaatggtcagtttgtagtgagaaatgtgatcagggagtagtaagaaggtatcgtgattttgattttacaaaaattggggtttttggttataatccacccggtacatcagaagaacaaaataaagtgagagaaatatgcaaggatactccaacattagaagaggagccatgtacttcaggagttgcatgtactccaggatgtaaatatactgaatggagtacttggtcaagctgtgattgttctggaactcaaactagagatagagttgttactttccctgaaggtgtaattgatgcaacttgtcagagttctaaagatacaagatcatgtagcaagcctgaaggttgtacagaaactgctccagattctggagacgctacacttgccattgctattggattaccagttggtattcttggattatgcattattgctggttctttgtttttaattggtgggagatcaggtgatcaggaggaggatgagacaagttatcaatactttgatcaaccttctgctactttagatcaagactcagaatatgttcaagaaattggtccagagagtcagaactgggctagttga

SEQ ID NO: 10 - protein, 538 aa, Cryptosporidium hominis
MKKLILYLVLLHIYIVQKYVICSKLTHYSVGGHASTSRVKGRSSSGSSSSSGDFNVPGLNGYLCPSYNRDPRGFGCFGMNTAYTVKKNSWQECANQCYWSKYTVFGNCQRSVYNSNNKDCYIKSGDNRCVKSPDGMILTNRQSYMIGECATTCTVSTWSSWTTCSGVCGEMRSRTRSVLSFPRYDYEYCPHLIEYSNCVVQNKCPENCPQYGVSILGWGCQFESTFSFNKNLFVSYEEDWRGCMSTCKQDPFCVAWSYNATLSEGPDSVGFSREYRPCYTHRFASGCQALAPGWVSGNKNTINVDCETGTCIHNEWSSWTTCKPCSNTETMSRNRTVKTVSQNWASTPCRDETQIQLCSENPQSIETCKTCLVGGWSWSDCSTSCGEGNRVRTREVTKPPLNGDDSTCPELIEKESCNKDVECPHVQCELGEWSSWSPCSVTCGCGTTTRNREVKGENCTELSTESKKCNLANCDDNSASCTAVMSVWSEWSVCSEKCDQGVVRRYRDFDFTKIGVFGYNPPGTSEEQNKVREICKDT

SEQ ID NO: 11 - DNA, 1971 bp, Cryptosporidium hominis
atggattcaattaactttagaagcatttatattccatcagcagtgaggtatattatattacttttattatggacaatatttacaaaaaatgtttatagtgaaagtagtgaagaaactttattgggaagatcagtattggatttaaacaagaaaaatacatgtgaatactatggagagcaggatggtatgtttactgattcatttcattcaagaatatgtatagttccagaagatggattacatggaaaaagggaatatgaaaatcatcaaaaaaaaacatttggaacaattagaccaaataataaacaattatctgataataaattatataggaaagatgatcatttaacttcttcaattgcagattttgatagtaattctgtgagaatacagagaaaaaacgtggatttagaagctatgtttggaataggaaaagataacaacagaatgaatcttaataatgaagcaattcaaagtttctattcaaataatgaaacagaaagccaagataagaatgcgacaaacgactattttttatttaaagaaggacttttgaaatttcaagagaaaaagatattaagatattatttatatgatgtaggaaataaagtctattcagatactatagcttatccagaaaatgttatatcagaaaactctgcatttaactatttggggaattatgtagatgtttatgaaattagtaaagtatcagatccaccagtaatttcatggccaaataatcacatagtttttatacactctcaggtaaaatctgatggtacatttaaatttcaagtatatactagctcaggagagataggattttattttgaagtaactgataatagttataaaacaggttgtggtagttattctagagttgataaaagcaaatttactcactctgcaaattctttaattcaagttcaattagtaagaagaaagtttggatttaatgtatttgttgatggtactagaagaacacaactagatataattgattgtattgcaagtgttccaactaaagttcaaataactagtggatcaggatcacaaatttatccaaaagtagaagattgtcaaatttcacagtggacagattggtcaacttgttcaaaaacttgctcaactggttcaaaagctagataccgttcagtaattatgccaagtatgaatggtggtttaccatgtcctaaattacttgattcaagtccttgtaatgctgatatttcatgctcatcatgccaatattcggaatggacaatgtggggtgagtgctcagctacttgtggatcaggatcaacaaccagaacaagaaagttattaagtgcagcatattttattgaaagctgtattgatacattccaattaaaatcttgccatggtgtttcttgcgctagtgattgtattgtaacagaatggtcagattggagcgaatgtagtacaacttgcggtgttggaagtcaaatttccacaagatccatagttgttccagaacaaaatggtggaaaatgtgattatgatcttagcaaaatccaagaatgcaatgtttctgtttgctccaagtcttgtgatccttctccatgcttaaatggcggtatttgtagtgaactaccaaagtcaaacttcgcttgtacatgcccgccattttacggaggtgaaacttgtgatcaatttgaatttccttggtggttttatagtgttataattgttttagttgttttggctattgggatattttataagtcacaaatttcaaatatagttactccaaatacaatggatccttcatatgcaggagatggggattatgccttcagtcaaggccctgctcccccagatccattgcaagcagcaaatggacaacctcaatactaccaaaatacgtataattacaactatgggtattatgacaattctaatgaaggatatttggtaaataatgatgaaggaaattggatgtactag

SEQ ID NO: 12 - protein, 656 aa, Cryptosporidium hominis
MDSINFRSIYIPSAVRYIILLLLWTIFTKNVYSESSEETLLGRSVLDLNKKNTCEYYGEQDGMFTDSFHSRICIVPEDGLHGKREYENHQKKTFGTIRPNNKQLSDNKLYRKDDHLTSSIADFDSNSVRIQRKNVDLEAMFGIGKDNNRMNLNNEAIQSFYSNNETESQDKNATNDYFLFKEGLLKFQEKKILRYYLYDVGNKVYSDTIAYPENVISENSAFNYLGNYVDVYEISKVSDPPVISWPNNHIVFIHSQVKSDGTFKFQVYTSSGEIGFYFEVTDNSYKTGCGSYSRVDKSKFTHSANSLIQVQLVRRKFGFNVFVDGTRRTQLDIIDCIASVPTKVQITSGSGSQIYPKVEDCQISQWTDWSTCSKTCSTGSKARYRSVIMPSMNGGLPCPKLLDSSPCNADISCSSCQYSEWTMWGECSATCGSGSTTRTRKLLSAAYFIESCIDTFQLKSCHGVSCASDCIVTEWSDWSECSTTCGVGSQISTRSIVVPEQNGGKCDYDLSKIQECNVSVCSKSCDPSPCLNGGICSELPKSNFACTCPPFYGGETCDQFEFPWWFYSVIIVLVVLAIGIFYKSQISNIVTPNTMDPSYAGDGDYAFSQGPAPPDPLQAANGQPQYYQNTYNYNYGYYDNSNEGYLVNNDEGNWMY

SEQ ID NO: 13 - DNA, 1038 bp, Cryptosporidium hominis
atgaaagaatcaggcacaattaattatctaataacatttacattcattattcctttcgtactttcccagtcaacattattaaatcttggtgcagggggtatacaggaaaggagggtttgcactgacgaaatgccatgtaactttagattggttgctgatttagatatgaagtcaaagccagggagtggggaaaagaattacaaaagtttatttcaaaaagggtcaataatacaagacaaaaggggcaactatcgagtgtactggggagaaagtctggaacttaaaagcggatataatgaatatgggagagggatggaattaagtgagttgatttcatataatggaatgatgcttgcgggcgacgaccgtacaggaataatttttgaaataactgatgatggaaaaggagtagcaccaagatatatattatctgaaggtaatggaagaacagctaagggaatgaagattgagtggtttgctgtaagagatggaatattgtgggttggcagttttggaaaagagttcgtatcaaacggcataatagaaaaaagagataatatgtgggtagccacaattgataaaagaggatatgtttcacgatttaattggagttttgtttatgaaaaaattaggaattcactgggggcgcaatatccaggttattgcattcatgaagcagtgatttggagtcatttaatgagaaagtggatatttttaccaagaagagttagcttcgatgagtatgatgaggagaaagacgaaaagagaggttccaataaaatgataattatgacagatgattttgaaattcttgaaattattgacgtaggattgataatacctgaaagaggtttttcttctttaaaatttcttcctgggtcgtttgaccagataatagttgcaacaaaaagcgttgaagaatcaatttcagacactcaaaagtctttcttaactatattcacaataaatggaaaaattttaatggaagatttagaagtgcctggagactacaaatacgaggggatagaatttatatag

SEQ ID NO: 14 - protein, 345 aa, Cryptosporidium hominis
MKESGTINYLITFTFIIPFVLSQSTLLNLGAGGIQERRVCTDEMPCNFRLVADLDMKSKPGSGEKNYKSLFQKGSIIQDKRGNYRVYWGESLELKSGYNEYGRGMELSELISYNGMMLAGDDRTGIIFEITDDGKGVAPRYILSEGNGRTAKGMKIEWFAVRDGILWVGSFGKEFVSNGIIEKRDNMWVATIDKRGYVSRFNWSFVYEKIRNSLGAQYPGYCIHEAVIWSHLMRKWIFLPRRVSFDEYDEEKDEKRGSNKMIIMTDDFEILEIIDVGLIIPERGFSSLKFLPGSFDQIIVATKSVEESISDTQKSFLTIFTINGKILMEDLEVPGDYKYEGIEFI

SEQ ID NO: 15 - DNA, 843 bp, Cryptosporidium hominis
atgtcgagaattgaaaaaggttttaacatcttagctaacttggggataatgctggttgcaggtggaagcattttggcgtctaatagtatgtataacgtggatgctggacacagagcaataaagttctcaagaatacatggagttcaaaaaaggatttatggagaaggaactcattttatgctaccttggattgaaagaccagtgatatttgacatcagagcgagacctcgagttgttgtatctctaacgggaagtaaagatcttcaaatggtgaatattacgtgcagagttttatcaaggcctgataaagataagctggtggaaatatatagaaatatagggctggatcacgatgagaagattcttccatcaataattaatgaagtgctaaaatcagtagtggctcagtataatgcttctcaactactaactatgagagaagacgtgagcaaaacaatccgagatttactggtaaaaagagcccaagagtttaatattattctggatgatgtctctttaacccatttaagcttttctcaggattatgaaaaggctgtagagtccaagcaagttgctcaacaacaagcagaaagagcgaaatatcttgttctcaaggcaaacgaagagaaaaaaagtactattattaaggctgaaggcgaagcaaaagctgcaaaactaattggagatgcgataaatgagaatcctgcctttattgctcttaaacaggtggagacttatagagaaatctctaatattttagcaaaatcaacttctaaatcgcttataaatctttcatcatttttgccaaacctcccaaatagtaatttacaatcatcttgttag

SEQ ID NO: 16 - protein, 280 aa, Cryptosporidium hominis
MSRIEKGFNILANLGIMLVAGGSILASNSMYNVDAGHRAIKFSRIHGVQKRIYGEGTHFMLPWIERPVIFDIRARPRVVVSLTGSKDLQMVNITCRVLSRPDKDKLVEIYRNIGLDHDEKILPSIINEVLKSVVAQYNASQLLTMREDVSKTIRDLLVKRAQEFNIILDDVSLTHLSFSQDYEKAVESKQVAQQQAERAKYLVLKANEEKKSTIIKAEGEAKAAKLIGDAINENPAFIALKQVETYREISNILAKSTSKSLINLSSFLPNLPNSNLQSSC

SEQ ID NO: 17 - DNA, 1245 bp, Cryptosporidium hominis
atgaggaacgcattccctctcgggctgtcaatatgttatttgatgttgaaagttgcattgactacttttgtttttgggtcaaaagaagagtttacaacactccctagagaattaataaactcttggttggaagaaaatgaatatgctggattatatggaaaatcagatattttttcaattgtaataataccagactgtgaagataatgaattgattgatgttacaataaatagtatacttttgactgcaaatcgaaatttacttcatgaaataataattatttcaaatgattgtcaagactctggaaaagatattaaaagttatttgggtgagaaattcttggataagcctttgattaaaataattgagactgaattacaagaattgggagaattacagaatcttggagcaaataattcaactggggaaatcattttatttgttccgtctgcaactctttttccaaaaaattggatgtcaccaataatgaggagtttaagtgataattataaatcaataatagttccaagatttaaaaaattgaataaaaacaaatgggcattttcgaacaatgatcctgtatattcaccaaaaatgatgttcacaaaagaatttgaattaacaaatatccatacattagataataaagttccaatgttctattcaaaaatctttgcaataacaaaatcatggtggttaaatatatcaaagctttcagatccaacaattaacctgatattcaaaacgagtattaactttgatatttctctaagatcatggaattgtggtgggcgagtagctcagatagcagaactgtcatttggtgtaactaaggtaaaaatctcacaaccttcgttagaaataagacaagttctattggaatcttggatagatgagccaaccaagcagatgattatgaataatagtgagaagctggctaactatatgaaactatcatcaggattatttgaggtattgataaataaacgtaaggaactcattaaagagtatgaatgtgaccaaaagtcaatatttacttcaaaattttataatgagttgagcgaatttggactaatagaatatccaaaaagtcaaatagtttttagtggtaatggcaaatgcttcacattaattgggaacgagaaaaaaagtggagaaaagaatttcgagttaaagttatcagaatgtaaaccaaatgaaaatgcacaaatattctacattgacaatgagagtaagttgatctag

SEQ ID NO: 18 - protein, 414 aa, Cryptosporidium hominis
MRNAFPLGLSICYLMLKVALTTFVFGSKEEFTTLPRELINSWLEENEYAGLYGKSDIFSIVIIPDCEDNELIDVTINSILLTANRNLLHEIIIISNDCQDSGKDIKSYLGEKFLDKPLIKIIETELQELGELQNLGANNSTGEIILFVPSATLFPKNWMSPIMRSLSDNYKSIIVPRFKKLNKNKWAFSNNDPVYSPKMMFTKEFELTNIHTLDNKVPMFYSKIFAITKSWWLNISKLSDPTINLIFKTSINFDISLRSWNCGGRVAQIAELSFGVTKVKISQPSLEIRQVLLESWIDEPTKQMIMNNSEKLANYMKLSSGLFEVLINKRKELIKEYECDQKSIFTSKFYNELSEFGLIEYPKSQIVFSGNGKCFTLIGNEKKSGEKNFELKLSECKPNENAQIFYIDNESKLI

SEQ ID NO: 19 - DNA, 1722 bp, Cryptosporidium hominis
atgcttattataaacggagcaattaattgtgctagaactgatatgtcgattcgaattcaaattgatttaaggatgtggctaactaatttgattttgaaacaatattattctgatttaacttactatcagttctcaataaataaaacgattgataatcctgaccaaagaattggagaggacatttcactgttttcatcacatttattattgttaatatgtcgttgtatagacaacttatttgacttttttgtttattcaatcttgctatacaatgttaatttcaaattgtttatttcagcaattatttattcttgttttggcacatttttaactgctaaattaggcatgaatataatattattaaaagttcaagaaaaaaagcttgaaagtgattttagatattcaattatgagagttggtgaaaatgcagaaaatgttgcaatgtatggaggagctcagtgcgagatggaaagacatgaacaaattttaaattcattgcttctcaacttaactacgaaaagatcatttgaatctaaaatgggactctttggaagtatttttagaaacctaatacgtgttctgcctattgcggttatttcaggagactacttttcaggaaatatccaacttggaagaattaatcagtgtagccttgcatttaacagtatagttgaagatatttcaattttggtcaatacttttagagaaataagtaatctactttcttcaatagatagagtaggacattttattgcattgatggcagataactatattgaatctcaatctataaatattggagagaaattgattagtagttttgagagtgattctaaaactagcaaaaaaattgatttcttacatcttgaaagcgagttttcaagacaaatgaaggaaaaatctttagaatttaaacttaatttctcgacaggaattgcttctaagtcattaaaaaattgtgttaaattagaatttacaaacactcaggggaaatcttcggttaatatacgtggaaaaattagatcagtaatatggccagaaccaaaaattaagtttgaaagtgtatcgattaatactccggaagaatatcccaggaaacttctttttaatataaactttatgattgaacaaagcgataaagtcttaataacaggggactccggtgttgggaaatcatcactcttaaaggtaatttgtgggatttggaataatgggtcaggaaatatttataggccaccttctagtgaattattatttataccgcaaaaaccctactgtacccaagcaacgctaagggaacaactgttttatccgcaaataccctcaattaaaactaatggttatgaatataaaaataaggaagaactagattcatatctattgaaaattcttgaggaagttgggctgaaatatctatgtgatcgactttctgaaagtgaaacagttaattgcttagacaccattaaagactggtcaacaatactttcgcttggagaacagcaaagacttgcatttgcaagaatatttattttcaaaccatctatttgtttccttgatgaagctacaagtgcgttagacatggagactgaaacaaaattatattcaatgctaaataaaaaaaactttacatacgttagtgtaggtcacaggccctcaatatcaatatttcacaacaaaaaagtccttataaaaaatggtaatataatttttgaatgtatatga

SEQ ID NO: 20 - protein, 573 aa, Cryptosporidium hominis
MLIINGAINCARTDMSIRIQIDLRMWLTNLILKQYYSDLTYYQFSINKTIDNPDQRIGEDISLFSSHLLLLICRCIDNLFDFFVYSILLYNVNFKLFISAIIYSCFGTFLTAKLGMNIILLKVQEKKLESDFRYSIMRVGENAENVAMYGGAQCEMERHEQILNSLLLNLTTKRSFESKMGLFGSIFRNLIRVLPIAVISGDYFSGNIQLGRINQCSLAFNSIVEDISILVNTFREISNLLSSIDRVGHFIALMADNYIESQSINIGEKLISSFESDSKTSKKIDFLHLESEFSRQMKEKSLEFKLNFSTGIASKSLKNCVKLEFTNTQGKSSVNIRGKIRSVIWPEPKIKFESVSINTPEEYPRKLLFNINFMIEQSDKVLITGDSGVGKSSLLKVICGIWNNGSGNIYRPPSSELLFIPQKPYCTQATLREQLFYPQIPSIKTNGYEYKNKEELDSYLLKILEEVGLKYLCDRLSESETVNCLDTIKDWSTILSLGEQQRLAFARIFIFKPSICFLDEATSALDMETETKLYSMLNKKNFTYVSVGHRPSISIFHNKKVLIKNGNIIFECI

SEQ ID NO: 21 - DNA, 1044 bp, Cryptosporidium hominis
atgttagaatttagacaatatgatttaaagtttatgaaaatgaaaagaattttgtattttatattaatacatattcttatatttaatattttagaaataaattctttaccaccaagttttagttggacaaaagcatggaaagatattaccagtgaagggttagtatatacatttagttcaaataagctaccttggtattctggagtatcttttaggattgtgggtaaatttaacgcagaaaatgataaagaaactttggtaacaattcagaatggtgatttataccactgtaagttgattataaattttgcagcacaaacagtagatgtggaatctacaggatatactgcagaagagagatgggctagatcttatgcttactttccatttccatataagccaaaattgatggatcttgacttggtagttgagaaattaagatggccaggagggttttacttttatatttcaggaagtggaccatattatccttgtcatagcatagtgtattcaaatgtgaataaattaacttttggtaatggacaaaataactttagtaaatataaaattacaagaaatgttcctttggcagatccttatagaaggacttatttctgggacgaatttcaacaaagatactattttgatgataaaaatttgtattatgtaaatagcaccggaattgatgagaaatctggagtaccaaatggtgatagaattccaaaacattataaatcttggccagaagaactagaaatacatgtacattcagcaagtatgtacccagttaatgataaaagatacggatggggaggtacggtagcagtatttacaagcgatcagagtcagttttattatagaatgaatggattttttgcaactttgtcaagtaattcatattgtttaagttcgagtgtattattaagtgggacaagttatacagttagtggagattatccttttgattttgataatccaggtcaacctttcaatgtaagtttacttatgattattaagataataagcctatttattatgaggtag

SEQ ID NO: 22 - protein, 347 aa, Cryptosporidium hominis
MLEFRQYDLKFMKMKRILYFILIHILIFNILEINSLPPSFSWTKAWKDITSEGLVYTFSSNKLPWYSGVSFRIVGKFNAENDKETLVTIQNGDLYHCKLIINFAAQTVDVESTGYTAEERWARSYAYFPFPYKPKLMDLDLVVEKLRWPGGFYFYISGSGPYYPCHSIVYSNVNKLTFGNGQNNFSKYKITRNVPLADPYRRTYFWDEFQQRYYFDDKNLYYVNSTGIDEKSGVPNGDRIPKHYKSWPEELEIHVHSASMYPVNDKRYGWGGTVAVFTSDQSQFYYRMNGFFATLSSNSYCLSSSVLLSGTSYTVSGDYPFDFDNPGQPFNVSLLMIIKIISLFIMR

SEQ ID NO: 23 - DNA, 489 bp, Cryptosporidium hominis
atgtctgaatgggatgatatggtcaaagaatggttaattgacaccggtagtgtatgtgctggtggtctttgttcaatagatggtgcattctatgctgcttctgctgatcaaggtgatgcctggaagactcttgttagagaagatcatgaagaaaatgttattcaatccgacggagtttcagaggctgctgaattaattaatgatcaaactacactatgccaagctatctctgagggtaaggcaccaaacggcgtttgggtcggaggaaacaaatataagattatccgcgtagagaaggacttccaacaaaacgatgctattgttaatgttacattctgtaacaaacctcaaggtggatgttttttagttgatactcaaaacggtactgttgtcgttgcggtttacgacgaatccaaagatcaatcatcaggtaattgcaagaaggttgctttgcaactggccgagtacctcgtatctcagggatactaa

SEQ ID NO: 24 - protein, 162 aa, Cryptosporidium hominis
MSEWDDMVKEWLIDTGSVCAGGLCSIDGAFYAASADQGDAWKTLVREDHEENVIQSDGVSEAAELINDQTTLCQAISEGKAPNGVWVGGNKYKIIRVEKDFQQNDAIVNVTFCNKPQGGCFLVDTQNGTVVVAVYDESKDQSSGNCKKVALQLAEYLVSQGY

SEQ ID NO: 25 - DNA, 1314 bp, Cryptosporidium hominis
atggaagaaaattcagtaaaatttgggaatatagatgaggaagtttcagaaaaattcgtttataattactttattaccggaataataattggaatttgtaagtggataattatcatcgcacactttttttgtttaaatagaaatggagcaagcttgttacctattgtggagcaatcaggtttttcatttggaactttattagcgcacagtttaaatgttgcaattccattatatatgtctctactgggttctcaaaactattatttaacaattctagagaaaaaaagttataaagtgagaaaaaattcatttacgtatatggtaatccccggaatcatttatttttttctttctattttgcttaatttcattggaattcccaaacatgtatcaggatcacaattagggatgagcccgagtaaaatattttcaatatttaagcctggatttttatcattttttttgcttgcttacttgacaatgttatttttctcgccatttgttgccatatctatcccaagtagtagcagcataatggaatttaaaaggtttatgtcatcaacatcaaattctgattctaacctggagaaaggtatactgattcagaaacatgcaatcccattcaataattctgatatggttaaattaagtaatattggtgcctattcaatcataaaatgtgttgtttcttctatttttgtggcttatttattttattttcttcatgttagtgattcatgcattttcaaattttttatgtttgtaagtgtaatcatattaacactttcagtaggttcatttgcattcaaagagtatttattggaaacttacgtgcttttgataatagtatctataatatggagctttatctgtttacatggaaatagctttttcaaaagtgaaattcctgatttaatttgttcgacattgtcagtgtatttgacaatgtatacagcagggcacttcttctcatgtattggaatggaagtagttaagtctccatcatattattttttatttattcctgttgttgcactggtttactacaatgttaatagttactacgtcaccatttcgccgatactttatccattttaccattgtcatttttcatttcaaaaatcattaatcatatcctggctttcaattatacctattataagtttatgcctcaatctttgcgtttatgtcaagaataagacagttatttggtttatttctagtcttcctgacgatataataatttatattttatctcttacaccaatatttgagttatttattggattttatattcatccaataatattataa

SEQ ID NO: 26 - DNA, 1317 bp, Cryptosporidium hominis
atgtgctcgaatatttatagagaaaataataaaaaaaatgaatcattaaaagatttccttgaatctcaattaaccatacaaattggcatttctctatggatcatttttttttttcactgttcacatataatcatgtataatggtgttatattcccagtagctattgatgtaaatgctactttcagttactacacggtggatttgcttaacattgcaattcccttatatctctattctcatggatgggagttagtaaaaattagagttatgaactttcaatactatttaaatcaccacttgaaatatttacttccaggatttgtatattggcttttgatatttgtcataaaaaatttcgataaatttgagttgagtactcaaagtaatttttctttaccaaatgaagactggtcttggtcagttccttatcgattcggattaatttccatttttatttatcactttctagttgcaatggttatgtatccaattatttgtttaataaaaaaatgctataattgctacgagagctgtgaatatgaatatgggataatttcaaattcagatttaattaccaatgttgataaaggtttttcagaaaacgaaatttcaaaaagttttgttgcaagtcaaaatgtttatataaattatggttcgagcaactcaaaccttccatatataatttctaacataataatatactttttaataattaatattttcttttatttttcatatagtgccaatctatatattttatatactttattttattcaagtatattcttgatctactcattaaaatttattcaaaaagaaataagtataagtggaatttgcattttcatgaatattacatatatatcactttacaaatacttgacttctggaattcctaactcagctttcaataatggagccgtattcttcaatacattttttcttttccttgtttactattttactggttttacaatggcatttactgattttttactaaaaatacaaaaatattacctggatcttttgtttcttttaccgataatatataattttctcagcattcctaatcgaacgctaatgtactcgcctctcattttcccaatttccttccaagagggggatcaaacaagagtcataatttcaacatggataggaataatattcacaatttcaatagttttaagattttgtcgtaaacgctcaattgaatacacgaaactaataattaaaaaaatcccatatatactaattattttggtaacgatgatttcatttatatacgagagagcaagacagatagcaaatggactatag

SEQ ID NO: 27 - DNA, 4953 bp, Cryptosporidium hominis
atggaaaattttaattctattccaacaattaattatcgaggcaattatcctggacaacaaaacgctggagaaattcattttgatgaagaatatgatagttctgagtccgaattttcatttcctgttgtaggatctactaattcagctaatattaaaacatcgggaaagaataaagcttttattggaagagacaaggaaaaagcaaaaagatactacatacaatcaacacttgaggtaaatattgataatcaatatcctgtagataatatagaaatatatagacaaaaaattttcccatttcaactatctccaaatatttctcttgtagcaccagaagaaaaaaatgtaaataaatccagaatttctaaaatttggaaagctttgtcaaattctgagccatccatcataggtattttaagaggcaaaggatttgtttacactcttccagagacaatagacttattattatatgttactttttgctttggatttatgatggctattcttttttttaattcctcaggaagtgttaaacattcaattcataatatgttaaaccaacaaacttttaattttcaatcttcattagcatctgagtgccttggaatgcctgatgaaaatggagtaagcagttatgaacaattatactcaaaaaaatttatcaaatacgttattgaacccaataaagacactttttttaattcgatgagtggcgacgttgtatttccatgtggaagaggaacaattaaggacgtggctactattgcggattacctgagatggattgcattggtattatttccttcatttatctatattaggaacacaatgaattcggctctcacgagccatattaaaatttcaactcaatttaataatggaacagagtctgagttaacatatgtttttgataaaggattattaaaaggaaataatatatatatctatccttatgacacggagtctgctcttgaaattttggatttgattgtagaaaaaaattattttaataatacagaggtttcaagtattaatactcgttttttcacttataatccttttgttgggataaaaacatcggttatgattactcttggaaattctaaaataactggctattatgattcaagtcttgatgttaaatctttgctaatacatacaaattcatattcatatatatttatggctcttgcaattatttcaggtttctttggtttcttgagattttttacacataaagatgtaatcgtgtctccaatcatgactataaaaagttctatgaacagggtatttgcattgctatcttctatattaataattatttctgtagttacatatatgtgtatatttattccaattaattggctatggactgaagattcttctctcgaatactctactttgctttcattacatgaggataaaatggaagaaaattttactgaacagtcaagtcacttcgaatatctagctacttttgatattatatttagaacttcaggtagcgcaagtttaatattcacactttgggagtttttttggttcctttcggttaaaatatctcgcaagcatgctacttcgattactgttgttgtaaaaaaagtaacttttcctatattatttggagctttgttggttttattttttttctcaagttatggaataatcggtttaattttactaggggattatacacctatgtattcttcggctaagtctatattattccatatgttattgttcattatagggaaaacagatgagatttggattttgttaaatgaaacaggcatatatactgggattttttttgtacctatcatttgtattttcggaattattttgcctagctatgtttatgctttgttttgccatatatataactctacaatagacacagttgaatggtgttgggacaattgtaccagggaaaatggaacaaatatccaatcttctccctggtatatagaagagaactcaatttacgaaaggaatattcgagaagataatactttatctacacagaaaactgacgaatcaaaaggcattaataacaatgaatctcaagaattaaatttaaacgtacgtcaaaatagtcagatgaatgatttgctctttgtcagagataggtattcaaatttcatggctcagacaacaacttttgaaagattgtttgatatttttttttcaagaaaaaaatatttaactttaaagcaaaagaaggagattgaaatgggtaaatttgattcttatgaacaaaccagaaaaatagcaagtttacatggaagtaatgttaataacttgaataattcgttgccaagtttaacacacaataatgcaaatgaaaatagtgagattattaaacaacaaagtcaaaatgaaagtttggaaggaagtgaatatgtaacacttgttacaaagtcaatacatgaatattattggtctattttcaattctggaaaaactattttttcgaatccagggactgtttcaaattatggaaataatatctcgagtaccagccaacaattaatgtttagaatggttggcacaatggaagcttcagttgatatgacacagttcctgatttctaagaacagggactcagactactcagattctataggtttaaacgatcaaaatggacttcctcttttagttggaaatgtaatggctgcctcaccatgcccaaatatggaaaatttattaacttttacagaaaaaatcaatagagtaggagagagcatctggtttacggttttgttgtgttttattttaatattattaattacttcgagtatttttgagtttagaaaacaaatttacaatgatttaattaattcaatttcttggaaccaatttcatactaatattaatgtaaatgcaatgaagccaatttccgcaaaggaggagcttgatattaagaaatcaactgatccatcaaagttcattctaaatcctgtcacattaaatttattgacttcagaaacctcaaatgaagtagcatattggatttcacttgcgtcctcaaggctgatatttaactcttcatcagaatatcaatataaggtgttatttccggatttcgaaaatgatgtaacttatccaaaaatattattcgaccaaaatttgctatataatgatcaaggcgaagcaggcgttacgttaagagccattgcggtaactgaaaataggtctgtagaccaatatattgatggaactagttctgctgacgaattatttaagtttataggcgtaacggaaagatttttttcaacatttgacgatgatgacaaaaaattatctgaggatttgaatatgaaatttattaacaaagcaattaatggctatccatttttttatactaaaaatattgtaccaagtgaacattcttcatttattgaaagtctgtattcaaacatttatgaattactgcattacccaaaaatagtatatttggagattctgttgccatctttacttatagaagatcaaatgttcaattttgtaagaataataataaccagagatatatcaggaggcctcaataaaggacctttaaatattttgctgagcacaataaatagtgaatttgattcatatttcaaaatttcacttgaagttgcaattatcttattaatgattgcttatatagtcgttttttttttagaatgcaagaaatttacaaagatatataggaattcccctgaatctacaggaagaagagcaaggtcaacagtgttttgtttcttcaactatatctttactgacttatcacgagctcatgacatagtaataatcatgatgattattatcaggttaggagtttattcttcaatattttactataaaatggtattatttaaatcaaagattgacactgatgaatttgatatggtctatggactatcaatccaattatcatatattaatattgcgattatttggatttttattttacggttatttggacaattttcttctatttcaagcaatttcaggtttcttacgttctcatatagacgatcatttttacctttgtttttagtattcatttttttggctttgcaatttattgggctctcaattatgatttttattaacttttcaagctgcaatgataactactcctcagtatttggagtcatttcctcaacaattaatttatttgttgggaactttgacttttatgaggcatataaatgttccagtaatcttactatttctgtattgcttccacttcttatcgcaatttattatattattatgcctgttcatactattattatattaagaagtctttggctatcaaaaaaagaatctacagatattgacagaattttcaagatagtagcggagagtcgaaataaaaaaaattctgaagaatacaaaaaatatattaaacatataactggtatgaatacgcaaattagcgagcgtgaaatatgggatcatgccgggatagattatgatgaagatgatccaattgatagaaagatgtatgaacaaaaatatgaaaaaagtgttccaaaggttgagataccacctccgaaaattgcagaacttactgatgaacagtgggatgcatcgcccgatttcataaaagaatgggccgaatatgaagcagagagttttatagataggtttagatgtttagaaagtgaatttaaaatgaatacaagctcaactggttattattctcagtttgtttccaaatgggaaagttctgtttataaagagttgcagctgctggaagttacaacaaatgaagcagagcaacttctaaaaaggttacagagggccataaagggaactgcaagtagagtgagaattaatcaagcactgcaaacaaataatctagaagctgcaattagagaaaaagaagaagaaagagaatcgaaaagagcactgctcaaggctaggaagaacagaaatatttatgataataattaa

SEQ ID NO: 28 - DNA, 1014 bp, Cryptosporidium hominis
atgaatgatacaataataggagctttctgtgtggctggtatctactttttctttattttttatgggatcgtgcaagaacgaatccatacattgggagataaaaaggttggtgataatttcaattatagcctatttttggtattttgcttttgtttggtaaacacagtcgtgagctttggagttattcaattagaaaattggagaattgggccaggaaaagaaggtaattctaaaaaaaataaaaattctagtaatgctgaaaaaatatttttcaatttgtcatttgaatgcatcttccaaattatgctaacttcagcaacatatttaacttcaatggttctaacaaatcttgcattaggtaatgtcaactacccaactcaagttctcgttaaatctgcaaaatgcgttccgataattgttattggaaccctttacttcaaaactaaatatccttggtatgactacttagctgtaatagttatcactatttctctttcttgttttaatttaatgcagataaagactaataaagtaggaaccgttcaaacactttctggggtgtcacttcttggattgtcactattatgcgatggactcactggccctaggcaagacaaactgatcaaaaaatacaacgttacatccaatgtcctgatgttctatactaatttatttgcaatgatactttgtgggattttatctttatttttagaagggaaggaaccttatctatttatttctcgatttccttcaactccgtattatatacttgcactttccttaacaggtacatgcggacaattttttatattccaatcactcattagatttggttctctatatttggcaataattactacaactaggaagtttttcaccgttttggtttcggttatcatttttgggcataaactatcccttggtcagtggctttgcgtatctgctattttcgttgttctggggatacaaactgttttctcaagaaaaaataaagataaattaaaaactaaataa

SEQ ID NO: 29 - DNA, 18563 bp, Cryptosporidium hominis
atgagcatcaacaacggtaaggaggttagcgtggaagattgtccagaatcaaagttcttagtcgaggagaatgtggatctaacaaagtcgtgcctttggtcaatcttagagcgttattataagactgtatcaatagatgcatggcgaaaaaaccaggtcccaagtttcataacatcgaataatcgtcttgccagtggatatgcgaggcttatacacagttttataatggatcaaaatccaatcggaactccatttaaaaaaatttatattgttgagattggtggtggccatggaaggtttacgtttttgcttttaagagctttagaaagatattctcctgtttgggaagatctcggatacagtggcgtaccttttaagtacatatttactgatgcaactgatgcaagcttttcgtttttaacaagagaatctagtgcattaatctcatatatacaaaagggatggctcgaatttgcatgttttaatggtaacaactctgaaccaagcgatattaaatttggattaaataaggaagaaactattccaccagaatcaagcatagtattagtatgtaactatgttttggattctcttttgactgatgcaattgcaataagcaaggacaaggtaatttctaaagctactgtttctgtctattcttcacaagttgaagaagacttaacacacccaagcattgctgatagaatgactctttcatggtcatggaaagaaatgatagatgaagatttcttgcccattacaactcattcagaaaacaaagtctgtaatacaaataatgaaacaaaaaaaactcaagaatcagaatacttgacagaaaaggaacaattgttactaaggtattctcagttcgactattctctttgtgaagtaataaagtcctatctcgaacttgatcgagaaatgtcttttgtattaccactaggggctattcaaatgctcagacgtttttatcaatactctaccgggaatatatgtgttttaataggtgataaagggtatcctgacgatactgagtttatttctatcaagccccctcatattgctgtgcatggatgtatgagctttatggtcaatttggatgctataaagaaatatttctgtaatttaggctgtagttatcttgctacaagatacaaggacacatttcaaattatctgtattcttggaggaaagaagtcttcattcccgagggtcgttgcatcatttattgatagccaagaagatttggttccagataatttgttaagcattcaaagaggctttgaacaactcagttcaaattcaggttcctttactaatggattgaaaccttatttgggcgtattaagatatagtttgcacgatccatttatactatgggtattgcgcaatggaattcttgcaaatattggagaccttaacattaggcaaagagaagatattatttttgatttgcatagcgtttatcgaaatatttatcctttggagattaatattgatgtatttgatctattggctcaaatttgtttaaaaggtggctttgtaaacgatgcaatattttactataatgaaagcttgcgttgttgccctgaaatgatacacccatcaacctatgtgaaccttgcaaagtgctatcaatcacaaagaaactggaaaaaagcctttcacttttgcaacgaagcattaaaattggatcctgactatccgccagcacttgaatttaattcagaataccttaattcatcaaaaagaattaactatataattattggttgttatagctcgtggattttcacagatgtaattccaacaattcaatttgatgcaatgtacaattgtatcggcgtagtaccgagtaaaaaaacaatagaaaatgctaagaaggcatttgaccacttacaagcaattttttcgtgtaaccaagagaacgaggttttttctagttctccaccaaagtttttccttgaagaaatttctgaaaattcttcttttgcaaatgcaattgcagatatattttatagcaacccacagatcgaggcaatagttcttgatgtacctcctgaccttttcaagccttgtatggatgttatttgggaatttaacaaacatgtcatgactagatctccaaccgccagagatgttgtaaacgcttcggaaattctctcaagaaagcctcctaggtcgctttggttcgattatgcgccattcaaatttgaaacagcattgctacaagtatttaatataattaaacagcatggtcgactttatgcaattaattgtaaatacgaccttccatcggaaactccgataaattcagaagggtataaaaacgatgagttgatagcgagactaattcattcactttcggcaatttatattgcaattgatggaactttagactgggttttttgcccatctacagataaagatcatgataaaaaaacactattttgtggatggagttctccattgtggtcacaagccgattctggaaaaagaaataaaatcccttcggaaaaagcctcaataaaacctacatccactaaaagcgatgaaattcattgcactatttcaactgaatttgtaacttgggacaagacattcatacaatttgactttcattgcgataactgtacattaagcctcagaaaagaaggcccaatttggattctactcattagaacttctaagggaaggtatgagtctaagatccaatgcgttggattgcagactgcaaatgaaagattcagaaagttgtgtaaagattataaccctgatcaatacaatattaaagattctataggcttttctgcatggtgggatgcaattgaaaaatctaagcaaagcccaattcacttttcctaccaataaatgaatgatacaataataggagctttctgtgtggctggtatctactttttctttattttttatgggatcgtgcaagaacgaatccatacattgggagataaaaaggttggtgataatttcaattatagcctatttttggtattttgcttttgtttggtaaacacagtcgtgagctttggagttattcaattagaaaattggagaattgggccaggaaaagaaggtaattctaaaaaaaataaaaattctagtaatgctgaaaaaatatttttcaatttgtcatttgaatgcatcttccaaattatgctaacttcagcaacatatttaacttcaatggttctaacaaatcttgcattaggtaatgtcaactacccaactcaagttctcgttaaatctgcaaaatgcgttccgataattgttattggaaccctttacttcaaaactaaatatccttggtatgactacttagctgtaatagttatcactatttctctttcttgttttaatttaatgcagataaagactaataaagtaggaaccgttcaaacactttctggggtgtcacttcttggattgtcactattatgcgatggactcactggccctaggcaagacaaactgatcaaaaaatacaacgttacatccaatgtcctgatgttctatactaatttatttgcaatgatactttgtgggattttatctttatttttagaagggaaggaaccttatctatttatttctcgatttccttcaactccgtattatatacttgcactttccttaacaggtacatgcggacaattttttatattccaatcactcattagatttggttctctatatttggcaataattactacaactaggaagtttttcaccgttttggtttcggttatcatttttgggcataaactatcccttggtcagtggctttgcgtatctgctattttcgttgttctggggatacaaactgttttctcaagaaaaaataaagataaattaaaaactaaataaatggaaaattttaattctattccaacaattaattatcgaggcaattatcctggacaacaaaacgctggagaaattcattttgatgaagaatatgatagttctgagtccgaattttcatttcctgttgtaggatctactaattcagctaatattaaaacatcgggaaagaataaagcttttattggaagagacaaggaaaaagcaaaaagatactacatacaatcaacacttgaggtaaatattgataatcaatatcctgtagataatatagaaatatatagacaaaaaattttcccatttcaactatctccaaatatttctcttgtagcaccagaagaaaaaaatgtaaataaatccagaatttctaaaatttggaaagctttgtcaaattctgagccatccatcataggtattttaagaggcaaaggatttgtttacactcttccagagacaatagacttattattatatgttactttttgctttggatttatgatggctattcttttttttaattcctcaggaagtgttaaacattcaattcataatatgttaaaccaacaaacttttaattttcaatcttcattagcatctgagtgccttggaatgcctgatgaaaatggagtaagcagttatgaacaattatactcaaaaaaatttatcaaatacgttattgaacccaataaagacactttttttaattcgatgagtggcgacgttgtatttccatgtggaagaggaacaattaaggacgtggctactattgcggattacctgagatggattgcattggtattatttccttcatttatctatattaggaacacaatgaattcggctctcacgagccatattaaaatttcaactcaatttaataatggaacagagtctgagttaacatatgtttttgataaaggattattaaaaggaaataatatatatatctatccttatgacacggagtctgctcttgaaattttggatttgattgtagaaaaaaattattttaataatacagaggtttcaagtattaatactcgttttttcacttataatccttttgttgggataaaaacatcggttatgattactcttggaaattctaaaataactggctattatgattcaagtcttgatgttaaatctttgctaatacatacaaattcatattcatatatatttatggctcttgcaattatttcaggtttctttggtttcttgagattttttacacataaagatgtaatcgtgtctccaatcatgactataaaaagttctatgaacagggtatttgcattgctatcttctatattaataattatttctgtagttacatatatgtgtatatttattccaattaattggctatggactgaagattcttctctcgaatactctactttgctttcattacatgaggataaaatggaagaaaattttactgaacagtcaagtcacttcgaatatctagctacttttgatattatatttagaacttcaggtagcgcaagtttaatattcacactttgggagtttttttggttcctttcggttaaaatatctcgcaagcatgctacttcgattactgttgttgtaaaaaaagtaacttttcctatattatttggagctttgttggttttattttttttctcaagttatggaataatcggtttaattttactaggggattatacacctatgtattcttcggctaagtctatattattccatatgttattgttcattatagggaaaacagatgagatttggattttgttaaatgaaacaggcatatatactgggattttttttgtacctatcatttgtattttcggaattattttgcctagctatgtttatgctttgttttgccatatatataactctacaatagacacagttgaatggtgttgggacaattgtaccagggaaaatggaacaaatatccaatcttctccctggtatatagaagagaactcaatttacgaaaggaatattcgagaagataatactttatctacacagaaaactgacgaatcaaaaggcattaataacaatgaatctcaagaattaaatttaaacgtacgtcaaaatagtcagatgaatgatttgctctttgtcagagataggtattcaaatttcatggctcagacaacaacttttgaaagattgtttgatatttttttttcaagaaaaaaatatttaactttaaagcaaaagaaggagattgaaatgggtaaatttgattcttatgaacaaaccagaaaaatagcaagtttacatggaagtaatgttaataacttgaataattcgttgccaagtttaacacacaataatgcaaatgaaaatagtgagattattaaacaacaaagtcaaaatgaaagtttggaaggaagtgaatatgtaacacttgttacaaagtcaatacatgaatattattggtctattttcaattctggaaaaactattttttcgaatccagggactgtttcaaattatggaaataatatctcgagtaccagccaacaattaatgtttagaatggttggcacaatggaagcttcagttgatatgacacagttcctgatttctaagaacagggactcagactactcagattctataggtttaaacgatcaaaatggacttcctcttttagttggaaatgtaatggctgcctcaccatgcccaaatatggaaaatttattaacttttacagaaaaaatcaatagagtaggagagagcatctggtttacggttttgttgtgttttattttaatattattaattacttcgagtatttttgagtttagaaaacaaatttacaatgatttaattaattcaatttcttggaaccaatttcatactaatattaatgtaaatgcaatgaagccaatttccgcaaaggaggagcttgatattaagaaatcaactgatccatcaaagttcattctaaatcctgtcacattaaatttattgacttcagaaacctcaaatgaagtagcatattggatttcacttgcgtcctcaaggctgatatttaactcttcatcagaatatcaatataaggtgttatttccggatttcgaaaatgatgtaacttatccaaaaatattattcgaccaaaatttgctatataatgatcaaggcgaagcaggcgttacgttaagagccattgcggtaactgaaaataggtctgtagaccaatatattgatggaactagttctgctgacgaattatttaagtttataggcgtaacggaaagatttttttcaacatttgacgatgatgacaaaaaattatctgaggatttgaatatgaaatttattaacaaagcaattaatggctatccatttttttatactaaaaatattgtaccaagtgaacattcttcatttattgaaagtctgtattcaaacatttatgaattactgcattacccaaaaatagtatatttggagattctgttgccatctttacttatagaagatcaaatgttcaattttgtaagaataataataaccagagatatatcaggaggcctcaataaaggacctttaaatattttgctgagcacaataaatagtgaatttgattcatatttcaaaatttcacttgaagttgcaattatcttattaatgattgcttatatagtcgttttttttttagaatgcaagaaatttacaaagatatataggaattcccctgaatctacaggaagaagagcaaggtcaacagtgttttgtttcttcaactatatctttactgacttatcacgagctcatgacatagtaataatcatgatgattattatcaggttaggagtttattcttcaatattttactataaaatggtattatttaaatcaaagattgacactgatgaatttgatatggtctatggactatcaatccaattatcatatattaatattgcgattatttggatttttattttacggttatttggacaattttcttctatttcaagcaatttcaggtttcttacgttctcatatagacgatcatttttacctttgtttttagtattcatttttttggctttgcaatttattgggctctcaattatgatttttattaacttttcaagctgcaatgataactactcctcagtatttggagtcatttcctcaacaattaatttatttgttgggaactttgacttttatgaggcatataaatgttccagtaatcttactatttctgtattgcttccacttcttatcgcaatttattatattattatgcctgttcatactattattatattaagaagtctttggctatcaaaaaaagaatctacagatattgacagaattttcaagatagtagcggagagtcgaaataaaaaaaattctgaagaatacaaaaaatatattaaacatataactggtatgaatacgcaaattagcgagcgtgaaatatgggatcatgccgggatagattatgatgaagatgatccaattgatagaaagatgtatgaacaaaaatatgaaaaaagtgttccaaaggttgagataccacctccgaaaattgcagaacttactgatgaacagtgggatgcatcgcccgatttcataaaagaatgggccgaatatgaagcagagagttttatagataggtttagatgtttagaaagtgaatttaaaatgaatacaagctcaactggttattattctcagtttgtttccaaatgggaaagttctgtttataaagagttgcagctgctggaagttacaacaaatgaagcagagcaacttctaaaaaggttacagagggccataaagggaactgcaagtagagtgagaattaatcaagcactgcaaacaaataatctagaagctgcaattagagaaaaagaagaagaaagagaatcgaaaagagcactgctcaaggctaggaagaacagaaatatttatgataataattaaatgtgctcgaatatttatagagaaaataataaaaaaaatgaatcattaaaagatttccttgaatctcaattaaccatacaaattggcatttctctatggatcatttttttttttcactgttcacatataatcatgtataatggtgttatattcccagtagctattgatgtaaatgctactttcagttactacacggtggatttgcttaacattgcaattcccttatatctctattctcatggatgggagttagtaaaaattagagttatgaactttcaatactatttaaatcaccacttgaaatatttacttccaggatttgtatattggcttttgatatttgtcataaaaaatttcgataaatttgagttgagtactcaaagtaatttttctttaccaaatgaagactggtcttggtcagttccttatcgattcggattaatttccatttttatttatcactttctagttgcaatggttatgtatccaattatttgtttaataaaaaaatgctataattgctacgagagctgtgaatatgaatatgggataatttcaaattcagatttaattaccaatgttgataaaggtttttcagaaaacgaaatttcaaaaagttttgttgcaagtcaaaatgtttatataaattatggttcgagcaactcaaaccttccatatataatttctaacataataatatactttttaataattaatattttcttttatttttcatatagtgccaatctatatattttatatactttattttattcaagtatattcttgatctactcattaaaatttattcaaaaagaaataagtataagtggaatttgcattttcatgaatattacatatatatcactttacaaatacttgacttctggaattcctaactcagctttcaataatggagccgtattcttcaatacattttttcttttccttgtttactattttactggttttacaatggcatttactgattttttactaaaaatacaaaaatattacctggatcttttgtttcttttaccgataatatataattttctcagcattcctaatcgaacgctaatgtactcgcctctcattttcccaatttccttccaagagggggatcaaacaagagtcataatttcaacatggataggaataatattcacaatttcaatagttttaagattttgtcgtaaacgctcaattgaatacacgaaactaataattaaaaaaatcccatatatactaattattttggtaacgatgatttcatttatatacgagagagcaagacagatagcaaatggactatagatggaagaaaattcagtaaaatttgggaatatagatgaggaagtttcagaaaaattcgtttataattactttattaccggaataataattggaatttgtaagtggataattatcatcgcacactttttttgtttaaatagaaatggagcaagcttgttacctattgtggagcaatcaggtttttcatttggaactttattagcgcacagtttaaatgttgcaattccattatatatgtctctactgggttctcaaaactattatttaacaattctagagaaaaaaagttataaagtgagaaaaaattcatttacgtatatggtaatccccggaatcatttatttttttctttctattttgcttaatttcattggaattcccaaacatgtatcaggatcacaattagggatgagcccgagtaaaatattttcaatatttaagcctggatttttatcattttttttgcttgcttacttgacaatgttatttttctcgccatttgttgccatatctatcccaagtagtagcagcataatggaatttaaaaggtttatgtcatcaacatcaaattctgattctaacctggagaaaggtatactgattcagaaacatgcaatcccattcaataattctgatatggttaaattaagtaatattggtgcctattcaatcataaaatgtgttgtttcttctatttttgtggcttatttattttattttcttcatgttagtgattcatgcattttcaaattttttatgtttgtaagtgtaatcatattaacactttcagtaggttcatttgcattcaaagagtatttattggaaacttacgtgcttttgataatagtatctataatatggagctttatctgtttacatggaaatagctttttcaaaagtgaaattcctgatttaatttgttcgacattgtcagtgtatttgacaatgtatacagcagggcacttcttctcatgtattggaatggaagtagttaagtctccatcatattattttttatttattcctgttgttgcactggtttactacaatgttaatagttactacgtcaccatttcgccgatactttatccattttaccattgtcatttttcatttcaaaaatcattaatcatatcctggctttcaattatacctattataagtttatgcctcaatctttgcgtttatgtcaagaataagacagttatttggtttatttctagtcttcctgacgatataataatttatattttatctcttacaccaatatttgagttatttattggattttatattcatccaataatattataaatggaagaaaattcagtaaaatttgggaatatagatgaggaagtttcagaaaaattcgtttataattactttattaccggaataataattggaatttgtaagtggataattatcatcgcacactttttttgtttaaatagaaatggagcaagcttgttacctattgtggagcaatcaggtttttcatttggaactttattagcgcacagtttaaatgttgcaattccattatatatgtctctactgggttctcaaaactattatttaacaattctagagaaaaaaagttataaagtgagaaaaaattcatttacgtatatggtaatccccggaatcatttatttttttctttctattttgcttaatttcattggaattcccaaacatgtatcaggatcacaattagggatgagcccgagtaaaatattttcaatatttaagcctggatttttatcattttttttgcttgcttacttgacaatgttatttttctcgccatttgttgccatatctatcccaagtagtagcagcataatggaatttaaaaggtttatgtcatcaacatcaaattctgattctaacctggagaaaggtatactgattcagaaacatgcaatcccattcaataattctgatatggttaaattaagtaatattggtgcctattcaatcataaaatgtgttgtttcttctatttttgtggcttatttattttattttcttcatgttagtgattcatgcattttcaaattttttatgtttgtaagtgtaatcatattaacactttcagtaggttcatttgcattcaaagagtatttattggaaacttacgtgcttttgataatagtatctataatatggagctttatctgtttacatggaaatagctttttcaaaagtgaaattcctgatttaatttgttcgacattgtcagtgtatttgacaatgtatacagcagggcacttcttctcatgtattggaatggaagtagttaagtctccatcatattattttttatttattcctgttgttgcactggtttactacaatgttaatagttactacgtcaccatttcgccgatactttatccattttaccattgtcatttttcatttcaaaaatcattaatcatatcctggctttcaattatacctattataagtttatgcctcaatctttgcgtttatgtcaagaataagacagttatttggtttatttctagtcttcctgacgatataataatttatattttatctcttacaccaatatttgagttatttattggattttatattcatccaataatattataaatgtgctcgaatatttatagagaaaataataaaaaaaatgaatcattaaaagatttccttgaatctcaattaaccatacaaattggcatttctctatggatcatttttttttttcactgttcacatataatcatgtataatggtgttatattcccagtagctattgatgtaaatgctactttcagttactacacggtggatttgcttaacattgcaattcccttatatctctattctcatggatgggagttagtaaaaattagagttatgaactttcaatactatttaaatcaccacttgaaatatttacttccaggatttgtatattggcttttgatatttgtcataaaaaatttcgataaatttgagttgagtactcaaagtaatttttctttaccaaatgaagactggtcttggtcagttccttatcgattcggattaatttccatttttatttatcactttctagttgcaatggttatgtatccaattatttgtttaataaaaaaatgctataattgctacgagagctgtgaatatgaatatgggataatttcaaattcagatttaattaccaatgttgataaaggtttttcagaaaacgaaatttcaaaaagttttgttgcaagtcaaaatgtttatataaattatggttcgagcaactcaaaccttccatatataatttctaacataataatatactttttaataattaatattttcttttatttttcatatagtgccaatctatatattttatatactttattttattcaagtatattcttgatctactcattaaaatttattcaaaaagaaataagtataagtggaatttgcattttcatgaatattacatatatatcactttacaaatacttgacttctggaattcctaactcagctttcaataatggagccgtattcttcaatacattttttcttttccttgtttactattttactggttttacaatggcatttactgattttttactaaaaatacaaaaatattacctggatcttttgtttcttttaccgataatatataattttctcagcattcctaatcgaacgctaatgtactcgcctctcattttcccaatttccttccaagagggggatcaaacaagagtcataatttcaacatggataggaataatattcacaatttcaatagttttaagattttgtcgtaaacgctcaattgaatacacgaaactaataattaaaaaaatcccatatatactaattattttggtaacgatgatttcatttatatacgagagagcaagacagatagcaaatggactatagatggaaaattttaattctattccaacaattaattatcgaggcaattatcctggacaacaaaacgctggagaaattcattttgatgaagaatatgatagttctgagtccgaattttcatttcctgttgtaggatctactaattcagctaatattaaaacatcgggaaagaataaagcttttattggaagagacaaggaaaaagcaaaaagatactacatacaatcaacacttgaggtaaatattgataatcaatatcctgtagataatatagaaatatatagacaaaaaattttcccatttcaactatctccaaatatttctcttgtagcaccagaagaaaaaaatgtaaataaatccagaatttctaaaatttggaaagctttgtcaaattctgagccatccatcataggtattttaagaggcaaaggatttgtttacactcttccagagacaatagacttattattatatgttactttttgctttggatttatgatggctattcttttttttaattcctcaggaagtgttaaacattcaattcataatatgttaaaccaacaaacttttaattttcaatcttcattagcatctgagtgccttggaatgcctgatgaaaatggagtaagcagttatgaacaattatactcaaaaaaatttatcaaatacgttattgaacccaataaagacactttttttaattcgatgagtggcgacgttgtatttccatgtggaagaggaacaattaaggacgtggctactattgcggattacctgagatggattgcattggtattatttccttcatttatctatattaggaacacaatgaattcggctctcacgagccatattaaaatttcaactcaatttaataatggaacagagtctgagttaacatatgtttttgataaaggattattaaaaggaaataatatatatatctatccttatgacacggagtctgctcttgaaattttggatttgattgtagaaaaaaattattttaataatacagaggtttcaagtattaatactcgttttttcacttataatccttttgttgggataaaaacatcggttatgattactcttggaaattctaaaataactggctattatgattcaagtcttgatgttaaatctttgctaatacatacaaattcatattcatatatatttatggctcttgcaattatttcaggtttctttggtttcttgagattttttacacataaagatgtaatcgtgtctccaatcatgactataaaaagttctatgaacagggtatttgcattgctatcttctatattaataattatttctgtagttacatatatgtgtatatttattccaattaattggctatggactgaagattcttctctcgaatactctactttgctttcattacatgaggataaaatggaagaaaattttactgaacagtcaagtcacttcgaatatctagctacttttgatattatatttagaacttcaggtagcgcaagtttaatattcacactttgggagtttttttggttcctttcggttaaaatatctcgcaagcatgctacttcgattactgttgttgtaaaaaaagtaacttttcctatattatttggagctttgttggttttattttttttctcaagttatggaataatcggtttaattttactaggggattatacacctatgtattcttcggctaagtctatattattccatatgttattgttcattatagggaaaacagatgagatttggattttgttaaatgaaacaggcatatatactgggattttttttgtacctatcatttgtattttcggaattattttgcctagctatgtttatgctttgttttgccatatatataactctacaatagacacagttgaatggtgttgggacaattgtaccagggaaaatggaacaaatatccaatcttctccctggtatatagaagagaactcaatttacgaaaggaatattcgagaagataatactttatctacacagaaaactgacgaatcaaaaggcattaataacaatgaatctcaagaattaaatttaaacgtacgtcaaaatagtcagatgaatgatttgctctttgtcagagataggtattcaaatttcatggctcagacaacaacttttgaaagattgtttgatatttttttttcaagaaaaaaatatttaactttaaagcaaaagaaggagattgaaatgggtaaatttgattcttatgaacaaaccagaaaaatagcaagtttacatggaagtaatgttaataacttgaataattcgttgccaagtttaacacacaataatgcaaatgaaaatagtgagattattaaacaacaaagtcaaaatgaaagtttggaaggaagtgaatatgtaacacttgttacaaagtcaatacatgaatattattggtctattttcaattctggaaaaactattttttcgaatccagggactgtttcaaattatggaaataatatctcgagtaccagccaacaattaatgtttagaatggttggcacaatggaagcttcagttgatatgacacagttcctgatttctaagaacagggactcagactactcagattctataggtttaaacgatcaaaatggacttcctcttttagttggaaatgtaatggctgcctcaccatgcccaaatatggaaaatttattaacttttacagaaaaaatcaatagagtaggagagagcatctggtttacggttttgttgtgttttattttaatattattaattacttcgagtatttttgagtttagaaaacaaatttacaatgatttaattaattcaatttcttggaaccaatttcatactaatattaatgtaaatgcaatgaagccaatttccgcaaaggaggagcttgatattaagaaatcaactgatccatcaaagttcattctaaatcctgtcacattaaatttattgacttcagaaacctcaaatgaagtagcatattggatttcacttgcgtcctcaaggctgatatttaactcttcatcagaatatcaatataaggtgttatttccggatttcgaaaatgatgtaacttatccaaaaatattattcgaccaaaatttgctatataatgatcaaggcgaagcaggcgttacgttaagagccattgcggtaactgaaaataggtctgtagaccaatatattgatggaactagttctgctgacgaattatttaagtttataggcgtaacggaaagatttttttcaacatttgacgatgatgacaaaaaattatctgaggatttgaatatgaaatttattaacaaagcaattaatggctatccatttttttatactaaaaatattgtaccaagtgaacattcttcatttattgaaagtctgtattcaaacatttatgaattactgcattacccaaaaatagtatatttggagattctgttgccatctttacttatagaagatcaaatgttcaattttgtaagaataataataaccagagatatatcaggaggcctcaataaaggacctttaaatattttgctgagcacaataaatagtgaatttgattcatatttcaaaatttcacttgaagttgcaattatcttattaatgattgcttatatagtcgttttttttttagaatgcaagaaatttacaaagatatataggaattcccctgaatctacaggaagaagagcaaggtcaacagtgttttgtttcttcaactatatctttactgacttatcacgagctcatgacatagtaataatcatgatgattattatcaggttaggagtttattcttcaatattttactataaaatggtattatttaaatcaaagattgacactgatgaatttgatatggtctatggactatcaatccaattatcatatattaatattgcgattatttggatttttattttacggttatttggacaattttcttctatttcaagcaatttcaggtttcttacgttctcatatagacgatcatttttacctttgtttttagtattcatttttttggctttgcaatttattgggctctcaattatgatttttattaacttttcaagctgcaatgataactactcctcagtatttggagtcatttcctcaacaattaatttatttgttgggaactttgacttttatgaggcatataaatgttccagtaatcttactatttctgtattgcttccacttcttatcgcaatttattatattattatgcctgttcatactattattatattaagaagtctttggctatcaaaaaaagaatctacagatattgacagaattttcaagatagtagcggagagtcgaaataaaaaaaattctgaagaatacaaaaaatatattaaacatataactggtatgaatacgcaaattagcgagcgtgaaatatgggatcatgccgggat

SEQ ID NO: 30 - DNA, 900 bp, Cryptosporidium hominis
atgattcaaaagttaatatgggattctattaatttcactcttggagatggagaaaaagataattcctcgattggtgattatgaatatttggaaataattggagaagggacatatggagtggtttataaatgtaagtgtaaacaatctggagaactttttgcagtaaaaactttcagaagtgctacaagtgaattttcaacaacaacccttagagaaatatcaatattacgtgagatcaatcatcctaatatcgttagcgttcaggatgtgatactttcatcgaaaggtgttaatatagtgtttgagttttttccttacgatcttaaacgttacctttcaatgttccctgataaagttcctcctgtaaaattcataaaacatataatttttgaaatgctaaaaggtatattccatttgcatatgcatagaattattcatcgtgatctgaaaccacaaaatattctaatatcatgcgacagaaatctacccgacgtcaaaattgcagactttggactttccagaattttatctactcctttcaaaacattgactagagaggttgtaacactttggtatagagctccagaactacttttggggaataagaattattctagttccatagatatatggagtgttggctgtatatttatcgaactgttaataggcagaccaatattttctggtgatagtgaagtttcaactctttttaaaatatttaaaacgttgggaactccaaactctaaagtatatagtaatattaactctcttccaaattacagccctgattggccaaagtgggatattgatgaaaattgggttgataatcaaatttgtatgtattctccaactaaacaatatttgctggaaacggatgcaaagaatttaataaaaatgtaa

SEQ ID NO: 31 - DNA, 357 bp, Cryptosporidium hominis
atgatagataatgcagaagttccactacaaaggcaaattcaaaaccaaaaaagaattaaaatttccgtaaaaccgcacctaatattaaagagattattcggaactcaagcaaatgcatgcaaccctgaaaatttggttgctccgtttaaaggtttggacggagcatcattaatagcttcgagatttaacagagcaagcggcggaattgagcttttgcaacgctgcgatggctctcaatataatgaagcgctggttgagttggaaagcgagagttatggagacgttatttgcgttcctgatccgcctcgtcccagttggctttgttctggtctttccgtatattgtaagccttattag

SEQ ID NO: 32 - DNA, 444 bp, Cryptosporidium hominis
atgctgataaataaattttttatattgtttagtgctgttttaatcattaatatcgttgaatacatgctatgctttgaaaaacttagaattacgccgaatgtaattgaagatttgcagaatggcaaaattacattaactgaagctttagaccgatatattgttccaaatgatattattgtagcatatgtaaaagctttatctgaagaatcacaaaagagaattaatgttgatttgaatggagttacagcggaagtcttttttgtcggggatacttattatataggaggaataccacccaaacctgaaaacgaattgaccatatatgaaagattaagggatctctcagatccaggaaatcccggtcgaagatggtgctggaagtttgtaaaacatgctcaggtaagttattttgctttcaactttttagaagcattcattttctaa

SEQ ID NO: 33 - DNA, 2277 bp, Cryptosporidium hominis
atgctaagaaaaactaaaacttatgattatgaccaatttttactaaatgactgtttagatgttggggtctgtgaaatggaaaataatcttgtacttaggaaaaagcaaagaataaattttgataactacaatgaaagtgaaagaaataaagactatatggaaaacagcggaatattttcagtctatgactttgtttatcctctttctaagcaagtttgttgtgattcaatttcgagcaatgcagcctctcttattgttcagacagtagagtttaagttaagacaaataattgaagaagcaataaaactagcatttcatagagggagttgtagctcaggtgatctacaggaaaatgcggagttgccatttatttcattaggagatattaatagcgcgatgagatatatatgtggatccaagaatctcatttggagtttggagaaacctcttagaagctattttatttccagaagtcaaaacggaaacgaccagcttatcgttgagaaaaatgcagaagtattttataatttacctgaaagatcaataaaatatataccttgtttttgttttcctgatagaaattataagatcgcttcactaaaaactttcaaaaaagatacaagtgatgataaagaaatttttcatgatattatcaaagatctagatggtaaaaaaattaaaaaaccaagtattcatttacattggcttgctgtagaaggaaagttcgttttcaattctgaaaatgatacaacatatataaagaatatttataataatatggaggcaaactctaaatttgtaaaaagaaagaatttcgacgtaatttccaatgaaaatgttgataattttaagattgtaattaataaagctattgaaggatttctatcagaggaacaaagggagtttttaagctacatgaacagaattttcttgcgtggaatggaggagctgtattcatcttgtaatttaccatttaaccttttggattcaaatattgagagaagggcattaattatcaataattacgttaatacttacggactttctgataaagatactggtacaataagctccgtattttctgtatttgaaggattaaactcttctaatttgccacattcagcctataatcaatatgacaactgtatagaaaagaataaatttcattcaaaagagtcacaacaaaagttcgagctttttcagaagttagactatatttttcacataatagagacgaataccgattttgaaccactactaccatatttagtttattatttcaattataatactagaattatatgtatccaattcgagaaaacaggagtatttccaaaaataggaactctaagactattaataaggatttgcagatctataataagaaatcctcattgctcaaaaacaacgtattatatccataaaattattgagtcattaataagaataatggtttcatgcccagttaaggaggcgctttccaatataaattttaaagtttcagaactttttcttgctgataatttaaatgctaggcttgacgcaagtattctattggaaaacattcttgaacagtgttctaatcacctaccaatcggaactgcaaaaattcttgaatatctaagtagtgaatttaagaaaatattggatattcgtatcaacaatctgacgaacggaaattgtcttcaaattgcatcattatatgggatcgtttgtggaatcagaagtctaggcgatttttcagtttctagtgttctttttccaagactactaacattattctttcactatccagaagatcaaaattcaaaaatttcttttattaggcttcacctagaaatctcatccttaataaacaaatatatggccttgttccaagttaaattcaaacttcctaaccactgcaattcaactgatctaatttttttatatttggaaaagctaattgaaaatctagaaaatatattgggtgatggagcaattccaattcttctaacatcatctattaaccctatttggaatgtaaatcaaattaatcaagcaatttgcattctcgatcaatgtattaggacacattacattgactctaatataaaatgccaaggctccaaagaatttctctacattactgataaaaagtgcctatcgaatcaatacttaaataaattcgtcaattcatataataaagatgagttatgttcgaagcatgatttctgtatagaatcttttgattcagatttctatcctttaaattctatactaaatattttcatttag

SEQ ID NO: 34 - DNA, 1230 bp, Cryptosporidium hominis
atgaacccaaaaacaattattcttacttgcgaggattttttgagaaattttagcacacacgaactaaaggtttcacaggcgaattcaaaatactttgaacagttccgtaatctaagttcgctttgggactctaaaaatgtgagtgatcgggatagcctagagcttagtgaagtatggaactctattctacattgctacaaagttgttctagacaaaacatcgactgaaataagagtaaactctgaaaaaatttcgaagagagaaaatattcggtcaaattccagtgaaaaactgttattaaagtttgatggtcaatttcaaagcttattttctactgaattaacgttgatcaaacaatttcttatggatctacttgaagtgattaaagagttaactttagtttgtgagaatatgaaatcgtatttagaaagtaatgttggccttacgagttcttcttcaacaaatagcctatcaatagtattaatattggttaaaataatttgccacaaaattgaaactaagaatcgtgatttacttgaaaaaatgtgtggctccacattatattgcttaaatattctatttcggatatataaattagaattcactgagaattgggatctaatattatttccagaaaaatttgatatctcttcaattgaaataaattacttattatacaatgaaatatctattttcttgagcatagattcagatattccttttctttcatactttttattaagttcaaacgcaaaaatgagagtgaattcaatattgtgtatacaatctatatttacttccccaatatttaggtttaaatctatgacttcactactttgcaaaccgctatcccaacaaataatagatacaagcgcatcctcattatcaaaaaatgcagtaatattgacactttcacttttaaagtttggagagactttttttagatcagaaaattatgattcagacactgtaataacttttattaaaacaatttcaaaaattgtaagcacaacaccatctctgttttggactaacaattttattaatgcaaatacaagctttattcaaattctctccaataatttactttatggtcttaaagatttaaatttatttatcccttctttgcagctcttttccaatattttgaacttaataaaaaattgtgagacctcgaagaatattcttttcgatgatttaaatccatgctttgaacaagtattgatcaac

SEQ ID NO: 35 - DNA, 822 bp, Cryptosporidium hominis
tctagtttgggaaaactagaagcaacaggtaaggaagtcataaaaattattcaatttttcgacgatttttcatttggaaaagaaatatcttcaactattgtacaaacagttaatatttctactagattatttcatgaactattgagaataataaaaattgaatcaaaaaaacaaaatgatcaaaaaataaaagaaaaagaattgaaagagtataaagaaagagaagagtcaagtaacttagctgcacatattctaattggttgttgccgtgatggtaaatgcaattcattagatccttcaaagaaaaaagacaaaaactccagaaagaagaatcgtggtggaaggaaaaaaagaactgtggttgaggttcagaatgaagatactcaatctgatgcagatcaaagtaatgataaatacgaactattaaatattaagtatgaagatcaattggttaaagaatctgttggagttgtatctagattgattgaattgcttcaagagattgctaattatgaagaaaatttagttcaaatatcaaatttattcgaactcaatactaaaaaacttaaagaaaatttcgaattgtttaaactttctaaaagtctatttacgaggtttaatgtattagttaacgaagaaagaaatcataaacactcttttgaaagcgtcaaagcaccaagaagcgaatatagcttgagactgatttcaaaatcttcgcattttcaattaaatggaatagttcccaatgagaaaactgaccattgccatcactcaactcacaaatgtaaagaaaaaatgaaaaaattgattaataatcctgac

SEQ ID NO: 36 - DNA, 1305 bp, Cryptosporidium hominis
atgctaaaattatctttttttttagcacttttaataatatatttttgtataaattattcatttggtgcatcaaatcaaagtaaaagtgatgaagaccatcttaaaaattctgtattattacaagccacagcattgaagaatctttgggcgttgctcagcttaattgtgaatcttaccgagtgttccaatatttatggcattgataggatgcttttttgttcccccagtgtaggttattatttggaaatgacgcaaaaatcattaatcgaaaaaagtaaacaactttctgacaaagaaagagaaataattgtaagggcaaaatactctcctgatttgaaagagctatttgatgaagtaaatgccattatagatgattgtttaaaaaaaagacttaaaactgaagctgcggtagctcttaaagatcaactgcttggccttataacgaaaatatatcgtcaaatggtttattttgacttctcgattctacttcctaatcatactaatgaagatgcttttcatttattccaagaatttagttctgcttctggctttacagtaacaaaactagttcttgctactacaagtaaaaccttaaacgaaaataataatacaccaaaagaagaccatcatagaaaaagtaggagaaatcgtcaaagttcagctccaaagctattgaaccagcaagaattaaatgaagcaaataaggctgctgatttgaatgctcatctaatgttgggatgttgcacagatggaacttgtggtgctcttgaaggtaaagctaaatctaaggttaaaagtaaaaaaaaaggtggcggaagaaagaagttgaaagaggttgctttagatactccagatttagaagaaaagtctgatgaaatagatcataaaaatttagatcaagatttggctcaatctatcgaaattgtaaatcaaatagtccattttctaggattaatagcagaaattgaagaaaaactaatttctagagaaaacgactttcaaacaattgtgacaaaaatctttgaaattgattcagcaacaataaatagaggtctaaaagaaagactagctaaattgcctgtgaatatgaagatacaatctagtagcattaaaaatctcctagcgctaaaatctgaatataacgaaaacataaagaaaatggctgagcctttaattaatagaaatggagaaaatctaactgttaatttaccttgtaataaaaagccaaaaggtaaatgcgtgcattgcagtcactgcagttctactaaattgtctgaagatgacgaaatacattctgttgattaa

SEQ ID NO: 37 - DNA, 1893 bp, Cryptosporidium hominis
atgaagtctcaagttttgtatttaactgttgcctgctttgtattttttttttattctaaggagactagcgctgctgaattacctaacagtagtaataaacctcaagttgttacaaaactagatctacaaaatgttgagattacactgcttaaagagacttattccattttttgtcagttaatgtgcctgataaaattgttgaatttattcaattcattaaataatttatctatggcgagacaatctcaagaactactgctaattttatcaaaagagaaaaatgttactgaaaagcaatctgagattcgtgaagaattattaaaaagaaatattgatctattatcttctatagatgtcgatgcgattaaaaaatgctcagatttgactagaaaattgagcagaaatatttgtagtaatagttcacgatttgccgagtttctccttgaattaattgaattaatccaatcaataatatatcttattactggttataatttagaaaccagtatttcagaggatttttcgtctgagaatgtcagagatttgctactatcccttaatgactattttttgggacttgtattggatgctacacaacaaaatgagaaccaagagcaaggagtaaataaggaaagtaatagtatggatgatttattattatctcttccaaatcaggacctttataatgatgaaagtcacgctttatcaagtcagttgggccaagaacaagatttataccttgaatgttctgaaaattcaaacattaataaagaaagaaaagctcctacttcagataataaattaggaaataatgatcatgtagaaaatggagcaagtaaaaaaagtaaaagaaaaaaaaatagaaaagataaagatggtaatgtaaattcaaaggaaaatatttgccaaactccaccctgtaatattcaagcaaatcgacaagatgaagatggcaggtttgaaggagctagtccaagcaatacatcaggtgttaaaacacgagctaatataactaagttagaagcatccaatgctgatgaagggagtgctagaggaaaagattctactcataaaaaacgtacttcaaaaaaaaaacatttacaaagcagtccccacggtccccaacctcaagttacttttgtgcagcctgcagaacttattgctctagatccgagagggggagcaaagcagaaggtaaaaactaaaactgatacatcaaaaaatgacaataggcgtaattcaagaagaagatcgcgttcaccttctccaaagccatgtacttcttcaggagcacaaactggttcctcttcacgttcatcttctccaagaccatgtacttcttcaggagtacaaactggctcctcttttcgttcacattctccaagaccgcgtgtttcttcaagatctcaagctggttcttctctgcgttcccatttacaaagtaaaggcaaatctagaagcaggcgtagtagatccaggagccgtgacgcttctccaactgctccaaggacgggatctgtcacagaaggagatcaaagtaaagacggagaattggaagcttcagaagcattgtttttgatacaagaggcagaggaaactttaaccgaaatattgaagcttgaagatgaattgttgaatttatcatttaaattacacgaaaaattgggagaaatggatcaattgcttttcaaaattattggtagaggagataaatttgctgcaatcatagctcaaatggaaattataaaagtggcattagaagattggaggaaaaaaatagattttagctcaaatggaaaatacgttttaatgaacgcaaaagatgtattggcagctatccctccatctgttgcagctagggcaaggacttgcatcaagagtatgtggttctag

SEQ ID NO: 38 - DNA, 774 bp, Cryptosporidium hominis
atgaaatttgatacaaaagtatcactttttgtattattttctttttcattattttcagtactgagctcagcaaatataccaaacgatgacggggaagatatttcaaaaaatgtagaaaaaggtgtaattaataaattctctggattaaatttaaatgtatttgaagctgaattttgtatagagatactggtacaaatgatgcttataatttacacattcatattgagatgcaatgcggtatttaatcctgaagaaagtattgaatctgtcagtaaattaaaattaattcttctttatatagacaaaaattctcgattttctgacaaaaaaaaaatgatatctccaagtcgattaaaaggtattaataaagcactcaaacctttaatagaaacagatttaatttaccaaatggagaattcttcgagagttggtacatccatttttgtagttgtaagcgaaaggctaaacgaaataacttcaatattgaaaatattgagtgaattgttgaaattaatgattattaaaaaagttcacttcggttataatgttatagcaaaaaaaatgatttctcttcttagtaaatatcgtttattactcaaaaagtcgtttgatttgtacagaaaaatgcccaaaagtaaatttttgcaacaatatgaaacaacgaaagaattagtttgtaccatttctattaatttaactcatggaataaatctacttgaacctgttgaaaaattattggataattataataaaaaattgattatgcaaaattaa

SEQ ID NO: 39 - DNA, 435 bp, Cryptosporidium hominis
atggagaaaaaaatacaattagaacaagagaagttggattataagaaaagacttgagaagctaaaagaaaaaagtaaatcaaaacaaaaaaaatcatatcctgaggttaaatatgagataaaaaaagtacaagagtgtgatactataatattagaaactcaaaaaataattaggcctactgttagaaataaggctgaaagaagaagaaagttgatggaagagataaataggtttaatgaaaaatcaataaaaaaagaactaataagagaagcggttaatatactaaaattaacaaggaaatctaaaaaaaatttaagttcaagtgaaaggagatctaaattgcattcaatggaaacgaataatgcccgaacgaaagatcggaatacacataatattgatatgggaagtgatgtatccagccttatattcctctaa

SEQ ID NO: 40 - DNA, 366 bp, Cryptosporidium hominis
atgatttcaaagttaatgcagctagaagaaaaaatgtcttattctgtagatgattcttctgagcataaatccaaatttattcctatgttttcaaaatcaaaagtaactgaagaagtacaatccgttgatattttcagcttttttaatattgttaatctcgattttttagaaatcacagaagcttccactattgaagaaatagaagctgccatcgaattttgcagtgaagagattactcgcattcatactgaaatcctaccgctattgacaggctatgatctacttcaaatgaaaaactttcaaaaggatctaataagccgattaattagattacttattatgtttaataataaaaagaatgaataa

SEQ ID NO: 41 - DNA, 2167 bp, Cryptosporidium hominis
atggttatattactcgagaaattgtcgtcattagaagttgattcaaatctcagatgtacagcaaaattcttgattggggtttctaatgactgcctcagaatgtttagtaaatgtattcttaaatattataaaatgactacatcacaatttaatagtttgttcgcatcaaaaatagaacaaatttccaaatcaactctttcagttgaattaaacgatgattttggctatttagtaaatatgggatctaattttgagaagatagtcaggtctatcgaggcttacaataaattcttagaaacgggggaccctactttgagtaatggagaaatagagaatgcaaaatcaattattgtaaatttttttgaaaatggaaacctagatgaaacaggtatatttaaaaaagaagaaacagcgctaatttcttttgaatttttaggtcttgctgccatgaacctatcttcacttgacaaaacaaagtttctttcatttaaaaacgaagttgaagaggcatgtaaatcagcaacattgatgattaattccagaggaactgagataagactttctcaaactgtagttgttacaattagggaggagataaggactctgatgagataccaagaatttttacgattagatttcacagtaatgaatttgaataactcacttttgaagagccaaatactatatttcatgaactttgtttatgaattattgcttagggctttcgaaattgtgagaaaagaacaatcaggggaaagcggcggaaagtatattagcacaatatattgcaaactaaatccactttttgaaaaagcattagatcactataaaaacacaattttaaactttgaacaaacgcaaacaaaatcaaaaaaaacaagtagaggcacaatttctagggatggtaaaaaaattatgagaagaattttgagtaaggatagattgaaaccgagtatatatttaacaaaaattaaaagtgactctgcgaaaaaaacaagaaaaattaaaataagaaaaaaaaataatttggacaggctcaaacaaaatgtagataaacaagggattgaaggggtaaataatgaccaacctaaaaagaaatcggaaagacaactaaaagctcagacattatcagaaacatcccagttattgcgtgtagcgagaatgatgaaaaaccaacaaggttatttaaataaaaataatattgccgacatttctattgctattggaacagttctggaaatttctggtgaaatactttcttttgatggactaatatctcatgaggaacagcgagagattatatcgagtgctaatgatttttcaaatcttgtttctaatttaagatcaattggcgatatgactaatactgaattttcgttatttgcggataattctaacgaagcaagtgatcctgataataaatcaattggaaaaaaaacaaaaatactggaacaatactcggatcaaaactcgttaatgacactagaagaacgaagacccaagttagaagatgtggtaagtttaggttcgagaaaattgataaatagtaataaaaaaaaaagaaaagctgacgatacagttagaccattgagtcaaattggtcctacggctgatttatttggtaaagatgcaacttttgcaacaaaaaaagaatcaagacacacatttggaaaaagttctaaaactcgacaaaaacatactagagcaagaactaattcttcaaacgaaaatttgaataatagtttttctttagcagacaacaaaaggactttaaaaggagcttctaaaaaaatttacgataaatcatatataaaccattcaagaagagcagcgaagcgcatattatcgaaaaatcaaagttgctttattataaataaaaaattgattgatgaaagaacacttgttatggttcctccgacattatttggacaagaaattgttcaaaacatgatttctacctataatattaaaattctaaacttttctcacgtttcagtcggctcatcgtacagttttataaaacaagccatactattttgttgtgacgaaataggtcacttattttttgagatattcccatttctttcaggtatagaaaatatgattttaaaacaaattataatgcagatgattatattgtttaagaatttagtatctgttttaattg

SEQ ID NO: 42 - DNA, 858 bp, Cryptosporidium hominis
atgaatactcacaatagatcctcaacgacagattattcatgctattacgactttagtaatgcacatgagtattatcagaaatttgataatactatgtttatgaaccaaaataattcacaatattcaggctcaatatacaataagggtctttcagcccaaggacctaactttttgcatagcaacaagataaatctttctacggtaaaattggatgtaaataataacgctcctgcacttatgaatacattaatagaaaagaataaggaaataaaaaatatggagaaagaactcaaaatagtgaatgaaagtaatatatttctcaataataaaattgaaatgttgaagattttagctgcaaactttggcgcaacacaagaagatatcgaggccacaatgtcaacaaatgacattttttgtattccaaaaccatctattaacgtaaattatccccaaacagattcatcatatgaaaatctacatgaaaaaattgatgatgaacttgatgacctgatagttagtgacaaaaatatcattaatcttaatattgatgatccagtaaaaccgtttaatgatgaacagagtaatgaatcaaaaaatatatcaaagagtactagaattaaacaacaaaatgaagatcagagtgagaaaaaagtagatctgagcccaaaaaacctcttaaagagatcatcaactctacttaaagctacaaaaagtttgacaaacagcattcaagctcaaaaatgcaccaacaacaagtacttaactggtactagattcggcccatctattcgacaaaaaacaatgatgcaagctaatgccaataagagattattattatctaaagcaaagaatatttga

SEQ ID NO: 43 - DNA, 1566 bp, Cryptosporidium hominis
atgcactacagctacaatacaaatggaatgatgcaacctcaaatgcacgtgatgcagaatcatcaacaatttagcggtatgcatcatcaaatgggagggggagtttgttctcagcagttctatcatgaaaatgggattggtaataacagaggatattcggataatcaaagctatcagcaaggaagcttccaggcacaacaacatatgccgcagtattcgatgatgcaatctcaacagcaacaacatcagcatcatcaaccaatgggagataggaatctgggaagggcaagagctcaaacgaggggcccattttcgagaacagctgcaagcaggtcaactactcctaccccaatgaacagaacaacaaatttgaaatcaagggaattttttcaaaacgatgagattggaatgctacgtagatcttctgaatattcagaagttaacaagaatccatctttatctcaaatcgaaaatagcaactttaatggcgaatataataattatagtagccaccaagatattccccagaccccaacaattggaggtggaagatcagagcatggatcaaagcttaatattatgaatccagatcatattatagttcaaaaattgaatgctcctttagaaccaactccaactcatgtcgcaagaatgaataaaatgaggctaatgggattattaaataataacaacactcctatgactcaaatgacaccaacatcttcaggaaataacaattttggaatgagagatttccatgcaatctcacgtcaatcatcttttccgcctcattaccaagaaaagtatcccccaaagtcaacaagtaattctaataatacagcagctgcatttaaagatagctcaccaaaggtactcggatcatatgtttcaagacaattagaagaagaagtaacaaggttaagatatttggtagactctcagacgaagaggatttcggcattggaaatgagaaataaggaacttgagaacgagttgatatcggccaggaattatcaacaaatgtaccaaaatttgttagaaaaaactaatttagaaaatcatgatgaagatgaaaatgaattggaaaataatgagggacaagtaaataatgaggattataatgagagagatcatgatgaagtagaagacaatgttgttcaaaagcaaaaaactatggcaagcgaaatcaaatacgtcagacaatcaagcgaaaagggagcttcaatgttttcaaacattcatcaattttcggcagaatctgcactaagaaaggcaggagtaccccctggtaaaccttcatatgtttataggccaccaaacaaccctgaaatgattgatttaaaacttgcagaatttcataattcgcgtagctcactaattagatggtcaaaagttagtagcacaatatatctatttggtacaactcaggttcaactaagaatttcaagaggaaatcttcttgcaaagccagaatcatctgaatggggtaatgggaatttctggccaattgaaaagtttgtttctgtttttgagccaattgaaagagcaaagatgccaaataattga

SEQ ID NO: 44 - DNA, 1683 bp, Cryptosporidium hominis
atgttttccactgcagtaaagctagcaaacttagatgattatttagaatcctctcaagattgtatagtttcacttttatcagataaagatgatacaaagccaaaaattgcagtaatgagacctgcaaaagcccaagataataaagatgataaaaaatcaggaactagtgataaggcaacagtaaatgtggcagattgtcttgcttgtagtggatgtgtaacttctgcggaagctaagctattagaggaccaaaatgtctcggaatttatgaatatacttaagcaaaaaaggctaactgtggtatctatttcgaaccaatcatgctcttcttttgcctgccatctaaattgtgatctaataacaattcagagaaaattgtcggggttatttaagcatattggagctaggtttgtaatgaattcaacaatttccgagtatatttccttattagaaacaaagtatgagtttatttcgagatataaggcgaaatctgatctaccaatgattatttcacactgcccaggatggatttgctattctgagaagagcttaaatagttctgtattacctttattgagtaaagttagatcagcacaacaattacaaggaattttgattaagactttgactcttgaaatatataatcaattattatttctgtataaatttagattaagcaattcttatggaacgaatatgaatattaaaacaacctttacacaaaacgatgactttgttgaacaaagtgatatttttcatgttgctattatgccttgtcatgacaaaaaattggaatcaaccagaagttctctttctttgaaatcatctgataaaaattctagttgtcctgaagttgatatagtattagcaacatcagaagttggtgaaataataaaattagcagggtttaattcactattggacgttccagaagctccactagataatttatggcttaaccagaattttcaaattactaaaaagcataatctatctcttttaattactgaaaattatgtaagcaatcaaattctgaatcagtttccttggttgattccttcatattttaactcaaactcaggcggattctgtgaatatattataagaagtgcaatcaaagaacttgctggagataatattgataataaagttcaactcccatttaataagttaaaaaatgacatcttagaagccaaatatattaaaaacaatgttgagctaaattattgccttgtttacggatttagggcaatccaatccatctctcgtaaacttaatttgcaaaagaacgcaagtcaacatactcagtataaacaaaacgttgtaaatcatgtaaattatcacttaatagaggctatggcatgcccaaccggatgcgtttctggcggaggccagatactttcacaaaacgatcaaaatgatgataactctgatttaaataagctaagaaaaaatataaagtttattgacgaggttcaagaagctttgtataaaggtattaatttaaataaaaatcaagaaattatactgccagatgaaattccaattgtgaatattttgtatgaatatctaattcatatagacaaacaaattgatagaagttctggcttaaaactcccttttcttaggaatgatttcgtatccattaatgaagtaccaactgcatcttcgttgaaatggtag

SEQ ID NO: 45 - DNA, 456 bp, Cryptosporidium hominis
atgactctattgcaagttattagaaaaacaaaaatgaaagataaagaaatgagaattttagtgcttggtttagacaatgcaggtaaaacaactgttgttaggaagtttgctggcgaagatatttctacaattcagccaacactaggttttaatatcaaaacactattacatggtaaatacagattaaatacttgggatattggcggccaaaaaacaataagaagttattggagaaactattttgaaagcacagatgggataatttgggttgttgattcaactaatatagaaaggatggactcttgcagcgaagaattgcaccgccttctttccgaggaaaggctttctggagcgtccttattggtttttgcaaataaacaagatttatctaatgcattaaaaccagaagaagtagcacatgtaagtttttttgataaaattaagttaattaaataa

SEQ ID NO: 46 - DNA, 306 bp, Cryptosporidium hominis
atgtacggatttattaagttttttgttgggttttgcattccagcataccattccattcttgctttaaaaactcaaaatcatcatttaattaaaatatggctagtatatttttttacagttgtcttttatgagctaattttatcattcattttggaccctgtctttaaagttatagatcccaggcttctacactttaagactttatttgttgtattatatatcttccctgaaacaggatttcaagaatcatatttcagtttttttagtaattatttaagtaaattatttattcaagtatttgagtac

SEQ ID NO: 47 - DNA, 1281 bp, Cryptosporidium hominis
atgaagatctttttagcttttactattttgttattctattctttagaaatcctttttcaaagatttcccacaagaaataaaacatttgaacattcttttcttcaattaaaaagccaaaacaattgggcagttattgtgtcaacatctagatactggtataattatagacataacacaaatgcactaagtttttacaattatctgaggcaaaatggctttagagatgacagaattattttaatgttggcagaaaatattccttgtaatactagaaattcaattcctggtggagtctacagcgaagactttgattttttctacaacttaaacaatcatacacaaactatggaatgtgcagacgtagactacagggaagatgaagttactgtttcaaatttcatcaaagtattaacaaataagcacgatgacagtgttccaaataaaaaaagacttctttcagatgaagattcaaatatatttatatttctaacaggtcatggaggagatggatttctcaaatttcaagattttgaagaaatgacatcttttgaacttgctaatgcaatcaaagaaatgaaagcacacaaaagatttaaaaagatatttataatatcagaaacttgccaggcttcaacacttcataaccacttggattttgaagatgtttatgcaatcggatgttccagtttaggcgaaagctcctatagtaaacattataaagttgaaataggagttgcttcaattgataggttcacacactttagtttggcagattttaaaaacttgaatagaaataagttaatgcccatagctagtttgattggaaaatattcagtatttcaactgaagtccactccccaactaaaatacaagtccggaaaaacagatataaaaaatgtatatgttaatgagttctttttcccaaacattgaaaaacttttttctttgaatattggaaacttaatcctaaaccataaaaacatcaaagagcctataaaacgagttttaaatgaaggggtttcaaaatacttaaactgctcgttcttatatcatacattaaaaagatataatgatttggatttgatagatccgttatccaattgtcatttcaaaaatacactaaaaaaagctataatattttctcaaaaaagatatgtttttaattcaaaattctcatcaaaaaaaatgattgataataaatcattaaagttaatcaaagccatttttggattaacttttattttaatattagtatttattttatcatactatagtttataa

SEQ ID NO: 48 - DNA, 1392 bp, Cryptosporidium hominis
atggaacctattaagagagttgcagttactcatcttgagtgtggtataggaggcgcagaacaactaatggtattagcatctctagcattacagagctacaaatcttcaaatgagaaaatcgagctgaccttgttcacttcttaccatgataagtctcactcattttctgccacaaatgatggcaggatcaaagtaaaagtttatggaaattggattccaagaacattttttggctacggtacaacattattctcctatattagaattatttatacttctcttataatgttttttttcgtaattatgacatcattttcacttgagaaaacaagtagatactacgatgtgattttgaatgatcaagttagtgtaatcaatcctattttgaaattgatgactagaagactaatattttattgtcattttcctgatcagttattggttagaaaaagagatggttctcttagaaaaatgtatagatatgtcatggactttttagaggaatttggtatgagatattgcgattatgtatttgtaaattcaatttttaccagaaaggtttatatagaaacattcaaaggattgatttctaatgcaaataaatatcctcttactttaagttatcctgaggtactttatccaccagtaaatctggaggatatcccttcagaagaagaatgtgaaaactatttttcaaattcaaaaatacctcaacagctgaacagagcaccaaatgtaccatttttcttatcattaaatagatatgaaaggaaaaaaaatattgaacttgctattaagtcatttgcaatattacgtgaccaatacaagccaggagagaaattgtgtcttgttatttctggaggctatgacaaaagagtttcagagaatatcgagtattttgaagaacttctcaggcttgctaattcttatgcttttaatgtttatattggaaatgaatgtattgaatcaactgattcttgtttctccgtcgtctttttaaggagtatttctgattcacttcgttggtctttactaagaaaatcaattggacttctttacactcctgaaaatgaacattttggtatggttccatgcgaagcaatgtctgtggggacttgtgtgattgcctgcaactctggcgggccaactgaaacaatagtgcatggaaaaactggttttctttgcgaaccaaatccagaaaattttgcgattagaatgaatgagctcattaaaattagtaaagacagtatagagagctcagtttggagtagttcgtgtaaagaaagagtaactgcattatttagtcagagcattttccagaaaaggctttgtgaagtagcttattcaaatgagactaaatcaaaagtattcaagaagataaaacatttataa

SEQ ID NO: 49 - DNA, 1065 bp, Cryptosporidium hominis
atgagtacggcaattttgggattaattgaagacgtttatgcaaatcgttcaaatggaacaatagacaataaaaggaagatgtgcttggagttttccaaggagttactagacttagatgggacagactttttgaaaattgtaacttctctgatttctgatgaagagaaatccaataaatttatcttcacgcttgctcaagcattaatactttgtaaaggtgataaatgcgataaaagacttttgttaatagacagattacttacagggaatagacgtgttatagaagacgtcttatctccgattatagctattcttacttggatttatctgaccagagctttctgtacattatcatcaattccaaaatgccattttgacacaaaagactcagatcataaagctttaagaccaaattatgatggaattgaacacattttactgaggatatgtagtaggaatattgacttgttgagatcaagttcttgtaatttatgtttgcacgaggatgatttaaactcatcggttatattaggtactaataaattaaaactatttaaacaaactaaagtagagaagaaacataggtttgttgatttcattgagaagtttgatggtgatagttattccaatttccccacaagccacaaagaccaaacaactcttgtgcaaatctgcatatcgctcattcatcaattgaattttaatggaactataacttttatttggatcatgttgggactttgcagttccctttcaaatcaagagctaatccccattgatctttcttccataaattttgaaaccagagatatttctccaaataattctaaaattagaataaatatagaagatgacacgttgataacaatatgtaaagttgtaggaaaatgcttattttcattgagctccactaaatttaacagtaatataaaaaaatttatatataaaaaaattagaattactctaaataaggtacaaaggaggtctatatgtgaggttatgcctaattccagctctttcatctcttcatatatagttttaatagaaaaaatactaaacagttaa

SEQ ID NO: 50 - DNA, 1500 bp, Cryptosporidium hominis
atggaatttttgaacttaggacttcacaaatgggtccaagatacatgtgactcgttgaaaattcaaactccaacggcaattcagtccaaaagcattccatatatactaaaaggaaggaatgttgtaggaaatgctccaactgggagcggaaagactttatgctattgcttaccgatgctacaaatcctggcagaggatccattttcagtatttggccttgttctagttccttcaagagaattgtcatatcaggtattagatcaatttcaggtgtttggtaataaggtaaatgcaaattgtcaggttttgactggaggatttgacgaatctgaacagatacatatattaaatcagaaacgacctcatatattaataggaaccccaggaaggttgtcatcgatcatttcgtacccggggagcaatataagtgatcttttgagaaatttgagatttctcgttttggatgaagctgatagactcttgagcgaatctcttgaagatgatatgcttcctatattgtctattcttccaaagtcatgtactggacgccagactttgcttttctctgctacgttaacaaatgccattaaagagatcgtaaacaattattctactgcccccaaagatatgaaaggaaagaaacctcaagaacttccgatgataatagtgaacgaaaatccggacgactcacctgttgagaagattagacagatgtatttgtttctgaatcatagagttagacttgtgtatttacattatattttatccaacgttcatttctttaacattgattctgttgataaagcaaaattcgagaaaaattcaactttttttgaggattctcaggaggatgttgacgaaaatgtaacatttggcaccaaaaacaagaaaaaatttataaagaagcaagaacaagttattgatcaaaataagataataaaacaaggaataattttcactgctacaaaacaacaatgtcaaatgctaacaagctgcctagaaataatgggatactctgttacaggattacatagtttaatgaatcaaagaagaaggcttgcttctcttgggaagtttaggagtaaaacgagcaagttattagttgccaccggtgttgctgcaagaggtttggatatacctgatgtagagtttgtcattaactatgattttccaagatcttttgaagattacatccatagaattggtagggttggccgtgcgaataaaacaggtatttctcttactttcgtaacagaacaagatgtaccctatgtatatgaatttgagagcaaaatgaaaaaagaaatggagcttttaaagctagatgaggatgaagtactgaaaaatatgaatagagttactgttgctcagcagaaggccttgctattgttggaggaaattggattcaatgagaaaaatcaagaggctcgtgagagaaagctcaaagttttaatgtcaaagaataaaattccatcggataataagaaaacaatcaaatag

SEQ ID NO: 51 - DNA, 1383 bp, Cryptosporidium hominis
atgagtttattatttttgacttttgtattaataatattaaaaacacattgtctaaattcgtctggaaaccttaatgaaatagaattcccaccatcttggcatttctttgaaaatcataatagcttagaaagctacaaatacgggttttttatggaaacactattacatttaaaaaaaaagagtgagaaaaatggagaaattttcagtaatataatgaattataatatagagtctaaaccttgtgaaatagatgaagatgtctttaacttatttaataatccagtaattttagtcgataatagaactacttttcaaaaggatgataatacaaaaaatgttttattttgtcaagagaaaactaatattggaagtggtaaaaaaaaacgaaagactataattcgaacattaaaacttaaattggaaaatgggaatgttcttagactgatgttgaacttctcaaaaattgggttgtggatttgggataacaatttattattaaaaaatcattctaatattatcaatagatgctttgcagttgggaaaaaagataaaattaagatacttcaaaaaagcttacattctaagataaaggtttcagaacttctgattgaggttcctttttttaaatctaaattgttttctcagaatatgtacaagttcatagttgaaaataaaattgacggaattattggattaaatgataactcaatccaaggagttggaatttttgaaacagcatcgaaagctatggaaccttctaaaggtagatatattatgtcctttcaatgtagtgggcttggggataaaaacagagtaaatcagaatgaagattccttgatatttgcaatttataatggaaatggagaatcttcaaaagatgaaaaatttttatcaaatggagaatctgaccccatagttaaagtaatgatagacagagaagtaaaatctaaatttaatgttaaatttagcataaacttaaatatatatggagcaatcataccagaaattaggttattacaattatatacaattttaaataagtatgcagttcaaaagggttttagctgcgaaactcaagaaacaattttgggaaaaactattttatgtgactgtaattttctgaataataagctcagcattaaattatataataatgcaaattcatactcaattgatttgagtaacttcgtaattaataatggcaatgaccaaaagagttgcggaattgagatttacggaagaaagagaaacggaattaaatttgaagaaaattgggtatttggccaaatactatgtagtgccagtaatataagccgattttcaaaaacgaacagttctagttggagcataggaaatcctaaattctttataaatcaagcttaa

SEQ ID NO: 52 - DNA, 213 bp, Cryptosporidium hominis
atgggtaggaaaaaaaggaaggtagctgaaatcaaaccattttgttactattgcaaccgcgagtttggagatgaaaaggttttgaaacagcaccaaaaagtgagacatttgaagtgcttacactgtagtagaaagctttcaactgtttctggattaattgttcacatgctacaggtaagttggaattttaaatcttcaaaaatttatagctaa

SEQ ID NO: 53 - DNA, 243 bp, Cryptosporidium hominis
atgtatggaggtccagaattcatctttggagcaatgcttcccttcccaaatcaaaaaccaatcccaggtgtaatggttcaaagggagaatgagaatttggggaaaacatcaaaaaattacgagctcataatggtcctagaagattcagatacttctccggaggaattgtatgcatcaaaattattttcttacaggataattagaaagcatgcaccaattaatatttcgcttattaaaaagtaa

SEQ ID NO: 54 - DNA, 1104 bp, Cryptosporidium hominis
atgagaagggcacttagaacgattttgaatgtatatggttttattcttagtgcatttattgcactgccagtgttggtttggggcatgtttgtcactttgatttctaaatactctgacttcaatttaggctgtttgagtgatgacatttctcctgaatacttcaaagataaagtagtttggattacaggagcgtcttctggaattggcaaagctcttgctttgagattagcaaaactttcaaaggaaagtaatattacactatctttaatcctaacaagtagggatagtaaacgactcaaccaagtaaagaatgatttggttgaggaatttaagttccctgaaaatgatattttagtcttagaattcgatcttggtgatttagacgcgattgattcaaaggttgatgaagctagaaattggaaaggaaaaattgatattctatataataatgccggaattggccaaagagcaatcataggtagctttgaatcagatgaaaaggttatgatgatcaactcattaggtagcatgaaaatttctaaacaagttctttctaaatgttttattccgcaaaagtcagggcatttaataaatacgcttagtatccagtcctatgtagtattacctggaagatgtgcatatggagcaagcaaaagagcttgtctttcatttttccaggcattgagaaaagaattgaactatattaactgggatgaatacttggaatacaactattctagtgacaaggaggaaaatatttctccagcaattcaccttggcaaccccaacgtagttattactaacatctatccaggacatatccaaactgagtttgattcaagaaatgttctgcacgatggatctctgaacgttggtgctcataaattgaaggggatggcctcggaaaaatgttcagatttaatggttaaagcaacctcgaatcttttaaatgaagcttggattgctcagggtcatgaacttttgtttttctatctcacatattattctccgagtgttgcagaagcaatacaaagttttctagataaaggatttacagataaaatatgggaactccaaaaatctcatcttaaaaaatctagttaa

SEQ ID NO: 55 - DNA, 1467 bp, Cryptosporidium hominis
atggagcaaataaaagtaacagtcaagtggaacctgaaaacctttgaagatgttgatcttgttttgtcaagtcctctttctgagtttagggagaggttaagcaatttgacaggggtacctgcttctaagcagaaattaatgtcccagagaggtgtattaagagatgggatggatttaaataaacttggtttaaagcctgggtcaaagatagttcttgtgggtactgcagaagggggtgaactgaaggccccatcagagaaaactatattttttgaggacttaacttcggatgaaagggcaaagattttgcatgaaaaggaaatagtacctcttccggtaggcctagagaatctgggaaatacgtgctatttaaattcaataattcatatgttgagaagtatccctagttttttacagattttgagaaatagcaatttgagctcatctgaaagaacaagttcaagttcaggaaattcaattaaatttctcaattcgtttaaacagttaatggacaagatggacggaagcattgaaagagtggttccaggagagtgcgttgacttatttaggcgtcagttcccccaatatagtacaacaactggaggagcttttgcgatgtaccaacaacaagatgcagaggaagttttgggaagtttgcttacattgtttagaaacgagctagacggaaaagatggagatgatcaaacaataggggatttattccgttttagaatgaaaactaaatttaaaaatactgcattagagactgacgaggaagttaaaatggaggagaattataagcttatgtgtcatatgggaactcaattgaatcctgtagacttcttaactcaaggtattaagctctcattagatgagaaagttgagaagaaatcttctgaaacaggtatcgactctatttatcaaaaaacttcggaaatagattctttgccaccatatttacttgtacagctcgtacgatttgaatggaaaaaatctagtgagattgcaagaacagaggctactagagcaaaagtgtgtagaaagattgagttttcccaaaatttagatctttatgagttttgctctgaagatttaaaaaaaatccttaatattggaagagatatctcagagaaaaagaagagtaaagccatagagaagcctgatcaagaagaacagaaaatggaaacagagttatatacagattgtcctacaggagtatatgaactcgaatgcgtagttactcaccaaggtcgtactgccgacagcggacattacgttgcttggagatattgtccaaacgatcgggaatacattattaaatttgatgacgacaaggtctcgagaataaaagccaaggatgcagatctttcaggtggtagatctgattaccacatagctgtaatgcttttatacaaaaaaacagtaattaaggcttcagaagaggagatggccacattattaagttag

SEQ ID NO: 56 - DNA, 1050 bp, Cryptosporidium hominis
atgccaaattctccaaagaaatcacttaagaaagtaattaaggaagagaaaggcgaaaaaaatcaaagcaggaatctgaaacaggcaaaactagaagtattttcatcgaatattaagacagaattaaaagtaagggatgatgtttgtcatacatatgagggacacaaagaactagccgaaaaatatcggaaatttgtgggagctcatgtaagcgcatcaggaggagtagataagtcagtgaataattcaatgaatattgcagggatggcattttctatgtttctaaagccatctcgtggatggaatgctcctcctttaaaacaacaaacaattgacctcttcaagaaaaattgtgaaactaacaaaattgaatattgtaaattttgtattcctcacggttcatatttgataaatctagggaatccggatgaagagaaaagaagtaaaatgtacgtagcatttgaagatgagctcaaaaggtgtgatgcactaggaattaggctttataacttccaccctggatcaacagttggccagtgcagtaaagaagaatccattcaatttatttcagattgtattaataaagcccatgaacagacaaagtcagtaatcacggtattagaaaactgcgcagaatcaaaatgtgtaggttatagatttaaagagctttctgaaataattgaaagagttaaggataaaagccgtgttggagtttgtcttgatacttgccaccttttcgcagcaggatatgatgttagaactgcagaaagttttaataaagtaatggttgaatttgaagcagtaattggacttaaatatttaaaagcaatgcatctaaatgattcaaaagggcagtttaattccggcctggatagacatgaaaatctaggaaagggtaacatcggtatggaatgttttaaatttattatgaacgactcaagattcaatgacatcccattaatccttgaaactcctgatccgaataatgatgacaaagtctacaaaaaagaaattgcaatactgtatgacatgttggttgaaaacaagtaa

SEQ ID NO: 57 - DNA, 1749 bp, Cryptosporidium hominis
atgaacagaatccgaaggaaaatatcgagatatgttcatagaaagcctaaaggatttagaacagaagagatacttgaaagaaacacagatataactcaagagatagatgtaaataagcatattagcctgctagaaaatatagaaatagaaacaaatacaggtgaaagacgttcaaagtctttaagttcatctaatttattagaagaggttcatatagtaagtaacgaggcagaaaccactacagtaattgaagaagtagacaatctgattagttcatcttctataatagaatcaagcaatagtaatacgctcattaaaaaaaataaagtaatgaaaacaaatagtgaggaaagttttgttagtattaaagaaagtgaagatgacttatctgttgaaaggctaaatacaacaaaaacttgtgttgaaaatgaagatatagaaaaagaagaaacatataatattactaggagacggaaccttccggttccaaaaacatctgccaaattctcgcttttatcaatgatgaggcaagtttttggaaaagatctttcaaggatatctatgcctatatgcttaaatgagcctttatcctttatacaaagactttctgaggatttagaataccatgatttactgaaaaaagcaagtaattccaaatctattgatgaaagagttgcatatataacggtatttgcatcttcagcgatttcttcaacatttttgagactttcaaagcctttcaatcccctattaggagagacatttgaactaactcatagagggttcaaatttattgcagagcaagttatgcatcatcctcctgttgcagcatatcatgcagaatcagatgatggaagttgggtctattgggggacagtttggtcaactatgtcgtttggaccaaacagtctgtccattcttccacaaggaactgttcatttaaagatcagaactgctgatggagaggaggaatattcttgggaacgacctaattgcattattcataatattatttttggttctacatggttggaatggctaggagatgttaatgtaacatcgaaaaatcatggttatagaggaaagacctcatttttctcagattcaaataattcatattcatggaataaatataatagtagcttagaaaactcaaagcgtggtaaaagacgaaatattgtaacaggttcagtatataacgaggataatcagaggttattctgcattgaaggacagtcagaccaagaaatccaaatttcttcaacaaaatctcaaaatgattcatttcatccatattctaaatcaaatgttgtttggagatgtaacccgcatcctaataatggagataattcgcataattttttcttaacatatatggctcttgaattgaatgaaatatcagatgattacaatccagaaaaaggggcaaacataccaataactgacagtagatttaggcctgatcagagattatacgaatctggagacgtggatggagctcaaatcattaagggactattagaagaaaagcagagaaaaagagaaaagagtggaaattctgctgtgccaagatggtttactaaaggaaagaggctttcatcatctgttttgaatgccaaaaatagctctgtatctaaagatgttgttgaatatgaatgggactttacacatgaatattggaattataaggattctcaggatttctcaaatttaaacgatattattgatatttttaatatcgataaataa

SEQ ID NO: 58 - DNA, 2445 bp, Cryptosporidium hominis
atgaatgttgacggggaaaatcaagttccaaagtcagaggaagttcaaatgactaatggtgattcctctgctaataatacgtcattaactcaaattgaaaaaaagagagctccaaatagattgctggttgacgatgctattaatgatgataattctgttgtatgtttaagtccagcaaagatggaggagttgaaattatttagaggtgatacgattttattaaagggtaagaaacgtagagatacaatatgtatagtattggttgaccctgatttggaggaaggtaaaattcgtatgaacaaggttgtcaggaagaacttgagagttaagcttggggatacagtttctgttcttgaatgtggagatgttccatatggtaagaggattcatgttttgccattcgatgactgtttggaaggaattactggtaatctttttgaaacatatttgaaaccgtatttcctagaggcttacagacccgtcaaaaagggagatgcctttttggtaagaggcggattccgtccaattgagttcaaggttgttggagtagatccagaagagtactgcattgtagctccagatactgtaattcactgtgaaggtgatccaattaagagagaagatgaggaaaaaatggatgatattggatatgacgatattggaggctgcagaaagcaaatggctcaaatcagagaaatgattgagcttccattacgtcatccagggctattcaaagctttaggagttaaacctccgagaggagtcctattatatggacctcctggttctggtaagactcttattgcaaaggcagtagcaaatgaaactggagcattcttcttcttgattaatggaccagaagttatgtcaaaaatggcaggagaagcagagggaaatttacgcagagctttcgaggaggcagaaaagaactctcctgcgattattttcattgatgaaatagattccattgctcctaagagagagaagactaatggagaggttgaacgtcgtgttgtatctcagttattaactcttatggatggattgaaagggaggggccaagttgttgttattgcagctacaaataggccgaattctattgatccagcattgagaagatttggcagattcgacagagaaattgatattggagtcccagatgataatggtagacttgaaattatcagaatccatacaagaaatatgaagctagctaaggatgtcaaaattgatgatattgcagctaatacccacggttttgttggagcagatttggcccagctatgtactgaggcggctctctgttgtattcgtgagaaaatggatgttatcgatatggaagatgaaacaattgacgcagttatcttagattctatggccgtcagccaggatcactttaactctgcattgggcgtttgcaacccatcttctttgagagaaactgttgtagaggttccaaacattaaatgggatgatattggtggtcttgaagaagtcaaacgcaacttacaagaaatgatactttatcctattgagcatcctgagaagtttgagcgttttggaatgagtccttctcgtggagtcttattttatggtccacctggttgtggtaagacattacttgcaaaagctgtcgcctctgaatgttctgcaaactttatttctgtcaaaggacccgagcttcttaccttatggtttggtgagagtgaggccaacgttagagaggtatttgataaggccagagctgctgctccttgtgtactattcttcgatgagttagacagtattggcactcaaagaggaagcagtatgggagatgctggcggtgctggagacagagttatgaatcaacttcttaccgaaatcgatggtgttggtgttaagaagaatctcttcttcattggagctacaaacagaccagagatccttgatgaggctttattacgtccaggaaggcttgaccagttaatttacatccctctcccagatcttcctgccagagtctctgttctacaagccattcttagaaaatctcctctttcaaagaacgttcctatatcttttatcgctcagaaaactgaaggattctcaggcgctgaccttgcagagctttgccaaagagcagcaaaggctgcaattagagatgcaattgctgctgaagagctaaagaaggcatctggggatgatagtgctatgaaaattgaggatgaagtagatagtcacatttacgaaatcggaagaaaacattttgaggaagcatttgctggagcgagaagatctgtaagcattaccgaccttgccaaatatgatcagtttagaatgaagtttgaccctgtgtatgtcactcaatccggaggagaagggtttacgattgactggccagattcgacccatgcccaatactctgctcccatcgatgacgatgctgatgatttatattcataa

SEQ ID NO: 59 - DNA, 1194 bp, Cryptosporidium hominis
atgagcacaaaagagaatgtcatagtctattgggagaaacaaggaaacgacaggatgtgtgctctacactgtttaaactcaattctccaaggaccatattttgatgaagcttttctctctaagattgcttatgaaatagatgacatggaaagacgcttattagaaaaaagtaactcaacttttaagacaatttccgataataattctcaaaacgcttcctacgatggcttcttctcaatcatggttcttcaggaatgtttacaaagacatggatactcttgtataccagcagcaaatccgagagttcaagattatattttgtatccatcgtcttgctgtggctatatcattaactcatcagaacactggacttcaataagatgcgtcaaaggaaagtggtttaatttagatagtcttaaggctgctcctattcacattgattatttcgaggtttcaaagtacttgcaagaaattatgttctctggaaagagtgtttttgttgtacaaaaaattcagaatgaaactgattcacattcaattcctttacctgatcccgacccatttcttagaccaataaagaacaatggtaaacaaagattttatctcactgcttcagaaattgagaaccttgttttggagaaacaaaaagaagaaaatagagtatctcaaatgggtgatgaaaccccaaataagaattttatgtattctaagaaaccggttgaatactcatggccaacttctggcggaaatgtgttgcagtctacattaaataatgttgatcaatctaatgaaatgacatccgaagaaaaagaacttcagaaagtattaagggaatctgcaatagagtttgctaagagtattcctcttccggatgaaccccctgcagatcatgtcaattctatccaaattcgtgtcaggagcaaagttggatcatcttttgtcagaaggtttgacaagactaattcctgtaagcatctattctcttggatcgaatatgaaatggcactattggggaattcaattcatggtagcccatattctttcgtttctcaatttccctatctcaaagtttcaaaatttgatgaaaattcgattaaaatttcgagatctgatattagtgagatgatccttaattcaccaactttcaatgatattggtattaatgagaacactctattactacttaatctttaa

SEQ ID NO: 60 - DNA, 999 bp, Cryptosporidium hominis
atggataacttatggagcaatccgaatgtaaataataaacactgtcagttattattcattgaatgtgaactatggaggcttcatcctgctgaaaaataccaggttcccattgtaaatgggaatgttggaagtaatcagcaatcactatgttttgaaccatcttttttagatgcttcatccctctttaatatttcaaatgtttctcattttgaagattctaagtatttagttgaagttaccttactttctgttaattcttcagatgacttggaaaatagtacaggatatactgcattaatttcaagcgaattcttatctcctcaaactttatcttattctagggattgtatagatgtcaaaggtttttctgaaagaattgaaaagcaaggcattcttgatatggaaagaatacatagattaatgagctactttctctcttgttgtcaaaacaaagattgtaattgcaatttgaataatttaaataataaatcatgtattattacgtgggatcctgtaaaaacaaaattacttctaaatctagacttgttcaataataaccttgcatctagtaatagcacaatttcagttaatcattcatgtccaaataatatatggaataaattaaactctataattggtttaggcggattaattaagagttttcttccagaattctggccagcttatgagcccagcagttctctggagctcttcagcatacttaaaaatattgcattttctttcaatatatccattgaagatctttttgtttctccatttaatagcgataatattacatccatcagagacctttcactaatttgtaaatgtatggcaagaatataccttattcttttaaaaaagggaattattaatgctcatcaagagagagtcaatgtttctgaatacaaagattctcctcatttagaaaattctcttgttcgtcctgttgtgagactaagaggtcttccttggaaagctgccgtattagatattatt

SEQ ID NO: 61 - DNA, 1612 bp, Cryptosporidium hominis
atgaagaagcaaagaaagccatcagatattattagttttttaaccataatttttttgatatttatttacaaagtttttggatatgtagaaagaccagagaggaagctacaatattcaagagaacaaatttcaacaattcctgatgattatttagaattaggaatccctgatatggattatggtgttgaaaaccaagatctcagaagaattttgtattctttgaataggggttcattgagaagcttcccaacattgaacgaagcaatgatcattttggataatttagcatcacaattcggaccaaactttatgagaaagcataaaatagggacaagttttgaaggaaggcctattgatgcttatagagtcggattttttagtaagatggatggctcttattcagaagattcgtacttttatatcaatcagggtaaaaaacctgcatttttactaacatcaatgcatcattcaagagagcctgcaggcttaacaactggaatatactttatcactaaacttatggaagatgcaatttataagcaagaccctgcttctaactttttactctctaatatcgacatttggtatgtcccatttgtaaatccagacggatatgcagcaatagaaagaacaagaaattatgggattagaaagaatcaaaggaaaacttgtaattctgggagatcagatgaagatggagttgatattaatcgtaattatgacttcaattttaaaaactctcttgtttctaaatgtgacccgcaagagtattctggggaatatcctttttctgaacccgaaacacgagctataagagatcttgtaaataatgtaaaaagttttgttactgcagttaatctacatacatttggtgatttgtggactataccttggaattgttgcaaaaacaaagatctaaacgagaatatcgcttccatatataatgaacttaagtatgaaattttaatatcttctccttcttgtataattagaaccttaatgcatatgaagggcccattttttgtcaattctgccaaaaaaggatttgattcaacatttttcacaaaatcaagaaatgagtttgaaaatgcttccaattattgtttctcatcagcagctagaaaccccacaatggattatgaggcttcgggagaagcagatgactatttacttgcagttcacaatataatttcattatctccagaaattggctctgaatattttggtttttatccccctcagagtgaaattttcccaattgcaaaaaaatattatccccaaattcttgctgtggcctcaaagtccactattgagcttagcatttctgctagcttacacttacaaatgcactctgaagttaatcatggaaaacttgaattttcaatgttcaacagtggattatcatctatttgctccaatattacttatgagactcacaaaaatgattccaagggaacttctgaatgtcacacaatctttacttgggagctgctttcatctaactgtaaacaagattccaaatttgatcctggaaaaaccaaattcggtgagtattctgccggctttagatacagaacttctaattttaaggaattgaactctactgtcagca

SEQ ID NO: 62 - DNA, 468 bp, Cryptosporidium hominis
atgaacaagtttaccaatttattaattaagagaaccgcttcaagcttaaagggaggagattttagagagctatttaggaagaattatatcccgataacgcaatttgagaaagttttgctgtcagttacaagctgtgtagaaggtcttaaaaatccaactgattctaattcagttgcatgcatcactgaacttacctcaaatagagctttgagaaaattacagattttgatgaactctacgccagatggtagaagaataataaagaatagaccattgatagattcatcaaaatattcgattaaagatttaatggcttttccagatgattcactcggaagaaggtatggggaatttttgacaacttataatcttgaaatagatcgagctcctgtgagatatgtgaacagtgaggatttagcttatgttttgacaaggttcagacaggtaagtcttaacgattataaataa

SEQ ID NO: 63 - DNA, 813 bp, Cryptosporidium hominis
atgtacaaaactaaaaataacatgaattcaggatatgctgaccctagaagcttggtattgactctacaagaattatccacagattatcacaaggaaattgctgaaatgaacaatattctgtttcaagcaaaagaaaggtatcaattaactcttaatgaaaataatgaaaagattcagagagctcaagacaagatgtctgatgaaaatgtccaaatccaaaaggagtttgaagaacttagaaaaatgtatgagaagaatctccctagtttaaatgaagaaaaaattatgatccaatcccaatattacaaggaaaaatccaaatttgattgcgattttcaaactaaagtcaatgaagccacaaataaactttccgaaattaatgtcaaactaatgacaacatcaaaggaagctgtacaggaaattgaagatttaaaagctcagctagagcgggaaattgccgagctgaactccgaatatagatccaatcttagtaacattgatgttagttacaagaaagaactaaatgcagttaatcaacatattcaagatttaaccaactatgttaatgagactacaattaagcttaatcaaaggagagaacaatcatccaaagattatcatctttccgttgaaaggcttactcaggataacaatgctgcaggtgaggagtataatgctacatgtatctctatttctcaaaatattcgtatgagaactcaaaattatgagaattctgcttcaggtattagaaatgcaattgaaggcgccattaataatcaaaagcgccaagttgttcattctccatttgcatga

SEQ ID NO: 64 - DNA, 2196 bp, Cryptosporidium hominis
atgttttggtataatacaagattttatggagtttttctactgacaattttcaatattttactaatattaaaagctagtgaaaatggaaaagtctgtgaacctagagaagaaaagtccaaagttgagttaagtcgccaaaatagttttagcaaccagggaaatcaaaaaaataatcaactaaatgaagaatttaatgtaatttcaaaagacaatgatgcatacctattactttttaaaatgatggaccacgataaacagaaaatgcttttactattctctaaagacaataattcaggagatttattatcaaataaaaataaagataatgaatctggaataattattaaaaagtactctctaaaaacttggtcaaaactagatataaataagcttaaagaactttcagtattaggtaaaaataagcaaaacaatcaaggaatttggaaaagaaaactaggaaatattcaaaataagagactaagggaacttgaatataaaacacttaatattgacaataatattttgagaattgattatactaatagattattattggaaggggtaccctttcttaatttacttcctaatgtagaaaatgaatatgcaacatccaacgaattaactctatacaaggaaaaaagtctaataaagatgagtgatggagttctaggcctaaattttgacaatgacctaaataaacttcattcatcctatcctgatgacaaaattaaaggattaattaggtatttcaaattcaataaaggatcttatggagaagtttggagaggattagcatttactgaatatttatcagaaccatttggaaattgtgggaccgagaaacctgtggaaaatgatcatttatattggagaagaggagaattgctcaatcatgaattgaattcgttgattttagatgctctagatatccttaaaaaggactttaataaggcaaaaatggctcctagtgcgccaagaaactcttctaatcaagaaaaagatggggatgtgctggatattgttatgaagaagatgagtcacaatctagaagaatctacgatcatttatagtgttgtaagagaagtattttttggaataattttgtattgccttccaaatgtttccaggtttttacatatttttgaggaaaatattgaagatcacgaaactttcaaggattcaaatgctaaatccaatatatggcttgtttatagatatgaaggtgttagccttgggaatttactttttgatattgatgataatggttcacttattccatctgaattttggtggaaaaaagttaaaggagttaaaggaaagtctaaagaaaaaaatatctttaaggaaattctttatcagatttttcaaggtctaaacagtgctcacagtctcggcataatacacagagacattaaaccttcaaatatattcatttcccaagttaaagatgagtttggacaagagtcaatttacgttcgagttggagattggggaagtgcaatggtaagtggggacgaggatatgagacaagagatcttctctgtaaacagctataaggacatacaagaggcattatatggtaaaattggtccaacatcaggagatgaaacagaaggttttcagcctccagaagtacaatttaaatcttttggatctgagaatgaggagaatcccagaaaattaagttacgacgtttggagtgtagggattgtaatgttacaaatgatttggggaaatttgcaagttttttcagtattagatgaagattctgaatttcagcatattcttaaaagagtaattttccatgttaaacaactcattaatgaagatagaaacaccaatataaatcaagatgaactggttgctgactcagtatatagacttagtttaatgaggctatgcttattagatattagtgaagggaaattgggatattcaaataaattggatagattcatttcaataatcattgaaaaagctatccaaaagtctatgaaaaattcacaacaggatgtcataggaattacaagaaaatgtagtgatgaatattttagcaacttgatacgtaaatatgacccatcagaagttggattagattctccagaagctttagatttgattaagaaactactaaagcctaaatataaagaaagaataagtattaaagaagtagtaacacatccttacttttcctag

SEQ ID NO: 65 - DNA, 288 bp, Cryptosporidium hominis
atgtgttttgaacaagaaatgtggcatcctaatgtatatcctgatggaaatgtatgcatatctatacttcatcctcctgggcatgatagatataatgagcaagaaagccctgatgagagatggcgtccaatattcggagttgaaagcattcttgtttctgttatttctatgttaggagaaccaaatttggattcacctgcaaatattgatgctgcattagaatttaaaaataacattaatgaatataaaaagaaagttagagctattgttagacaaagcgttgaataa

SEQ ID NO: 66 - DNA, 276 bp, Cryptosporidium hominis
atgcatacatttccatcaggatatacattaggatgccacatttcttgttcaaaacacatttttggagggctatttgggaaatcttctggaaatgtcaataatgcattgaatataccaccttcatataaagtatctggtggtccttcaaagcatacacgccatcttagaaagtttgaatcatcatctaaacccacagaaaagccagaagtatcatccctaataagctctgaatatacaaagaattatggtaatttaataatttttattaattactaa

SEQ ID NO: 67 - DNA, 252 bp, Cryptosporidium hominis
atgcaatttggagaatatattaaatgtaatttgaatttatacagactcagaaatggagtacaactcagtactacagctacagctaacttcacgagaaatgaacttgcagaattacttagatcagatccccacaatgtaaatattttgattggtggatatactaaagaggaaggagcaaagctttactggatggacgaactagcatctttaggaaatgttaacaatgctgctcacggatacggtaagttttaa

SEQ ID NO: 68 - DNA, 726 bp, Cryptosporidium hominis
atgaacaaaagaggtagtaaaggacgtagtgaaagaaacgaagttaaatctattaataaactacttaataatttagaaattcaaagctctaaatcatccgaatcttccttttcaagacattcaaattctaccattgtctccaactctccttctctttatgaccaagatcttaactctttgaacaaaacaataaacaatttgaaaaattctaggaaacaagtttcatttgaaatggatcttaaaaaactagaaaagaagagatcatccaaaatatcaaaaaggttctcaaatttacttggaaaaagaccctcaaaaacttattctgatgttcaatttagtaagaaattatcagaacctaagataaactatcctaacaataataataaagctgatgattataataacaatgctaagaatgatataattctcttggaagatggaatttttactataaatcaagatgaagttaaacaagttcaagaattcaatattccaattacattattaaagtctgaatctagtgaaactcttaactcaaacttttcattagatcaaagagttgcaagaacttatgatatgcaaattatcacttatgatcaaactcctataccaattccaaatcttcctagaggaagaagacttcaatctttggaaaatcttgagaattgttatcttgttattagcccaaatatatcaaacatgctttcattatgttattgcaagtaa

SEQ ID NO: 69 - DNA, 1767 bp, Cryptosporidium hominis
atgattgaagagaaagaattagaaaaaagaatgagttcagggagttactctgaatttgagccgagctcgaatgaaggatttttccaagatgaaacggaaagcaataagagtaaaatgatttggtcagaaataggacatattgttcactctaatagaaaaccccagtacagcttatcttccattttaagaaggacaaatctgtttgatgagcaagaattaaaccaatatgaggagccacttatggataatgagaacaatgtagacataacattaagagaaattggtgaacctggcaaattagatgattattatatggcaagaaaatcaaaaactctagagttattacaagttactgatataattaaaaatgtacacaaagaggaggtaaaaatatatctggatgaaattgcagtattaagatcacaaattctgcagatgtctaagaataagatgaatgaaattgcagaacatgatattatggaggagaaagaaagtttgagagaagtagaagaaagaattaatattaaagaagaagaggtaaagtttgaggagaaaggaataaatacaaatacaaatatagaattgaatttacaagtattagattcaattcagattttacttagtaaaactaataatgagcttgtaggctctttggtacacaaaattgaacttttccctgaggttttaccagatactacaatgcaaagtgcagattatgaacaattactaatagagaaaaataactatattcaaagacttgaagatttaaacattgaaattcaaagacaattagatttgagaaatgagcagttttcatcagtaagtcttgagcttgtcaaacaaaaaagtctttttgcaaaagaatcagagaatttaaaaaagagtcaacaaacagtaattgaaatggaaaatcagatgaaacagcttttagaaaaagtatccgaaaatgaaaattatcatttagagcaacaagaattatttaatactaataattccattctaaatgaagtagttcagaaactggaatttgaaaaaaaaagcttaaatgactttttacaagatctattaaatttcattggatatcatattgaaagtgaatctattcttgagtcaaacttttctgatcttttagaaaattattccaaagactcactgatttgggaaagctatccaaatttaattgaatttattattattattgataaagtcttccagcctctaaaagaactcttgtggaataaaaaaaatacttttttaatggattcagaaactcaaacaaatcctcaaaataaaactaaacccaaattaaatgttgaaagaatttccaatattttcatccagtcaataagcaatctccaaaaccaaaactattatgaagacattcctattacaagcaattatattttagaaaatgttcacaagaaagattttcttaataaaactaataacgaaagaaatattgactttgtaagcagtgtatcagctacaagacttagaaacgaaatcaatattttaaagaatcagctggatgcctccaaacaaaaacttaaactcaaagatcttgaaaataagaaactttcagaggaaatctcatacttgaagaacaaaattattagaaataaaacttataatacttctttatcaaatcaaaattttgatcatagttataacgaaaattataaattaattaacaatttaaagcttaacaaactatctagatctaaaaactattattcaaccttgaatcataataattattccgatgaa

SEQ ID NO: 70 - DNA, 2901 bp, Cryptosporidium hominis
atgagatatttatttctggctattttttatttatttaccttatatacttcactaatttatccagttagttatggttctaactattatcaaaccattagtgaagtttctttggtaaaacttaagactctccccagaaattctcaggaccccaaaaataagactggagaaggtggtaatagtaaatcagctaccgctagagtaggatcaagaccttcaactgtaggaagttcaactacttcaggatctggtactaaacctaaggctactataccaagaccatcagggcagagcacttcttcatcttcaagaattgtatcaggagctgtgcaagggccttcgaaaagaaatactcaacctaagcaaaatgaatctggaactacagaagctccatctacaggttcgcctacaccaaaagaggagcaatcagaagtacaatctccatgcggtggatcatctcaagagggaataccatctccacgtttgacatcaaattcggaagcaggagttcctgaatccaagtcacctacatctagcccaaatcctactacaaagtctcctccaaatcctactacaaagtctcctccaaatcctactacaaagtctcctccaaagcctgctccaaagcctactacaaagcctgctccaaagccaacactacctggagtaacaacaaagccgtcatcaacagctagaccatcgaaacctctggggcctgcggcaggagtaagaccactaggatctggagtagcaccaaagccatcagggccatctagatcatcaaagccattggggcctggggctggagtaaaaccattgggatctggagtaacgtcaaagccatcagggccatctagatcatcaaaaccattggggcctggggcaggagtaaaaccattaggatctggagtaacgccaaagccgccagcatcatctagactatcaagaccactgggagctggagcagcaataggatccccaacaaagggagcaacaacagcatcaagagtatcggcaacagggttaacaaaaccgacaccatcaggtttatcaagagcgtttttatcagggtcatcaaaaccatcggctggggggggtttaactaaacgttcgggatcaggaacaacaaaatcttctacaggattaggagcaggaccgaaatcatcaccacttaccagagcttctcaacccaaaaccaaatccggtgcaactagagctcgttctaaatctaggagcagatctaggagtagagatagattttcaggcggccgacgttctcttgaatctacagaaccaggttgcagcggtgaaacaggagataaaggaggttcaggtgagggccgttcatctggaggatcatctggtggtgcatctggtggtgcatctggtggtacatctggtggtgcatctggaggaggagaaggaggaagtggcgaatcaggagcctatggaggaagtggaagtggaagcggtgacgataaaggagacaaaggcaatcagccaggaagagggagatacgggatgtctatcgactcttctggttctgattcggattctgattctgattctgattctgattctaattctgatggtgaaattagagatgcagtttcttctgctgccataccttccgtcacacttttctgtagagacctcattaattccgtcaccaatccaggtaaaactaccctgtcttttgaacaaaataaagcctcttcactcagatatattgaagggtatattaataattgggtgaaaattctgaaaatgttggaaaaaagactagaagtcttgttgaagaggtttgtggcattaggttgtgaaaatccggaagctagaaaaaaccctaaactgaataaactatgccaaaaattagaggaaaaaatcagagatgttgaaacttccatctacttagctaaaaggaaaatccacaaactaaaaaaatgtttgaaaaagattgcaagaattgaagaggaggaagaagaagcgcatacatccaagaaacatcgtagagctaggagatcacaatctgatttggaaacaggacataaagattctcaacaagaagcaggaagctccagtgacgaagattcatctcaaagagaaaaatgccctaaaagacgttctaagagaggaagaagtagaacgggtgtgacatcacttgatgaatcaactcttggcgctgttgggggtcagtctttggacagttctacgcttgagtccaaaagttcaggctccacttcaagtcttgattctacaagctccagtttattgggaaattctgaatcaagtgcaagacctgatccagataaagtacctgtctataatggaaaggtcattactcctactcctactcttatttctgaagagatagattcttctcgacgtcactgcaaaggaatcttatcctcaattggaatcgtacccgaagaagagttaattcaaattctggaacaatttggtgtcacagtatcggctttaaaatcattgcttagctctaacttagaaaagttgtcgcaaactcaagagagattacttgaacttagtcaaaaaactggagatggtacaaattctggacgtgaagtgaaaaggtttgaagtgcgcgcttcatctctgaaattgaaaagtgaaatctatgagggtaagctgagtgttctagaagaatgccttttagagatattagaaagaattattgaattgaaccttgaatatgcattaccccaagtaaagttaatggcttgtagattacatcctgagctcgaacaaactgatgaagaaactaatcagggagatggagatgatggtgaagatgatgatgaagatgatgaagataatggcgatgatgatgggacccaatatgattctgaacttcttaaagaacttacggatggtggtgattcttag

SEQ ID NO: 71 - DNA, 498 bp, Cryptosporidium hominis
atgtttaacttaatcatcaaatttcaaatcataacaaataaaaatacaaatttcagtcttataattaaatatttacctacaagaattgatcataatcaaatcattctatttgaattatttaaacaagtatacgaagatatactctgtttaatttcttgtattccaaacaatatagttaaggaaacagaaattaacaaacttagtgagttgaatttcaaaataatgattcaaaagaatatagaaaaagattcaaaaatattaaaagtattcaattattcctctatttcatacgatcccaagtcaagtatatgccaatctacgagatactccccttatcaatacaaggatattatcttcaagatgaattcattgacattgtcatccagttctcacgaaaccataagcttatttatggagaatcaattaacttgtgttaaaatagtaagtcttaaacttaaacaaaaatatcacacattaacttctgtttcccttttctaa

SEQ ID NO: 72 - DNA, 393 bp, Cryptosporidium hominis
atgagtgagtttgtattagtaggtagcagtctatttgaggagaagttgatggaattttttaacgaaggggtaagatgtaagaaaattaataaaatgaatgcattaatcatgaaaatacaaaaacatgaatttgatttgagcggcaaatttcaagaaagtgattcaaatgggaaagaattactagtcccaaaatgtgaaatagaacaaaaaatagaaataccattggaccaaatattggtaacagaaagaaattcttttggagttgtttcaacaggagaactctttgaaaatatttgtcagtttctgagatctgatgataaaattagagattacaaagatgattttagaattatattaattaatggggcatacttttcaaagtacttaaggtaa

SEQ ID NO: 73 - DNA, 1341 bp, Cryptosporidium hominis
atgagtatttcatcatttagaataaaaagaaggaaaaaaagtgaggatgacgatgatgagaaaaaagatagttcaagttatgaggaattactggaagttattgcaccaataaacaaatttaagagtaagccagcattaggagtgactacattttcaagacaaatgtggtgcgaaaaaagcttagaaatttgtctcgaaaataatattaaaattacaagtaaagctattgaagaaggtattaaacaccatgaagaattagagctagaagatcaccaagttcttagtgtaatggtagagaatgaatacgagaaaatgtcaattgaaattttaagtatagtaaatctattggatgggttaattgaaagaggatatattcgtgagcttccaataattggattttacaaaggaataatgttaaggggaataattgattcattgcaattaaaaccaaaattaaatggaattggggaaactaataatgtaaaatattcatcaaataacattaacaagtttattattttgatatcagatacaaaaactagaagaaatacaactcttccaagtaatgttcagcaaaagactacagttctacagcttggattgtatagaaagatattgggtgaaatggttaattttggaaaaatctggaaatcttgccatcctaatttaattgattccaatgcaattaaaaaatatttgaattcttcttcaaccatagatttgtcaaactgttgctctggttgcagtttcctaaatagcattttcgagtttcatggactagacccattaatttctttttcaatatttcaagaattggaagatgcaaaaagaaagcagtcttgcaaagaaaaaaatgatatttgtgatacaaaccaagaccaaattcaaacagaaacacattctgagacagaatctgtagttgatactgacgggaaaagtgtcctaaaggagtttgaaaacgccgttgaaattggttttaacatgttacttagcttttcaaaacttccagatattcagtcagaaatgaaagttgaatacgattgccaaggcaaaactttcgctacaaaatggtataagtcttcagaacagactattgagcttgaactagattacttattaggctggtggcttggcgctagagaagctgaatttgttagaatgtcagaagcatggaaatgtaagttttgtaatgtaatcgaatattgccaagtatgtcctctttcaaaagaagaaaaagaaaaatgcattgaaaaaatacgtcaagacgaattagagtcattactaattaaagatttggaagagtcatctaatgagcatattttaacattaaattgttcataa

SEQ ID NO: 74 - DNA, 1785 bp, Cryptosporidium hominis
atgccatcaagctcagctttatccactaaatgctgtaaaattattgatgaatatgaaactaagctaaacaaagaacttggaaatgcatgcagggagggggcagtaggcgcgccagagttaaaaaagtacaataatttgagaaaaggaagtcttctgggaacaaatttggtaaatagtgttatagcatctgaaagtccatttagaagagattcaagcttattatggttgtcatatgatccatctaatgaaagacaaaatgagataaataagatgattaaaaatgaagatggaatagcaattccagatatgtgcgataaatacgtgttggtagatacttatacaagtattttagcttcaaatagacagcaggcttgctatatttcactattatctcctcttccgcaggatactgtagttggtataaaatttggagatcacttgtgtcaaggaagaattaacgatacaatgattgaatatatatctccatctcttcctgttggacgtcaatatgcaagactatatttaaatagtgtgaagatgggagtaaagtttgggaatgggaatacaatgtcagaagcaagaagttatttaccttttgatgtaatagttcaagaaccaaaatcacgaagattgaatattaaaaagcataagacctcaatacctgttggagttatgggaccagccccattaccagaagttgatatagaagatgaagttgaagagctattaataatgcataagccaagaggaaatgcctctataatttcaagaaggcatgctttggataaatatttcaaaggcacgcattcaaaagtagttaatgctccaagacgtgaaactggtgacttaaataacttagacccatcattcaaggctgcagttaatagagattttttgagaagactctcaaatattactttagaaccagattgtagaagaactattaatttattaaatgaatttatatctaagttagacccaggtgcaacaaataatttaataccttttaatgttaaattagagtattggaagagagttttatctgatggatgccaagagattgttgataattatcacagttatattacacaagaatcatccaatgagaaatctgtttatatatttactaaaacttctcctgattcacttgaaccatacaatgtatttatgttttcttgtattatggatgaggaaaataacaattgtctaccattattaagaagattcacatgtagtccagaaaattgtggagatgtaaggctttggatatgtattggagattgttatcttgcaaagaacgaagttgcgaataattatcgaaagattgatttgccttgtccaattcctccaataatgaagtcaaaaaaatctgctcatatttggagtagagcaaaaaataagtcttatacaaactcaacattttcatcaaggaagtttggtattggtaattttgtgtcaacacgaggagttggaggagggctactaggagctgctggtgttggtgcaggcggtatcggagcaggaattggtgctgatgaagatttgaatgctgaaaacgaaaactcttctgaaaaagaaaggtgcattcaaatttcgaatgatgtttttttattttttgagatgtggccttcaaaacttcttccaaatgctggtaatactacagaatcatattcatttgtcttatgtattaaaaatcatcaatatcactcaataactggtatttcaaagccagtactcaactttattcttgaaaaatggctcacaaaagtccccattaactcttga

SEQ ID NO: 75 - DNA, 498 bp, Cryptosporidium hominis
atgattacttgtgacccaaacagtttattttttggatttctgggaattgcaggatgtttgatttttgcaaacttaggagcagcttatggaattgctaaatcaggtgttggtatttcatctatggctgtaatgagaccagatttaattatgagatcaattattccagctgttatggcaggtattttgggtatttatggtttgattggttctttggtcattttcttccagatgggagaaccaaatttgtactctgcttacactgcttatgctcaaatgagcgctggtttggttattggtctcagcagtttagctgccggtcttgctattggtattgttggtgatgctggtgttagagctgctgctcaacaaccaagacttcttactggtatgattttgattttggttttcggtgaagctttggccatttatggtgtcattattggtatcattatgggtactacaaagccaactggccaattatgtgcatcatacatttaa

SEQ ID NO: 76 - DNA, 498 bp, Cryptosporidium hominis
atggcacctccattttgtacaccaacagcaactttatttggaatgcttggttcaactttggctacagctttatcaaactttggagcagcttatggtacagctaaagcaggattagcaattgcatcatgtggtgtaatgagaccagatttagtaatgagatcaattattccagctgttatggcaggtattctaggagtttatggtttaattgtaggagtcattatttgttctcaaataaggacggactattcattatatcagggatattgtcatcttgctgctggattaatctctggtttcagttgtgctgctagtggttttactataggtgttgcaggcgatgcaggaattcgtggtactgctcaacaatctaagttatttgttgcttcaatgcttatacttatctttggtgaagcacttgcaatttatggtattattgtttcattggtactcatttccagcccttctgcgaataatctttgtgtacttattaagtaa

SEQ ID NO: 77 - DNA, 1287 bp, Cryptosporidium hominis
atgattaaaaattgtccaaatttcaaatccaagtttcaaaaaagtaactgtgaggtcttctcaaaagaattcaagaatataatcatctcaagaaataccctgatcatttctatcattacttcagatttgacaagcttgtatttggttccttatattaatcttcaaagcgaaagagaaatgagtgaaaattcttcagtatgtattcaattaccaaagattgaattttatttgaaaaagtataataattctcatgttgaaaatcaagaaataaataactttttaagtcaaatagaattatcttctttatttcttaaggaaggaatcttaatttggatactttccaaagaaatctttgctcctgtatcaaatagagaacttcaatgtcgtctttcttcaattttgaattcaaaaaatcaaaaatactctttaaaaagtaccttggtttccatttcaaagttaaatataaatactcaaaggaatacatataataatttcaatataaaactcgacttggatggtttggataagaagtcaataatagaaagatgttttggaaatgactttaataatggtgataatactcaaaacatggttatacctttgactttaaatttggactcagagaaattgattcaactttccacaatattagaatcttttcttgatgaaagtaattttgatagtatttccatatattattgtgaagattgcaataaatttaaaccaacaaaatcagagtctttattgagatcacaaaaagttttgaatttggatcaaaaaagtttatcccatgaaaagaataataatcaaccagaattgaactttaaattaaaaatttctttgaatcatattaatttgagatatgaaatctttagcctgataattaatcatgtattacttgatttgagatattttaattcaaagattggaaatctgaaattaggaataaaagaaactcagttgattgctgaatattttccatataaactcagtcaattttctaagtcatcccagtctttcaaaattttacgtggatctagtattcagatatcttcaaactttagtgttataacaaaaatgttggaaatagctagaattggaagtattttttttgatattaataataatgactcaattttgcttgttttaagagctcctcaatttagtttaagtactttaacaattatttacttggaagttttaattaaaatcattaatatattaaagtcaaaatcaaaaagagtttcattcacaaacgagaaatcttcattaagtccaataccataa

SEQ ID NO: 78 - DNA, 2865 bp, Cryptosporidium hominis
atgatccaagaatataggaggatttgcttatatactgaaagtaatataagcatccctttagaatatggccaaataatagattacatgattcttggagaatttggatatggaataaaatctgatcatatttccttatcaagaagctttaagcaaatcataactaggattcctagagttgattgctcaattggtattcatgatagaaacaagaagttcgagtttgtattaaagatatttccagtttctattgatgtttttctctcaaacagattgatttgggatttgtttggagaatgtactcttgagaatttatttgatataaataaggaagatcaccccagtatttctccagaaatctccaattattattgctgtagatcagaagagtcatttcaatgggatgatcataattgccaggctcaccctcattctcaaaatgactttagtaggatcatttctgatattccacatgtaacaaaaagtaatgaaaattttgaggcagtgacggaaaatttcttatcatcttcattatcatcctctccccccttagccctcatagaggaattccaatcagatagaaaaagaagtttatatgattccactcaagagattctgaagacaactcccatttttgttagtattcgaattcatacagaaaaaccaagtactcaactaaaaatgtattcaaaactgctttcagtttcaattgattcaagtagagtccaatcaattaatgagatcttgaattcatttgagctcaggaatataaacacaaacaagaataatcagtcgtaccaagtatccaataatatctcaaatcatccttcaactttgaccagttcgaacaatacaactataaataatcatccaatgagcgttttgtcaaacacaatgaatagtgttgcaggtggaaatcttccacctccaatttactattcacataacttgaacccaacaaacagtatagtaagttctggagatcaggcccaaaatttaagttcccatattttacagcaagggtacaactttaatgcatatcccatagcaaagactccttcggtattatctttctcgaactatttttacgaccaaaaacaagaaaagggccaaagaacaaacttaatgaacttattgaacttgaataataaaaccaagaatgcaaatcccaaatctaattctttggacttaaataccaatcgacttcttttaaattgtgatttgaatgataagaatgtaatgaatatgctcaagtttgaaattgataaatttttagcagataatccgcttttttatacagttgttgataatatccaatgtcaggctggaggagacaataaccatcttaaccaatataagcttcagatagaatgtatcgtagatcagctgaatgttgatatattcattaataacaaaagattctcaaatttccaatcaaaagatattaactttgttatgttctcaaataataatccttcaaactcaacaataatagagtttgatacatcattcatccatttatcggctaataaagactttgtacagtcgaatggcaactcaagtgttattccaggtacaagcggcgttggtagtggcgttgtttctggtaataatagtaattacaataatcaaattaactgtaatatctcgaattccaatttaaatccaaatccaaacaatatcttcaatgcaaatggcaatagtattggtaatggaaatgtaaattccaatatcattggagaaggtggaacgggtcttaatcataataactcaggcttgaatgttagttcggtatctacgattgaaaatagcattaatgcaacttctcaggaagaaatttccataattcatcccatgtacattgatggacatactagtcaggggcatgggcatgttttatcaattcgtataaatatgaggcaggttagattactagaagtatataatatacgaatcttagagagcgttgtaatcagagtccatccaattcgggtaaacattactcaatatttaacttcttgttactatgatatattcttcccaccaccaataacaaaccaaccaagcatgagttcaatccaaattggaagtaatacccaaaactttttacaaatgtcaaatgttgattctgaagctgtttcatccaagataaaagaagataatgctatttatgccgaaaactcttacattatcaatagtaataccaatagtgatataacaataccaacaattgaacaagaaaatttttctttaacatttaataaccaacaaccacaaaataataacacatcagtagacactcaaaactgctcctcaaaaaatatactttacttcaattaccttcgaatatcatcaattcttgtggaagtcacttatcgtggatctgtatcgttaaataacgtacttttggaacttagctctttcactcaaagaagaaagcatagaaccgtaaaggaaatggttgacaaatacatctctttccttagacgtcaagctgctagacctgtcatttcatatactttcaaacaactcagacattctttacttcctaaacacttcaaatcccataaacgtaatagcacctataattctcattatgatattatccaggcaaatattcaaaatagtcaccataataatggaaatgaacgttccttgaaaattgattcttcttatcaagaccttctttctgaaactacaaacaatggaaatcattccaattacaacaataatattaactccattctttctaaaaacgacgatgaacttcctaacacttatcgcaagattcaaaataccaactgctcaaaaaatgactcagaatacaataaatttagactcatctttggtaatcagcttttgatttaa

SEQ ID NO: 79 - DNA, 378 bp, Cryptosporidium hominis
atgatttttagaggaaatataagaagtatttgtagaaataaacaaataagagaccatgtaagaaccaataatatggctctattcgccttgaattgtagaaattatccagtaaaagtatataattttgatggtgaactaataactactgtatatatgaaaaaccaatttgaagaaattgatgaaatttattcactggaatttatatattcagaagaatcatctattattttaggaggaggaaagaattgcgtccatgtatatgattataattccggtaaaacacttgaatatatcgtaagtttaatctcaatattaatattcttaattaaaattaaactaaatattcgtagaatttcaattccaaagaatgtaaaatag

SEQ ID NO: 80 - DNA, 411 bp, Cryptosporidium hominis
atggattatcacttaatttctggtcatagaaatagtgactacttatatatttgggacgtaaggaagcctaataatatactttttaaattagatagagaaaattttggttcaaatcaaagatataatattaactttaaatattttgaagacgagctaatattaacttatggagattccagaggaaaccttaatatacaaaaactaaaatttaattatgattacaataaattccttcaaaatgtaaggcaaagacaaaaaatcaaattaaaaagtcaatccattccttgtattgagaggttttttgatcaaaagttattagttacgttatctggtgaaagattcacgagttgcgaaaaagatcaaggatgcactttcaaagtttggaagattaacacaaataccctcagttaa

SEQ ID NO: 81 - DNA, 705 bp, Cryptosporidium hominis
atgtggctacaaatcttatttttcattgtttcatgtttccttcttggaataatcgtctattattcattcaaggatgttgaaattttgaattcccaagacgaagctctttgtgatgcatttatttcatctggtagattaacatttcctaaaaaagatttgaaacattattttcaattaagagatgaggttgctccacaaaatgttggccttgaggagttccgtctaagacttagagcttcaagtccagagctagtatctgaaatgaagaaagctttattaagagcagcaatggcagttcaagataattattccagaatttcatcagaatatatgggaaatatgcaattgtataagaaattacttctttcagaaaagcagtggttatatgttgagaattctatggaagaactaaaagaaactgtagaatatataagagatgaagcaaacttaattcaggattcctggggagattatatatttttggatgccagaaagctgaatgctattagaaaacaacaagaagaaatgcgtttacaaaaggagagacttgctaaagagaaagaattagaggagaagaaagccaaggaaaaagagaaaactgaaagcaatcttgcaaataaaattgctcaggagttacttgaacaggaggagagtttatctaataatgatagtaagaacaattctggtattaaaaaaaggagataa

SEQ ID NO: 82 - DNA, 2259 bp, Cryptosporidium hominis
atgcgtctagtacatattccaagtaaaaatggaattgatgaagcttatgtagtatttgaaaaagataagaataaaaaattcacagactttgagaaagttagagaagaaattgaccgtcttactgatgaagtagcagggaaaaataaaggtattgtagatgatccaataatattaacaatatatggtacccaatgccctgatttaactttaatagatttaccaggtattacaagggtaccattaaaaggtagtgatcaatgtgataatattgaacaattaactagagatatggcaataagatatgcaagagatccaagaacaataattctagcagtaattccagctaatgctgatatgtcaacttctgatgctcttcaactttctagaagagtggatcctaaaggtttgagaactattggtgttgtaactaagatagacttaatggatagaggtacagatgcttcaaaaatgcttcatggagatgaagttccgttgagattagggtatacaggtgtgaaaaatagaagttcagcagatttaaaggcggggaaatcgataaaagatgctttagaagatgaagcaacattcttttcaacacatccagtttatagaaatctttcaccagaattagttggtacaaagaatctagtttcaaagttaacaaaagttttattcaaacatattagaactttcttaccagatattagaagagaaatcaatgcaagaattagaactttatcatcaagattagatgagtttggacaatcagtacctttagaaagcagtgatagaactcagttaatgtgggcaatgataacagattattgtgagatgattaagaatacaatccgtggaaaatatgataagagacttcaaacttattttgaccatggaagtgatggtggaatgtcaagtggggctcaaataagagtaatttttaatgaacttttagatgagtatactgaaaatgatgtaacttcagagctcacagattatgacattgatgctgcaataagaatgcatgaaggagattcaatgcctggttttccttctcctgatatgtttgaatacttaattttacctcatttaagaaaaattcaagctcctgttatggaatgtttagacaaggttacttcagctttggagaatgttagtcaaaaggttgcacataaggtctttagtagattcccaaaactttcagatcaaatactagatagaagtcaagagattctattacaagagaaagaaaatacaaagacaattcttgaacaattggttgaagctgagacaggctatcttttcacaaatgattcaaaatatttaactgaacatggaagtgtaattaacaataactcacaaggtaatccaaacgatccaaatgccgctggcgccagagctggtcagatgggcgccaatggcatgcaagacccaaatatgatgcaagtggggccagatggacaaccaatacaaaaagagcaaacaaagacttcacaaatatttagtcaggttcaacagacagtagggagtatgactaattctttgtctgctaatttgtggtcacaagatcctttttctcaaaataaagataataataagaggaaaactagatattctcaggtattcttgaaggagataagaaaaagacttgattcttacttttcaatagttgtgagaaatattcgtgattctgttccaaagattatcggccactttttagttagacaaattatggataagttacaattccaattgtataatgaatttaataaggctgaaagactttctgatttattaaatgaaccaaatcatattgttgaagaacgtaaggccttagtgaatcagttgaatactttgaaaaaggcttctacaatactccagagagatcctaatattgcggctttaactaacaatgactttgatgagcaatatgatagtgatttgcagcaaatgcagaataacttcaatcaaaagatgcaactctctggaggaggtcaacctggagcaggaaatatgagacagcagcaaatgcaacattcccaatctcagaacaattttagaaataatcaacaatctatgcctaaccaacaattattatcttctggtagtggtagtggtggggctggtgggaatattggaggaggatcttctcaaatgcagaatccaaatatgaataatcccagttcagcaaaggctgctttattctcctcagttcctggacaaaaacaagctcaaagagaccctctttttgctaatttctaa

SEQ ID NO: 83 - DNA, 7941 bp, Cryptosporidium hominis
atgggtagactcttactcacttcaaccgcagtcacattgttcttattttcgagtctttgtacgggaattgggttaaagtctccgagtacaagctctggaagtaatgaacctttaacaactgtatttgatacaaagagaaatgttgagatagtacactctggaaatgtcaaatataatattgaaatgggatataatggctccatattaggaggaggagagcttgtcgttggaaacaatttacttataggattggctgagcctgaagcgcataatttaagggatggctcgaagactgacctccgcattttggaaagtaatagggatgaggttcaagtaggcctatttttgggatctccttgtatctatgaaaatgggaatagtggaatattgggccctggtagtactcatatgactataacgaatatattagcttgcacaaagttgttcaagaatcaaagcattaagcatgatgacataagatttttgttttggaagatgagagattatagtttacagaatccagaaatgaatctaatcgatttggatgacattgttatagattcaaatacttatctatcaattatgtttcgaggattacttcatgtttcagcactcttcaaatattcaaaaaaatataagaattcgtcatcaactcttttgagttcattggatacctttttaaggagtggttatgttgctgaaattaaacccgtttacagtgattcagaacttaagttagagctcaacttgaatgttggggcaagcttaacaggaagtgtgggcacacttgtcaaggaaaacgttccttttgcgatagcttcaattaccaaggaaggtaaaactcatatggagaatattgtttctccatgtgatggatcaattgtttggcttagcgaaaggtggctacaatatggtaaatcttcaggcttgaatactagccagacaaattcagggtattacgggaataaggattacatggaagagattatggtagttataaaatgcaattcaactccttcttatcttgttcccagaccaggtttaaataaaagacatccaaacgatattttggtaagcgatagatttggccaggttagtgactggctgctaaaagaacatataaaaaacagtctgaatttgataaaggtcaacagtaaaaatatcccatcaaatttgaggagtgaaatgatttttgagattaaagctactaaaactttggatgaattaagaaatactttaataggccacatgagaagttttggccttgaattagacttattaccaaatttatctttgcctaagcctaacgagggtgaggataaagaaagacccaaagaggtggttcttagagaagaaaatgatttattagaaagattaaatgattcaaaattgttgctcagaagcaatatggctcccaaaacaaaaatgtcaaattttgaaaggagggttagaagtggaagtgtccctggaaacacctatatttacaatatggagaaacaacatctcgaaaattacgaagaaaaccaaattccagtaccaaaatgggagggtttagcaattgcaggatggaataacatgaagagtgacgagaaaaggattaaactgaaggccgcaagttacactgggaaagcgatccagatattcggcccaagaccatggaatatggattttctgagtatggatgtagttagaatggtttctatgtatcgctatggaaatattagatatcttctttccagggaatttttgtatttgtttggaaagtttggtgaattagaggattacaacatctatacttcttccttaatgaaatattctgtcgagatgtttgttattgcagggatgtttgttagtggagaagagggagctgagactcttttgggaacagttaccatagaattcactgcagagctcaaacatagggatccaattaagataaatatattctcaatgcatactggtattgttaaacaggtaattgcaacaccaaaagttgcatgttctttggatccattagttataattagttcagttgaaaacgaaatccataacgccgagaaatactttgaaatcaactctgataaattggatggaagttatatcttttccaaagttccaggacaaagagattacttgacttatcctctttcccaaaatcagaaattattggatgggggtaatgtacaagccaaaaccgatgctatgttggacgcacttaatagacatacctatttatttccttctcaaagtccaacagatatcccatcacattctgggccaatcccaaacttattcaatattgaaagcgaatccattgaaagcattcaaacatctagacaaatcttacataccaaactcaaaaagttaaattctgagaaattgagggaaatccaaaaattacaagagatgtttgttgctccaacctcggataatactcgtcctatattttcttcatctgtattaagattagggattctaaagaattggagaaaatccaagtccaagagtatttcaaataagatattgggagcaatgaagactaaaagtgatcgtgtagatgagtcgtttttggctagttttggtactaaactagaactttctctaattacaaatgttccaaaccttaaaacagtttccaagaaaagatcagctcgtgttgttagaaagcttgctttacttgagaaattaaagcttaagagaaagcctaagactgaaagagagttaaagattaagagtgctcttattgccaggagggttaaaatgttaaagaaaatgtcaagtcaaaaatatccatcattagatttacattcaggatatggacaatctaaagttcaatcttctactggaactttccctattaaaagtaaagctcgtaggcgattattatcagccaaaattcattctgcaccttcagctttcagtttagctgctatgaagattcccttctatttgcgacaagaattgatacaatcatcaaatattactccgaaaagaaagactaaacctgtttccttgtcaaaacccaagaagaaaaagccagcacaagataaacctacggaattacagtctgaagagaatttaataaagagtacagttggaccaacatttccattcacatctaatttcttccttcaagaggaatttgagttagaaaaaagctcttctattggtgagagaagcacacaaataatggttgacagtgatgagagatttgggtacataaatgaagaaagtgattatactgctataatacatttattgaagttggaaggttctaggataaagaatttgaggtctgagtgtatgtcttatcaaagtagtttagataaaatgcttgatttaaaagaaggtttgctatcagatattgcaaatacaaatcttatcaatgatgcaaagggtattttatcggacgtagtgagattgacagctcaatatcaagaatgtcttaagaagttaacaggatcaattctggtaacaaaaggacttgagattgaggctaaaataattagaaagaactttaaaaagaaattggaaagaataaataaagtaagaaagaatatacataataaatataagaaatgcaagaccgaattaagcaaagcaaagaagtctttttactctttcttgaaaggtgagatatctaagcaaaagagtaagaataaaatgagttctcaaagttacgaggatttattgaggaaaatacagcaagaatttaaaaattatcgtaggcttgagaagaaatgtcagggtatcatggtcaatttaaggaaggaggatatgaatttgagtgagacgaagatgaatagatacgtcatggcaagtagttacgagtcattgctgaaaaggaacctggaattgtttaatcaaactttactttattacagggttaatcaaacatactttttgatgattttgtctttggaaaagttgatattatcgtcacatgaagtcttgcttgaaagtgaatactcaacattaaatacagcagttcaacaggagcaaaaattagagagtcttactgcctactataagagccaagtaaatcttgataggttaagatttgaggaggaagttgcttatcaagataacactattcgagcaggagttcactgtcttacactttctaatgaattattggtcaaaactaaattattattggaagtttttgaaaccaatattgatggtttggaagctggaatcaagtctttactggcaatcttatcatttactcaagttggaagtaattcacagctaaatttagagattataaagaaatgtcaggtaatggcaagaaggcaagctaagataataacaaaattatcagaatatattggaacaacagaaagaataaactctgatatgtatttgttatcgaggacaagagaattattgaatagtggattaaactctttgagtgtagcagtaactgaagaaacggaagagagcagttcaagaatgagagagagggcaagaacttctgcttataatactaggattagaaagttagaaaggaagatttcagcaaagatgaagttattagagttaaccacttctcgttttagttatatgaagaagaaatttgaagagcagaaggagcaatttagtgaggtattaaatacaatgaaaaccattattcctggattgaacttggatagttttacgacagatacaagcgatattcaaacaagtgacgcaagtgtagattcagaaataggtagttttggttttactagtgattcaaacagttcaggaaatgagcaagcgccttctgattctttaatgattaccaggatttccaacgcaataatgattgtggaaagggagatagcaactggtccaagtacgaataataaagaactagaaagtgttagagcgaagatgatagaattaagaacggagttaaatgataaattggaacagtttagaagactttctggtcaaaggaagagtaagagtacatcaagtgctaggacgaaactaagggaggagatttctgttcatattaaagaagcaattaaattaaagaaatactacaatcaacgaatggaagaatccattaagcttttgaaaaggaaattattgttttcttggccgagaacaagactaagaagatcccttttggattctaatagaaggaaaaaaatggaagaaaataggatgaggagaatcaataaagaaaagtccagggtggggagacttgagacttgggattattcacaaggctctacaggagaatcagaagaaaaattgttagaagaattaggaggagaaggtgatgatattaaaggaattgacacaagtgcaagtagcttggatttaactaaagaaaaggaaaaagctaccaagaaggagaagaccaagaaaggaattaaaatatcaagaaagccgaaggaaagtaaaaagggaagtaagaaaggaagtaagaaaggaagtaagaaaggaattaagaagggaagtaaggggtctgaggatgaattattgagaaagtttggaggagaaggtgacgatattaaaggaattgaaacaagtttaagtagtttggacttaactgaagaaaaggagaaagccattaaagaagagaaggacaaggagaagaaaggaaaaatacctaaaggagaagttacagtgagagttgagggttcagaaaagtcagcaagggaatcggaggaaaaattgctcgaagaattaggaggagaaggtgatgatattaaaggaattgacacaagtgcaagtagtttggatttaactaaagaaaaggagaaagccattaaagaagagatggataggaaaaaaggagatgacacaattacaaaaggagaagaaataggtaaagaaaatgtggaattagaagatgataaaaaaggttcaagcgaaagcataatagatttggttgcaaatagtgtaattaatgagatgaaaatagagaaatttaggagcaaatggtctaaatcaagggagttgaaaaaaagaaaggtattggataaactaaggtctagaatacaaaagactgagaacaaagaatattcaagttcggagttgtcatcagatgcagaacaaggtaaaggagttgcttctagaaagcatgggaaaaagggagcagacagaaagaagtcaaggagtgataaaaagcaaaagccaaaaacaaacggaaagaagaaaagattagggcttgggaagaaattgggtggttctttagttaaagaatcaaagcctaatttagaagttccagaaactcaaattccttcatcagttccaggaagtccaacggcttcagaaactccaattgctacaggaagtccaatgactccagaaagtttaacggctccaggaactccagttgctgcaggaagtccaatggttacagctccttcactagtttcaggagttgcttcacctgcagaagtttcgtcaattgcagggactccaattccaacaccgccatcattttccccaccacctcctccaattccaccaccaccatcattttccccaccacctcctccaatcccaccaccaccatcgtcccccccaccacctccaccagtgcctgaatacccacctctatcgtctgcaattccaccaccaccatcattttccccaccacctcctccaattccaccaccacctcctccaattccatcaccaccttctccaattccatcatcaccttctccaattccatcaccaccatcgtctcccccaccacctccaccaaagcctgaatacccacctccatcgtctccaattccatcaccaccatcgtctcccccaccacctccaccaaagcctgaatacccacctccatcgtctccaattccaacacttccaccatcttctccaccaactccaccaatgccggcatttccaccttcaccgcctccaacaaccccaggagttccatctccaacatttccaagtcaattatctcctatccctgaagcccctgaaggggctgaagataagttattggaagagcttggcggagaaggagatgatattaaaggaattttaaccgattcaagcagtattgatttaaatgaggcacatgaaaaagctcttgaaaaggaaaaggaaatgcgtcattcaggggcaactacatcatcaggcttaaagccagcttcaccaatacaacaaggagcttcggtaatatcgggacctgcaggaactccaccaactccaacattcccaccagctccaacactcccatcaacttcaaaacttccaacaccaacaatttcaacaccaacaattccaataccaacagttccaccgactcctataccaactccaaaagcaccaacactctcaccgctcccaccgctcccaccaacttcaaaggtaccaacactaccaacgctcccactactcccaccactcccaccaactccaaaagcaccaacacttccaacaccaacaatttcaacaccaacaattccaacaccaacaattccaacaccaacaattccagcaccaacaattccaccaactccaacaccaacaatttcaacaccaacaattccgacaccaacaattccaacaccaacaattccagcaccaacaattccagcaccaacaattccaccaactccaacaccaacaccaacaatttcaactccaacacttccaccacaaacacttccaccagcacttccaccagcacttccaccaacaattacaccaacaccaacaccaccaacactcccacaaactccaggacaaactatcacttcaggttatccttccaatttaagtcaacaacatagcacaaatactgatatgactacagatgaagaagaacaacaaagtgattctgacgagtttttgcaacgtaattttggtcagagggaaaaaaaaactacagaagataaaattttgaacaaagaaatacaacaacaaatagagaacattaataaagaagctgaagaagctagtgttgaataa

SEQ ID NO: 84 - DNA, 825 bp, Cryptosporidium hominis
atgcaattacagaactttgaaggatattcaaaaccaactcctttttctttagctagagatataattaacaagaatggaattttggggctttataagggattagatgcaggtctaatcagacaactaacttattcgactgcgagattgggaattttcaggttattatgtgattactataagaaccaaatggtttatcagggccacaaagtatgtaatctgtctcttggagttaaagccctgatagggttaacatctgggggtatttcttcatttatttgcaatcctgtagatttagcacttatcaggctacaaacaaattctctgttacctttaagcaaacaaaaatactacaaaaatgtattacaagcaatgaaatatataattaaagaagagggtttcttttcaatgtggaaaggatctataccctctattattagagcaatgtcaattaatatgggaatgcttgccacatttgaccattttattgaagtatgttatagatggacaggaccagacaagaatcaagtttttgttaaggttctttcatccattctttcgggtgccgttgcaagcgtagtatccctcccttttgacacaataaagacccaaatacaaaaacagacagttgatggagaggattctgagtctttaataacaaaacgcgaggatcacaatttgaatagttatagtaaagtcatcacacacatatacaagagccaagggttaagtggtttctttaaagggtacctaacgtactatttcagaattgctccacatgcaatgataaccttactttgtatggattggcttaacaagaaattctaa

SEQ ID NO: 85 - DNA, 429 bp, Cryptosporidium hominis
atgtcatctttgaagcactcaatccataggagagtgcacttggagagagcgactccagtgaacagacttcgatttgggattttagagcgtaagaaagactataagataagagcaaaaaggtatcatgagaaggaaaatctcttaaaatctctatcagaaaaggcaagaacaagaaatccagatgagtttgactttggtatggtgaattccagactggaaaatggtagatataaaaagattggatctgacctatcaaacggcggtcttactagtgctgaagagagaaagcttgcggagagtcagaacctgacatatgtccattttagaaaatcaatcgataataaggtaagttgtttcactaaatcattccctgtttgtttcttttgtttatattctattagaaaattgaaagaatggaaaaagagttga

SEQ ID NO: 86 - DNA, 351 bp, Cryptosporidium hominis
atggaaaaagagttgacattatttggccaaaatatgcaaagaagccatattttttttgatgatgagcacgaacaactagaaagtggttcacagagaaataaaagcaatacaaagaaactcaaagatttagattcactttcgaatttagaaactattccgaaggaagttgtcaaaaatattaccaaatcttataagatttttaatgatacaattgctagatcacagaaactagaaaaagtatccaagcatcttgagctacagagagacctcaaatctaaaggaaagaagaagaaggttgtaacaaagaatggaaatactgagtatgtatggtacccaaaaagaaaaaagtga

SEQ ID NO: 87 - DNA, 1317 bp, Cryptosporidium hominis
atggcttaccttagccgaagattaaaagcccaaaccattacactattcttctttctaattgctttcatctctttaaatgaattcttttctgaagcatcatctacgcaacaaaagaaagaacctaaaagtgtccggtttgttcaaagtgggcaacccccatatgtattatcttcaagaccagggcaatactttagacatctccagacaactgtagaacaagattctagctcatctcctgatgaatcttcttcaaaagaacaatcacgtaccagatctcttggcccaaagtatagatttgttcatgcaccagttggatatgaaaagtcaaagaatgcatatttagccgaaatccaatcattaaaggaggcaaatgaaaaattaaatgaagaagttaaaactcaggctcaaaagattaaggctttaatggctgaaaacaaagagttgagagaaaaaattgagggtgaattaaaaaagacaaattcatcaaattccaaggttaaaagtttagaggaagatttaaagaagaaagaaagacaaaataattcattctcaagtatattatcccaaaaggaaaagattataagtgaacaaagggcagaaataaaatcattactacaaaaaatccaagataaagaaacatctttggaatctaaagaaaaagcattatctgaattagaaaaacaaataaataataaaattgagtatatacaagtgaaagaaagagaacaagaaaaaatcaaagaagaaaaagaattggaagcattgagatttatggaaaagattgagaatctttctgccaatgttagggaaaatgcatcaaaacaagaattactagttagtgaaaagaatcaacttgaagctaagatcaaagaattaatggcggaaagagataatgcaaataaggccctgaatgaatgtcttgaatctcttaatgctaaagaagtcaagaatgaagcagagaatgttccgaaagaaactcagccagaagaaaaaagaagagctttatataatcttgtattaaagcaaatggctagtcaaccaatgaaagaaagatgggtgaaagcacctccatttaaacgtcctgaaggaattaatgtagaaagtggcttggttcctgaaatagttaaggtctttaattcacttaagaaaaaaaaagagaacgaatttaaagcctttgtaactgaaaatggccttgaaaatgaagatagtgcaaaacaaagacaattgtatgaaaaacacaaagagaaaaatattgtagcatctccagctggaatccaacaatttacccgttttaagaaagaaagcgtttctgattaa

SEQ ID NO: 88 - DNA, 930 bp, Cryptosporidium hominis
atggttatgaaattagaactcaaacttccaggtactgatgttggaatgagaatagcttttggtcacctagatgaaaattcaactgggtcaaggacaaaagcttcctcttcttcttcctcctccacttcctctcctactcttccctctaaacaaaactctggagcgaagattaaggtaataaagaatgacctagaagaaagtgaatgtgaatgtgatgattgttctggaaaagccaaaactaaggaaaaagctatttctcataaagatgatgatcaatattctgttgacatggtaaccaaggtatttgcatcacttatgcagtgtacagcatccaatattaataacagtcagtttaaccaaaataataaacttaatcagaaatctaaaggattaaaacaagtcaattcatccaaatccaataataaatacgcttctgatagtgaagatgaccccttagcaagaggtattcttggaaaaggatgttcatctgacttctcggtctcccaatctctctatcccgatgatatcctagtttcttatgaacccagaaggaagaagtcacctaaatctaataaaagtcccgccaaaactaaatctgctcctttgagtagccaagttcaacaaaatactaaggatcttaaagatgtaagaatcatccctatcaacaaatcaacaaatgctaagattctacccaatagaaagttcaaagaaagtaaatatgatatttcttgtatttcagtcccaactttctgtaacaaggcaaaactcattagttgttgtaacgccagacttattcctcaaattcctagatgtgatctaaccaaacatgaagacgaaaatctgatgatttcagttccatccgcaatttatccagataatattattctcacattaaaaaatccaaaaccgaagaaaaataagaaaaagtag

SEQ ID NO: 89 - DNA, 1785 bp, Cryptosporidium hominis
atggcgggaaaaatcacggctcacttggcgcgcagtgcacaattattgaaaaggtatgaagaaaaaagaaatgaatatattagatcccagaagaagttattagatgaattgaataagtctaagtcagttcttagaacaaaggcacttttggagaatgtgaataaagtttcaagtgctttaaaaggatcagatacaggaattgacgtttcaaagtatgtaagtgagccagataataagaagtttggttctttcttcgagaatagagatgaattgaaaaatgtggttgagaatgagcatgaaaataatcttcaagagttgcaaaggattggaaaggaatgccatgataactttagagaattagaggatgcttgtgatgatttgataagagattcaagcttgattaacgttgagattagctctttggaagatgagattacctcaaaggttttagaatctttggataagaggcagagaataggagttcagatattggatgatttggacaagttagaaaaattgaatgattatcttttacaaaatgcacatgaagttggtaatgttgatattacccgaattgaactcgatgactttgaaaagaatccagagatatctaagactttggatagtgagacatttggtatttttagtggagataggaaagcttctgactttaagaagttgattgataccaactatgtttcaacaaggtattatatagaggagccaaagaatggcgattttgtggattctgatgagggagatgatgaagaagaaactaagggtggtaagaagaagagcgggaagggctcagataagtcaaagaaggcttctaagtattccacagactttaagggcaaagtaaaattagtatttgaggaagctttgacaattattgaggaccatgttagagatttatacattgcagtagctgatagaaaggagagaatgtcagagttgttaaagttggaagcctttttgattagagaggtctcaagacaccgtaaatccttatctgttgtactaaatagagtagcattaccagaggatgagattattgatgaaaatgagaatgatgagcttaagatgagaattttactcaagattcatgaggaaaagacaaagttgatgtatgttagagaggtacttgataagttgtatttctatccacacttccgtggagttaaaccaagttcttctttgaaacttaaagagttagaggaaagaggtatcttgtcaagatttggatatacttacttaccaaagtttaaactaggtgaagatgagcaaccgatcggaatttatggttttaaaaagctggattattatgatatgaaacttgatttctataatagattaatttcaggtttcgagtatgacttgagcagttacagatttgatttagagatgatgagtttattagatagcttgaagtacccagaactaaacaaattaatttactctgatgattacatagagtcgagtattttcacaaaaagaacaaagttaatgaaattattgaagaagttaatacttaaagagaaaaataaggatttgagaagatctttaaagagggcttactttgaaattagagaatggtttgacaatgcagtaaggtttgagagggaatattatggtagttcagctttggaaaccattttttctgaatcaaaatcttcagatgatggaagcagtagaagtgaaagcgcaatagttctctcagataagaaaggttcgagtccaagcccatcaaataaacaacaaagaagaatgagaagaaaaaactag

SEQ ID NO: 90 - DNA, 252 bp, Cryptosporidium hominis
atgtttattaactattattcgaattccattgtacgcatgcacatgcaacttcttacctcccaatttttttaccttttttattttactttgttaactccaatgccccgcccaaaatattcaaaatcccaaagccctttattggccatgcacaaaccgccaaatgttggcgggaaacacggtaccgaatcaactaatatcaaaaattgtcaagtaaaaggaaagttttcaaacaaagagagaaaaagaaagtaa

SEQ ID NO: 91 - DNA, 2145 bp, Cryptosporidium hominis
atgagacaacattgggatggcaatcttaacgatacagcaaacaagttaattcatttatcaaagcagagaacaattagtcaagaaaaaagtgaaattgaacctatttttgaagatgagctcattagaaatcgtgaaagagcaaaggaaatgggaatattcaagggagaaaaaagtcgaagtaatggagaactcagtaagagtagcaaaggaatttcggaaatgtataatattggaagcgaaactgaagattcaaaagcaggagattcttctaaaaaatcagaattggatgagaaatcaattataggtaaaaagaagaagaaaaataagaaaagaaagagtcaacagaaaaaaaataatagaggaaaagaaaaacgatccggaattttaaacaaagcaaaagaattattggaatcgtttaaaaaggaacctgaagttcatgctagcgaagaatccaaagccaaatcttcggaaaatgatatttcttcatcagaatctactttggatgatgttgagaaaagtagtgattctccatttaacttgcttaactttggatctcctattaaagatgagcaagaaaatagcgaattttctgaaagatttggaatagatactctatttgaaaagtcttttgaagatttaaatgagcctaagaagcttggaggagagccttcttttccttctcttgaaaaaagtaagttagaagaaaagttaaataattcagagaagaataatgaatttgaaccagaaaaaagtgaaattccaacaagtttaaaggaagaagttaaggaaaaagaaaaaatggatttatctgaacaatctccaaagaaagaaccaagcgcagatgtttctccggaaactacagtgatggtaaatttatttgaagatattccacttgcagatgaatcgttcaatagtgaggattcttttaagctaaaaggaaatgaagatattattaagaaaaatgatcaaatttctcaagatattagtgagaaaagtgttaaaaaagttgataatggattaggatctcaatatgagacaacatctcttccggaaaatgaagatttagaaaattattctgtaccgagttatcgagaagagaacatattccattatgaaccaacaggagagacttcaaaaactgaaccttctaattcaagtaaatatttgccaaaagaagatgatgatctttcagaagaagaaactaaagaggactcagaagagggagatacacgtgtctcagataaagaaaagccaatcaaaaagaaattttcaaagatatttgaaaataagttatcaacattatttgcgaacacaaaaaagttctttggctttgataaaaaatcatccaaagaagatttagcttcaagtgatcaaataaaaggaaatcaagatcaatacttaaatgttgaagaagaatacaaaaatctaacaaagataattatttatttcattcaaagttatgcagctttaagatacaaatttgctgataaggcagtaattgagaattcttttgatgaaatcaatgaaatagttaaatcttctatacattttcatcaaggaacaaccgaatttgataatatagatatggagaaagctattaaaaaaatagcttcaatgttgggaggaggtagtttcacagctttgaaatcaattggtttgactactaaagatattactgcaaacttgaagcgctatctaattaaattgtttcctactgaaataactcaagaacattataaaaaagataaaaagttaaatactaccaatttttggttaaaacagcacttcactcaagatgttactaaagatggaatgattccagaacaattggagagacctttcattattgaaactagtcaagatctaatagccaaatcaaatgatccaggatctattgaaactaaggctgaaaatctctgcaaaaggatcccctcaatattggaaaagttcttcgataaatctattactaagaaaattaatcataaagattttgactgcttagcagtagttgcagcaaatgaactttatggactttccctcagtaattcactctatcttttcttgtttgattataaaacaaattattggagattcttaacaccagatctctctatctctatatctcaaatcttggagaatgagtaa

SEQ ID NO: 92 - DNA, 1017 bp, Cryptosporidium hominis
atgaaattacttgccattctatttctttttgaacttatctttagagcaacagctcaagatgtaatactcgaatctgaagagggccatcaaaataaggatgataacgggattgcagactcagatagcaatactgaggtcacaaaagtaccaaatttcatcttattatgtgctttaattccccaaatcccaggatgtccttgtgatcctctattagaaactcgtccaacattttacgacttcttgccatcggattgttcatgctatgactcacaacaaagtggattttctagccctccttgcttctgctcaaaacctgattctgatgaatgtaaatgtttaagtggattaagcagcttggacgaagaacatgatagaatgtgcattgtttcaccactaacttacgtaaccccatatgcaaattgtacttccttcttaaatccattaggggaagaaggcttatgtagtggagattctgagctttccgagcattgtgtaacattaaagtcttgtagaagattaactccaatttctattgaggaaagttcaattcaggacaaatgtgtgacagatcccgaatcggaaggctgtccatgctcagcagatcaacagatcactgatgaggatgctctcatctgcagttgttacaagaataacaagaaccctggttgcccatgtgatgtccagccagattcttcaatttgtcaaaagttcattgatttactcacaaaaccaacttcaagtagcagtacaactacaacttcagagcccattgaaataatgaattccaaagaaactgaacctgatacgaaaaatattgaagataagacaaaaagttctgttaaagaaacagaagatgataaagccaaagaaattgatgatattgtcccacatgacgaaactattatgaaagatgcaggaaatgattctggaaaaaatgattcatcttttgcttttaaggtctcgaccaatctttacatatcagtcatttttgttttgttatcaacgctcattttctaa

SEQ ID NO: 93 - DNA, 888 bp, Cryptosporidium hominis
atgatcgatctggtatatgatattgaaagtttaattatattggaacctattcgaggtaaatttacacgtgaagttctcaagtttgataatatacaagaaattgatgatttattgggtttacttaagttattaactactataagaaatagtttagaacttggatatcgtgatgtaaaaaagagagtcaatttagaaaatccttctgcagctacttctatttcaattattgcagttttggtatattctatttgttatggaattgctgttgaacatttttcaaagttccatttaaatatatgtaatctccctaggcctgcattttcaagaccagttttgagaagaaatcaacaagattggatgaagtttgctattactaatgttcttacaaacttgaatattaagctttcatttccaattgcaagatcatttgaaagaaagttagaagcatctatatatgtaagtaatccaaaatctacattattcaattctttattccaaccatatttctctggtataccatataaaccatttaagagtagagttgaatctaatcagaattttactgaaaatgataataaatctaatgtatttaatcctttcaagtctgataaagatcatcgtgaaatatttaaaaagaatttaataatgttaaatgatgatttattggaatatttaattaattctctttcatctttggattatatgccattctttgtacgtcaatgtatttctgttactacagcatttgtaagattccaaattcagaaaactgaagaagaaaaagataatggagctccaaaaccttcaaataatgaattggcatcaattgtatgtcagaatattcaagattacttacagaagaaagttcctaaattctttaaattataa

SEQ ID NO: 94 - DNA, 1188 bp, Cryptosporidium hominis
atgtcagagttaaggcgggaagaacttgtcatttcagacattccagctttattaaaggaagaaatgattgaagacgataagagtctttctttggagttgattttagactcagaaataagaaagaccgaagttttagataattggagttttggaagtaacgaagaatttaatttattatcaattttcaaagatgataatgctaatataaaaaataatgaacaattagatggacaaaaggattgggaaaaggatttaaagaaagatcaggagaagaaagctgatgagaagcaaaaagaccagaaggaaggggagaaggaggttgaaaagaatgctaaaaagaaccaaaaaaaagagtctgaaaataaggatcaagataatgacaataaaaagagggagaaggaggaggctgataaagctaaaactaaggaggacgtaaaaaaagaggtcaaaaagaaggatcagaaggaaggccagaaaaaagaagccaacataaaggatcaagaaaaagattcgaagaaagaaactaaaataaaggatcaagaaaaggatccaaagaaagatcaaaaaaaggatccgaagaaagaaaccaaaataaaggatcaagaaaaggatcaaaagaaagatcaagaaaaggatccgaagaaagatcagaaaaaggatccgaagaaagaaaccaaaataaaagatcaagaaaaggatccaaagaaagatcagaaaaaggacctgaagaaagaaaccaaaagggatcagaaggaagaccctaaaaaagatgagaaaaaagaccttaagaataagtctgatcaagccaagactaaggataaaaaagacacaaaaaaagatagtggaaaagaagttcagaaaaaagactcgagcagtcaaaataaggctaaatataaggaaaatatagaggaagataacataaccgattcagaaagtgatcataaagaaaagaaaaattccaagacaaaaaaaaactcatcctcatcatcaaagtctattaatattaaaattccatatagagaaacaagtcacatcccaagttgtctctttgaacaagacaatacaaataacttagattttaacagaattaaaaactataatgaatatatacatgagactagcagagtatttagtgttgacagtgcatgtagatatgtatttattaaaagaatttctaaattagagtaa

SEQ ID NO: 95 - DNA, 495 bp, Cryptosporidium hominis
atgaacgaagagaaatcatttaaagacttggaaactcttgtttctaggtatattaaattgaatatgagtgaagaaagaggggaaggagaagaagaagaggaacaagaagaaggaggaacaagaagaagaaagggaagagatggagaagaagaagaagaaaaaatatttattgatagttttgagttatgtaaaggaacaaagtcaatccgaaataaacgaagaaaaatagaagatagtaactcttcgtatacaaattctgaaaatttaaatcatagaaaattaaccggtactattgctcaataccttctaagtagagtacctttacctacatcaagagtcgatatacagaaaaaattcatcaaaccagagggatcaaaaaaaattgatttagactcaattcttaacacaattaatgacaaatttaaatcttgtatgggattgggaatatttggactagataaatcaaccactaatcaaaacatcatccaaccctaa

SEQ ID NO: 96 - DNA, 1104 bp, Cryptosporidium hominis
atgaacgattcggaacttaatgagaatggaatatattcttctaagaatttctcaaaacttaataaacaatatatagatattgacacagtaaattttgagagtcttggaaaatatcctaaatatcactcattttttaaaagaggattcctcaatactatacttttcaaatggttatctcccattattaatagtgctgaaaaaggaatcatagttaatgattctgatattaatttggcagatgatgatgttgatattcaaacagaatatatttactttataagaaattggaatgaagaattttctaaacctgaagcagtaaattcaattcaattctcaacttttaaagtaatattcaaaactttctatctaagaattattaacattcttttattcaaattaatatatgatattattcaaatgtgcagaccctggcaaatacatggtgtactttattggattggagatccaaatggatcaaaaactagtggaatattaaaatttttttctattgttatttgtgaattaatctctggttctattttacaacaatattttagaagatctttcagtctttcagtcatgttaaaaggtgttatgaattattcattaacaaataaactgattaaattaccaaaaaatgttgcaattgaaaatgtttcgaaatgtatttcattattatcttcagaatctacttatttattaggtactggaaatacacttttagcagtaccttcaatggttttacaaaatttattattattattttcactatatcaattcattggaattagtgcttttattggatatattattatagtcttatcattatttgttaatggattacttattaatcttactcaatcagtaagatttaaatatatatcatcacttgataaaagaatctcaatatcaacagaattggtaaattcattcaaacaaattaaatgttatgcttgggaaaaatattatataaaaaatattaatgaaatcagaaaagaagaaatacgtcatttaggaatatggagatttcttaatcaatttggattagttcttgcaactttatgtgtatcattatcaccagttatttcatttggttcattttaa

SEQ ID NO: 97 - DNA, 1446 bp, Cryptosporidium hominis
atgatacctcagaatcttatagattttacttattgttttacaagagtaacaatttatattggatatttcatatatcttgattatagattcattattgttttcataccgatatcttatttctttaataaattcagaattagagctatgtttgctaataggcaactcaaacgtatctttcattcaagaacgtctccaattctaacatctgtttcttatacagttgatggtttatcaattctaagatgttccaaaaatggacttaaaaatttctcaaaaaatgttcaatatcttattgattatgaatgtgctccttggagatgttattgtttaatacaaagatggcttggaattcatattgatatacttggagcttgtgtaatttcttctcttggtattttttgtatttcagctaaaggatttgtttctgttggtgctattgccattgccttccaatgttctgtatcttttactcaattagtattatggatgattagaaatatatcagaaactgaaaataacttcctttcttatgatagaatttctgaactcattggtattttaccacaagaaactaatattggtgatgatgatgatgataatgatttaaataagtcttgtaatattaaagaaatcgatgaaaatgctcaagattcagattctttacttattaatattgatcatcccaataaaccactttctttagattggccaactaatggaaatattgtctttaagaatgttgtattcagatacaatccagatgaacctcctattcttaataaccttagcttttcaattcaaggaggaaagaaaattggaatatgtggaagaactggttctggtaaatcaactcttttatcagctattcttagattatatagtatccaagaaggaagcattcttattgataatgttgatgtttctcaaataagtcttaaaaaacttagatcatttataaccattattcctcaagaaccaaacattcttacaggaactttaagatataatttggatccatttaatgaatatacatctgaagaaattgaccaagctttagtaaactcgaattcaaaatcatttgtggattctcttcctgatggaattaatactcaaatgacaaatgtttctaataatatttctttaggacaaaaacaattgatttgtcttgcaagagccatacttagaaagagtaagataattcttcttgatgaagccacatcttcaatggatattgccacagataatattattcagaatattatcaaaacacatttttctagttgtacaatcctttcaattgctcacagaattcatacaattattgactatgatctcattgttgttttagataagggaaaaattgttgaatatgattctcctcaaaacctcttatctaatacttcgtcagttttctattcaattgcaaatgaagttaataaactttag

SEQ ID NO: 98 - DNA, 864 bp, Cryptosporidium hominis
atgtccgagagatctgatttaaactataaaatggaaagaatgagaatggatgaagtcttagggtaccttaaacatattttggataagtatcaagaatatcctaaaggacttaataaagttggattaaatcaagcaagcaaaagctccaattttgagtttgaagttttagtccaaaataatcatctcgtcaatgattgtttgaaaattgtttgtgatcttgttagtgaatccttgctaaaaagtaaccgaattgatcaacttaaagatattattttaaatactgatggaaatcaaaaaatcaatcatcattttgatcatcaatataaagacgaaaaccaatgctattgtaataataatgatctttttgggagcgtatatggaaaaatcgtttgtaatgatgaaaaaaagcatcttaaagaaaaagttcaacatctaagtcatgaaaagttgttattacaaagaggtattgagtttcttaagaaaaagctttatactctaaaaaatcagcaattgattgtttcttctgaaaattacgaaagtaatttggatttaatggcaagtatagataagcctcttggagaaactgaaatagattctcaggaaattattcaagtttcagatctttgggatatatctaactatcttaaagaagatggtattaatgatcttacgatcatgagtgaatttttagtggtcatgaatcgttggaagaagcttgccaaatatacaattgaaaatgatgatgatatttctgagttgaaatctcattctgaacttagaaagaaatacagtgatcacttttcaaaaggagggatttcaatccaaggatttaataataaatccatttattacaagttcaaataa

SEQ ID NO: 99 - DNA, 1164 bp, Cryptosporidium hominis
  misc_feature (1094)..(1095): n is a, c, g, or t
atgccagaaggaagaaaattgatacagattgggaaaaaagaattattagcttgggggagcagtttattgggtgaggaattaaattggaaaagtttttcggatggaacagtgcttttaaagttttgttttattgtttggcctagcctaaataatacaaagactgagattgatgctttatctgattcatggagaaagattgaaactatttttagaactttgagtattgactattccaaattgattgatgaagaaggaattaagaatgataagctttgttctgcatataactcagtgattattttcttttttctttatcattgcgcattcaagaatgagtcttcctttgaatttatccctccgccgtccaaacacatcgcagaattcctaatgggagattcgtcaataaaaactttaattgtgggtggtagtcttcaactatctcctaagactcaaattaggctctttgaaaatgattcaaaagttccaaataagctctcagaagttccaactgaaggagtaaggtattttaaaggagatgaaggagtatattacgatcgaattcaaagattcaacgaagttatggatatggatgaaagaactgtaaaacttgtccaaagtattgataacttttttgaaggcttaaatgataaattatctgaaattaataaaattaacctacctgatgaaattgagaattttactactaaagtaaggcattctttggaatactgtgtgagacaattggtaagaactaaggaagaacaagcaattgaaagagcaaactatgagaatcgaatcaaaactatagaagaagattgtgaaaagaaaatagaacaattaaagctaacttatgaagaaaaaatacgtgaaatagaaaatgaagggaaacaaaaaattattcaagagaaaaaagcttctcaaatgatgttaagaaccatgcaaaacaatcaaactttaaatttgcaaatgtctggctcaatatacaaggattatcataacggtgatctttctcttgaggaattatctacaaagattaaaggtgaaacaattgaacaacttaaatatctacaagaaattgttaatgaagaaaatannaaaagagatgaaatcgagaaaacgcttaatgatgaaatttctttctacccagaaagaaatagagattga

SEQ ID NO: 100 - DNA, 213 bp, Cryptosporidium hominis
ccaagttctgtagctttttttaaaaaatctgccactattctcccaaaattagtattttttaaatctaattgcttattccatgaaaggtatgttgttggcaatagagtgtcatcccaatccacgattattaaagttgtttcaccccctaacaaaccttctattcttttttttttatttggagcatttacaagttcatgggaactaaacatctca

SEQ ID NO: 101 - DNA, 1038 bp, Cryptosporidium hominis
atgtttttgttgggattattcttattctcatgcttaataatcaaatggaacttttctttatcccaggactcattacattcagttcaattgccaaatatttacagcgtgaaaatattacaagaattcccccactaccatataccagaaaatcatattttttctgaaaatgattcatcttataaatataacaaaaatccattcacccaaggtttaatgtttctaaattcgacaattcttatagaaagtgcaggattatttgaaggaagttttattaaactgattgaatttccaagcatgaagaatcttcaacacaagattttaccaaggaggaactggggtgaaggaattgcaactttgaatggccatatataccagttaacttggacaagcagagtaatgtttggatattctcttgatctttcagtagtgaaacgttattcattaccattaacaggatggggtctcacatcagataatgaatcaagaatatgggctacatctggttctgatcaactttttgagcttaatgttccagattttgattcttcagataataaagtcacaattaaaaaggtaataatgttgggatgtcttggaaagcccatgaattttgtaaatgaaatggaatatattccagaaacaaaaactatttggggaaatatattccaatcacaaatgattgttgaatttagtcccgaaacaggtgaatgtatatcaattgcaaatctgaaatcaatttatgatccaagcaaaagcacgttattagaacactttgatattcttaacgatgtacttaatggaattgcatatcatccaagttatcaagaaaagaagatttccaacttaaatggcccagttctttttgttactggtaagaggtggccaagaatatataaaatagaattaactaagattccaattagagcacggaagaacgaaaaaataaatgaatctggagattttgataaatactttgaattttatagctcatccatagaaaatcctagctcaatttccaatgaaaagtttgaaatgtaa

SEQ ID NO: 102 - DNA, 234 bp, Cryptosporidium hominis
atgaatcagaaccagcttttaaagtacattttccgttctttgaagtatctatcttgccaatctttggaactggtgcaagcttacaagcataagctactaacctttcttttagcatggaaatttgggactcaatacttccatttgaattctctaaaatatttgacattggcctgttattctaaaagaatcagaatttcaaaaacacaaataaaggacttcaaattcaaagtttga

SEQ ID NO: 103 - DNA, 363 bp, Cryptosporidium hominis
atgacagaaaattcagtcaaaatcgagtctcattcaaagaaagaaacaatttctcatttgaatgaatcggcaagtagaagcaatcccagaaagaaaagcagaaaaaacacaggaaaggacaacaaggttgataattttgattctcccgtattctcagttaggtataaggatccatcaatagagttatcagaagatagattaacagctgtggggtataaaggttggtcaacagttttgttaacgcacggtgcaagttctggagtttggtattttgaaatcacagttttagaaccacgggttatttccaagtttttaggccattctaagtttttaaatttgaaacaagaccccagtataaggtaa

SEQ ID NO: 104 - DNA, 630 bp, Cryptosporidium hominis
atgatgaatgaaatgattattaaacatttcccaaatctatccattgaaaaagatctatatagacctctattatttactaatattgttacttctatatgcagagaaattccaagatctattgtttctgaatatttacaagatagattaacttcttattatgaagaacaaggaacttcaagacttgttttctttgatgaatttcttgataatattaatagagttgatcgagtattaagacaaccttttggacatttattattaattggacctccaggatgtggaaaaacacttcttgctgatatggtttcttggttaaatggattaaatgtatttactattaaacctggaagaaaatatgatatttttgcatttgaagctgatttaagatctgttatgaaaagagctgcaattaaaggagaaaaattaactttcatttttgaagaatcacatgctttaggtccagcttttattgaaagaatgaatgcattattagcttcaggagaagtaccaggattatttgaaggagatgaatataatcaacttttaaatgaatgtagaacagcatttagcaatagctcatcagtttctatttctgatgatggaaatgagttatttgctagatttacttaa

SEQ ID NO: 105 - DNA, 2541 bp, Cryptosporidium hominis
atgccttcagttgaacaacctgaagaaagagttggattaacaattgattgtattatttcattatttcatgctgaagttggagaagatggaggtattaaaaaaacttctacatgtaatacaaattcacaagaacattcaatgatgagaagaactccaagagatttctttgatttcttaaaacatattattaaaatatataaagaaaagaatgaaacattattagaacaacaacaacatttatcttcaggattagaaactttaagaagtactgaacaagaagttgctactcttcaacaagaacttggcgaaaaagaaaagatattaatagctaaaaatgttgaagcagaacaaaaaatgcaacaaatgattaaagaacaaggagaagctgaagaaaagaagaaaactacagaaactttagcaaaatcattagatgaacaacaaaaagtaatagctgaaagatcaagtgaagtagaaatacaattaaaagatgttgaaccaatacttagagaagcagaaaatgctgtttcaaatattccaaagaagaatttggatgaattaagatcaatggcaaatcctccaggtctcgttaaaaagacgattgatgctgttgcaatattacttacaaataattcaacaaaacctcaagcgtgggaagagagtagaaaattacttaagagttcagattttattacaaaagtattaaattttgattcaaatacaataactttaaaaactatgcaaagattacaaaaagaatatttagaatcaccagaatgggatacagaaaaaattaatagagcaagtcatgcagctggtcctttatcttcatgggtatcgagtatattacaatattcattaataagtgaaaaagtacaaccattaaaaacagaaattagtcaattagaaaaatcgaaactagagaatgaaaaaggattagaagcagctcaaaaattggttggtgaattacaagaacgtatagatgtttataagaaagaatatgcagaattaatatctcaagtacaattaataaaaagagaaaaagatcttgtaacaaataaagtagaaagaagtataagattattaggtaatttaacaacagaacaagatagatggagagaagctaaagaaggatttaagacagaattttcaaatattatgggagattgtcttttatcagcagcatttatatgttttgcaggaggtttagatcagattttaagatcacattatataaaattatggcaagagattttggatgaatttcaattatcacatacaaatcctaatacttttaagattgttgattatttatcaaaaccaaatgaaagattattatggcaaagttatggtttatcaaatgatgatttaagtgtagagaatgcaataataataaagagacatattcgatacccatttataatagatccatcaggatatgcaacaagttttctattagagatgaataagcatagtaatagtaatgtaaatcaagggaaaggaggaggtaaacttcagacaagtactttttctgattcaaattttccaaaattattagaatcctcattaagatttggttcatcattattaattcaagatgtaggatcatcattagatcctttaatatataatgtattaaatcaagaaattcatttacatggaggaagatcattaataacagtaggagatagtgaggttgatttttctcctcattttagagtttatttaacaactcaagatccaacaattcaatatggtccagatctaacgagtagggtaacgatggtgaattttactgtaacaccaacatcacttttagaacagagtagaaatattattttgaaagaactacgtccagatattgataagaaaagaacagatttacttagattacatggtgaatatcgtgtacaattaagagaatgtgaagataatttattattagctttatcaaatgtgaaaggtaatattttagaagatgagacaattattaatacattagaagtacttaaaaagaaagctcaagatatacaaatagagacagcaaaaatggagaatactatggaacatatagatcaagtacttactcatttacttccattatcattaacagcaacaagaatttactttactttacaacatttatcatcaattagtccaatatatcaatatgatcttgaattttttaatagaatactatatggagtattagaaagaaataaatcaaagattaattcaaattcaagtgataatggaggagatcatgaaggagataatggagaagaaagtagtaataatagtatagaatttgatcacaaaatacagaaaattataatcttagatctattgcatgaagcatatttaagagttgctcaaggtttattacataatgatagaatagtatttggattacatttgatgagaatttatattgaatcatattggaatctgtctttagataatgtattgggaaaagaaattgatcttttaacaaagtcgcgtcagcaatcaatatatcaagttcaagatcttcttcaaccataa

SEQ ID NO: 106 - DNA, 2208 bp, Cryptosporidium hominis
atgataattcatataattaatgtttcaggagatgtttgcaagaatgtgtttcaagataaactagagtacaggacttattatgttttggatactcctcaagaaagcattgaaggagtgctttatgatagtattgaatggattgatggaaaattcaaggaaagcaatgaaaacaggatatatgtacattgtcaagagggtgtttctagatcctctagtatagtaatcggctatttaatgtggaaatataataagagttttaatgatgcttcagaatatgtaagagaaaggaggagcacttcaagtccaaatattgggtttacttatcagctattattatttcagaaggctctgagtttggtaaaatttgggattccaactagggatgaaaaagaagaaggagggggagaaaaagctgagcttccttcaataaaccatcttgggaagaaacattggattacttcttcaaagatttactatatatctaaacatggtattccagtttctttaattcattggaaaggggacggaagtaataaatttagtttaaattcaaataaaatctatctattaagacaaagtcttctagaggaagcagactctattcgtcgtgagaaaatttggatttggattggaagccaagttaatgaaggtgttagggaatcaattctagcagttttgaggttttgcagacaaattctcaagatcgaaataggatatgactcatctttagagctggaaaacttagaaatcagagcagatttgataattggagctcttgcagatgaccgaaattcagcctctgaatgtattacaaatatcctttcttccaccattattctcgaatactttcacgaattctcagagagcggggaattcatgcaaattctggcgccagcagatttgcatttatgtaattcctatgacgtaatacaaaggtcattttcctctccatcgataaaaagtatttccaagaatgccattcctttggattatgagaatgatgtagaggatgaggcagaagatattggggttgacaataatgaaggaaattacaaccaaatagatagattgagttcagattctaaatcaagctcagagttatcatctttaatatctttggacgagtctttaccatacttttcttcttttccgtcttcaaatggatctccaattccttcaagaaattcacctgataatttcaaaagttctgatacagaatctactaaagaaatgggacgaatcaaccaacatcatttttcattagattctcggaaaattatctactctaaagataatcttctggaaaaggaaagtagagaagttgaaagttgtcctttgacttttggtaaagttgtgataccaaagttgaattttgctttcaaaggtggagataaatctttggaagatcgttcccagtcacaagattcagaaatgaaagacttaaaagttcattcattttctactaaagaagattctgctcctgtaaagaagcaacattcaatacattttttccaggaagaggttttctgttttaatagtagcagctactccaaaagaagttctatatctcaagaaaatctttctatgaatgaggattgccacagcactttagatagtggaagaatgaaagttttattatttagatttccagactattttggatcagagtctcttcgcttttttgactctgaggatcttcttcctacctcagtctgccctctcattatcattggagaaatcacttcagatgaacaaaaaaataaagaaaaagaggaacagaaaaagaaacaagaagaacagagaaaagataaagaaaaagacaaagaacaagccgatctctcactttcaccattagaaaaaaatcctattaaaaacataatggtttatctttggattggatctaagactacgtattttaatcaagccaaacaaattctttccgaacattttcaaggaaatgatagtcataaccatgcagatgtatcttcattaatattaagtactgttgaaaatcatagtttaaaggattctgagaaaactaacctcaatgaacaaattaataatcatcatttcgagttagatattacccaacttttaattctactaattagaaacaattcaaaattgagtataaaagaagtcagttctgtttactttgagtttgaaggtgaagaatctaacagtttttggaactatttctatcaatag

SEQ ID NO: 107 - DNA, 348 bp, Cryptosporidium hominis
atggctcaggatgatccagttactgcctcccttaatttcaatacttcagctgccttgtataaagaacttgctatcaactttaacaaagaatatttacttccatgcagtacttccttcaacaatctttctgttgcttcattttattcaagtaagcttcctaattctgtatccattcttgagaaccagatatacaaccaaaacaacttctttttcaattcccagcaactttttgctaccaactttaagaatctaaaaactttgtatcagttttcatccgataaagataagctgatcaacgagcttaagaaaatttctaaaagctcacttagatactcaatcataaaataa

SEQ ID NO: 108 - DNA, 648 bp, Cryptosporidium hominis
atgagtactcaagcattggagaaaattactaataaatcagaaaaagaaaagatcaaaaaggaactatatgatgagtacgagattttcaaagtttcaaacatttataatgaaatggacttgaacaaagccatttcaaatgtgatttcctcgattattactctctcaggcctggaagaacagattcaaatttaccacagaaaaaatattctaatgttaattgcaactgtttttggaatatttggagctgtagtattcaaatttccaaaagatcagtggtttattcttatttgtgttgtaggattctttctttccatgtttggtacatttctaattgatgcaaaatctccattttcaggtttcacaaactcatatattgttccaaaaaaactccaagagaaaggtggattttccttaaagaatatatggaactatgataaggatgcatgctacattacaccaaaattaaatcgtgcttcaaacaatattgaatttttgcttcaaaatcaagaccaccaagtgtcaaaaaccatatatgttggaaaattgttcacacttgacggttatataaatactgatgaaatttttgaagttattagcaagctaattgtggaattatatgaaaaatctaacgaaaagaagaagaaatag

SEQ ID NO: 109 - DNA, 4197 bp, Cryptosporidium hominis
atgaagaatgatttaaagaagaataaggaattaaaaagtgtgagacaagatagaaattatacgacaaagagtattggaatggaatcatctctgaaacttggaatgaaagcattttcatattcaagtggtgcagagtggaatccaatgaatccaagcttaatatggagaaaaaacaaggaaaatgatgatgcatccacaatttcttcatctttctcaaaccaaaaagctttaatgaacaacccaggaattattagagagttggaaaatgaacttggaccagttaaaggttcaatcatgcttgcagcaacaggagaaaagcttcgagatattaatattggaaactctttgattgcaaaagaagtttggaaagatgagcctttgtctcatattacaaaacttactcagcaagaaagagagaagcaacaagtgggatataattaccaagagtcgatatatgacaattttggggtaaaaccaacggaactggtaaaaatgaatgattttggaaacattaaattaccagtgagaagtgtcttgtcaatgtctcaagaagcatcaaaagaggtggaaaagaaaattttggacaaagaaggaaatctagaaatgaaacttttgaatgcagtagatccctttaagcaaaaatttcaccataatgatatgacagagaatagaatggtttgtgataggaagtcttcaaaaataggtaggttttataaaaaccctaataatttgaaggatcagattctttttgagaatgaaatttccaaagatagcgagaaagaacatgaaaatgacttgatgaagttacgagcttttaatactaactttgaaaagcatcttggatttaaacttactgggaaagtttctttagataatattggagaacgagtcatttccttgggaactgataatacttcaaaacaaataggaaaagagttcaaagaattaagacgacaacttggttgggaaaaaaatacagaaaagaattttaagaacgaagaaaaagaatttaatatgtatggaaatcttttggaccaaaaaaatatatcaaatgaagctctcattgatcgtctaattgaaaatacaactctttatccttgctttgatgaggtactctttgaaaatactttcagaatacatcctgacaaaaatagaaatcatgtctcattgataacagactatttggatgctacctcggtcttaagctccagtgatgtccttcttaatattcacaaaaaacagtatactcctcctttggctgaaaactttcccaaaggtcttccatccattgtccaagatcctcgtgtaatttggcaaaaagagttccttaatattccatatgaagttacagctgatttgattagaaagattcaaagaggtttctgggacgaaatttcgaatgatatagcaaaaagcagttatggatcaatttcaatatcttctgttgaatctattactaatatcaagaagtttattttgaatgaactcagctataattccatatataatgttgatgaaccatttgatgtctcaccaccaaaactacctcctattgaaagagaacaacaaggaaggatcttaggatctagttcaaaatttcagcaacaaaataacaaactcgttataactccaaagttgaaatttggattaggaggtacgaacctaatttctggatctatctctaaaattggaaataaaatgtttaaagggcctatttctagtcataattctaatgagagttccaaaccagagactttcagaaatgatgtcactgttattaagtacattcctgattgtgaactgtatgagacagcactttggggtagatatgaatttccaaatgatgattccaataaaggaattatacgaaaagttaagaatacagaaattaatgaaggagaacctttatatagagaaaatgtaatctcaatgtcaaatgaatggagagaagatatggaaaagcaaattagtgaaagaaagaaaggagtagagatgcttgttaattctcaagaaaataggtcttctcttcaaaactttactttgaacttaaacaaaattattgattcaaagattcaaaatatggataaaaaagaactctcaaagttgaaagaaatccttaaagatcgtgaaagtttagaagaattaagtaagactcagatttctggaaaaggaacaactctaggagacaataataagattcataagaatagtagacagttaaatataacaggatttaaaaatattggattgtctagtattggaatcaataaagaaagtacttataatcatttggattctccagatatcagtagagttggaattcaacaaaacaatatcttcaaaaagattaaaaattctcagaaaactgttaagaataaaattggtatggcaaatataaatgatgactatgatgatgatgaaagctctgttagggacgatgagtcagaagaatttgaagatctttcaagtgaaaatgaagaggattatagacaaatctgtgagacaattcatattgctccatgggagccaactaacttaatgatgacaaagaatctattcaaatcaacaaataatctcttttctactttatctattttgataacgaaagattcaaagattaagagtagagttgagcttcatgaacttggagaacatggaattattgtttggatgtctcgtgatcctattggaattaaagagaagatcttaaattgttgtaccgatattaaaacaaaattaagagttaaaggtgggatatacttcactcctgatagtgatatatctccaattgagccttgtactgaaattcctggaaattttactttttcagtaactggagttaatttgtctcatcttattttgagtaagaattctatcaaacaattggaatatgttaagaaatatgtcaaaaattatgagaattcattcaatgaactttctaataatggtagtataaataattttaatgggaatgatccaatgtatcaaaaatctctaaatacaggaattaaatacgatgaaaataatcttgtaaatgattctccaatattagaacaaactcaatttggaataaatgcagatacagatattgaaataattacaagatatgataagaaaaacattaataatattgatgtaatgaatttgattccagcattgaataataaccagatttctggtcagaatacaattttggtagtatcggaaaatccttttataaaaggaatacttccattaactttgtcagattttccaaagactacaatgaagtttagtttaagaaggaatcgtttattattgtggagatcaataaagtgtcagatttggaagactcaatatattgaatattgttttaagagttcggtagtaccagcaaaaaaggtgataacatttatttcaaatgcttttttgaaatcaaatacttcaaattcttttgatatgggaggattaatatttaacgagactttattttctcattgtattaatgttgcattatccaaaaaagaccctaaagagatgattttcaggggttgttatatgggagatgatggttttcatgcaattttccctttactaactcaagtaaaatctttaggaaaattggatttggggatgaataatttaacagctcgttctttacctttaatattagaggttgtgaaaggatgtaattgtaagaagctcttattggactttaataatttgggtccaaacaagacaaagcgtgaattttcagtcttctttaagcatatactattttcaacgagtatagaacatttgaatctttcaagaaataaaattaatggaagatgtattgactctttggatactattttggataacttggggatgaaaaataagactttagagactttaagttggtgttcaaatggaaatactcaacctgagattgagacattattacttgctcttcaaccttgttgtgtaaatctttcaaaggtatttttaggaggaaatcctattgaaaggattgatgcttttaaaaggagatttagtccaattcgtataatcatggaggatataagttctcattatgttaacaaagctggagttaatcaaggagaaggtagctacttttcagattctaaagagaaaaaatcaagaggattgagtaggaaaagtcttacatccaattctaatttgagttatacgaactctggattgtttagtcagtga

SEQ ID NO: 110 - DNA, 1783 bp, Cryptosporidium hominis
tctctcaaactcgaacaattttggaaagagtaatgatattaacaatggtaataattcactttatgtaagtaattcaaccaataataattcttccaataatagttttacaacaacaacaacaacaacagttagcacattaatgacagcaaataccattattaataaaagtaatgaaattgacgctggatttcaaataacaactcctggcccaaaatttgtacagaatctgttaaatgctggtggagtacccaatagtgagtcattagtaaaacaactgggacttgaagatctctcagaatttacaaaaatagactcagtagtattattttatgtaccatggtgtgtatattgtcgaggaattatgcctgaatttgaaaaagctgcaaatatatttaaagggaagaaaataagttttgggaagattgattgtaatgagcatcgtaaagcagtattattggaacaagtaattagatttccaacaattaaaatatattctgagggtcaaagccaatattattctgggcttccaaattctgtttcaattgtcaatttcgtgaatagcgaattcaacagagatatttcaatttccagtttgagtgtacttgaagttttcctaaatacagataacagttccatcaaagttgtagcaatcattgatcatgaaaatagtgatgaaagtgatccaatgtctttagtttcttcttcatattcaaaactgagccataaatatcataatatcttctttgcacatgctttaactaataatactgaagttttgaactttatcaaaaattattcaacaaaagataagaataaatcaagaagtgtgatgaaccatagtaatttaataaaggaaaatactttagcaatttttacaccttgggatgataattcagataaacaatatgattttaataaaaatgatgggaataaacatgggctgattttgattgataaagtagattttagtaactttgagaatttggagaaacaaattttaaaataccaatatccattaattactgaatttgatcctttaattgctcaaaaattatttttgggtgaaaaaacaatttctttcctcttcgtcaacaatgatgtaccaaatttgaaattaataatggagaaatatagagaaatagcaagccaattcagaggggagatcctctttgttaaatcaggaactaatcttgctcatgagagaagaattgcccaagttttgataccagaagaatgtaaacttccttgtatttccataataaagtttccaagtgttgatgaagggaagatgattgctccaaccttaccaaatatgcctccaatgaaacgccctcaagctccactaatttatagatgtcggttttctgggccagacttactgaaaaattcaaatcttgaacactttattcaagattttgcatcaggaagactgagcccatattttaaaagtgaagagcctccatctgaagaggacaacgatggaccagttcgtatagtagtttcaaaaacattcaaaaaagaagttattgaaataaatttggatgtcttgatagttttttatgctccttggtgtggtcattgcagaaaattggaaccagattataatgttcttgctcaaagactacgtggcattagtgataagcttaagattgcaaagattgatggatctcagaacgaagttgagaatattcaaattttgggttatccctcgattttattatttaaatcaggaatgaagactgaaccaattttgtataatggtgacagatctggtgcaaacatg

SEQ ID NO: 111 - DNA, 1616 bp, Cryptosporidium hominis
atggtttcaattttgaataatttagaaaacatttatttcctacttcaagtctcaccaattgtacaagttcacactctgagggcaaacgtgagatacagaataggtcctgaagatggaatcacagacgttgatatttcatatccggatccaccaccttgcattacaacaagttttgacctatggattaagaatgaggatcgtgaatttaggcttacaagaaaaggagacaacaatcaagcagagtcatgtaaatacttttacaaagattgtgttacaggatcttatttaccaatcccactatttccagatattattgtggtttcttctggtactaaattaagagtaatgacatctcaaccaaatgagtgtaatattgcatttgtattgaaaacccaggatgtttccgatttgattggttcaaagattatgttcaatactgaaatccaagcttataaaattaattccaaggaaaattctcataaaatgttaatagatgaaatatctaactcaaaaactaaatataaagatacaaccgaaaaaaagcttcaagaggatatgggaaaaagctatttggtttttactgaggcttcacttggaaagggaggcaatggagaagtatttttaggcttaaacagagaaacttttgaatttgttgctgttaaatcagaaatgtcaggttctctttctagggaagcagattatttggagaaatgcaaaagtgattatgttgtaagaaaattagattggtttcaaaatagaaccgacaatagagagtatttgattatggaactatttcatggaggaacaatacgtcaacttttaagatttaaatacaaaaacggtcttccaataaactctgtgagaaatctaatgtatactttattggttggaataagtcaaatgcattcaaaaggagttgttcatagagatttaaagacagcaaacttgatgttaactgatgttgtacgggatattaatacttgtaactctcaaatgaaaatatgtgatttgggaaactcaggaatgtcaattggtggaagactcaaaggacattgttgcacatgctttgctacagctcctgaagtatatttaaataatgactatgatgaaaaggttgatatgtggtctattggaactattttatatgaattaattacaggtcaaagattgattgaatgcaatcatcaaatccactgcaatgcaaatgaaaagatacttcgatttgatttttcaaatattgaaaaaaaaattaatgagcatatttcaactcattatacttttggagatgttaattgggttgaagatctaattgatttattaagaagattgttagaaaaaagtccctcaaaaagaatttctgctcaagaatctttatctcatcacttttttacaaattaccaaccaataacaatagataattcttggaaatgtacaacgaaattgcagttaattaaaattcttgatgaaaatattccagttcagcacgaatcagaagaagcaaatacatatcttccgaattgtaaatgctgctcaaatcaaatgaatataaatcatcattttaattataatattgccccaacttcaagaatatcatcaagttgtttcccaagtttaaa

SEQ ID NO: 112 - DNA, 2295 bp, Cryptosporidium hominis
atggaactgagtaaaaggtcgaactgttatgaagcagaatacactgctaacgagttagcaatagcggctcaaagaagagataaaaacacactacataatattattcaacaattaatagaaacagggaatactggcattttgaatgaatcaaatgcgctccactggtctgtatattatagatgggacgatgtttcaattcacttattgagcttagggtgtgatccatttatgggagatattaatggagatacaactgtgcattactgtattaaatctggaaacttttccatgctaaaatatttatatgaaaaacatgggaacaaaattttttatgttaaaaataggaaccagtttggattaatgctcactgctgcatcagaagtggccgaaggtagagttcaagacttactgagagtaatggaatggctttatcttcaaggatattctctagaagagcaggatattttaggacaaactcctatattctgggcaactaaaagaggaaattacggtattattcaatggctaataagtcatggagcaaacataggacatagagatcataaagggaatacattactacatgctgcctgttcaggagatgttgatgatgaaacagttagctttttgtgcgatttaggtctaattcatctaatatcctattcaaattacgaaaatccggctgttggcaatactgctttccagatttgctggactaggaaaaattattggttggcattaatgcttaatttttggtattatcataataaattatttggaaggatttccctacttagaaacccatatgctgtatactactggtttatttctattctgaatttattggtagtttttattatggtcagcacccttaaatcgtatagagaatacttggatggaatttacctaggttatttctatacctggataattttatttgcagcagctcaactattttgggtgttatcaaatattggaaatgataattatgttaaacatccaatctatcaaaaaataatccccaaacttccacgcgataaattacttttattagagtcacatggactttacttacctttgctaactccgcaagctaataagctgggtaagaattccagtatttatcatttaatgcttaaggaaaatgaacagattcagcttaataatcaacttattgacatgaacaaactcttatttaatggcgatcattttaacattagcaagtatagagaaaaatataataatcacattagcagacaaattgaactttccaatgaaattattgggctgatgccttttgttgcaaaggaaaggcaatctaataattcaaagatttatattgatattgttgaaggaaaaccaataaattcgactgctccagttttaccaaaaatatgtgttacttgcagaacagaaaggccatttagaggacatcattgttcagattgcggatattgtatacaaagatttgaccatcattgcgtatggattgattcttgtgttggctatgggaatcaaagagcattcttcttcttcctaaagtttctcacaatctcattctttctctactactacttgttccaacaatattgctctttcagattcaagttttcagcatctctcaaaaagatttcatccactgattcgaataataactggtttacaatgcagactggagatcttttccttggagttggcgacactgagggtatctatttccacgaaaaagcctattacttcatgacatctgatccttggtttgctctaataatgttcaatagcattatgaatatcccatggatgattttcgtattgtatctatttatcagacatgttaaatcaatcatgtctaacgtgacattttatgagtattataagaaacctgaagcaattaagaagagatttgctggacgtaatacagaaggattttgttatgacatgcaggggaggacattttccacttgtattcgaagtgcttttgcctactttaccaagaataactcctgggataatttggatttctttactcatattagagagcctgaaaagattcttggtagtactacaatgcctattcatattgaaagcaacgccccatatcagagtttatctcaagttcctccaagtaatgatattacatttattaacgagaatggagatcctataccaaatatattttcttctcacgtttccacaagccacccatactatcattcccaatttaacttcccatcaaactcatcatcagctttttatcaagttaatccatatgctggcaaccatatgtataattaa

SEQ ID NO: 113 - DNA, 2985 bp, Cryptosporidium hominis
atgacaaaaaagagacaggctagtcaatcaaataatgaagccaaattagtagaaattgatacggatttggggtcaatatactcaattagcaatttcgacagtattttattggcttgggatttttttaaagatattaaggaggaagtgtttggggtggaaaggccagatatcgttaattcgtttgatatttctggagaaacttgtcaagttagagataacccaacaagatttgctacttctaaagagtatttggattatttttttccactctttttgttggaatgccaacaatctattcagagagctaaacaaatagagatgagtgactttgacactttttcactcaaggatattagagctaataattcaaataaattggaagagtcgaactttctaaccttggtctttgaaagaaggagggctgatgaattaatatacttttctccacaagatttagtactgatcatatttgaccctgagtttaagtcggaggaatttgatgataatttaaagcacgtaataggggtagttcaaggttcaaattcaaatgggagagtaactatcacagtcttaaatcctaattattatgttgatgataaaacaatgaaaagaaagatagcatcttttactagtcaagataggttggtttcgagaatgaaatctttcagtgattcattgggaaataaggagtttggacaagatacttccaatgctttgtcacaaagctcctctcaatcttggtatttatcaagaataacctcattttcaaccaactatagagagcttagtggtttattttcacttccggatcttttattaaaagatgagcttttgtgcagaggcttaaaatgcgagcacactatgaaaattcccactttattgcaggaaaagttaaaagaaaaatataatccttctcaaatgagcgcattaaacgagtgtcttaaatatagtggaataagtcttattcaaggtccacctgggactggtaaaactacaacaattattggaatcattagcgccctcttatcatcaacatttgaagttaagaatgtttcagaagacagtagcaatgaagagaatattgaaactaagaaaaggaaatctaatgaagaaaatatcccagaaatgtatgcaccaattcttagagctaaaccctggtgttacgatccagactacgtaccttggtatgactcagaaatgaaaaatctcaggattttcaggaataacaaagttgaaattaaaaaagtaactttggacactagtagtagaaaaatggggcctcgaaaattacttgtttgcgctccttctaatgctgccattgacgccattgttagaaaactagtcaggaatcctataactggagaaggcggtatattagacaataccggtgaatattattcccccacattagttagggcgggaccaaattttcacccagatttgcatgacttaagtttagagtacaagttacaacaaagactacaaagaaatggatttgatgcaaagaattgtaaacaagaaatacgtcagcaaactcagtggaagattttacaagagtcccaaattgtttgtgcaactctctcagtatgtgggagcaaggagctaatttcaatactaagtcagaatggcagaatgcaggccgcgggaagtggtgacaggaccgcattgtcatttgatactgttataattgatgaagcttctcaaggcgttgaattatctactttgattccattgaagcttggatgtaagagactgattttagttggggatccaaaacagcttccagcaacagtactttcaagacgagcaatagaacgaaaatatgacatttctcttttccagagacttcaaatgagcggacaacaggtagtaatgctaagtgttcagtatagaatgcatccacagatttctgctttcccctcgaagcatttttatgacggagaattacatgattataaggatatactcgaaacaagagctcctgttgtagcttggcaagatatcccaatttttaaacctttcactttcttttcagtgaattcagaagaggagcagggaaaatcgatttcaaatccactagaagcagactttgtttgccagattttggagcttctagggcttattctttatgaacatcaaaagaagttaacagaaaatacagacttgggagaacccagtaaaagatggtatgaaaggattgcagtcatttctccatataatgaacaagttaaaattataaggaagaaaatcaaagagaagtttggactaagtcctgaaactatttgtcctattgatgtttcaacagttgatggttttcaaggtcaagaaaaagattttataatattttcagttgtaagatctcagtatatagaagaagattctctgaataacgctgatgataggaagacaaatgcagggtttattgcagacaggaggcgtataaatgttgctttaacaagagcaaaatataacttatggattgtaggtaatagtagatatcttcttggaaatccagaatggcgtagtctttgggattattcatgtaagaacaattctcaattttctgttgactttaagaggattggatcaacagaaaattatttgaaactttggctatatgggtttctacaacgtaaggaatcttgtagaaatgctcttcgacaagaggttcctgaatttgttcaaaatcttacattggattgttcagtacttgagaagaataaggatactttaaattcagtcacggaaattaaggcaaaagtggattcatcattctttgttgaccttaaagaagatagccaaggctatgaatccaagaataaaagaggttctaaagttttccagactgaatcaaagcctattgaaattgaggaaaacggagtaattcgtaaattcagaaatctagaccttgatcttttctgtgatattaatgattatgaatccagtaaaaataaagatcttgagtcagaaaatgctgctgagtaa

SEQ ID NO: 114 - DNA, 297 bp, Cryptosporidium hominis
atgatccaagattctaaagaaacggattctcctgagcatcaactcagggaaaaaaaaagtcaagaattagatcaaatcctaaaagaacagaaagaacttgttattaggttagataatatcaacattataatcaaagataatcctaaaatcctgaatgaaaatttatcaagtgctaaccaagaattatctatttgggaagataatgtctgtagtctaagacaatggatcaaaaaaaaaatgcctggaatttctgaaaaagaaatcaataataactttggacttccagatgatgactaa

SEQ ID NO: 115 - DNA, 453 bp, Cryptosporidium hominis
atgacattgtatgaaacagcagctccaagagtaattaaaacagctaaggatgttccagctggaatcttgattgaaaaattcgctcaacaattaaagaagggtggcaagatgacaatgccagaatggattgaccacgttaagactgcttcatcaaaggagttaccaccacaaaactcagattggctctacattcgtgctgcttcaattttgagacacttatatgtcagaccaaatgttggtgttggtgctctttctaagttctatggtagaaagcagcgcaatggaacagctagaaaccactcagctgttgcttcacgtggaattattcgttactgcttaattcagctccaatctcttggtttagtagaattcaatccaaatacaggtacccgtagactttctccacagggtcaacgcgagcttgactccattgctagacaatgcaaagcataa

SEQ ID NO: 116 - DNA, 633 bp, Cryptosporidium hominis
atgagatttatctttgcttttatttcactattgcttgggctaattgtctcggtttttgcagagaaaggtgttcgtccaagtacagtaaccccctcagtagttgttgagctcacagtctccattgataaagaagagagcaagttgagaattggtctttttggtgtagaagtgccaaagactgccaataacttctactccctttgtgttggtggaatgaaggataaagatggtaaagaaatgagttatattggaagtattttccatagagttattccaggtttcatggctcaaggcggtgatttcactaatggtaatggaactggtggaaaaagcatatatggtgattcctttgaggatgaaaactttaagtttattcatgaatctcatgtaatctcaatggctaatagaggtcctaataccaatggatcccaattcttcatcactttcacccccactcctcatcttgatggaagacacgtagtttttggaaaattggttgatgatgagagtaagctcacactcactaagattgaacagcttggttcttactctggaagaacttcaaagcgtattgaggtcactgcctgttctcattattctggtactcctccttctgccaaactggaattgtaa

SEQ ID NO: 117 - DNA, 1218 bp, Cryptosporidium hominis
atgacaaatagtgagcagaatcctccttcagaggagaacgtacaagtagcttcaactggtgaaattgagagtaattatgatgaaattgtggagtgttttgaagctttaaatttagagggtgatttattgagaggtatttttgcttatggttttgaaaaaccatcagcaattcaacagagaggtattaaaccgattttggatggatatgacacaattgggcaagctcaatctggtactggtaagacagcaacattcgttattgcagctcttcagaaaattgattattcactaaatgcttgtcaagtacttttacttgctccaactcgtgaattagctcaacagattcaaaaggtagctttagcattgggagattattgtgaacttagatgtcatgcttgcgtcggtggtacttcagttagagatgatatgaataaactaaagagtggcgttcatatggttgttggtactcctggtagagttttcgatatgcttgacaagggttatttgagagttgataacctcaagcttttcatattagatgaagcagatgagatgttaagcagaggtttcaaggttcaaattcacgatatctttaagaaactccctcaagatgttcaggtagctctattctccgccacaatgccaaatgagattttacacctcacaactcagtttatgagagatccaaagcgtattttagtaaagcaagaggagctcactttggaaggtattcgtcagttttatgttggcgttgaaaaagatgaatggaaaatggatactttaatcgacttatacgagactcttacaattgtccaggcaattatttactgtaacacaagaagacgagttgaccaactcacaaagcaaatgagggagagagactttacatgttcatctatgcacggagatatggaccaaaaggaccgtgaagtcattatgagacaatttagatcaggctcatctcgtgttctaattacaacagatttactagcaagaggtatcgatgttcagcaagtttctcttgtaattaattatgatctacctgtctcaccagaaacttatattcacagaattggcagatccggtcgtttcggtaagaaaggtgtttcaataaactttgttactgacgacgacattgtctgtttgagagatattgagagacattataatactcagatcgaggagatgccaatgggtatcactgatattctccaataa

SEQ ID NO: 118 - DNA, 3990 bp, Cryptosporidium hominis
atgaaaggtagaaagagaatttggcaggtctcatatagagatgcaggaacgaagggaatgctagttaaatggggattagtagtgctaatttttcagctatttttttccttgcttatcaatgctggtgatctggatttgccaagcagaaatagtgagtctagtagaatcagcctaccagaaatctactttgtattgacagtggatggtactttatggtcaattggagagaatggaaagatcttatggaaaaggaagatccttgaggaaggtacattttatcctagtagggtcttttatgaccgtgggaacgatgaatcaagcattaaatcaactcgtttatactgttcttttcaaggaaaaatcttttttggaacatcttctgaaagcactcaaggtttctataatacccaaaacacctatgaaaatatcttttctgaaaaatcagttttaccaggaggagttataccaatagagggtatcagtatcggggatctagttgaaaggtgtccgttccactcctccctctttcctggattatatcttactggttccagaacatctgatgtactagctattgatctatttactggaagaattctttcaaactctgcctcgtcccaacaatgcgaagcttatgatcaagaggcatcccttaatccaaaaattcaagttagcattgcaattggagttactacttggaagattcttgccttaaacatccccacaaacaagttagaatgggatatcagatactcagatgttaatggaattaactataataaatattctcaaagcctccagaatgttcatctattggagtctggtcaagcagatcgagaaatacctatcttctttggttcttcacgaaattctctatacttgaaaaatatttcattgggatttaacagtattatttccaaagtctttattcttaaagaggggttatctatcccatatttcccttctaacttctactatattgagcaggtgcatgtcagccgtcttcgtaactactccaactctgctgttggtcctctaattggaactaacaacaacattttgttagatgactttgctcatagcaaatctgagcctgtaaattctgagattagtcatcttattggtagcaagctcaaaggccttactcctatggtcattaactcaaacaggcctgttcccaggcctatgcttcctttcccaggcaataagactgaaacttctgaagaagaggtaactctgcagaacttacacaaccagacggaagctgtaggcttgggaaccaactcagaatctcccaaactacccgagttagagtcagagaatggctccaattctatcctattttccctttctattctgtatcacagaaatcacctcgcaatgaccactggaataatacttttcatagtcaacgtaatcctgcttttcgtactactctcaaaacgaaaacatacttcaagtgcaaacaatcaacaacagagcggaaatctccgaaattcattcctcggctcctcatatgccaccacttttaattctgaagaaacagaaaccgacttccctccttcccgtagctcaggtgacaagtacatgcgcctctctaaaagctattccatggtcgatatgcgtacgaacttcattggaatctcaaagaatgccttcttcaaagcactcaataataaaaatgatgctatatctaaaagccccaattacaacaatcactttgataacttaggagcaagaacaagctttgaagatgactccaagctcacaattgatttgcccaactcaagtattaccgcccaacttggcgcctccacaacgcgcggtcaaactaatcttaatgcaagcaatgcaaataccccaacaaatctccaggaaagccaaaatgcattcactccaaaatctgcagccagtggacccaagtcatcctctctctacaatattcctcctcgttgtgaacttgcaagatgtattgataatggccgattttctaagaactttgagattgtaaagcttataggaagtggcgggttcggtcaggtttatcaagtcgagcacaaactggaaaggggaacctattatgcaatcaagttcctaagattagggattggagcaaacgatgacattactagaattcgctattttagggaaattactgcaaaccgtactactttgagtaaacatgtggtcagatattatacttggtggtgcgaagagccagaggccctacagaattatgtggatgggattgatagtctcggctgttccaaatccgcatcccactcttctattcagccgaaggttcttgagactaggaaaccaacaaagaagcataagaatcgtaaatctgactcgagtggtctaaaaggacgaaaaaaaaactcgaaaaaagaacttgcagataactcggagactttggatcagggtttaaacaaaatcaaagcgcgcttcattatcgatgaattatcacaagaagatgaggatcttctaatggaaacctcttctaatgacagtataggacgtttctcattagagcctacacaaaagaaccgaaagggacgccataatgctgaatttggcttctataacgacgaacattcccagtttagtaactctgactcctgctttagcagggctccttttgacctagatggcgaagataattaccaaggtattgaagaatccgcttttaatggtgactcacatataaatggaaatagatacgctgatgggagtgagggttttggtttacattctgatgataaattaagtattggatatagcgcgagatttggaaatctgagtttagcttcggactcttctttccaagatgggtttgagaatgactctcataatctaaactttatagcttttgagaatgaatctcatgttcttgagaagtctgaacttgaggactcttctccagaacatatcgaagaaataccaaatatatatattgacgacgttcacaatcaaccaaatgataatggattattgtaccgaactaagactatttctactaaaaacaatcacgagctttttgtattatcatctggaaacctcccacaagtcagttcaatatcttccgttactgacaatagcaaaagcctcaataataacaaccataatcaccatcatagatctcttgtatatctttctccagcaaatcgtaaagataacgatccaatttatgaggtaattatgatgatacaaatggagctttgcattggagtaactttacgatcctggcttggagacgcaagcagaagtaccgaatatggtggaactgatgttgagcttaatatgttcaaacaaattattaagggtatcagagatattcatgagaagggaatagttcatcgagatttaaaaccagaaaacatttttgtgaacccagattccctccagatcaaaattggtgattttgggcttgctagattaatgtttgacggtgactctaagactaataatggtaatagtaatgtgattagtggtgatactcaattagtgtctcaaccaccctcctcttttactccttcctacaaacttgaaaaaaatggagctgcagttaacaatgacttgaatagatttatggacgaaagaagaagacaaagtcaaatggaagctcagatgaacaatcctctttcgagattggactcccaaatgagtgtgcgtggtcaagtaattggtactcctgggtatactgctccagaaggaggagctttatgtaatgaaaaggcagatatatattcggcagcccttatcctacttgagctcctttgcccaagattcactacggccatggaaagaattcatgttctagatagttttagaagcaaaggggtcgttcctgtttctattatgaagaaccacgatgcttggattcctttacttagatcaatgacttatcaggaccctgaattcagaccatcagcagaaaacacatacagaattgtgaaagacttaattaagaagaaaaaggttatttaa

SEQ ID NO: 119 - DNA, 576 bp, Cryptosporidium hominis
atggattcaaatacgcctccagtctcatctagtccagcccattctccttcattatgtttaaataactgtggcttttatggaaatccaacaacaaataacctctgtagcaaatgttataaagatagtatttcaggaaacagtgtcagtaatcagagctcagtaagtcatcctcagagtagtgattcagtaggcccctcaaaagattctgaatgcggttttttagaaacttcaaaagaatttaaacaagaatcaagcagccctacactaattgaacaagaaattactcctatagaaacaacaaaagagaaagaatcccaagatttgactacggaacctgcatcttcttcagcttcattatcctcacccaccgaaaaaccttcaattccaggaagatgttaccattgtaataaaaaggttgggatttatggatttaactgtcgatgcggcttcaacttctgtagtactcacagatatgcagatgctcatgattgcacatttgattataagacatttgaaagggagcagcttagaaagactaaccaagcagttattgctgacaaaatccaaagaatttga

SEQ ID NO: 120 - DNA, 1200 bp, Cryptosporidium hominis
atgtcgtctttctcaggagatcaagctgcaaatggagaacaatgcatagtaattgactgcggatcagcttatatgaaggcaggaactgacagtgataaaagcccaacatgcattttcccttcaatggtaggccagtatagatcaagatatgttccagaagatgaggataataaccctatttttgtaggagaggaagcaattgcgcaaagaaagaagttatctttaacatttccaattgatcatggccatattgatgactggacaaagtttgaagagttattaaattatctattttatagaggcctggatattgatcctattgacagctcagtaattatcacaaaacctcctttatgtagtaacaggcatgaagaaaaaattacagagttaatgtttgagatgtttcagacacaaagcttaaatatagctttacagggattaatggcattatatagtgcaggtagaacaacaggagttgcttgtgatattggagaaggagttacacaagttgttccagtttatgatggctattgtgattccagctctctcaaaagggcagatattggtggacaagaaattactatgtatctacaaaagcttttatctgacaagggttatattgcaacaactagggatgacttagaacatgtaagaattattaaagaaactttatgttatattgcaaaagaccctgcagcagaaaatgagcgtcctgaagaagaaattaatgaggtatatactttacctgacggattaacacttcatgatgaacatacaaataagattgaaattgacaaggaaaggttctatgctcctgaggttatttttgacccaaaacttataatgagagatgtacagccagttcacgaactaataatggaatccattatgtcttctcctatggaagttagaaaaacacttatgggttctatattacttagtggaggtacatctcttacaacaggtattgaagagagattagaagaagagttaatgtatatttgcccttcccaagctaaaagtaatattagagttactcctgctgacgatcgtaactatgctatttggaaaggagctcagttatttagcgctttaagagattatcaggagaatctttggatatcaagagatgagtacttagaggaaggagttaatatttgtatcaagaaacagcctttcttcagttctataccaaagtaa

SEQ ID NO: 121 - DNA, 894 bp, Cryptosporidium hominis
atggaagcttcaataaggaatcgtcttagaaagcaggatttggttttaccagacgaagaagttccaaatagtcaggacagtaatataaatagcatagattactcagaggtcaaagagttggttttagacggagtaaaacttagagagttaacacagcaagatagtgaatttcttggtagattttcagagttgcaatatttaagtttgaacgcaacaggtcttcaaagattagataactttcctttacttgagaacttgaaagttttagagattcaggacaaccatatttctggtggtcttgatattttacagaattataagaatcttcgttgtttattattaggagggaataagattaaagatttttcagaactaatagtattgaaggagcttcctaagttagagacactttcattattacttaatccaatagctgagaagaattcagaatcctatagatcaatcgtttttgagaccttaccaaacttacagattttagacgaaatgaataaagaaggaaaggaagtcgaagattacggttatgatgatgaggaggttgaaataatagatgatgatactgagggaggtgatgaggaagaaactagtgttcatgctgacagccatgggctgcctgatgatgatgacgatgatgacttcgacgatgacgatgacgaggatgcaggtcaagtggatctcaagcagttctatgaaaatgatctcgaagatgatgatgatgaggatgaatttgagccaggagatgtagatattgatgaagctgaagattttgaggaggaagaggaggaggaggatgacgaggaagatgaggaagatgagattcaagccagcagctccaagaagcaaagaattgaacaggatgacgatgaggatgagtaa

SEQ ID NO: 122 - DNA, 540 bp, Cryptosporidium hominis
atggataatgacagaagcatttcaatgagctatatagatttgggttcagactccccaacatcaaaagagtcctgtccctcaaatttggagtatatcattgaattagttatatattcccagcttgtaatttcgctctttctatgtattggaagaacagactataactttatgttatatttattgggatatggagtattttgtgtggaaatgcctcctctggatgtaaatggattaattaggaagatcacaggtataagaagatttctaatgttaatcatacttgcaacagccattgaggcaatttggctctcttttgcagtatctgcatggctgtgtccaaataaccaaaaccctgatgtctgttttgttgaagactttcagatgaattgggaatacaaactacaccaatatattatttggggatctagtataaactttattctcaaattagttttgggaactctttgttggatgtggattgacaaagagagaacaaaactcgaggctatttcactgaaaccattaattttcttctggtaa

SEQ ID NO: 123 - DNA, 1446 bp, Cryptosporidium hominis
atggcatctatcaaaatatttaagagtttaccattcaacttcttgctgttgtttacattactggtttttagtattggagtggtatcggtaaaatccaatgataactctgaaaagcttccagtttttgcattggtagacatttttcatgttccaccagagtccagacaaaaatgttcaactattttaggatggcttgcaaccaaatacccaaacaattatgttctaatgagtgttagaaacattatttatcaactggcacttcctcatagtatgctacaggaaaatgcagaaaaggagttaattgcagcaatggatagtcttcaaggaacaatgtcgaatgtttctggacttgaaccgggtacttatataagtatattaacttgttctgtggataataaaggaagaacaatccttcaaaaaatggttgagcatggtctagtacaggctctttctcacactttatctcaaaaattctgggttggagcaaaactaaataagttattagatacagaaggaaataatttagcacacttggcagcaatgtcagaaaatgatgaactggtacattatgttcttggaattatgtttaagtcaaatattgttgctgaaatgttggaatctcttaattcaaatggtcaaaagcctattgatattgcaatatttcacagagaccagcaaactgttgatactatgaagaatttcttcagagtaactactttagcagagagggaaggatttgtggatggtgttgaggttatcgaggattctgtagctttagctgagaaggaagctgagaacaaaaagtttaaagagtttattgagaaagaggaagatgcagcaagtaaaatcactaacgctgaaattacaagggatattgaatatgcaaagcaagataattataaagaaagtattaatgatgatatttcagactctcaaagtcagtcatttgagtcatctgctgctgaagattcaatgaattctagccaattaactcaaagtcttgaggacgagtttagtattaagcctaaactcaaagatcaagatattctgcaaaacgaaaataatcagcaagaacaaacattctctgatgaaaacatttatgatgaacaggtggaagatagtattattaatggaaatcaaagattttcagcgattaataagatagaaaatacagagaagggagatgagcctagagaagctgaattaaatttctcatctctaagaggagccgttgaaaacaatatggatcaagaaactcaacatcatcattatcaagatgaccaagaagagattaaaaaagttaataaagaacctcaaagtaaatggaatgcaacagctaaggctattgttggtgcttctattcttgtaggtacctctatacttgctgcaaccgttgtgtttattgtctgtaaaggatatggaaataaggaagaaaatagtttttaa

SEQ ID NO: 124 - DNA, 2457 bp, Cryptosporidium hominis
atgaatttacaaggacataaacgtgggttatcatctcaaaataagataaatagttatcactatttaaatgggaagaaaaatacaatagcaaatatcttgtccaacactacgactacaaataataattattgtctagttaataatgtagtgaatcaagatgataatcgttttaagccattaaacaataattcttcaaagtcgatggggatttctccttccactactacaaagatgaagtaccatatggaagaaaatgaaaataataaatcgtcgttggggttatttcagcaagtatcaagtacaaatttaagtcgttctcaaaatgtgagtttaacgaaacaaaatgaaggattaaatgggagtggagttaataactcgagtgcaggaaatagtttatccaataatccgagtatttccaatgaactcaaagacaagccacaattatcagggttaaataattgcaatagtgggatacaatctaataataataacgattcaaaaaaaaagaggtcaagagtaatttattgtcatgtttgttgtcaatataaaccaagatcaaccagggctagatttcaagtatgtcaacatattgcatgctatgattgtgtcagacttgcattaatgattcagcagagatataatgttaaggctcattgcccattttgccaaatagagttagattggaatagggttaagccttttattgtcttatttaagccaaaatcagaagctaatattgaagaagatactaacaaaactttggcggattcaaaacaagaaacaaatttgggaataggttttaataataataataattcgattggaatagctactaatagtaatggcgcaaataatgcagttgttaataataatagtacacaaaatgaatcaaatgattataatgccaattctcaaatgatttcaaatgacttaattgctcaagcttttgaaagtaatggaatttccaaagaaaaaatattaaaaggattcttttcatgttatttgcaaaaacaaacgcatttaagaaataatgggtgtattctccagaataacaataataataataatggttgcgtttctcaaaacatattatatgactccaaagaattacaaaatacacacacaaactattctaatacacttgaatcatataagatgactgggtcgatttgctatggaggagttaacaataaacagtatattcctcttaaaaattttgccgaccaaaatattcttgtattacctaatcttcaaaattcttctgagtcatgtggagaatttttacctgatgtaggattggcgccagttggggaaactttaccgttgacaaattgcatgcaccaaattgtgggcaccaaagaatttaatccttacatgtatggcgggaactttagttcaacaatttctaataatggtgctggcaatagtaccattgctcaaaatacaaatataagcacttttataagtgataataatcaaattaattatagcagcagtggctgtaatgttgatttaaataataataacagtaatattattagtagtaataatagtaatagtagtaatagtagtattagtagtagcagtagtagtagtagtattaatagcaacaacagcatttgtggtaatataagttacagtagcagtactactacaaccatgagaaacagttgcattggtatgagaaataataacgttgcaggaacgagggttgttcatggatctaattgcaattgtacaagctgtttaaaacaagtaggaagaatgggaataacatcatcaatgggtttgggaatgactccaccgggaagtatattgagtacgatttatgatgaaaataatcctcgtggatttgtatgtggtttgtttaatccatcaattccaacagatggtgtggcattggtacatcaaggtaagtcaaataaaagtcagcatattcattttgagcttcagaaacagtttatgtctgacagtttgaataattattctattggtcaaaatgatggagcaagcactagtagaattagtaatggtattaatactaataataatacagcaaataatcattttattcagcagcaaaataatcattgtacttctcaaagccgaaaccattgccaaataccatattcattatcaacttacggaaatagctgtggagtttcaagtattggtaatggtactttcaataatataaatattgggaatactctattaaattgtgatgaaaatataccaaattcattaaaaacatcatatggattatataatgatcaaaatattcgtttaagtactggagtatcagagatatttggattctttgaaacaagtgaagataagcaaatgccaaattggatgattacaacaccttatttaaatatgaaagatatattgagtgattggaggaactcaacattattaaagagtcattctgatatggtcatatgttctatttaa

SEQ ID NO: 125 - DNA, 1857 bp, Cryptosporidium hominis
atgccaccaaaaaagagtacaaagagtggcggaggggacgaaaatgaaagtcgtttgagaatagctattgtggaagcggatagatgtaagcctaagaattgtcgacaagaatgtaaatcattctgtccagtggtaagaacaggaaagctttgtgtagaggtggattcttcaagtaaaattgcctccatttcagaacctctctgtattggatgtggtatttgtgttaagaaatgtccatattctgcaattacaattattaatttgccaaagaatatgagtaaagatacaacacatagatacggtaagaatagctttaaattacatagattaccggtacctcgtccaggacaagttttaggattagttggtaccaatggtataggaaagagtacagctttgcaaatattgagtggaaagcttcgtccaaatcttggtgattacacaaaggagttagaatggaaagaagtaatagcttattttagaggaagtgaattgcaaacatactttaacaagatgcagaatggagagcttaagacggtaattaaaccacaatacgttgatcatattccaaaaagagttaaaggtagagttggtgatattattaatgccaaagatgagaagtctattgcagaaaccctaatagatcaacttgaactaagacatttactagatagacaagttggtgaattaagcggtggagaactacagagatttgctttatgtgtaagtacttcagttgctagtatggtttacatgtacgatgagccaagtagctatttggatattaagcagagaattaatgctgctaaagttattagaaatgtacttaatcatgaaaactatgtaatagtagttgagcatgatctctcagtattagactatttatcagatctggtttgttgtttatggggaagtcctggagtatatggagtggtaactactccttttagtgttagagaaggtattaatatatttttggatggttttgttcctactgaaaatatgagatttagagaagaaggactgaatttcaagattgtagatcaagatgaaattgcaatgcaaagatctaattttgtaaagtatccaggattcacaaaaactatgggatctttcaagctttcagctgaagctggagattttggaaattctgagattattgttatgcttggacaaaatggatgtgggaaaactacctttattaagattttagcaggagtaagcaagcctgatgattctgatgtaattgacaaagatcattaccaaatgccagaatttaatgtatcatacaaaccacaaactatatcaccaaaatttgaaggtagtgttcgagatttattcttaatgaagattagagactcatttatggatgttcaattcacctcagaagttgtaaagccattcaatattgagagaatttctgaccaacaagtaaagctcctttctggtggtgaacttcaaagagttgctttaatccttgcccttggtaagaaagcagatatatatcttattgatgagccatcggcctacttagactctgagcaaagaattacagcctctaaaatcattaaaagatttattctccactcacaaaaaactgcattcgttgttgagcatgactttattatggctacatatcttgctgaccgtgttatattatttaccggtacccctggtgttgattgccttgctcatagacctgagaatttagttactggtatgaataaattccttaaaatccttgaaatctctttcagaagagaccctatgaactttagacctagaattaacaaacttgattctgtcaaagataaagaacaaaaaatgtctggaaattatttcctccttgaggaataa

SEQ ID NO: 126 - DNA, 2646 bp, Cryptosporidium hominis
atgccagtaataataagtatgttaaatagctacagtggttggtctacggctattacaggatttcttttggacaatagtctcttaattataagtggagctttaattggttcaagcggtgcaatactttcatatataatgtgtaaaggaatgaatagagactttatttcagttcttcttggaggatttgaccaggaagagacagaaaaggtggtaggagatacaaaatgttatactacaagttcaaaagaaactgctgagatattagctgaatcatcaaagatacttatagtaccaggatatggtatggcagtaagtaaatgtcaagatataatttctgatataattaaagaattagagtctagaagtacaatagtagaaattggaattcatccagtggctggaagaatgccaggccatatgaatgttttacttgctgaatcaggagtaccaagcagaattgttaaagagatggatgctgtgaataattgcatgcaggagtatgatttggtattagtggtaggagctaatgatatagttaatcctgcagctttggactctcaaagtaagatttcaggaatgccagtaataaatgtttggaaagcaaaacaagtcgtagtttcaaagagatccttagcgtatggatatgcatgtattgaaaatgaactctttacttgtgaaagaaccagaatgttacttggtgattcaagagaaactcttcaacaagtatataagatattaaaaggatgtgcaggattcgttccaaggcaatatatagattcaagggtaacagaagagatagaagaagttgaagatactgatgaggttacgacagctttactttcttcaaaacaaagaaaatcatccaagacttcaggaaatgttagttctagaaacaagaaagccggtggagcagaaacagagatagagaaagtatctattagtgttaacaaaggttcaaaaaaaattgctcttttaccaatagtttcagaacaagataaaactttattattcccgatacctccttctaaagtgtataagtttagagaaaagggatatgaagtagcaatttccagagatgttttaacttcaccattccagtccaaatatttctcagaggagatatatatgagaagtggagctcttgtatataaaaatattgaggagttaatcaaggaatgtgatgtagtaatcaaaatggctagaccaagtgagaaggaagcaaagtgcatgaaacaaagacagattttaatttgtaacatgcatataagtcagtaccaagataaggagaatagccaagatcaactactagcaagcttaacaaagaatggagtaactgtaatagctttggatgaagttccaagaacttctcgtgctcaaactatggatattagaactacaacaagcacaatttccggatatagagcagtagttgaggcttttaattatcttccaagaattagtaaatcaatttccagtgcagcgggtaatgttgaagagtcaacagtattagtcataggagcaggtgttgctggtctacaggctattgctacagcaaaaagtatgggaacaaaagtgtttgcaatggattcacgatctacttcaaaagaagaagcagaaagctgtggagcaaggtttatccaggtcccaagtgagggagaatctctcagaaaggaggaaatattgaaaaagcagagagatttaattgaaaagtatttgtgtatctcagatattgtaatcacatcagcatgtaaacctggtgaggaatgcccaattttgattacaaaagaagctgtaagaaagatgaagagtggatcagttattgtagatctttgctcagaatttggaggtaactgtgaattaacccagaaagacagaacattctctgatgttcaatcaggaacaacaattattggaaaatgcaactatgtattttcaatgccattacaaagcagtgaattgttttctgggaacttattatctttaattagtgaattagggccaacatctgatagatttaaatgcgatttgaacaatgaaatcatttcaaaaatgtgtgttgctcatgaaaataagatgctttggagaccttttactgaacaaaatcaagagaagcacgaaaaccaagaaatgttagaaaagaagagtcttcttgaaaatatttcaaagcaatcaactcttatctctatcaaggatgaagatacaaccgcaagtaaaacttctgttttttgctcaaaaactgaaattgatgggtatttacaaaaagtcatgaaagaatttaaaaactttgataagcaattgaatggaggagtaaacttttatgctggagtaatgctcgctactcttttcttcacagtattaggactcacaatgactacaattcagatccaaaatatcttttcctttatcatttcaaccatgttgggatattactgtgtatgggatgtggatcctaaactacatacacctttaatgtcagtaactaatgctctttctggagtaatcatcattggtagtatgatgcaatatgggaaccaaactgtaacatatactaccttaatgtccatgttctctacatttttggcctctatcaatacttttggtggtttctacgtcacaaacaaaatgcttactctttttacatcctaa

SEQ ID NO: 127 - DNA, 897 bp, Cryptosporidium hominis
atgctagattatgatcaggagaaaaatctgtttgatgaagaaagcatttctcaactacaaacgaatagagatcaaggaaatattcctcaagaaaaagatgaagaagaacttgataatgcaattgaggttttagttagtgagaaaaaggtatgggaagcagcttttcatgctgcaaagcttgagattgaggaaaaaaacttagaaattgaaagcttgaagaagttactaattgaaagaaatcaactagagatgcaaaaagagtataatcgaaattgcaatttacttaaagggccatttgagtcaaaaattgatagtaataaagctgttgttaatagtgattctacatcaaaaatatcaaagccccctgaggattacatttttgaagaatttatcaatattgcattagaagaaactcaaatattggatgatggagacgaatttgtatccaagcttgaatcttctggagatattgaggatgcttatagactcatttttcgatcatttgtagaactaagtttaaataacatatcacaagaacaaagaattgagtcattaaatgaggagctaaatgctacacaagaagctgttcaaaatcttcataagacaatacaagattcacaaaatagctctaagcttgtttcagttgcatatacgtcccaaatcaagtctttgcaagaagatttgttaaatgcttgtaaagatattgatttttggaaacagcaatgtgagaatttaaataaaacagatattgcttctattcagaatgaggaagtattttcagagaccaattttcaaggatttgatccaactgaatggtgtaatcttggttctggaataaatacaatggtccaagttgaaacttcgcctgattcttattggtggtttatatcattttaa

SEQ ID NO: 128 - DNA, 696 bp, Cryptosporidium hominis
atgaacgatctggatgattcaacttttagattctatacgagtccagaagatagaaatgagttggtaaattataggtcttctctatcaaaatttgaccatgacgaatttatgcttcaatctacagcaagacagtctggatatgtagtcaattcatatatacatggaagagcagcttcagaatatagttgcagtagtggcagttttcgtgatttaaattcaagtgcggaacagacaactttcgagaggtcactatctccagttaaccgtacattagaaactactacatctgaagtttctacaattccttcggctagatctattgctgaatgtaataggaggggtagatccccaagtctatcatatacagtaactactttgcaagctcaaagaggcgcaaatcaagcatttaaaggcttaagaaatactaacaataatataggctggaatagcaaccaattaataagttcaaatgacagaaatccactatgcactcttacaatgaaaagcattgatttaaatcctccatgtttaagtgaagataatttaagcactaccagagtaattaataacggtatgctaactggttcagtgaaaaataaaaattatactgacaaaactgcaagatcttctctttgcacattcttcgacttttgtaattgttttggtcctagggtcaaagatatccataatttatag

SEQ ID NO: 129 - DNA, 105 bp, Cryptosporidium hominis
atggaatacaaaaacaaaaagtttgtagtatttccagatacaaatactggcttggaaagaaacttaactataattactttacctcatcctagtgtttgcacactt

SEQ ID NO: 130 - DNA, 315 bp, Cryptosporidium hominis
atgttatttgcatgtattccgaaatctctgacaaatgtcagagagagactaaaaagaagatttggagagtataagacaacaaatgactcaggaaacactgacaaaaataatatttctttgaataaaaatccaaagaatcaatatgttggagttaaaagaagtattaataagagagctcctcctattattacaaaaaaaacaccatccaaaagagcgccaccacacaaatcattaaaactaaatgtaaataatgacgtgtcaaatggtaatatattagaattcttaaaaaaaaaaaaaaatagtataaatatgtga

SEQ ID NO: 131 - DNA, 1152 bp, Cryptosporidium hominis
atggaggataataatttgaaagatgatgagatggaacaaaaatccactcccagtttccaaccggagattaatgaaaatagcagacaaattgcagagaatctaagaaagagatcaattttagaattgtatgatttaattgcaaatggatctgaagtatatgatttaatgaatttccaaccaacatcaatagagaatcaaaaaaagatgacaaaacatcaaatattggcaattcagtattttgttccatatgtaataaaacattcatataagttggaagatgatgaaattccagataatattgaaaagacagagtatttagttaagatgaagtataatactactcctattatggtagactttgatgaggaaatgcatttatttgtgacaagagattcatttcttgaaagtatgcaatcttatttaaaactaccaaatggtaaaaagtttccaataccaataagatttgataagaaaggaattccaaaagattgtaaaggagaagacaagaatgataatttggataaaaaaaataaggaaaggaataaattaataaaactaacaaaaagtcaagtaggacctcaaatggagaaagctattaatgaataccttaaaaggaggcagttgattaacgaaagaagtaataatggaggaggaggagatggaatatatacaacagaaattgatccagagtgtacttttcaaccaaatttacgcaagacactttttgaaaagtatagaaatgagttgggaattaactccattacaaagaatgatgagtgtatgcaaatgataaagaagtatttattattggataataatgacaaggatgaaaaggtggaatcatactttaaatctctccaggaatgtacatttcaaccaaatattgagaaatttataaaaaagggagtacctaaggaatattattcaaaaataaagaaggaaagtaaagaggaagtgaacgaaattgagagtacaaataaatcagaaatggtattttttggtagagatgaggctgagaacaatttggataatgaaagaatacaaaaggaaagaacaaaagcaattaacagaatatttaaagaagtatggaacgattcaatgaatatagtttttaattttgattccagtaaggtctattcaaatttgatccca

SEQ ID NO: 132 - DNA, 684 bp, Cryptosporidium hominis
atggattttggtcaacactacttttcagaccaagtcagccaagtatcaaatggtatattaaattatgacttgtttaggagctcggttgaacagctcatttccaatgatgatagttcaactattgaaaaaaattccaacataattaataatcccaatatcaagactgaaattagacttttgtctattattttgacaatttggggaggacttttagacgagaattctggtatttgtttgggattcaactttcaaaagcttaagaatttgataacagttgccataggagaaggaataataaatcctagtctagcatctattagcttggcatgtattttaacttgtatccagtctccagtatgtttggatatttctttaaatatgagcaggtaccagatatttttagatttatttgaacttattcttgagattcttgagggaatgaaggctcgagagtcagtctctgaagactcagtaccagaagattcaaaagaatcagagatgaatgatagggaacatcaatcaggtgaattaagcaataatggtttgaaaaagtgtgttttagctttaatttatatattcaaaagtggctcacagacatgtagctatagacaagtggacgaaaagattcaaaagtttatggaggactcaacagttgagatttttctgagattgggatcagtctaa

SEQ ID NO: 133 - DNA, 270 bp, Cryptosporidium hominis
atgactaaaataactagagaagaacgggagagaagagagaaagtgaatagagaaattacaaggcttgctcaacaggagaaatggctagaatcatttagacctaagagagaagagaaaaaccgagtaaaggttcaaattaagaaaaaagctatcaagatagtaaaagaaaaggtttcaaaaaagaaaaagaagctaaattcaaaactccttcaggaacttaataacgagattcaaagaatgatgactttatatgaaaataaggctaaataa

SEQ ID NO: 134 - DNA, 492 bp, Cryptosporidium hominis
atgaatatagagaaggaagataaatcaatactagatagtcattcaaagaagcgttttagaaaggcagcaggccaagtttgggtggacaatactttggatgaatggccagaaaatgacttcaggctattttgtggagatttaggaaatgatgttactgaggagatattagcaaatgccttcaaaaaatatgcttcttttgaaaaatgtaaagtaattagaaataaacatacaggaaagagtagaggctatgggtttgtttcattcactaacccaaatgatatgttgagtgcaatgaaggaaatgaataggaaatatgtgggaagcagaccaattactctaaagagatctaaatggaaagatagagaaattgattctgataaaaataaaagatttgacgaaatgacaagacgaaatgaatcagcaaatgctctcgttcaagactaccaaaaggaatataaaaagagaaaatattcagataaatttcaaagatag

SEQ ID NO: 135 - DNA, 324 bp, Cryptosporidium hominis
atgtattcatggatgtatgatgatgttgacattattattagtatctcagctagatttgacttagctaattcaattataactagatttatatcagatgaacagtatgaaaaattaaagaataatgagcttgaatctgttgaaattattccaagagataatattccaagaaagattactcttgaatgtataaataaaagaaatttggtggattataatatgcttaaagacagtaaagaatacaaagtatttcctactaatacatggcacaaaggacgatattgtcccagtacaagtaagttctatttaagacttaactttaagtaa

SEQ ID NO: 136 - DNA, 2298 bp, Cryptosporidium hominis
atgggaaatgatgatataaaatatatttgtatcagattaatttcaggtctaaagttcttagaatttgatgatatagagacaggaaaaccatccttaaagacttctcaaggattcaaaggatgcaaactttttttgtcaaatattgaaatagtgaatgagattctggaaattgaggcctcagatagaatctatagaagttcctttacaaataattataaggcattatttccatatcctaaaaagagattttatcgtgtggatgttttagaagcttcaatagaaggttatacatcaatatgggtgaatggagaaagatttgaattcaattcaaatgtgattcaaacaggtaaagatcttcatgaaagttggatttgtttggtaacattgatttttcagatgaaggatctaatagaagaaaggattaagaaagaaaaggaattaaagatatttgatttcgagaatgagttatggaaggcaaatgtaattaatgttctaaaaagatttgatcaatcttgggtagaatttgagagggaatatattacagaactgattgccatagaaaatattgctagaagatttataataaatttacataaatatatgttagaaaatgaaattctaagtaataatatgattggcgccaaaatgtgtgtgaatattaataatattgataatatttttgtacatgaaatgcacaagaaggaagaatctgaaaataacggcagcgacgggagtagattaaaaagtgaaattaagtgtaatagtctggatctagtattttttgagctaataaaaagcctttttcgagttttgaatctaaataataagcacagcattacagaaaacattaatttgtcaacatgggaacaaatagtgcaaattaacgaattggcggcaaactccccacattctagtttttctgtagttggcgcctttggcatgcattgcgtgtcagaaatgacaatattgttagaaaaagtcacagaaatatgcgagattccagaaaagatagacccccatatttgtaataatttgagcttacaacagcagattttgaaggtagatgagacatggggtatagcaaaaaaacagtttaataaattggtatcaatggagaaagaggatgttgataaattatcacttgtacagcttgtgaaattgcttcaaaaagtgttttcaattcagtttcagattaggagaagaattaaggaattagaaattggagaattaatcactgaaataggatctgtgaataattttgaagaaatatgtttatgggaaaatatatttgttgagaaattagaagaatgtgatgttattgcattattggctcttccaaagatttgctgtattttgtttttggtaaatccgggagtttgttcggatatgataagtcagtttctaaataatgatactacaatggaatatcactgggttcaacaagaaactgaaaatattgaagataagttaataaaaagtcaaattttcagatctattcaattgaataatgctttatccaataataaaaagattgagagtaaaaattgctcggttaaaaattcttttttaaatatggtaactctttggaattcattcacagaagctgttttatgttgtgaagattatatgaatttctcaacaaatttactagctttagaaactggtaaaaaagctttcaataaagaagagatactttttgtatatattttttcactattaacagggacctgtttatgtggagaaaaccaaataagtgattgtaaaatctgtaataaagagacaaagatcattcaggaaaatgaattcattaaaaaatcagaaaaattattaaattctttgttaatttcaatagaggaggtgagtatattattacagagagtctccgtttctgaatggaatgagtttattcaaactgcagtaatttgcattacaaaatcaccaattatattggaagaaatcattaatgttgatactgatcaaaaagaaattgaaattgagcaaaataatttccttcttaaatttgaagataatactactagtactcaaactactagtagcaattcagcatatatagtgagccaagctaaaaatactgattcttcttttgtcattaataacacaaaaattcaaagttttttaagtaacattggctcaattatatatgaaaatgttaagagttatggaaaatttactactactagcagaaattcagcaactccaaagccttctgaaagctctacaatgattgtgtatagtaattctaattctaatttcgataatgcaacacatatattataa

SEQ ID NO: 137 - DNA, 2841 bp, Cryptosporidium hominis
atgaatactgatgagatttttgagtattattatgcccaacatatcattccaaaaagccttccaactagtattatggattcatgctttttaggttgcatcatattcatattaacatatgttgcctcaagagctctgagggcaaatttgaaggaaattaaaagaaataagctgaataactatcaaattaagaaggctagaagtacttatggaaagaagatgatgatatgtggggtagcaggaagagtgtttggtatttcctgtctattgattattttagttggtttgacacaatatgtcgctcatgaaagtttaaacactaaaggattactggttccagatatttggttctcattagccaaagataaatacaaatacgatgattataagggatttacaagtttgttagctcatataatattatactggacaggattatctgttgacttttttggcttcattactgcattaagaatggtttttgcctatgttcacttatttgatggagttattcttggtatttacttatgtatggttgtaggaattggtttacctttaatgcaagaaggtcttttgggaccaaagaattcatgcaatgcaaatgatcaccattggtataaatttgatactcatgaaattacattctttagggatgagtcaggaaagattcgaactggagatttcagaggtccaacaagtactaattacccacctctattttacagtgaatatattacaatggatgatggagttaaaattgctgtagatgtatatttacctagaatcagatttgggtacaaaaccttaccaactgtagtagatattacaagatacaatagaagaatggatgttcattggccattcactttattctctctctggggagaacccaaatctgtatcaatgaatatttggtcttggcaaattactcaaacttttattcccaacttttatgctgttgttgtagttgataccaggggaacaggtgcaagtaccgggcatagaattgtggatttttcagaaaatgaggttgatgattttagacaaattattggatggataaaaaatcagccttggagtaatggaaaggtaggagtaggaggaatcagttatgatggaatggctgcaatcaaaacagctgcgttatctgggaataatgaatctgaaagcagctcagaaggttttagaagtgataacaatctagttgatgcagtttttgctctttcatcgccaatgaatgtaattaaagagttaattgagccagggggtttgatttgtaaacctctagtggaagactattatagtataacatattcgtttgaacaatatggatctccattacttcatttcttaaaaacggttgcatattatccttttaaattggtggtagccttcttattagtaataggaaatgtttctcctgttcaagggtattcaagtattaagaagcaagcattggaaatgcatcaaaagaattgggatatgtcaaagactattaagaagtacaagtacttggatgaacaggttgagttagatgatggaactttgatatacgctgaaaggcttgggaatactgaagatgttgcaacaattcttggaaataaaggagtaaatgtctatttaacttcaggatattgtgattctgccaactctagaggagtaattcaattctatgatgctttagtagagtcagcatctaaggcatatgagcagtatttactagaggctggaaatatggcatctaaagaaaaacctatatataagttggttcttggtccttggactcactctggcagagcaagttgctctccatttggaaagagtatttcttgttttgagccagccttatattacgacttggttagatttatggactgtgctttgaaaggaatatgctgggaaaaccaagataagaacattcatttcttccaagttggagaagaaaaatggtatactacagacaaattccctcctccagataccaagtatcttcagttttcttttgaaaagcatggagagaatgaaaaaagttcaattcaagaattctcatcaatattaggaactagatttgttccacttgtattccaatcaaaaaagaaggaaacaagaacacatttaaaccaaagccaaaacaatccttcaggatcttcctcaagctacattcaactcaaagttggtgataactatttctcagaatatagatccagatggatgattgcaatgcatccttttagagttacagtatcttataatgagaaaggaaaacagctatggcatgctggtgaaagacttcaccaaaagagaaaaagtagacagcatataagatttgcgactgcaccatttaaggcagatattcgacttgtaggaagtgtttggttacatttctcagttcaacttcttgatggttatgatgctccaatctatgtatacttggaggatatttctccagaaaacgaaattatgtatataacagaaggattggcacaaattggacacagacatgttaatatgacaaaaagtgctcttgagaacataccacatggatcagcaaggaaggttattaggcctcttacaaggagttactaccagcctttaagaagaattggggatgaatctccaatgcaaatcactttggaaccaattacttggaccttctttaaagatcacaaactggccatctcaattacaggtgcagatacaaagaactttaaactacatcatatttctcagaacattaaaatagccaaaaccattaatattaagctggacaactcgtttatggtcaaacttccagttaatagagaggactacaatacttggattgagttaaatcctgaagtttaa

SEQ ID NO: 138 - DNA, 1365 bp, Cryptosporidium hominis
atgagtgttttaagaaataaatatattcccagaatggaagagcacaatttttcaaaatcaacaggatatatgggcttttgggcatctattcttttgtcaataccagtaattatactttgggtattttctgagctcttttcaagaggtttgctttttgaaagtttaagaatatcttcaaatatgagagtagcatgtggggtcatggcagtagttgctattactatggtaatgtcaatacattttctcccaagtggaacttttagatggccttgttatgctttttggaagattatgatgggcatgaatattctatattttatgcttttaacatttttactctttgaagatacagagcatatcagaaatactttggtttatattgacccaaagttaattgaaaaggtcccggaggtaaattatgcaggaaattcgtgttcgataattggatcaaatggatggttttcaaacattcttccaaagatagatatgtttgttattgctcacttccttggttggatggtcaaaacattaatcttaaggaataattttcttgtttggtttaattcaatattgtttgaatggcttgaaattacccttagacacattttaccaaacttttatgaatgctggtgggaccatatcattttagatatttttggatgcaacatgataggtatattcttggggaattatataattaaaagattcaacatgactcgttttaattggcatacttgccgtaatggacttggaggccaagaatatgatcataaagcaggcgattcaatttcaaattcaaagcggagtataaaagcttcaaaagaagtaggctctagttctgtaaataaaaaaaaccaaaaatccacatcaaaaccaagattattaaaagtaaagaatttcatgtcttcattttttaaatggccaaaaattctcacaacattacgtggtcttggatcttttttgattttgacagcaattgttcagttgattgacttgaattacttttttttcaaagctgagttcaatatgccagtttctcactggatttttggtttaagaacagctcttttggcaattagtggtgcttcagcagtcagagaattatatgaaacaatcgcaagggattcatcaattcactttggtaaagtgagctttcaatgttggctcatcgtggtagtaatctttacagaatcactgctttgttggagatttagtggaaatcttcgtgttgattctttcataccctcgaattttattatatatatttggacttttatctttttcattcttgttgttttgtatttatttttaactttgaaaagtttttttcaaaattttggtccaagcgacaaaaaaaataaataa

SEQ ID NO: 139 - DNA, 1722 bp, Cryptosporidium hominis
atgttggatagaggacttcttcagtcaatatttggttctgattcagcctcagctccttcaggatatcaattaaatgaggtaactaatttgagttatattcaggaaggtagttgtaattatttggaggactatttaatcaaaaaattaaaaagaaatgatccgaaagtaaagtttaaggcattaagattgataaaacacctctgtgagaatggtaatccaacttttaagatgctggtacaacgtcatgcgaatcaaataagagtctgtcaaagctataagggcacatttgatcctgtatatggagatactttatcggaattagttagagaagaagcaattcaatgtttaaagtcaatatttagtagcaacaataggagcgacgagagtatcaaagttgggaaccaaagtaaagggtctggacttaaagctaatggatctgcgaataatagttacaaagatagaattcatggatttggaaatccaaactttactgataaaatagagccagataatgactcaatggatatttctcagattgggaattctattgtatacaatgcaaaaatcggacaatataatcaagtagttgacgacctttctgagttagtgttgaaagtacttccaaacaagttaattaatggtatttcaaactattacgggaactccagaaatggagtaaaacctgcaaattttagttatcagagcaatcctgagcctcgcagagacttcagagatggcttctttaacagtgaaatctcaagaagagttaccaatattcaaaattatcagattccaacatataaacaaaaaaatttccctgagtgtaaaatcgaggaaaataagcttcaatattcaaaacctactattacaataagcaaccaaaatatttccagtggtaatacactagaaactcattttgttgagaactattgctcatcaacaggactaattatgaatccctccaatgaaattcttcaaaatagcatcaaagagatccaaaaattagatatacctattgttattaagttgctacataacaaactaatcgatctaagcgatacagatactaactttggtaagaaagataatgaaacccataacaatggcaatgatgaaaaaactgatagttattatattgataacaacgaacaacataaatctccttacacttcgaatcaaacattaaaatcagaaagtaacttcaaagttatttataaaattttgtgcctcattctttctatgcttgaaacaaatcaaaacactaaaaaaagtctcattgagtattcaaacaacgatttcatacacctcctgaatacaatttcaaccagtaacattcactgtaggaggaaggtcaaacaaattatcgaagcattaggcgccagcactagcacctcgcatgcagttccacacgccccacaatgcccgcccgatgttgagttaactaataatttaatagacttaagtacagaaagtacagattttaaggctgataaaaaattaaattcagtaactgatctgacagattcattattaatactatcaaatcagacgcaggagaattcctataagaaaaataatttatttaagaatttatcgataaaaaatcattcaaataaaacaggagccataaattcgagggggcaacaacaggacaagcaaactaaaggttttggatcaaaagaaaacgtaggaaaatctctagtcgatttgggaatattatag

SEQ ID NO: 140 - DNA, 714 bp, Cryptosporidium hominis
atgatcgaaaatcagctatcctgcagttctgcaggcaaaatgaaagaaattataaagatacaagaacaactcagggatgaagttttggaatgcatacaaagtcgaaagagcaagatggccgaattacaaggtgaaactgaggaacttggaaaccaaatgatacaagaagtaacaatgaaggttttgcatcgaattgagcttattatgaatactttagaaagtattctttgtagatgtgagaaagttgaagccaagtttattagttataagagagatttaaattcaaaaagtcaacaagttggcgaacttgcagaaagatttgaatctgtcaagcatgaacttaaaaattactttgttataattgaaagaatagcaggaattttctcagaaactaatcatctcaataatcagatgattaaaacaatcaatgataaactttccagactgtcatgcaataattcgcatattccaattcaagaacaaatacagaaattccacgaaaattttgaaaataattcaaaacttaacgtttttaaccctaataatcaattcagtaattttgttcttcaagaattcaaaagcattcagaacgctataaattccacttcaaagctcagacaagaagctgatgacagcattgccaatgcaatgaaggaatttactgatacactccaaaacggacttaaaatcgctgttagtcactcaaaatactaa

SEQ ID NO: 141 - DNA, 807 bp, Cryptosporidium hominis
atgactgacatcttatccacgaacaaaaagtttgcctcagctgccgattactgtgcaaataatgtgtcttcatttagcaatgaggagcttttggatttatatggattctataagcaggcgactgtgggcgatgcaccagaaaaatctggctcatttttttctgcatttagcatgaaagaccaagctaaatcaaagtcttgggcttcaagaaaaggaatgaatccagaggatgctgccaatgaatatattaaacttatagagaagaaaaatcctcaatgggaggaaactattggtaagaattcgtctatatcactttccaattcaacttctcgtcctttattagaatcaaacttggacgaagagaaacttgaagtagaattgaaaggtgtattggatcaggttctgcttgatccaaacttttctgaaaagaattgctcactctctgtttttgatgcattttgctcgcaggtaaataaaaatgaggttgaatttttaaagaaaattcttgaaagatatccatttttatctaattcccgaagttcagaaggatcctatgctcttcatctagcatgcgacaaaggttatagtgaaattgctctgctacttttaaagaatggagcaaatccaaatgttaaagataactttggggactcccctcttcatgtttctgtaatttctgagcaggaaagctgcgttaaagttcttctcaattatggagctgacctaaaattaactaatgatgatggtttgactcctatccaactgtcagaaaatgatcaactcaaaagaattcttgaaagcagttaa

SEQ ID NO: 142 - DNA, 381 bp, Cryptosporidium hominis
atgtgtaataacaattttttttgctttgaaagttacccaacaaataatagaagatgttcttgctgttgctttgatctaagaagaggatgttctcaacagcttatgtgtgcaaatagaaggcctatcgttcaaagatacatatgcagaatttgtatccccagagtaaacagaatgccagctttgcagaatagaaacacatgctttgaatgttctgcatgcggacaaaaggcgggcactgcaccaatacagtctcagaagcccgaagttttagataaatgcgagcataatcaatcatgttcatatagccaggggtcgattcaaaagaatccaacgggaggatacagatgcggtgaatgttgtatagttttctgcggtcgttaa

SEQ ID NO: 143 - DNA, 894 bp, Cryptosporidium hominis
atgaggattatttttttggcttttttagttgtgatttttttctttatagtaaaaacgtcaaaaggagaagaaaatgagaaattgataaaaataagtagacggtttttggttgaaatatgcaagagctttcagataagtaaaaatccagaagatttagtaaattgttatgaatcctcaatatacttttgtgaatatctttgggttatagcatacataatagaggagaagaaatcttttaaaacccaaatgattttgcctaaaggagtaattgacaataaaaattgcatggagattaattttcaacaatgtattacaatagctaattttttaattaatgaaagttctatttccgtggaatataatgcaattaatagtatggttagtccagtcattgaagaatgtaattttgaaaataccaatttattattaagcttaaatgcattatggttgagaaattcgaataagatttcagatcttactcaaggcgttataatagggaggggataccaagaactggtacaatttactaatccttttcttgatttatcaacaataatttgtcaagatgtaaaaatgtatttatttactgaaaagtataaaatgaaacttaaagcagtcatgaaggatcttatacaatacaagaacctacccttaaccattccagatcctgtttatgttagattaccacttaaatacgatgaagaattagatttaaattggctctactgccaagatctgccaaaatatctaaataaattggatgaaatatctgatcaaattaagctagatttacgtggtaaaagtttaataattaacaaggatattattacaaaatgtacactaaagaataataataaagtaatgaagataattacgtggaaaattgtcaactaa

SEQ ID NO: 144 - DNA, 1125 bp, Cryptosporidium hominis
atgtcaggggattggtgtacaatagaaagcgacccaggagtttttacagagttagtggagagatatggagttaagggaatacaatttgctgaaatatatgactatagtgagagtgggatggaattcatagctaatgaatatgggaatatttatggaataattttcctctttaaatttacagaaaagttcaagggaaatcacttttcacagccaattgaggctcctccaggaatgttttatgcaaaccaggtaataaacaatgcatgcgcaactcaggcgatactttcaatcatcctgaatagattagatattgatattggatctcatcttgaagaatttaaaaagttctcaagtagctttgatccaatgacaaaaggacttgtaattggtaatagtgaagtattgagaaccgcacacaattcttttaggccaatctcttctttggaagtttctgatccagactcaaatgactccaagggagatgcatttcattatatttgttatattccatttggaaaaaatgtttatgaacttgatggacttactactggagttgtagatttaggaagtcctaaagttaatgattctgagaatttctcattagataatgaaatatcagcattatatgataaaccaaatctttgggtatcaagagtaatggaggaagttaaaagaaggattgagctacaaaatgaggattcatctcatggtgaaataagattcagtttattagccgttgttccagataaaatttctgttaccgaaaaaaaagtcaaatatctcaaaatatccaggcaagctcatattgcaaagcttctaagtttgggaggggacttaagtactgatttggaaagtctttctgaagaagaaattgaatctgatgagtttgattctatgttatcttccattccaaatgatatcgctttaattcaaaaagaaattactaagattacccatgaaatatctgaaaatctctcaataattcagaacgaaaagtataatcgtgaaatatggattattgagaacgagagaagaaggcatgattttcttccttttgttcttactcttttaaggcatgcatcgaaaaaaggtctattaatgaagaaactttctcagttacagtaa

SEQ ID NO: 145 - DNA, 2634 bp, Cryptosporidium hominis
atgataaggataaatagcaacaagtcagagggtggattggatgatactggaaagaatgcagtaagacaaacagagatcgcgctaattagaagcccgataatgtcaatgttgtcagtagaatccggcaagcctgtcatgttccagtctttcagatcccctatgtcaggccacgttccgggagtaagcttagaaagtagaaagatgactcttggagtgagaataccgagagattcaacatactgtaacagcataaaacagccgggatttaaacttcctccaaaggctgatgatgggtctcctaagggggagcctgaacctcaggttaatataaaccctttaatactttggatttcctcagaagatggggaaaaaagagttattgaagttgattcaatgttaaccaagtggttgagagaacatcaaaggcaaggagtaacgttcatttttgaatgtttaatgggcttaagagattttgatggaaatggttgtattttagctgatgatatgggattgggaaagacattgcaatcaattacaatcctttggaccttattaaatcaagggtttgatgggaaaccatctgttaggaaagctgtggtagtttgcccagcatctttggtcaaaaattgggcctctgaaatagaaaagtggctccaaggtaaatgtaagtgcacccctgttgcagagagagacagagaaaaggtagtttctgcgtttgcaggattcaaatatgacacgatgtcaagaattttgattgcatcatatgaaacttttaggatgcatgtagagcaacttgatggagttccgatagacttagtaatatgtgatgaagctcacaggctaaaaaatgacaaaactaagacagcaatggcaatcaataatctcccagcaaagaaaaggcttttattgagtggtactcctattcaaaatgatttggtcgaattttactcattggtttcgttggctaatcctcaagtattaggggatgtttctcaatttaaaaagatttatgccaatccaatattggaaggaagggagccagatgcctcggaatatcaacaggagcttgctactcagagattacaagagctttcgaatattacaaatcattttatattaaggcgtgcaaatacattgttagcaaaagtgttaccaccaaaaataattctaaatattttttgtaacttgactccaatacaaaattacctctacagaagatttctacgttcttcggcatgcaaaaagttattagactctgattctacgggaaatcctactggcttaacaggacaggttctttcttcaatccaatcactaatgaagctttgtaatcatcctactttgattagaccaaagacttcaggaggatatggaaagggctttgaggggtctgaaaagtacttggaaatgattcatgggagaagcgcttcaggcgaatctggtggagaatataagaaaagagttacagttggaagctctataaggaatagcaacagaacaggattcagctctaaaccaaatttaagcggaaagttatatcttctttccagattactttttcatattagaagtaatacaaaagacagagttgtactagtgagtaactatacccagacattggatgtattcgagtgtctttgcagagatctccaagtaccatgcgtaagattggatggctcaacaagtattacaagaaggcataacttagttaaaacattcaacgatccgaattccaatagctttgcatttttactttcttccaaggcaggaggatgtgggatcaacttaattggagcaaatcggcttgtcatgtttgacccagactggaaccctgcaaatgacaaacaagcattagcaagggtttggagagatggccagaaaaagaactgctacatttatagactattttctacaggaacaattgaggaaaagatataccaaagacaactttgtaaagacggcctgagtgctatgcttgtaacttccggaggtaataatgaacttaaagactcaatttcagctgatcttgttcgagatttatttactttaaaagaagatactatttcagatactcatgatatgatacaatgcaaccggtgccatgattccagtggtcagcctcttgatatggttccacaaactacaggtttagaagatgatctcaatacatggggacattatcactccttttctgaaatacccgatgaaatcttatcactaactctaaatgaatgttcaaatgaaacaaataagatgtctgttgatatggaaagcgagaagcctcatcccttagagttaccttctgattttcaaccagtttcatttgtaatggcctgtagaatcgaacttcaagaccaggaagatgagcaaagcaaagaatctaatggggagaaaccaatggaagttgacaaagaaaactataacaaagataatactacttgcaatatggatgacacccgtacagataattcaatcagttttgttaatcctgtaataaatatatttggcggtcatgtttcaccagatgcaaaaagaattaaggattcaaatgattctgaggatgattatgctagtgaattcgatatggatgaagaaatggaatattactcatcctcagatagtggtatggagtaa

SEQ ID NO: 146 - DNA, 924 bp, Cryptosporidium hominis
atgaagggtgaagtttcacttattgagaagaaacatataactggtggaaatgatgaatatgtaagtgcagtagaagttaaaaaaactgctcaacaacagtcagaagcagccaaagatattatgtcatgctcaaatttgaatatatactatccaattcaaactacccaaagaaaatcaaacgaaacagatagtgaaggtttctgctttgagaagaatcaatatccatcttccactcgagttttaagcgaattagatgactgcattgaagaatctttcgaaagtctttcaggagttggcaaaacatgcaataaaactatttccagaaaagaatcccttgaatgtatcgagtggtctggagaggagagagttttttctcctgaaacaaaatttcctttatccaaaattgagttctactcgaactggaaaaatattattaatcaccaagatgctcccagaactccccaatttagggcaacttatatactccctacatcaccccatttttctgactctgatgaattttattcagactcatcaagcaatagttctgaatccctcttatatattcagaaagaaactcctattatgagaaaaaataataatgccttcaaagctaattctagacgagttaatggtatttcctggaatcaatatgaaggtgccaatgaagtaaattacaattgtatttctccatctcttccaattcctagcagtatacaaggaaggaatagattagacatattactttctcaatgggtaagctatttctctggtagacaatcaattgatattaatgatattgattgtgcaactcaatactttactggattagatggggctactttggctgcagttacaagctcacttatttatataggtcactgtgctagatatacccaaattagaaaatataatcaagaataa

SEQ ID NO: 147 - DNA, 1689 bp, Cryptosporidium hominis
atgagtaaaagtaggaaaaataaatcaagtgagagctcttcgcacccaaaaagcaggaatgagagcagagtggagtatttacctgatcctcatcgaatgttagctaaatgcgaatttagagagtttcattcatcactgggaagttttggaaaatttagcgaaactgatcattgtcaaagaagcatattatcatttgctttaagccttatggaaggactttttcaatcaatattatgttcaggaactatattagagagcttacatgagttagatcatgatatatactcataccaggaggggaaaagacaaggatcattgaatctaagttttaaagttattagtactgaaaagaaaggttttacattacttcctttagactacaagggtttcaataaatctaatttcaaagatcctaaatcaaagaacgacgatgaaaacaatttttctgaaaatgatccattagttcctccaaaagaatatttagatattattggttacaaagaaccaattacaaaggcaactgtatttcaatttccatttaatacttctcctgaggatttaataactgaaaagtgtataattgacgtgattaggcgtagaatagaagacaaagaatggctttctcgattggagattatatgtggatggcttggagaattagcaagggtcattagacatctcgttaaacactttccagtaacatataaacgttttctagaagaaacagatggtagaatatatacttcattaagatgcccattgttttatatggcattaatgaaacttctttttgatgagtatccaatgattactgaaacagatgaagagctaaactcaaaatatccaggagatgcaagaagattaattaatagaatacgaagaaacaagttaccgggaatgagacttgttgaaataatgtccagaattactatttcttttggaagtgttctagaatctatgggaggaagtccagcatggaggtgtaaccctgaatttgctcagtattatttacatatggcttttgtatttgatgattcatcgttattcacacatattgctgcaaaaagtcaaatgtttgactacgaaatatttgaatggaaatacacattaaactctttagctcaacatataccattgttaaattcattcttaaagccgcttgctacatcaattatggcaaatagagttcaaaccagactagcatgttatttaaaggacttaaatagaaaagcgcatgcagaagatggcgccaattctgaaaaaagtattaaattaccaaaaccagtggtaggaaattcattagaagcaagattcttaacaaatgaagtaattaagcgctcaaaggcattttttggtaactttgaaggtgaaagattaatttcaagtgtgaaattagagttcgagaattggcaatacaaaccaataagaccagtagaggaaattcagaagttggcttctaggaaagttgacttagacaaaacacttaaagaatacagccgtacagttttagtaccagagaaaaagagtagacacgcaaaaacagttataaataatgtgttaccaccattaactcacctatcagagaagaaaaaaaacatattaatcaagatggcgcctggtcaaaagtatgcacaatctttctataataataaggtgagtatacctgtcggtatgatggtatatccatag

SEQ ID NO: 148 - DNA, 2277 bp, Cryptosporidium hominis
atggttcttgattggtccttatgttcatcttcaaggagtggtaatgactccaagaaaattcgctcaaaggttaataacttatcaaataacaaagaattcagtaattctttaaacaaaagagagatttccagtcgctttaacagttcttctagtcttacacaatcaacacgaacagaaagcaagcaaaagccttctcttttaaagaaaagtacctctaataatgagacttcaaaaaatttatcagatattaacttaaagcagaattctagggaaaagcctggggatgttagttctttatcaaataaaagtaaaagtccagaacctgaagaaaagtattgtgcttcttgtaagaaaaagattttgaataaagaagttgatgaagactccgtagagtatcatagaaatatcttttcattgcgtcaaaatgtgacattggatgacttccacaccatttctgtaattggccaaggaggttattcaatagtaagactggtatttgatattcatactgggaatgtttatgcattaaaacaggcaaagaagtgtcaaataatgaataatcaaagccaacacgataaccttgagaatttgataaagatagatattaattcttctaagaaacaagttgaagaaaaacaaactttgaacactgggataatgctgaatactgagatttcattaatgtataattcagatagcccgtggattaataaactttattattattgggaagacaaccatttctattatatgttgatggaatatatgccaggaggagatttaatgcggcatttgattgatcttcatacttttgatgaagaaacggcaaaattttatattgctgaattacttctggccttagattatttaaataatattcaaggtcatattcatagagacataaaaccggataacatacttttagacgtagatggccatataaaattaatagactttggattatcaaagcaaataatccaaagtaaacaaagaccttttgtttcgaatgcttcagtaaattcatcttttcaaaagaatgtaactgctagaattgatccacatgaagtacttattcatgatcaaaactttcatgctggcactccagattatatggctcctgaaattcatagaggggagccttactccctttgtgtagatttatggagtgtagggataatattatttgaaatgctttttggtggccccccgttatcagatccaggccaaaactcacttataacgagaaacaaggtgatgaattgggataagcatttttacttgccctcagagcatcataaatattctccagaagccatggatttgatttgttctttagtttgtgaaccttcacaaagaattaagagtgcaaaggaagctttgaagcatccattctttaaaggaatggactttaccaaaatccgtctccaaaaacctccaattgtaccaaaagtcaagcacaaattagaccattcaaactttgacaagttccctgatgatttgttagtttctttttataactctgcaaaagcttctacttctgttccaatatctaatctctctgaagaacttaatttcaattcatgtaataccaataaaattcaaggagaatctttcgttagtgagttctttccaaactcgatggttcctggagcatcacacaagcttggtaattctcaaagcgtcattgaacattgttctatcccaactgttggtaattcaaaaataccaatttgtaccccaaaacgctcgtatcttcctcttattacacacatatcttctcctttatccaacccttcaacggcgtcatcatggaaacaaattaataactctccaattttccaaactccaaggaaaccttcaccggcctctaataatatttcaagtcaaagtatttctcttaattcacacatactacctcaaagccattcgttttcacaaataattggaaaaaccaactctaacttctccaacccaattggtgcatcttcatgcatacctcaacccttcagcaatttaactccaatagataaaatttcatcaaatttaccaaaatcaacgattcaaacctcaaactccaatatattaaaccgtaattctggaacaccaaataatcataaattccttacattcaaagaaagaaaatcttctgaaaatgtttatagtaggcaatcacaaaaaccaaatactcatttatttccacaaagatctaccagcacatctatcaccagaaataatcaagaaatagtgaatattctcagaaaaaaaaatattatttaa

SEQ ID NO: 149 - DNA, 1056 bp, Cryptosporidium hominis
atgaaaaaaagatatacaaaacatacggccaagatggtgaatgaacattataaattcccagctcaaatgttgaaagaagattttccaataacaatagagaatttaaaagagctaaattcattaataaagacagatttggagaaacataagaacgaattggaggaagaattatcaatgattaaggagtcaaaagaaggaatagcaaaaatggatgaaaataaacaaattgaaaaagaaagtcttcctttctttaaatcgggtaaaaccaatttcgtattgataggacgtgatttctcaagttttgcactatgtcaatgtaagattagaggttcaagacagtttgagatgctaaagctattttctgacttgatatttcaaattcaacatgtagatatcagaataacaggatatgaaatgttgtcacattctctaaagaaggcagttagacaaatgctgataattatttcattaaatgagtttgctataaacttacttccaaaggtaagaaaaggtggatatcagaggttctataggatgaagcatacaacacacaaagccttaagaaaaaggatcaagaaatatctttcaaatataaagcaagacacctacaagctatcagtagtattgaattcattgcataatttgttattaacagcttttaatcactttaaatatgatccagagcttgatgtactaagaaaatcattttcaggaatagatactgaaaagtccgattggggaacatattatcataataactctcttcttagagcaagtaaagcagtaaggagaagtacaatagagaagctagtagggaatttctactttggcagaataaggaggagttttagtactttaaaggagacgattttacagatgttgaatcctcagcagattttgagtctatcacaaatattcaaaactgatttaggagttaaagatatagatgggattgcaagcaggctacatcactacttgaagagtatttatccctcacaaaattgtatcggtgtagaccagggacaaaaattggagtcattctttgccttgtgttaa

SEQ ID NO: 150 - DNA, 1386 bp, Cryptosporidium hominis
atggcagaccaagattctggtgaagtgttaggaccttgtttaagcaaagaggaggagcgtatttctgagattatagacgcctttaaggatacttcgattttagaaaagtctcactcagagtcagagagtgtatcttttacatctgcattggaggagtctgatatggagcttgttgaggagcttgatccagtttcttctagggcatttcttgacagaaagatgaatagtttgcctcagcttcaagaaactgttgggaatcttgaaataacaaagagcacttccatgactaattctggaaatgctaaaccaattcagagaaatattggaggagtagaaatatattccgctttaaacccattttcgaccactttaagttgcttgttaattgagccatcagaaagtgatataatagaagatgaaataagatatatctatttaaaccagattctttcagaaaacgaacaactctatctagcaaagttaagaaagtatgctaagaaccacggctacaagtttcctcactctatttggattcaggcattgagatttttggcttcttcccgttttcatgtccaaacggctttggagatgatggtaagtaaccatgaatttagaatcaaggagctaccaataagtgagaaagatgtgatgaatgatcttaaagttggagctatttattggcatggtaaggatattaagtgtaggccaatacttattgtgaagcttgcaaagcttgatacttttgttggtgaaatcgaaagaatccaaaagctattatgtttttgtctagaattctttcttaaataccttcaggttgcgggaagagttgaaaactggaatgtaatcattgacttggctggaaaagggataactgatctacctattcaagtcctaaagtctgttctttcacttgttaatacacgttatagaatgagactttatagaatgttcattgtaaactgtccaaagtttataaatgttgttagcaacgctcttgttgctgcaattccaggatcatcagttagaaaggttagatttattgatgaatcctattctgatgaaattactagtttggttcctcttgaacaacttgaagagtcttatggaggcaaatgtcctaacttaaccgaaaacttttaccccttcagattttacccaatgaatgagctagatcagaaatttcctaatatccacgctataataccccctgaatatatttctggaatttccattgagatcccacccagatttgatctaacaaaactcccatggcttaaccaaatacctaatgctaacttcactaagaaaacagcagaacagctttctcagatccttggtaccgaaattaaacctaaaataactacagaagacattactaatccttaa

SEQ ID NO: 151 - DNA, 7332 bp, Cryptosporidium hominis
atgtcaagaaccaaaaagagctggaagaggaataattctggcttccagctttacattaaacttattcctgctattcttctttggatattttttatttctgggaaagtttcatcatctaacacttatgaaaatcttcgaagctcaagaacagccaactactctcctcttagatacgaagaagtctcaaataattttcaggaagataataaacaacatcattcttttgaaaaaatcaggaattcaactccagatggatcattatccactaggaaatctagtttaggttcagcacctgatgaaactcagaaaaaagatccacttttaacccagcaaaatcattccagtgcatttcttcctgagatatttatgtcccaattggacatggagtatgggaatagaaatcagggatcagggagaatcacagataaaagttctgatgagagaccagaaagcggcttaaacctacaaatatcgtccttgtcaacttctccagaaacaactttagaatctgatttacaaaaattatcttcggaaccaaattcttcaataaatactccattgagttcttctcctccgcctgctcccccaccacctccgcctcttccaaaccaatccccgacgaatagtccaagttttcaaatgcttgatcctttgtttgaccctataaataagaagaaacaagatgaattcattaaagatttaacaaaaattaaattagtctcagatgttctaccaattccttttaagaaaagtgagcagaagtacgaatttaattatagccgcaatagaaaccagagcctaaacaattataaaatgaagaatctggcaataagtagagaagaatttaaggaaaaccagaagaaactggaagagaaagaccctgaggagcagggtaaagctattgatactccagagaaagctgaagaagataagattgagatgcttccattacctcttgggcctccaattcctggtactgagcctggaatagagggtttatctcatattatacctttagataaagcaccaattaggcctcaaaagcgacaggatgagtgggaatgcattacctcgcaggttgagagagacaaaaccacatggaagattgaaaaaggtaaaatgaggtttaactatatcccaaaattcagtgaaatcaaccaatcagtttttcctttaagcggagatcctaaaagtttgtattataactgtatctcagcattgaaggctttggaagctaagctaattattactcccccttccagtgatgagattgaggcagagtttctcagaactaccttttgcatttctgctgcagtattttgctacgtagaaactgccatgggagatccagaacttcagctcttttggaatcgtgaagttagaatgattactgatgcccttgttgccagggacccaaatttggatctccttcaggttgtaggtgagagtttggctacaaagattgatactcatgttggatcaacaggaattgcctccccagatcgtttgccagattttatgcctcagagaatgcctaaccaaagtttttcctttgcctccacaaagttggaaacttgtcctaccaggaatcaaagaaccgatcagggagactacgaatatgagggaggacttgctgtagctttgtcaactaatattaatggtgtaattgttgatgatcctgaaatttggacaatgtggaaagctatcattacacaaaaggatagggatttaaatatgaatttgaagagatttaagattttttcaaaggattttccagtaaagtttagctcagatacaaagccaaagaagatgagggagatgcggaatctatgcgtggaactaataagggagggaattaaagaaaatcctccaagatacgaacttttacctttggcaaaaccaaatgaggagcaagttttgaatgagttttgtaactatgcagctgactactactttggaaatagacaatggagttacatttatgacttttccttaaattcgaaatatattaatggggtaccgatttacagaccatatgcaccttttaggtattttgcagctgaaacatttaatgagatgaggaacaattgttgttcagtaatttacgacctcttcttaagcaaagtatttcctcacctttctacaaatcattatagagacaaaggtgcctctatggataagtcaaagttggaacgattctgccatgaagcagctggaaagtactttaagaaagatacctcagagtttgattcaaggctaaagaatgtgggatactttgattttgcaagctataaatcaagggtaaccaattacaagaaagcaaattaccaatctttagtattagaaggtatgcatgacttggaggatactccaggacacttttcaataggaagtattgatgggaatctaagctacactcccagatttccaaacttgaagccaacaagagtctgtttttcacagtggaaggcaattttagatcagaataaggaggatcttaaaaacaatatagaaactccaactcacttgcctgatgtaattcctagtgaatggaatatgcctcagttttctcgagcaacctttaagataacttgctttagaatattacgtaagttatacagagaaggaagcgtttcattaagatctagtgttttgagatcaagcagtgttgagcaaaacatggagaagattttctcagacttttgtactgaggcctccaagagatactttgatgggctaaacacagattattcaatggaaagtcttctacaagttcaagctgatacagaatcccagtggaattcggtagtagaagctataatgaggcttcaagagagtaagaagagcacaacaatttattgggtttaccctattcctccagaaagttatgctttgagtttatttagatataacgtgaacccttcttcagaagatgaggaagaggaggaaaagattaaaaagagcttctggaaatcaaaggaaggagaagtaggatatgaaactaggtgcatcgagtcattaaagttctataaagctaaaagcgatgaagaaataatgaaaatggaggttgataccaaagatatggccttaattgaaatggcaatgagaaaggtttgtgaagaagctgctgactcattcttcggagcaattgaatggatttggatgtataagctttcaaatattgacaatattaacaagtatgcaacttgggttccagcagttacaggcctacctaagagaagaccaattagttctcttttaaaatacaaagggacaggaagcatagtacaattcagaaactactgctttgcatttgtttggactctatggaaatcaggaaatgagccagatctaagaatttcaggaaagctatattctccaggagagggaagtttggtggatcagaaggctcagcttgagagatggtgcactcacgttgcgaacgaagcctataactctggatataagctttctttagaaaagaagaaacaagaaggaatagtcgaccttatgcctagagcagaccctcagacctctctctctgcggtagagcatgaaaacaagtcagaacaagaaagcgcgcaggtgatagaaggagaaactgttgtcttctctttcggaaacgcattttcacagtggaaaatgatcctctcacaagttgaggtagatcgaagacgtaatattaaaagaattgcttggcttccagagtattccgaaattaaagaatatttcccagggcctgttgaaaggcgccaatttgtgcccgcctgcatgcaaattttgcaaaagctgggtgaaagaggacttttggtgtggggaacagtctcaccagagtaccagggagtagtgatcagagaattttgttcagatgctttcatgaatggatatgagtggagaaatgacgactcaaatccaatttctgcaccatatggagaaaaggaggcaaatagagagttgctcatagagtttttgaaattcatgcacacaaatcgaatgaacataaggaaatggattcttttttacttaaatgagaacttgaatcttgattatgcaataacgtgggctattaatgaagataactggggttatttgaacgattatttccatcagtctcaacttcacgaacctgaaaactttgatcagctttttgaagaggtcagggagagagtaaggcagatgggaggttttgtagatgcctctggggatgattacttctctaatagtccaacagctagggagaatttatggaaagcaatttacaatcaaatgcatatagatttacttcttggaaggcaacagagagtttcaaatcttccattgaatcctccagagatttggctgggctcaaagagtccagaggaatttgtagccgattgcaaaagagtgataacaatgttgcaaggccaaacaaaccctgatttgccttcaagtaaagagctaacattaaaagagattcttactgctgttagagtctttgcaagtggcgataaagacgattctgaaatacttaattcatattgcgatgatgttcttctgcatgtttctgataaaagaggaagctcaattttcaaaggtagtggatttagttatccaggagcaattttggaatttgaaagaaatagacaatggggagtcattgcaaatttagaaagtaagtactcgaagcttgagcaaagagatgttgatggcaaaattggctctatttcgagaatttcgaaaattccagggtttgtaagacacaccatattccaaggaagctatgatatggaggaattccagtctcaatgcgaaattgctcttcaaactttagcaactgatattaatattccgtcacatctacgggttgtttttcccgatatgcatgctggagaaaagattgaggatatcataaaagaatattgcagaactgcttccgaatacgctttccaagaaaaggttgatcacgctctaagtgaagatgcaacagaagaagctgcaattttgaatgatttggatagtgttagtcgaaaattcaagctaagaaatcctttgggtctagactactccaaacgatggaatagcattatagacctcgctaagaaaagaattgaagaagaaaagtacttaaggatgaatagagtgcttgaaatcgactctgcgtggcttaagaatacttatccagagatttcagggaaagacttaaaaaatgcttttgattcaaagggaaataatcaccttgcaagctttgtattagtctcatatgagcttttttcggctattttgcttggaaaggaagggaataatggagctaataaggacaaattcaagtttatatccaggaaaaccctactacaattctgtagagatgtctgctacaagtattttaccgatgaagcaagaggtgacgtaaactactctagccgagataaagcagccacggaaaacgctttgattctcgacatgattgcaaccagacctagaattggccctgacccgagagacccactttacgagctttatcctgaacaaggagaggaggtccctgaattaaatagctttaatatggaccagtatatcacttctaggtgggaaatctacaaaaaagactttgaaagtgatagttacaaggaaaatttgcgcaaaaatattatggatagccttacttctgccgaaattaatctccttaatcctggaagtggaaaaccttcacctattggaaataatattgtttgggcgccaactgccccctatccctggaagcaccacactgcaagcaaaattgcattgcaagggaacgcgcatgcctcaagtggtggaaccgttttggcgggtaaaacattggagcatatgaagtcaattttcggaggaaatattgcagatgttgcaaaggttgcagtcattccggcaattccagaccccaattctagaaagcaaaatggaaagccagataatcagagtggtagtgggtcttctacagattttggaacaagtaatcgcattttacctttgggcgactttggagaaaccgccaaggtcaaaagactcaaaattggaactaaaggtggaaggccgattaaagggagggaggttaacccaatcgaggacaagtttgatcaaatagatagagagtataaagaattggtttctaatagctttatctctaaaggaaccgtaggcgaaaatgaagagaaaaatattataagtggaatcaagcctaggaataggagcaatcctgatcgaatctcacaagaacccaagaaaaagatcagatctaatcggagcaaaggtagccgctcttctgacgcttcagttgcagaaggtgaaccacctaagggaagcttggaagaaaaaactttgaccaaggaagagttagcaagctctagattagctgatagagaatggactgtcatttctcaactgggaaagattttacctgcaaacgaggggtcaaatttagtagtagggattccaattgaaaggccaaaggacttttacaaaaaacctatgggaaatgtaagaggtatgactgaagcctgtttctctgtcatatctaatgcaaaatttagagcaatttcaggtactcgaatttctggaaaaacaaaggaggaaagaagacagaatgctaacttttattgcaggaaggcagccgaagcctactatgaatctattgatggagaatttattccccctaaaggctttgaaaaccttccaggattctatgggctatatagttctattgggaaatccaaagctgttcgaggaagaggtaatcgtgtcttcctaggagaaagctctgcaaacccaatgggtaaagaggtgggcctgaaaccattacataaggagtctgccagaattagaagatcctttggtccaactgttggttcttttggactaaatgttcatatgcagaatcagtctaactctttagcaaatacttatagcaaaatttctgcagctgattcaactgtaataagcggatttggtattagtggcaaggcgtctagaattaaaaggagtgtttttacagattccaagaataatgtcagagagagattagagctgagtccaggagacgatttactgactgatcctgactattataatgatatgaaacctgtaacaactccgaacagttatgttgaaatgaggccatcaaaaggacttgggtcaggggccccaaggcctggaaggtcaccaaaaaaagataaatttggcaatccagaggtttattatgttcatccaagaccagatttagtggaagaagctaagataaaatctcagcttgctagacgaattaaccaattttcgacaattaacaaaccagaaaataaaaatcgtccaaatagtagttag

SEQ ID NO: 152 - DNA, 858 bp, Cryptosporidium hominis
atggcttctgatgagtctgagccagtggatccatttgataataaggattttctcatcaattctgtctcaagcttgaccagtaatgctattagatttggagtttaccattatgttaacaagagggattctaaaatgactggcgttgaatcctctgaaaacctggagacttctgaaaagtctgataagaagtcagaaaagaagtcagaaaagaagtcagaacacaaatcggagagtaaatctgacaacaaatctgaaaagaataaaagtaatttgagaccagaaaaggaatccaatgaaagccagaaggagaaaagtggtagtagaatgaagtactggtggtcaaagtatatcagaaggcaaaagaagaaaaaggaagaatcaaaagaaaagcaaactaatacacatcggaatcaaattgatagttatgaatatctattttttggttcagatcctggtaacaaatccaactcgacatttggaaatcctcaagccacaagggagctgttcatacaggatatgacatcaaatgaggatataatgaactctaattataatggaaacaaaatgcgtcccgaaacctacgtaccacttgaaattaagacttctatttttgctgcatattttgcagcagaacctgttgttattcacttttccaaaacaatttctaggaatagaagggttaaatatggacaagaaattgctgtagcagaagcatttcccagaactattaataactcattatcaagtattattttggccagatgcgatggtactatatccataataaatcagaccaagggacttccgatccaatccactcggatgtttcttgtgatcacatgcaatgacacagtataa

SEQ ID NO: 153 - DNA, 1182 bp, Cryptosporidium hominis
atgagtgatataggggaaaaagtggagcttcatatttacgacttaagcaatggaatggcatctcaactgtccccaatgcttttaggaagaacgattgaagctatttatcatacaggagtatttgtttatgggtatgaatacttttatggaggtgggatagtttgtgttcgaccagaagagattaccagattgtatggactaaaacctattcgaacattgacattgggaaccacgaaaaagtctcagaaagaactaaatagccacttggaatcaatttctaatgaatttaacagcgataactacgaccttttaaatcataactgtaatcacttttcagataatatagtcaaatttttgataggagaaggtattccatcttatattttagatctgccaaatgaggtgatgagaactccttttggttcaatgattcttccaatgctacaaaaagcgcagaagagtcaggcaattcgctcagttgcaaatgtttggaacacgaatggaatcaacccctcaaatgtgatcaataaaactgcagaggagttcagttatttgagttctgggtcaagctctacagggagtagtagaacaagccatcactctagatcttctggatcttcagatagtatttctgagttttctaagaagctgagcactgtttccaacaagtacggatggcagtgccaaagagtattagaaactctcgaaactatacttttcaatattataagtaatcccggtgatttaagatacagaagcattaaatcaacaagtaatacactaaagagtgtattaatgagtatagatgaaggccttgagttactattcttagttggtttccgcgagaagcaagcggaagatcaacttagatacgaaatacagctaagccaaccactgagcagagaagaaagagagcaactggaaactcaaattaacttggtcaggcgtaccttaagctccctggggatggcaagtgaacaagaaacccaagagtcagcatgcccagaatctaaagcaagcaatggatcaaagtcagaaagtacaattgactatgtaaaactattagcagaagtgaaagaaatgggatttgaggacaataagaaaatactacaagctcttcacaagactaatggagacatctcccgcactgtgtcaattctgctggatgaacagagccaataa

SEQ ID NO: 154 - DNA, 1383 bp, Cryptosporidium hominis
atgttgaatattctgaaagttggagataaccagacaattgcgcagatagaatctgcggacgcgtcgttcattgttggaacaggaggaagaacaagaagaaaactcgcggccgtttctggaacctccattacaattattcaggatgatagcaagacagccagggttgaaataaatggagatgcagcatgtcgtgaaaaggcttacttatatcttaaatatttagttcagcaaaagcatggcccagtaaccatcgatgttaccccggattcaagagatgaccttacaatagttaatgttccagctctttgtgttggatatattacaggaaagaaaggccaaggattgagagcaatagaagaagattctggaaccttaatgttctttagcagaccagaggaagagtgtccaactgacagtacccctccaagcaacggtgtccctatgaacaatggtaattcccaatcacaatacatcttggctatatttggagttgctagaaatagaagagctgctgagttgagggtaatgtgttacattgaacaaaagattaatgggcactttacaaaagatttgaaagcagaatctcatgaccacattgaggatctagcaacagatattgttcatattgaaacagaagaccttagttatgctgtaggaaaagagggaaatacaagaaggagactttgtgcatctagtggagcgattattgaatacgtgggaaattttgcatttattcatggtgacttgagcgagagaaaacgcgccaaagaatatttggcatggctaattgcccaaagaacatcgacagtctctgttgacaccagagctagagaagatgtaacagttgtttcaattccacaaaatgtgatagggtatgtaactggtgcaaaaggaagctttttaagacgtgttgaagatgaaaccggtacctttatatttattgatgaaaataaaggaaacgttctcgagagagtcctaatattctctagatcagcctttggacgccaaaaagctagagactttattgaacgcagaatgtatgaaaaattgtgtggctatgcagataataagaactatccaccgaatggaaatggattcaatagtaggaatatgaatggtatccgcaaaaccaatggaattactttgaataattcgcacttcgatcacccgatgaagggtaactttgctgcaatcccaaatgcattcctctcacaacctggaatcagtggacttggagcccctaatatgggaataggaagaagatcaagaactagaggtggagcaccagaacaccatatttctgataaatctagcggtaaacccgctggactttatggcggtaatttggttcctttcggtctgagtggtggcgccttgttttaa

SEQ ID NO: 155 - DNA, 801 bp, Cryptosporidium hominis
atgggttcttccaaaatcaggacggcagcagcagtagcaggaggtctggcagtggttggtgcccttttgtactatttattccgaagtgactcttcagaaaataaggacgagtccaatactttagttgaagcctcggtagccaaagatgtaccggagaacacggtaaaggggtcgctggatacttttactaaagaagacatgttattattgcttgatgagatcctagagagtcaaaactctctaaagaaaataatgcgctccttaactaacgactttgttgccgaccccccaaagtctctccaggattgctataataaggttaaagatgcgtctccccaggatccattagataagaggaaaatttctctagttgactttgatcgcttggtagaacgcttttataatgacgagggtataagtagcgcaatagaaaagatcatgggaatccatggaccaagttctataacagagcgagcaggcagtattagtagtgatcagcttgtcaaggttaatgagtttatgttgaaagaactaagagaattcgtggatcaatatatttttatagctaataaagatcaatttgatgttaagacactaactattgccgcacaggtttgggtaggctctaaagttgagaagcagtttaacttgagttctgatgatattgaaaccgcaatgctgcttcattcccagactcttcgtaatgatccagattttggacgaattagtttccagatgcaggctactatggagcagttgcttggttctcctgcaccaaccaatcttcccttttcaatataa

SEQ ID NO: 156 - DNA, 672 bp, Cryptosporidium hominis
atgaaaaaaaatggatttataacgtttggatcttttaacagagttactaaattacatcccttaacaatagaactttggggtgaagtcctaaaaagtgttcctgaaagccatttgttgcttaaatccaaagcattcagctcacagtcttgttgcaatttttatcttgaaattttcaaatcaaaatacaatattcaaccacatagaatttctttaatccccttaagcaactcttattactctcatctggagctttataatgatattgacatttctttagatactttcccatatgctggaacaaccacgacatttgaatgtatttttatgggagttccattaattactttaagtattgaccaatcagaaaattctcaaataaattcttcagacatttatactgaaatttcatcatttcattctcaaaatgttggaaggtccattctcactaatttaaacttgaatgaactcattgcaagtaataagaaagactttgttaaagccgctttaagccttgcaaatgataccgaaagactaatttattatcgctcaaaccttcgtggaatgctcactgaatccaaactttgcgatggagaaaaattctctcgcgatttctttgaattgattttgtatacaattgcatgccataataaaaatttatctgcatgcaagtaa

SEQ ID NO: 157 - DNA, 852 bp, Cryptosporidium hominis
atgaattcagctggtcctgttctgtcaatgagaattgtgcatgataaggacactggattgagtcgtgggttctctttttgcgaatatcgtgatatagagacttgtattatggcaataaagagtttaaatggatacgaattaagagggagatctattagggttgactgggcaagccaggatatgagaagtagatataatcatttagttgtaaataatacatctggtgcagctcctgtaacagcaacaactcaaggtgggattggaatgggacaacaaggaactgaaggcttacatcatccaatatccttaacagcgccatctcacgttcagcaaattcaggaggatgggacatctatgccttcaatcccaaataacaatgcaaattttgataatatttcgtcagaaattatccaacttgtacaaggaatgacagtttctcagttatattatttgataggccatatgcaaaaacttgttgtccagaatcctgaaactgcaagaagcattttacttgataatcctcaattttgttatgctcttcttcactctcaattcattttaggtatggttaatgaaccatttgttccacttaatcaagagcaacttaacaaagcaaatgaaatcagaactaaagtattggctttaagaaacgaaaattctaatattaatattaaaaatttgggagaagatgtttctgttcttattgaagaaattgcaaacaacccaaatcctgcattacttcaagcattgggttcgatccagccaaattccgttgctcagtggactgaagaagaaaaatctaagattcttgcaatccaacaagcactaaaaaatagggggctaattaactga

SEQ ID NO: 158 - DNA, 159 bp, Cryptosporidium hominis
atgggaaataggatttctattgatgattcaatatttgaactcaagctacagaaaaaggagctagagagacaatacaataagagagatagagattcaaagagcgaaaggaagaaagctaaggatgctataatttctgggaaggcagacctctctaagtaa

SEQ ID NO: 159 - DNA, 387 bp, Cryptosporidium hominis
atgcaagaagaatgtaaagaacttcttatcatgatttctaaactagatcgactctgcgctagattagaaaaagcatcatcgaaggaaaaaatttcaacgcagcttttagacattatgccaaaattgaaaaagcaactttccgaagaaggagttatgggatactcaaatatgggtaagatcaaagaaatcggacagctacttaatactattgaagattcccagcccgaaacagttggggaaaatgtgggtaaagaaaaatgcatgcatgcagaagactctgttgaaagactgctagatgagcttttaaatgaacatgctatggaaattgatttggcaatatcctcaaaaactgaaattaatgagttactggaagaaaagttagagtag

SEQ ID NO: 160 - DNA, 2424 bp, Cryptosporidium hominis
atgaaacaagatttaacagttgttaaaaggataaagattgaagagaaatgtaaaaaagtggacaatttagatattaaatacgaatcagagacggatatcgaaaacaaagccggttatatgaactcagaaaaatatacatcattgttcgatggctctgatagagatgatgaggatcttaatagaggatttaagcgcttggttcgaagaaagagaagtgctagaaatctctctgattcatccagcgtatcatcttcatctattgaatctattggaaaaagcgactttacagatttagaaaacagctctcaagatgatcaaactttggaagaaaaagaagcaaagaggttaagggaattaatgcagagagaagaagatgctctatctttctgcttggatatttcttcgaagatgaaagaggggattgtcgacttttttgtaggaaataatgcagacaatgaaaccaaaaagcaaattatcgacaatattaagaatgggcattgtaatattagtaaacttacagaggagttgaaaaaaagtgaaatatttgagtatatcaactcttttggagatactagattgaaggaataccaaatagttggagtctcatggcttttggctttgcatcagaattcatataatggcattcttgccgatgaaatggggttaggtaagactgctcaaacttgtgtttggttgcaatatctatttgattctggaaagttggtaaaacccgtaataattagttgccctgcttccttattagataattggacaaaggaagtatctatttgggccccaagaatcagagccgtaaagtaccatggatctcaaaaggaaagacgccaaatcgccgaccaactttttgaggaatatgaggaatctagagtggatgtaattatcactactttccaaatgctcagcaataagatggacattaatatggctttcaaacactttgaattttcatatatgatagtagatgaggctcataacatcaaaaattcggcttctcaaaggtataaatccatgagtaggaagatccaatctgagagaaagctgttattgactggaactccaatatccaactctatttcagagcttagtaatatgcttattttcttgatgccagaggtatttaattctgatctgctagaggatgcgtataatagttataagcgcaagatttcaaatagagaaaagcttgatgaagctaactctgaggtattgttcctccaacagattattgctccctttgtactcaggaggtctaagcaggacgtactatcctgcttgcctaagaagcacacctttattgaattctgtgagctaactaaaatacaaaagaaacagtatgataatgaaattggacgtatatatatggaaaaagattcagtaaatgattcaaaagattcaaatatgcttgataaggactccaaccaagaatcttcagatgagaagaagctaattaacttaattgaaagaaagatccaagataaggtaaacagccactttggagattcagcttctgctgagaatgaaaaggaatctgaagacgataaccttaactcaaatgatctaaaaacaggtttacaagactacgatcaagatcaggaacaaattgaacaagtaaaatctcgtgaaggaggaaaacatcactacgacccaaaatacgtaaattcgattatattcaggatgagaaggatttgtaaccatacccttttacaccagggccactatactagcaagcaaatagaagagcttgtggactacttgtcagataatgtggatgaattcaaaggatactctaggattaaagtagagcaatatattactcagctctgtgactatgagattcatcagcttgtttctagacttttaatagtgaagaactccccattacttgagagatttaggattgatgatgaactaattattaatgggagctgtaagctaaggaaaatgaacgaaattatccaaagcacggtaatcgaaaacaaggaaaagtgccttattttttgtcatcacacaatgctactcgatattatcgaagagtatataaagattaagtataacatgtccgacttctacttaagattggacgggacaactcccatacttgagagacaaaatatgatagagaaatttcagactactcaagttccgttgtttcttttgtcaacaaaggcagctgggcaaggcctgaatcttacagttgcatcatctgttattatgatggacctcgactacaacccccaaatagaaaaacaagcagaggatagagttcacagaataggccaaagcaaacaagtgaaaatctttaagttggtttgcaaggatactatagaagaaaatatctttaattgctgtcaatccaagctaactttagacaacgcctttggggggaggaatcaaagacagctctaa

SEQ ID NO: 161 - DNA, 1056 bp, Cryptosporidium hominis
atgattacggatatattagaagcactggaaactgaatataatactttgcttctgaacttaattaaagcttatggaactaagaacgaagatgaaaacatacagataaataaaaactctcatgttttcaatactatgactactttaactcaagtgataatctcccttattgcatttaacattaaaaacccagattttgaaatttcaaattcttttattcaaagcataaagcttcttgatgaaaaacttaaaactcaacttaacaaggactcttgctcacttatctctgatgttatttctgtcctattgttcagatttggagctttaaaaaataccaatatcctcaatcaaattaataaaaggtttaaaacccattattatagtagctttgtactcaataaacaaactcatgcatgcatattacatgcaattctgaattgcgcgggaaatagaggtatctactcaaaagaggaccttagctttaaagacaaaattgatcatgagatttttgttccaaaagagcaggacatattgatgaagagcgaagatgagtgtgtcaactgtatctacttaactgaaaagatgttgaatgataggaagaatttaatcaagattataaaaaagaagcaggaagagataaacgtcttagttaaggcttatatggaatcccaggaagctttgagaaatatttcaactaataaagatgaatctgaatcaaatatgggtcgttctgagaggaaagatgtagctattgacaagccggttgatacttctgattattttgctcttctagaaatggtgggaatcttatacagaagattcccaaatattaaggaattcatagaaaaccatttaatgctgtctaaccaggtcaaatcagaaatttcctctattttacttgatgaggatattcaaaactttgaatatgagtatttaacagattcaggagaaatactattagaagaaagagatcagcaaaatgttgaaaatagcactactattatgtttgacgacaatacagaagataagctattgcctagtgagttagaaaggagttag

SEQ ID NO: 162 - DNA, 2313 bp, Cryptosporidium hominis
atgtgggcttttactcagaaagcttccaacttaaaaatcttgaaaccccatccttttgttctgaataggtcaactaaatatggaattctttatttgggagtgtttgcaacctcaattagaggaaagaaggctttttttccttcagagtctaatcttgcacaaggcaattgcatgcatgcaatgacaatttcaacctttaaaaatgaggaccttgcgaaagaaaacaagcttgtgaatatactaaagaaaagtagatttattcaagaaaaggattcaaaaaatattgaaatcctgactaaatatttatggccaaaaaatagggaatatagaaaaagaatcatcttttctttattaagcttaggtgttgctaagcttgccacaattcaagttccattattgctttcaagacttattgacaatgtaggagctattagctcttcaaatctttctttatctcttactaacaaactcaatgttttcttcttaattagctcttatggtatcgcaagaatctcttcttctggctttaatgagcttagaaacgcccttttttctgaagttagtcaatctgcatgcaaggatttatcgctaaaggccttccaccattttcacaatgttagtaatttgagttttattcaaagtcatagatctggagaactcctaactataattaccagaggatttaagtccgtatctaaattgcttaatataatgatatttcagataattcccactactgcagaatttctaatggttttagggattcttcttcacaaagttggttctgaagtagcactgattacactagccacaatggtagcttatatggactttactagaagaattacccataaaagaactatttacagaaaaaacatgaacacctccgaacaaaaatcgaatggtctcttaagcgattctctaatcaatgcagaaactcttaaatatctgaatggtgagaaatatatttatgatctctattcaaaataccaggaaatatataagaattcgaatgttaaggtacaaacatccctggcatttttaaattttggccagaatttcatatttacaggaggacttttatcagcaatgttgataaccacgaacaaagttttagcaggaacgttacctattggttccattgtactggtaacttctcttttattccaacttgctattcccttaaactttattggtatgatttacagagagtcaaaattaactttgattgacttaagcaagttaaatgagtatttaaccataaaaccgaaaaattcttcaaattctcaagatagaactatacaactgaatccaaaaactaaagttttagacttttacaaagaaatgaacctcaatggaaccgaatcaagttctgaaaagaattcaattaaattagaaaacgtttctttcggttttccatcgacttttggaaatgaacatacatatattgaaacctcgaactcttctgatgatttagttgtgaatgatctttctcttgaaattccattaggaaagagaatgggatttgttggatcttctggtagtggaaaaacaactttagcaaagctgatatatagaatattcgagccaaactcaggaaagattcgaatctttggaaaagaaattgaagattatgaaataaatgaatatagaaattgctttgcagtactcccccaagaagttttacttcttaatatgagtattattgacaatttaaaaattgcaaataacaacgtaactttggatgagattaagtcagcatgtaaacttgctggagttcatgagaacattttgaagatgaagaatggatatgaaaccattgtaggtgaaagaggatgtagcttatcaggaggtgaaaagcaaagattaggttttgctaggatgctaattaaaaaatcacctatttggattctagatgaacctaccagtgctttggatttaataaaccacaatttcatggtaaaaatgctttcatttctccatgaatactctctatcaacctcaaattctgtaaatataagtgataaatacgatttaggatctaaatataaggatatatttaccctaataccttatgttaaagataagaaagaaattcaaagcattaagaagcttatagatgatattgtaaagctgccattaactatcattgtaatagctcacagactctccagtgtccgtaactttgatttaatagcatatttggaagaaggaaatgtcaaagaggttggagatcacgaccaacttattgaaaataaaatgcaatactaccagctttggaacaaacaacatattgacagcatactaaagtag

SEQ ID NO: 163 - DNA, 537 bp, Cryptosporidium hominis
atgaagaagcaatttgaggtactttatacacgacaaaaaactcagaagacaaaaacatggcatgatggagtggtagtaatagataatattaaagggattaaccgaatttctttgtataagactgacgaaaatggatataaaggtgatattgtagaatcgttttcttttcatgttcagaaaataaacatttcaaaaattagctttccaggacatttaatagagcttgtaaatgaagaaaaaattgaagaggttgaactagaagcagatgaagatttggatgcaaatacatcgtctgttttgaaaggtactcctaataagactcctccaaaatcaccggaaaacaatgatgataacaaaaattctcttgttaagaaaaaccttataagaccatttaaggctcctttagtaaaagtaaatatggatatttgtaaatcagcacagattaaggctccaaaaaagatcagcaagaatatcccactgagcaagatatcaagtaagcaaggttttataaaagctctagaaagaatatacaattaa

SEQ ID NO: 164 - DNA, 477 bp, Cryptosporidium hominis
atgtttagaaatgaatcaagtggtatttcagagcaggaaaagcttgagctagtacacgccgcgagctttactagaagagatatcattcgtatatactctagattcaaggcactagatactaatcaaaatggagagcttgacccacatgagctttttgaaatgccagaaattgcagataatccattggtaaagcgtgtgatttctatttttgacactaataaggacggtaaagtatcatttgttgaattcattataggtcttgcaaggttagctgttgggagtaatccagaagagaagatgaagtttgcttttgatatttatgatgtaaatagtgatggctggatttcaaatggggagctttttaaggttatgaaaatgatggttggagataatttggaggatttacaagtaagttttggaataatgccattattactctcagagtattttaacttaaatttcactaaaacaaattaa

SEQ ID NO: 165 - DNA, 1041 bp, Cryptosporidium hominis
atgatcaaatcaacaaatatggctggtacagatgatattctgctagaccattcaaatggatacgataaatttaggaggaaagtgctcactgcgctccctgtcatctttgtagtggttattataatgtgtttatatttgatttatacgttttaccatattattcctttaattaaggaaaatagcgaagctggcattactcaagtggtcattttcaatatatttgtactcatgacgctcgtttgctttgttcttagtatcttgacaaagcctggggagattccggatactcccgaatggagcattaaaactacaggaggcttacaaagcgatttaaaatcaaaagagctaaaaagtaatggagaaaggagatattgtaagtggtgtgcaaaatacaagcctgatagaactcaccattgtagagtatgcagaacttgtgttcttaaaatggatcaccactgtccctggatcagcaactgtgttggttggggaaaccataaacacctcctacttttaatattatactctgcaatttcatgttcttttattaccattacattgggtcctaccctaaataagagcctcaatatgacaactattcaatttggagatattgtcgcgcttttgttggccgaaattttatcagcatttttggtagttgtattattttccttctttttctttcatttatggttagtttttaattctatgacaactattgaattctgtgagaagtctagaagcacttcctatactaacatgtggtttaagggttatatgcattcgtttaaacaagtatttggctcgaacccatttttgtggatttttcccgttggaaaccaggtaggtgatggaataaactttgaatattctcagaaacctgatagagatattcaaaataatgagcacacaaatggatcaaataatgtatctaatacgaacaccgatgtggtcgtggattgccaaccaaaaacaacagaagaaagtagtttattattaagttcaaagcaggagtctggtaaaattagagacgactctctttag

SEQ ID NO: 166 - DNA, 1392 bp, Cryptosporidium hominis
atgttgaataaagagacatctaactctctcaaaataccggaatactgctttaggcgtcgtaactttaaaggagagggggagcttgaaaattcaaaattacatgcattcactgatgaatgttgggactcgccgagaataaccccaaactttggtgatgaaaatgataacctattaccaaatcggacactgagtagggtacctagaatttattctttggctgaaggtgattttgaggattttgagaataaacctgaagctctcaagcctctttttgacgccgtcagagagtcatcaagcattgattcagagatcactattcacgcagaagagtacattgaacccgctaatgatggctatgattatgatgatgatgattatgatgatgacgatgaagcgttaactccgcttgcatcttctgctgctagatatagactttatgatattgattgggatgaaaagctaaggctgaaaaaagacgagcaaatcagtaatatccatgaaattcaagatgatataaaacttaaagacgctgatttttgccttctagattccacaggaataaaaggtcctaaggagttcgaaactaagcaaggtaaagttattatttcggaagatggagacttcagttttgaattttctgatagaaggaaactgttcacagtcaaaggaggaggatgtttcgttttagttagtgatgttattgataagaaaagaaggttttctggcgattcatcatttgagtctgctgatgcaactaaccaagaatacaatgaaagtaaataccacgttagtgagcttccgcaacaacatttgaagagatatatctatggaactcatctttgtgaaactatcaaatcgttcattccaaaagtaaagcttaaagttccccaagaagggacttattttttgatgtctaatcatttaacttttgctgattttagagctgaatttatctcaaacctatcagaccaggttctctctgctcatcttactaattatcaatcaaccgttatatttacctcaaaaagtggtaagagagtagaacttgataaactaattcttgacaaaatgggagtttttgaagaggttgaccaggcctttgaagaaattaagtacaatgattacttaattaagaaatctcatgaagtttcagaatgcggaattaaatggtctacaattatcaaaatctggaggttgatactcgataggcttgttgattgcaaaaatttggagttgaaggggcttaaagcctactctgaatctcttattagttctgatgtagatttaaccctttgtgagagcttttccattggggaaaattgtatgatggactggcacattaaaaaaagtgtctttgagaatatattcccaattcaagttgagaagttctga

SEQ ID NO: 167 - DNA, 303 bp, Cryptosporidium hominis
atgtttattataattttggaatacatggcatcgattgaatcaaagttgaacttttccgagaagaaagttcaaaaacatctcaagtcatttaaccaaagtaacttgacaaatttttacaagaatattcatttaaatgataactctcacaatgttgcaagtgaacgttgtaagaatatcccgtatcacgatatattggcacttattcgctttggaatggttaataatggtttaaacaaacattcattcaagtataatgatattgcgagctcattaaaatcgttaaagggatttacttctaagtaa

SEQ ID NO: 168 - DNA, 744 bp, Cryptosporidium hominis
atgccggctaaagaagattttaaaccattcgaaatcaacaactttttggctgagttcaggtctcaagtatctaaaagaaagaagcgatttcaagaacaaccaagctcaaagcatttagatatttttgcagatggaagagctaagctaatggttaaaaaaactagtgacaataattatcaatcagatattaaaaggctcattgaatttgccattgataggtcatcagtacaaggtgagaactctcctttaagtccgttcaatactgatttgctcttcttcaatgaagatacaacctcttcttcagtttattttgagtggtcatgcacggattgtccattatatatgccaaagatgtgtaattgtggaacaaaaggtggtgaaaatctatattctatggtctgtagtaatgagagctgtgaaggcttgctaaaattaccttatagtcttatacatatacccttgaatcgtaaaattaattcagtccaatcattcgtttctgaaaatatgggaatcccaagttctatacttatttattatgggaaactaaaaaattcactgcttttagtgttatttgacaaagaacaagaacgaaacctcgtaagagctctttataatgcatctgaatctattggttgtattgctttatatgatatttttccagataataacaaaagtagaagttcaagaaggccttatacgactaagcttaaatatactggtcaaatccgcaatttatacaagtaa

SEQ ID NO: 169 - DNA, 1542 bp, Cryptosporidium hominis
atgtataaggtaatgaacattattcgtgagtactgtatggggaataaacaaattaaattcagagctctaaatctacaagattcatcaaatgttaatgggtacaattgggaagttggcgatgctaacgtatccattccattcttcggaatacatggaaatcatgacgatcctggagaagaagggcttctttctccgctagatatacttgagtcagcgaggtttatcaactatataggaaagaataacaatgtagataacatagaagtttttccagttttgcttgagaaaggaagtacaaggttggcaatatatggaattggaaatattagagatgaaagactccataggtcatttgaaaagaataaagttaaatttttgattcctgaaaatactaatgctgactctgaatggttttctattttgcttttccatcaaaatagaaaaaaaggcaattttggcggaaccctatcaaaagattctattccagaatcatttttgccagattttcttgatttaataatttggggtcacgaacatgaatgcattgttaaccctgtagaggttgcaaataaaaacttctttgtacttcaaccaggatcttcaattgctacatctcttattgcatctgaaagtttacaaaagcatgttacactattggaaataaaaaataatacatttaaaacaactcccatacctttactctcaccaagggtttttatccatgatcatattgttttagacaaagatttagttcaggttgaacaacatttaattgaaaaagttcatcaactaattgaacaggcaaaaattgtacagttggaaaaaaataagttaaatttgcctcagaatcctgaaatacaggaaattctaaagaataagtcaatggatctgccaattatcaggcttagagttgaatacgaatgcgattcacagctgatcaattcgaaaaggtttgggtttcagtttgttagtaaaacagcaaatccacatgagattttgatgtttagcaggcgtaatagaaacaatgtaaataaatacaatgatcaagaagatccgattggtcttaattcgagaattaacccaatttcatttagttctgatgatagcaacatgattgaaagtttaacaattcattataccgaaaaattaaacggattagaagtgataaatatcaatgatttgaataaggcaatagacttgtttgtcaacaagtttgataaccactccattgaaaattgcattctcaatgctatctcaaaatcgaattcattttacaaaaacaataaaaatctggaaataagcgatgttctgcaaaaaattaaggaaaataatagaatttgcaaagatgagtttggtattagtcaaattgactcaataatgtctgaaggtttctctgactcattcagtgagggggaaatttccgattcttctgatcatattaagcaaaacaagagatcacgcgagaataaaaacattacaaaccagaggaagtctgtgaagaatgagaaaatgggagaaatctcagatagtgagtggaattaa

SEQ ID NO: 170 - DNA, 354 bp, Cryptosporidium hominis
atgttaattaatagatgggtaatatttgcttacttatttcaattactttggaggtatattataagtgaaggaattcaaatcaatgcagcaaccaaagaaaatgatgttgataggtatgatatcatagctgatgatcttttgaatatggattttccgccgtataaatttagagatctaaaaagaaagtctagagtaataatagaggcaaataatagaatgttgcatgtattggaggatttgttaataatttctgacgaaatcttagaagatttttctgatccttcaaaagagccatattttttggaggaatataaatctatctcactggtaagtcttattttaaatgtaatttag

SEQ ID NO: 171 - DNA, 861 bp, Cryptosporidium hominis
atgttagaaagcttgccttcctcaaagccaataagttattttctgtataatgatgcaactgaagtttatagaaaggcacatattgaattgctaaaggactacagagtagtaaccataagagttgcatgcaggcttttaatcatctccatattgctttcctcattggagaacctagctaataaagagcattcaaaaagtcttaacatttcctatccatttttggatgatattataattcgccccaaatccacagcaagatcaaaccttacaaaagttttaaaccgaattttgaactccataagaaattatggaaggagaatcaaaataggaataaagaaaaaggtgggtatgagtgatgaatttgaaatagtcagtgcggattctccagaattaaatgaaaaggagtttctttccgctatttataatcacagacaaagttcagctagatctatatttggaaaagatgaagcaatctttgaaaacaagcaagaagtctttcaggtaataaacaattttataggaaaacaagaaagagactcaggaatattactacaaatccttgaaacagtgattagaaaggagcttggaatcgaaagttctcaagaactccaatggaactccaaagccaaaagaaaacttacaaatgtctgtagagacagccatgtcctagaaattttaccgaatagaataaaatttaaaacatgtaggcagttatttaacaaggctggtgagattttgacggggtctcactataagaatagtaaaaaagaaagtcatatggctggaagagcaaatgtattaaaaaaaatcagaagggtttcttcgattaagtttattcaggtaagtatcaaattaaactaa

SEQ ID NO: 172 - DNA, 2355 bp, Cryptosporidium hominis
atgaattcatgggttattctatttatatttttgcttttgtccattattattgtttccgaggctcaaataaaactttggaacttaaagaaaactaaaaacaatgacaggtatcaacagctacttgatttttttgtggaaaagtcaaagtttacaagtaacgttgaattaattaatttgaatagcaaattagagaacacagttgctacacaaaagagaattttttctaaggaggaaagtattaaattagtctgtgagaattcattgctgagacttctaaaagaaaatattgttgattctaagacttttagcagcgaaatgtcagtttttagagactcaattcatatttggaccaaaaactttaatattcttcaagaatcagatcaagtatgcaccttgaaggagtttatttattttttggattatatcaatacgaagaagtttgagatcgatttttgtattcggttacttaaaaactttcaaaaccaacaagaaaatatgtttaacaaagattcatttatacgaaaaaaagacttatgtgttgggttacaacaggatatcgaacatttcatttcaacaaaactttctagccattcattgggagttttaaaacagcacaataaagacattggcgatatttttcaagtaactgcaaaatctatttataacgaccttaggcaagcaattaaccgagtgaataaatacagtaaagtcttcaatcttattctacttttggatgaacataagaacaatctgtctagaagtaaagaactagaaccttatcttactttaagtggatttattgatcaagatactatgaaaagtattgaacaaaatattattggtagcattattgaactacaagaatatttacctgaaaacacaattttcgtctcatcccctctttcaaaaatagttctcatggagttaaatagagcaaacaaacaattgaagcagctaaaaaactgttttaagtataaacacattttggtccctctggaaaaaaaacttatttatatgatgaagtcggtttctaatgtacttgtttcatatgaaaaaagttttgaaatattaagagaaactctagcgcatgtctcatatatagatataacatatgacaagaatttggtggatttatgttcttataactttgagaagaataagaaagaactggaaagtttatctcaattagataatattttaaatgacagtgatttcgataaaaactctttaagtaaggcaaaacttaatccaaccaaattattaccttaccagttttctaaaacgaaatctagtcaaggggttttattagaaaatagaaacgcaaagggccttcctttttttccagattataaagaaattgatattttacaggaaaaattttcagataagctttcttccaaagagattcaaaagcttattcaacacattaatttattagctaatgaacttgatcatgtatatatgtatattaataattccacgagtattatgctaaactctctagaaaaactaaaattcactaataaagtctactccgaaatcattttgtcctcagccaagaatgaatctgtgccaaactcattatactcctattcttatttactttctttggacataacaatgtcacttaagaagaacttatctaaattaaaaaaagaaggctctgacaaagaaaatcagacaaacagtattctcaaatctattgacgtaagttcagaccttaggaatgaactggtagagtcaagcgaagaagcaattaacaaggtcataagtactatagcttctcttagacagactgtctatgaaagaacacagggaagtgggttaaagaatattaaggcaagacttccaactacaaagaggaaacttcgtaaagaagttttattccctcttataaatattgaagactatttaaataacatcaaacaatccagcgtgcatgcaaataataagatgattaatatagaaaaacaaatagagctaataaagaagaataacgctcctcaagtgaattcttctaaaactactgccaaattagaaaagtttattaaacctctaaatcttatcatgaaatgttcagtagttaaagaaacttctgagcaatttgaaagttgtaaggaggtaatttctcaagcaccttatttattaaagcgtatccactcattgataaaagaaaataatgaggtagttcttagccaagaaaagatttttaataagtcaaatgccaaattggaggcactggttaaagaatggaatcgccatttaaattgggttagagatattccaaagctttgtaatgatcagctttccaccatgaataagttagatagcagcacaagaatgattttgggttag

SEQ ID NO: 173 - DNA, 3153 bp, Cryptosporidium hominis
atgtatgatagaccacatctaaatggggcattcagaagaggctccagccttgactccttaatggactcgaacaaaagaaatcaagttaggaggtttagtcaaggtggcatagcctcaactactcgagaagaacggcccataatcagctctatagaacgtgaagcaaaaactcaagagagattgagaagattgtcaatgagcattaagtcaggaggcaagagtattaagcgtaacaatgagctccctcaaaataagattcaaatagaacagatacttctatatataaatacaggtgcaaaatataacagcgatatttacgaaaagaaagaagattatgaacgaatggtatatgaaatattttctgtaggagggtattgctgtgatttaatggtgagttcctttaaaaatattgtgaataatcccaaagtcaatggcgtgaatatgaccagaatggaccgtctattgaatttcttatcatttgttcaagatttattcaagaactactgcagtccagaaattgttagcatggccccaaaacaaagaattcaaagttggaaagtcttaaatccatcccaggattatcgttctaaaagtttgtcaaacatgtataatacagatagcaataacctaaacgaaagtgagagatttcttaaaattgaaaggaagcttttagaatctgtttctaagaaagctgtccaaaataataatttgaaaaaagaccttttagaaaaatataaaatcgaaaaggataacaaaaatttgattagttcaaaaaactcccaaagcccttatgatcttattagacgacggtatctcggagaattgaagaaaactcttgttagtgatagccaaatactaaatcgagaattttccagaccaaagtcaagcgaaggaggcgttaagaagattttcgagtccttgcgttattctagaaaaaaagtcggcgaagatgaaaatagggcaagatcattatcaaatatacctatctctagagactttacttctgagatcaaaataatcagaagtagatctgagaattctttgaaattggaagagactaagttaaatatcaagaaattagaagaccaacgaattcaaggactacagagactaatagacaaacttaaagaagttaagctgggttcaagtagtcgcgaatctaaagctatagaaagtccagaaaacaactcaatatccttgcatgatagtaagaaattaactagaaaaataagtgaagttagttccacgtctatctctagctctttgatttacaagaaattgattcaggctcaaatagagcattcaaatactttgaataagaatattgggccagaagagtgtttatctgaggaagccagtgatgaaaataactcaaaggaaagtactcacaaaattaaacgacgttgggaattggacacaccgtttattcactatagaaatattggattcaataaggatttgaagcaagatcatataaaggaaatttacgacaaacctgttgctggttatgaaagcaatgaagttgaacggccattcataccaggtatacccccagtaagatacgaatattctgaaattaaagagccgaatagtgctgcaaatcaacataccactaccaagtctattttggaactaaattctcaaattgatcaggagcctattgaaaaacaaataaagttagaagactctgttgatgaaatagttcaatttgaccatttagtaacaccagaagccgttgcttcagattcaaaagaagttatagagccagaaattgtttccgaaagcgatttgaataatttagatttgcaaattaaaataatggatccgacgcttgttcatgaattagagaacgattacattgatgaggctcaaaaaactccttccaacaaagatgtacgtaattctccaagtgaagatggtactgaacgcttgtctgttgtaattatagatcctcagaagactcttgataacaaaattgctttaaatgtagtttctatcgaagatgagcagacttccgaacgaaagcatggactggaagattctcctctggaacctattaaaatccttaaggacagtgaggttgcagtcgaagagatcagcaaaataactgacaagctggaagatataactatggtgaatgaaagtttgatcaagagaatcgaagacttgccgattgaaaacattgatctttcaaatgaaaatggattatcgattttgaactcttgtgctagcaactcagaagggaactctcccgaaaataagaaggatatcaatatggatagactacaaaatattgaatatttcacctcgggagatgaagaacttagaagtaaaattgaagagtataattattggtttgaaaatgcaagctctgggaattattatgagttgaatttggacggattgaatttagaggagttctactacaaaaatatcgagtcaattcccagatgttatgatgaattaattgatatgtcagaaagctccataattaatttatgcaatattatctttaataggttgcccgagctcattttagagcaaatggagagaagtaccgaaaataatatgggggaaagcaaagctagcataggtattgaagccttagcttattacgagctaagcgaagaggaccttcttttctttattcacgaaaaggtgatgaaagatccaagctatctagggtttaagtcatctattcgaggagaaatctatcctcccgatgataactttatcctgctaattattgaccttataagagagttggtacaagaatggaaagatgatacatctaattcctggaaaacgccaatcgcagatgaattgattgccaggaaagtgacagatattatatgtaattcatatgaaccttatttgtcagaagtaggttctgaagaatgggtattaaaaaaggtgtttcatgcgcctcattaccccaatattcttgagtctgaaaaagagtttctcaacattgaacatttgttcaagtaccattcgtgtgaggattcaatcacaaatgagtatattaatatggaccgtcaaaagtggcttcagacaagtggtctctatataccactattaaatgaggttatcgaacaaattcttcatgaatcaattgatcgtgcaattttagaattaaagcctcacaattaa

SEQ ID NO: 174 - DNA, 1998 bp, Cryptosporidium hominis
atggagttttcttcaagcgagttcttggaaaaaattattccatgtagcgaaaaactggaagctttacttggagaatatgtctcagagtgtatattatggaatgaggtaaaacaggtttttgagttaaatggacaaaagattaagaagttttcggaagagatatcaaaaattgaaatttctaagactgatattatccactcgattatgttggtattaataaaaagggaagaacctagtgatgatagcaaaattgtcatgatgaaggatagacaaattttaattttatctacaagtactttattcttagttaatagtggatatttcgatattgtattttggcttgatataattttagatatctccaacctttttaaagtccacggattggtagcatttaccaagtggatttgtggatgttttgaagagtttaactgggcgatttctaatcccagtattccgtttgataaaagaggtttggctcaggaaggcgttgagcaatcaacttctggatgtgatctttctccttctgtagctgctcaacgacaacttgctcaggcaaagtttgtaggtttgttaaaagtaatcagcagaaggctcattggatatcgttgctttatagaggctggcatgcttagaagctttgtattttcaatacttccaagcaaccaggcaggaatatgtaggaaggccttcactcctaggccttactcttcagtaaatgtagatgaacaaatggaaagtattattgaagctgccactttaatagatgactttgaagctctctcggataatgatacagataaggaagaaggagaaatgtcaaaagaaaaagaagactataattctggtattattaaaagtgactttcagcatattctagatccctctaaatctgctaaaagcgtatttgaggcttataaaagagtagacaactttttccaaacatcaactgattttctgaattcaatgattgataattcagaaactttgtcttctagcaaaaaaaaacaaattgatgatatatgtaaggatgttgaaatagttgtctcatactttgaggattataactatatggatatccaggacccagtgtctcatttccaaggattggtctcaactttagaaggaattccttcaagcttagaatcgctttatttcagaattaattttgcatacagattttcttttatagtatgttgccaactgaatcaagtaattgatggttgcaagcatgcatgcgaatatatgcataataaaatggttcctcttttaaaaagatgcctaggatcagttgataaatttaaaaataaaaatatttcttctgcaacactttttattaatcttatgattaaatatgaatttctttggaaaagctggaaaaataacaattgtgttgatatttctattcctccggaaaaacttaaaccattacttgaaatgacaaaatcttctactgaggaaagaaacgattccaagaaaagaagaattgaagaaagtaaatgtgttacaaagttcattgatgatgagacatttaataaatatatgtctttcattcaaaacttttccaactctgatagtaataaagattctgattctattacgataagaaatataaatcttccaaacttcacaactgaaagagaattattatatttggatcccattgatcttgactcatactcttcaaagagcgtaaattctaagattattagtaaattcaatgactataaggaaaaaattcttattgatttagacccggataatggaattgatgaatctgaaaaaagtatcaaagatcctataattagatggagatgcgacagactttacaagagaatacatttagatcgcttaaacgagctctcagatatccaactatcaatcagcaatgttgaacatctcattcaaaattgtgacacagaaaaaaataacaatttacccaacacagacaaatttgagtttttaaatatttactctccactcgaggataaccaatag

SEQ ID NO: 175 - DNA, 684 bp, Cryptosporidium hominis
atgtttacttattcggtcttaggctttagctacagagcagaggagacaccatttactaagaaactaaagtatgcgctcgcttttatcttagttttacagctcattgtacttttgatgagagttgtgacgcttactgatgtcataagcaccttttttgaaggatggatgatttacttgggttatgtggtatatactgaaaagtctccatgcgcattttttttatttattactatatcatttgtaagaggaattttattgtcgctaatagcatttgaatggataaagagaaatacactcgtattttcagaaataaaattagttgataagttaaaatttgcaattactatagctacaccagtactttcaatcctcgcatgtattattagctacaatatatttaagaatattcattttgtcgaggagaccgatgaactgttgaatcaatttataaatccttggaatggagcaaacacaggggctttagccaatgaaaatacagcaagtggggccaatgaagcaggaaatcctagtacaacaaacattaatataagcaataccagtgcaccttcgcctgtaatgtatactccattcacaggaaaatcatataagcttagtgacatttcatcatcatctaattctgcggctggacaagctggcaattatccaatatataagggaacctaa

SEQ ID NO: 176 - DNA, 1668 bp, Cryptosporidium hominis
atgcagaaacaagccatgcacaaaaaccatttcatccaggaagactatgaagaaattgaagaaataggaagggggtgttttggcacagtgcataaaattaggaggaagtcagatggaaggctatttgtctggaaaaaaatttgttatgaaaatatgacacagcaagaaaaaatacaaatagttaatgaagtaaatgtacttcgaaaattgaaccatagaaatataattaaatacatcgatcgtataatagacaaacaaaaccaacagatctatattataatggagtattgcgatgaaggagacctcggaaatattctcaagaaaaagaaaaagttaggattaagtattgatgaggaaactgttatctcaatatttattcaacttctagacgcactaaattattgtcacactcgtagcaatagggtactgcatagagatattaagccccaaaatatttttatgatagcctcttcatctcctgaacttaaaaataaaatacaggagggttcgagaattaacaaagaccttgataaacctgaacaaaagactatgatagttaaattgggagattttgggcttgcaagatatttaactggaagaaaccaactagcaaccactcatgttggaaccccttactatatgtctccagaagtacttggaaaaggtgaatatgatgaaaaaagcgatatttggtcgttgggttgttgtatctatgaaattttggccggaaggcctccattttacgctagaagctatgatgaactaagaaagtatgtcaaggatggtctggttcctgatttaccaaagttttattctagcgagctcaattcagtattgaaactgatgtttgaaagggatccgcataaaagaccttccgcagaagaaatatttaatctagatttcattaaatataaaactataaagctctctccaaagctggatttatattttctaatgtatgaataccaaaaaattcttagttataaccgttatctagaatcgttattaaaaggcgatcaaatatttgggaagaaaataattccagaggaatctgctctagacgaatctatcgactcatctgctagcactggaatagcatgttcaaataatgaaaatattagtcaaaatactgttaattcagttggccaggaatataaaagagtttcaaatcaaggtgtctcacaaaaaatagaatacacagggatttctaccgggaaagaaagtgaaaagatatcttacattactccaaagaggaaaactcctgtatacaattttgggtcacaggataacgttcctggatctgcagatgtattttgtaaatcaaattcgaaggtatgtgcgtattcacccgttactgcaccaactagattaaacggtcataaagaaaaatgttatctaaaaaaacagcccatccccgattttaaggatcaaagcttttgttacgtaagaaagcaattaatcataggaaatgaagccaatgtcgaagatagcatccggacgccagtttattcaggaatttcgagcaattcatcgaactccagcataaatgaaagtaatataaaaagtacaacaaccttcagaaaaggggatgatatcatttttgaatctgagcaaaggctttcacgttggatacaaagatttcactcaagaaacaaaagctctatataa

SEQ ID NO: 177 - DNA, 738 bp, Cryptosporidium hominis
atggagggcggcgaaaataagaatcatgttggaatgaactgctctctcgatgatcttatcagaaaagaagctccaaaaaggccgaatgttagcaaatcaattaaaaaaaacatgagccgaggaaaacccgtgatgaaaaataaaaaattggttcgttcggagagaacatttattagcaagcggaataacggttcagcacaggtttcttctggtagaaacaatgccagcggcttgtatagaggtacatataaaaaagaaggtaaatcacaatctttgtatacaaaaagaaaaaaagattttcaaatgagaaccgaattaaataaaaatgataatatacctgataaatactgtgaattatccaatttagatgaacgtgaaagaataataaaaatgatacgtctcgagcacaaagatgaagacttcacactccaagttctactagattcgaacccaataattattgtgaataaaataacaggagtaattaaattaaattcttttaattgcagaacttcaagtatgcttgatgtctggaatctgttattaaagcctctcggcttatctttacaggttgtaaatatgggcggtgactgtacaaactggtcaatcactgatgggagttgttatatggaaaattttaaggatggtatgatagttcgtggatcaggctctagagatactgctaggaatgctcggttttcaatccttgaacaacatattaggcagttaatcatttag

SEQ ID NO: 178 - DNA, 921 bp, Cryptosporidium hominis
atgcatgcaaatatggttgcatttatcattataggtgagcctaaatgcaggtcattaaaaataagaaaaagaattttacatttaaaaatgaaactttcgttttctgtagtattaactttattaatttacactataggaaagccacatgggtgtgaagctgggcttttagatactattgccaaagctgttggtacatattttaaagttttctacccagaagtaacaactccaaggaaagactatagtccagactttgaactacaagaccaattagttgtccaatctcaggagataatgaagggtctagtacatattaagaataacattacacaaattgaagataattgggctggaattaaagaattcgcagaacttaggcgcaatccaaagaacatatttgcagaaaatagtttgggaatagttgacaacttatcagatgttatttcaaaaatgtcgttatcatcagcattcaaaaatatggaagcaccaattgtatttctggaaccaccttctgttgcaatcaaacaagaagaacaagctggaaccccatgcataacatgcgttggaagacttagcttatctcaatcagaatttaaaatatttaagtctgaaattaatagactgaaaagaattcatgctaagactttacaagaggcaaatcaagaattacttgaagccgaagctcttgctaaagaaacattgcaacaaagatcaaaaattattgaaaatattcaaaagttatctaatgtgatttctttgaatgagggagtttatggtgcagataacgtcgagcttaaattcttacaatcagatttagcaattgctgaacaaaagcatgcagcattacagcaaaagcaaaaggccttagcaaagaagattcaagaattgagctcaaaaaagaagagcttctggagaaagtaa

SEQ ID NO: 179 - DNA, 372 bp, Cryptosporidium hominis
  misc_feature (359)..(359): n is a, c, g, or t
atgaaatataaaatgacttcaataacatcacaattagggtatagaataaccgaagattataagaaaattaaattagataatgaaaaagtatatagaatgaatccattattttatcagccaagtatagtacctggcccaggaatgtcagagtgtttattattagcatttaacacaaaaagtaataattctggattattgataacaccaccaattgagttgcagaaaaaagttataaataaaaatagaaatacaaagaattctatgaataaagatgaacagaaaaaaaaaggtaatggtttattgaatggtaattttgatgaaaaaaatgatgaaatatcagaaatttcagaatgttatantgatggacaataa

SEQ ID NO: 180 - DNA, 1041 bp, Cryptosporidium hominis
atggcaataagtaatagcatgattaatcaatctgaaagtgaaagtaataataataataataatgatagtggcagcaataatgttaaaacaaataagattaatgatattcttgaaaatttttcaaatatcaacaaaaataataaagaagaagtatgccaaataaatgtaaaaaataatggtattattactattcatagaggaccaaccaatgaaaatatatgtattgacccaactcaaatttttattctagaaaaaaaatcaggatattcaacagaaggtgggagtgtaatattagaaagggcagtaagattaagtaagaattggtcatgtgaagtttggttttatgttccttttgagataacatttcatccttattgtctgatatcaaatagtgacggtataggatttgttgtaataggtttaaatggtgaattgggatcaatacaaagaaaaataacaaatatgtatgaaaataatggtgtgatttctaagaaaaataataaatatgattcaaaaggatatgaaaagaataataatcgattacaatttttatcttgggatgtaaatttgagagatcatgttgatgttggttggtaccatatggttgttacatttaatacaacgcaaaataacacaataacaacttatattaattctcaatgtattggaaagaagatgaatgcatttgaattgccacatcatcaaagtccatggattgactgtattggtaatttaaaatcattcaaaggaaattacattgcaccatttggactatttgggcatttaaaaatatatgattttgcattgtctacaatagaggtcggattattgtacaaaagttggatgtgccataaaaatttaaagaaagaaatattaaatcgtcacattaaacaagaaaaatctgcaataactaagaactacactttgtataaaaatttaatgaacaaaaataataatctcaaggaagagaaacgatctgaagacaaggatgcggacgataaaggtttagatgttaacacagattcagactcagaagcttaa

SEQ ID NO: 181 - DNA, 1683 bp, Cryptosporidium hominis
atgcaagaccaaaatactagagaacaattgaatgaaactgtgaatccaatatcagaactagaatctctggtgaaagacccaaaatgcacccaagacttgtctgcagaaacggatagcttaattaccaaattggaaaatgctggaattaatgaaatgagctttcagaatgctgtcgaagaattattggttttagagaaaaaatgcagacaagtttctgattcaaattctagctgtaaaataatatataaaattattttgtggcttctaaaatactctaaaaatattgatgaacctctatcagtcattcagaaaatttgtaagaaaagaagccaacttaaaaaggtgatatcatatattatccaactattcttaaacctcgtaattgattccatagtcgctctaagtcccaatttcgcaaagtacaattcttctaggaaacctattgagaccataacaaatttagaagaatcttataggagtatttcttacgaaatcaagaatatggtggaatgtaacaaaattatcacaattctaagtgagattactcaaggtaagatatatctggagctcgaaagggcaagattgatgctcattctcagcaatattaaacaggaagataatgacttgaaagaggcttctaaacttctagaagatataactgtagaaaccattggaaacatggatctaagggagaaaactcaatacgtacttgagcagatgagactttccttattatgcaaagactttgttagacttcaaatatttgccaagaagataaacccgaaaattatcgaaaaattcatcgatcttaaggtaatatattatcaatacctaatcattttatggcactacgaacaaaaccccaaggaaatttctatatgctttctaaaccttctcaactcgattgcaaattttgagaatgacacagagaataactatgaaaaactaatcggtgagattccagaatatatgaagtcccctatttctcaatataatttttctgagaaaatgccaactactgcttcatgtattgaaggatatgtcatttacctcattcttggtccttactcaactaatattagagatgaactaattaaatttaacaaagattatcagaagcatattgaaagaaatgtccaatgtatttcagacttactgaatgattatattaataacgagctcatgttcctggaatcaacaaaaaatttcaactatacagttcctaagtattttaatcagctatcaaattgcttctttttctctaacaacgattatgagatgaataatgatgtgtactacacagaatataaaagatgcaaaatcaatctttgcaacaaaaaagacagatttactctgttcatgcaaagaattcaagagagaaatatttcaattatttcttgctattataaaactatttcattccaaagagtacaagatttattaaatttggatcgccaagagttgcagcttgttgtcaatcatctcgttgagaggggtattttttcggcgaaaattaatcagccagctggaattatcacatttactagtaataataacaatggccaatttaacaaatttcataataacgttggagaaatactaaacaaacttgatttacttaaagatttaatttcaaatgatatgatgattcatcaatttaatagtaaaatcaacaataaataa

SEQ ID NO: 182 - DNA, 2034 bp, Cryptosporidium hominis
atggagaataagacaaatagaattcaggatcttattagggaacaccagagtaccttaaaatctcaaaggaaattattagatgattatagtaagaatttctgtgatcaatctaaaggttttgaagaagatgtagataaaatagttaattccattctgagcgaaggtgggctgagcgactctctgtttacagggaatgaggaacaatttaacggccttaatttagcagcaatgggcgatataggtcctgaatcattagaagacaatttacgagggccaggttctgcattgaaaaaactgattggagaggtagatctaaatattcttgaaacgacaaaagatacatttgataaaggaattcaagcggaccttattcagagtagtcaactgggtgtagctccagatcgctatactggtttgaagaatcacactactggaggttcaaacaaacatctttctatatccatacctctgagcccagcagatttacaccaaaatgaaactgtttccgagtctagcaaacctttagtcatgaggattgacacaaacgaagagaaatactccccctctgggggacaaattagtgtggagaataataatgaaatattaaaaagtagcgagtttatggacttcttctcaagagcttctagattaattgagagagctttaggagagggtgctgttttcaacccatttttcaatataaatagtgaggttgcagaatcaactctatcatctgaaaacgatggttcagcaaagaacccgggtaatattagcttttcatcaagtaatggattgcttaaaaatagtatgatttttcagcacgaaacttcatctaaccgccccgtaatgaatattaaaagccatcctaccttccccgaatattttattgtagcttatggaacaaaattttcgcaaaactcaagttttgaagggatgaaacaaaatatgggtagtggaactatgttcgattatggaggttgcgtacagctttggtccatttcaactccaaaaaacccggaaaatacatttattgcttcaagcccagttttaactatttcatttgacccatattgtcaatataagtatattggaactagctataatggagaaattttaatttgggattcgagaagcggaaagatcccttgccaaaagtcaaatagtattaatattagtgattccgaagggaacaatattggtggtcactcattcccaatttattgtatggagcttctcggtagcaaaggctctcaaagtattataacaattgacacggatggaaaactttgtaattggaacttaactaacttgagtgagccagtagagtcttttcaattaaggaaaaccaattcaaaagatgtatcaatccagtgcatgacactttctaagctaattaatccaaatgcgattatttgtggttctgaggatggctctctctatcaaacaatgattaaaactaacaagcctggtgtaatttcaaacacatttcaaaatgcgcataatggctacattacttcccttgactatcacccaataaatgattgttttcttagctctggagcagattggaccattaaactgtggatgccaaacccacttgctagttcattcaccctcctttatacctttgaatcatctgagaactatgttattggtgtagcttggcatccggtgcatcctggaatttttgctgcaattgatgctgactcaaaattgattatatatgatctcacaaactcaaattgtcaaactcctttgtgtaaaatcaatacatcatgttctaccaccacaaattctatccctaacacctctgatatccctacttgtattagttggtcgatggatggaaccaggcttttcattggttatatgaatggtaatgtaattatgtgtaattcagactccaaactttatcagcctaatagaaatgtctgggatttattcaaccaacagatggaaacttttaaaagcaacaattctgttgattttaattcaagtttggaaagcaaagacgaagaaaatctagagcaatga

SEQ ID NO: 183 - DNA, 573 bp, Cryptosporidium hominis
atgtggcgcgaggtcctttttaatatgattagattgtggaggcttgcagaagatgatttacttgatgggaacaacggatataggcttggagatactggtcaaggtatccacagaattcaatctgctcctagactctatagagcaatgtgcgagattatatcaaaagtgcagcgcgaagtaggaaactgggtaggatcttctgtaattcaccttggagataggacagtacctaacgctctcgtttttattgataaatatcttcaggtaccaaaaatattaactccaatagttttgtgtattgagaaaatagataaactttctaattcaagcattcatttgaagatatttattgaaaattcgtttggaggagtcttaagtcttaaacagcaaattcttgtagattttttcaagcatggattcgatggcggtggggccgataatttctttgacgcaggctcctgtatcgacggtagactcacatctgcatggaactggtgttcaaatatagaaaagaaaccatattttccaattttcctactaacaggattcgtcggattcgacgggaagttctaa

SEQ ID NO: 184 - DNA, 1188 bp, Cryptosporidium hominis
atgcagcacagccaacaaggcgagttgggaacactccaggatggctcttacattcaacaatatgattattcgccaattaactctccaaattttgaagaaaatattttgctatacaatgacaacccagtaaataatgcaggtatgctatatagatctgacagcatttttagtgaaagtagttgtgtttctggatatacaatgatgaaaagttcatctttgactaacattccatctagaaatttaattagtgatgtccctccaatacaatctggtcctgcaagagcaagtcgaaattcttcaaatattaggagatcatcgacttcaccaccgccacatattaactacccgtattctccaaattcatatcatcagtcttctccttattattcaaatagcccgtctagctctccgaggagtttatcgccatcattaacttctagacaaagccctcaattaggttctgaacaatctagagcagaaagtggtttattattacttactgaaaaggttattgaatatgcaaaacaaagcccaaaatatgaaattgatctacaaagtgtggaaaataaactcggagtacctagaagaaggctttacgatattactaatgtacttgaagcagtaggattattcactaaacctaggcataatatttataagcttaatatggatatgagctctggacttttgcaagatgaagaaaatgatgaaaatattatcttttacacaaagtctcaattagagctagaacaagctatatcaaaaatcaaagattcgattcaggagcttatccaggtagggcaagagcaaggattgttatatgctgacagagaaaccctttcaaaattgtgccctgtaaacactaacacaatcgtttctatatctatgcccatagattcgtctatcactttaaatcccaaccagcactcctatcaactactaaattctattctaagaactaaaaatagccatactgaaagcggcatgatttcagttcaatcacagattttagactctcattggagcattctactaaagcatcagtcctcacagtttaatgttgacgttattaatggtcacgcaaatatattagaagagatcaggcaaaccatgtctcccatgaaacagcctatgcaatcacctaacattagcaaccccacaagtattgtggataacttcttgcattaa

SEQ ID NO: 185 - DNA, 1713 bp, Cryptosporidium hominis
atgtcatcttcacgttcaaactcaccatatgatacagataggcatagaggaaactatgaatgggaggataatgatagaaggagagttgcagataatgaggggcgcagagatcgcgactttgacagtgaaagaggaagaaggcgtgagcactatggaggaagagatagaaaaagagatttcagaagaagatcagtagagaactcaagaggtgggaggcatagggatgatgaaaacatggataagggcaaaaatgatgatcaaaataattttcaatgggagcgtgaacgcgaaaaagaaagagacagagatagggaaagagatagggaaagagatagggaaagagatagggaaagagatagagaaagagatagagaaagaggtagagaaagagatagagaaagagatagagaaagagatagagatagagaaagagatagagataggtgcaaagaaagaattaaagatagaggatatatggaaaagaagcgatcaaaaggttatcgatcaaaaaggagatcatcttctgtatcttcagatgactcagatttgcccccaagaagatacagagaattcagaagcagaaataggagacgtagaagaagtgtttctagctctaggtcatctagtgaggtaagtagttcttctgaatatgaaaggcgcgacagaaactacgaaagaggccgtggaagagatagagatcgttacaaaagaagccgaagaaattattcttctgatgaatcttctcctgagcgagcctacagacacagggaaaacaagtatagtaaaaaacataaaaactattattctgaatcaggatccagctctgattcagaaatcgatcgatctggacataagaggcgccatgaaccagacaattacgactggaaagatagatcaaaagactttcatgtagatatccaagaggaaagccattcatcaaagaaatggcagccagcctctagcagctcaattgagaaagaaggatccgggtactcttcaaagaataatgtagatacttccagaaataataccattattgaactgaataattacaattcaagttatgaagaaggcattccagaaaactccacatgtgtgactctttgtgagaggttaatggatattagaaatatgagcgagcctcaaagatgtaataagtcaattgccaaacttctagatttgatccttgacaatagcgatgaatttttggctgaagatactgctggaagagagctcactaaacaacaatttattacatggtttgtaataaaccagcaaaatggtccctctattgctgattctgaagttacatcttccaaaatggaaaataggaggcaaaggttcactagggtgaacaaaagattgtttaccgagatatcctcttctgaatcatattcgttagactttgaagaattaagggacaaagaatctgatgagactattaatactcaaatagtcctctatggatgcaaaaaaggaaagctaataagagtttatgttattaaagacaaggatgaccttactatgaaggataacatatctcttaacaagctaaaaagtcataagatttttgctgtttttcttagatacttacaaaagaaaggaataaaatacccgcgtaataactacggaaatgatgaggaccaaaatccacattttgacggggtctttcactactacgactttgtcaataatcaaaatataatagaataa

SEQ ID NO: 186 - DNA, 2793 bp, Cryptosporidium hominis
atggatacagactcagcgaatgacacttttttatggtctttgacagagatagaaaatgattgttcattatgtttaagacaaattggcatatcgaataatattccgggagtagttcttcagtgttgccagcaagttgtttgtgaagattgctataaggatgaattaattaacaagaataacggaagctgcccattttgtttttttaaaggtaataacaaaggacagaaatcgtcaatatctataaataatcctggtatatctatgaatggtgtaataaactctgtaaatccagcggcgattgtgtcagctactgctataccaaatggatctagctctaatactaactgtctatcttcagttggaggcggattaccacttgatctttcttgttggctaccacaaaaccttactgccatttgtaatccaggatttcaatcaagtagctctagtacatgcgctacatctccttattataaaagtaatagtaccagtgccggagagggatttaatcaagatagctttatatatatgagggggaattccattcctggtgtcgtttgcggaatgaactcgattaatgtaggtgttggcactcctaatgtaaatattccaaattctcagccatcgccatttggcggagtgcttaatgatggattttggaaccattcgcacaattctgtagcattgcagaacaacacagtaaaccataatactacaggaagttccactaacggctcgtttatatcagatccttggatgtctacaagtggtggttattctccatctaatgggtttttgcatgattttaactcttatgataacaatattaatagtaacaacttaaatccaaatatgaattgctccaatacggaaagtatttctgatacaaataccaatataaatcatatgaaacagtgtaataacggagctaatggcatattgaataatggacaaaattctaagattgtcaacggcgcaatgaacaatttgagtgagacgagaaattcgattatagaaactgataaaaaggtatgcgacttgattaatgaaggaaataaagacaacttatatcaaccaggcattaatgttagctcttttaatactacggcaccaaacttaataagtatttcaaataatgcatcagatatttaccaaaataattctatatatacttggactgttcaaaatccaatggcatgcaatagtatgaattcatttaaccaggcaaataatcaaaacggcattataccatctactacatccgttgatgttgattttcaaagattttgtcttggattaggatttgatattaattcgcaaaaccaagttatatgcgactcacaaaacaaaaacaatatgttaatcagcgagcatatcaacaatgtaaatatcaacgaaagaaataatagaagcaataatggtggggttaccttaagtagccaccaaaatatgaagcccttggataactcagataataatgcatgcgcaggggaaggggacggaatttcagtggaaagtggtgtcaatgaggcatatattaatggctctaacctcactgaaaacaagttagagaatagagacttgcaaattggctctaatatggataaccacttgattgctattaatgaggacagcggttcaaataatattaatagctcaattaatgacaccaataccaatacacagttatttaatagttctgcgtttcctccattaacaagtgcattaattaagcagataccatcatccaaagactcaacgaagatatctagtgttacatctagcaccaataataataatgggctaaatacgggaaactcccaacaaaatgaatgcttgaattcgtcaaatagtccaaaactatccagcatttccacttcaggctcaaaccagaacattaacaataacaacccctcagctggttcaaaccctaaattgatctccatgatgggggtgagaaatgaaggttcaatcagaaataatttaaatataggtagtgctctttctgcaaataactcgaagcaaaatacaattaactctggaaaacctggggttgtgggaaatttgagtatttcaacaggaaatgtgtcctatatcgacgcagttctacataaaaatgatagcaatagcggaggtgtgactacaacttcatcaagcactgggagatctgaaaatcaggcatcagttaatagcgatatgtcgaacattagtaatgatagctctaataatttattgtcggttaatacagacgaagattcatcaactgctcttggtgctcacggcgaaccatacaattacaaaagagctctctgcaggcactggatgcgcggctattgctggttagaggcagattgtaagtttgctcatggtgaagctgaattaaggacaagagatggtaaactacgccatcctactctttcaactggaaattctgaggttgctaatcaaaatcaagggcaatcccaatctcagtctcaaactcagtctcaatcccaataccagtccgcaacacagttacccaccgtgaataatgttacgattccatcggggaatttgacagcaacttctacttctacatttacatcctccacaagcggtgggtctagtgtatcgtcaagcattcagtcaaaaggattaaaacagcaatcgggcaatagtaagaacggcagtaatgcaagctatgcagcaacagcggctggcagtttaacaaataatgttctaaataatgactccaatattagctatagtgttatggtcgtttcaggagcctccaatttggactctaaacgttga

SEQ ID NO: 187 - DNA, 579 bp, Cryptosporidium hominis
atgttgtctatttctccaattcgcgaaaataaaaaaggcgttctgcgaatgccgaatagtgaggtaaaggaaagaagcaaacctaagtgctctgttgcgttctgtgagacagtcgaatttagaactgtttatgtaactaaacaagaaagactaggtcagttttatgacctaactcattgggatttcattaatgaagacaatcaagagcatacacaaaaccttattgcagactttgcagcaacatgcattcctctcaaggattcagatgaatcaactggaaatcggaaaataaagaggttattctggaactacaacgacgagaattgttgtaataactttactatttcttggcttaattcatgctctaacgaagaatccagtttcagcactgaaatggatcaggactcaatatttcatcattttgaggatagttattcgaatgaaatcgaatacgatcaacaagatgtaacattccaagaatttgatgctgacttcaattgtgaggaatttgaagacagtgtagatgatgattattttattgaaagcgaagaaattagtattagtattagctacaaatga

SEQ ID NO: 188 - DNA, 354 bp, Cryptosporidium hominis
atggtagattcagaagtgacgatttttgatagaatagttagtggggagataccgtgcaggaaaatttatgaagatgatttatgtatttcctttcatgacattgaccctgtagcaccagtacacgcattgctaattccgaaaaagaggagtggtctaacaaggcttagcaaagctactgaaacacacaaggaaatattggggcacctaatgaccaaagttccggtagttgccaaacttttagatctagatgactttagaattgtaattaatgatggcgagagttcatgtcaaacagtattccacttacatatccacatactaggtggccgtaactttacatggccaccaggttaa

SEQ ID NO: 189 - DNA, 1398 bp, Cryptosporidium hominis
atgataatggagcacgactcaaattatggatgttctggcgaaaatggtaggatatatgctagtgtgggatatgaatcttgtaacggaggcatcacagaaggtaacttgcaggtttctcattctaatcagcacataaatattgatgatattagaaatattagccctcaaaaaataatttgtgagaactcatcttgttttaataataatgataataataatttgtacgaaccagtaaatttgacaaattcatttatggatcatagagaatcaggctcgctgcctactattaggagaaactctatgagaggaagaaggaggtatagaagaacactattaagaaactatgagcaacctcttggacaaaactctcatggaaatcaaacttatatagagcagtgcgacgactttgaatcaaataatcagagacgtgtatatttaagaaatccaaacattgggggagcaaacggaggaatgaactattctagttttaagttcaatagtaattttgacaattattcaaaggtttcaaaaccttcttgggatggaggcagattagtcaagcttttacaagggcatggtttaaatatagaaaattatgaaaaagagaacgaatccctcttaaacaaaagttggggttccaaacaaataaatactcagaatagtcaattaagtagtattagtaacaataaagattttagtacttctgcagttttaaatggccaaagttacgttcagttaagccatatatatcacggagtcaatttaaaagtttgtgatgtcgttgaccaccaaaaaatatcgaatacgaagaatatacggaatttcccttcatatgcaaatgatcaaaaggatagttttgggttatgccacaaagagactttaattcatgaaggaaacccattaaaccagattaatcatttagaaaaaaaagtatttctccaagataaccttacagaaggtgattcaatatcaaatgaaagccttgaaactcaaaaaacagatagatttgcactagtctcttctttagaaaatcagcatttattaaaatcaaatcaaaatattgaagattccagcaatataattggaatcgctcataaaaactctcttttcaacctttatgaaagttctaaagaatcttactttaattctgaaagaaaatacagtataacttctcttatacctagtatggagaaacaagtagtaaatattgataatcagctgtcgttcaatatggaagaacatgaaagcgagcatgcttcaaattctacttattgtgatttaaatcactcattatataatatttctcaagaagaactttttattactcttggagataccccaacatcaaaatctaactataacatatcaactattttcgttccaaatcaagattcatga

SEQ ID NO: 190 - DNA, 771 bp, Cryptosporidium hominis
atgtatcaaattccttgggtagttaaagaatcatgcgtagtgacgaatgaggttgcataccatcttattggaaaatgcattcgaagtattggaaagctgggtaagagtaaatttgaagaaaatccttcttcaatgcaagaaacagtaagagaaatggagaaactctcaacggagcagcttcagaatattagagagagttttattaacaaaggggaatatgataatgaatgttttgaacttcttcgagtcaaaggcaccgttcagctattacctaacagcatagggaatattgaagattcaattaaaaaatatttatgttgctttttatttcactatattgcagagtttcaaggagtttgggtatgttttcataaaataagtactgttaacacgtacggatatgtgccagactgcgagcctaatggttcttttcttgtaaatatagaattcaaagctttagtatttaaacctaaaataggtgaactattaatatgccgtatttcacatgtgtctccatcccatgtttctggaattacctacgggattttgaatatagtaattcccatgaaaagttttaaaggggatgaatatgaatttcaaaaggcagactcattagcatacgaaacgaatactttggtaaacaaaataaacaaagaaaagaacttaaaagtcggatcaataatatttgttcgtataaagaagtataatttttccgataatggggactttatttcatctataagcggtcaattcgaatctcttattgattga

SEQ ID NO: 191 - DNA, 498 bp, Cryptosporidium hominis
atgaactcgaaaattattgggattggacggatttccatgatgaaaagagagattaggtgggcggatattgaggaggatgatcacgtttttcttaatgaaaataatttaccaaacaaaacttcagttgagcagcaacttgaacaactcaatgagctagaaaacgatcatttcctagaaatagagtcttcgaatatttttcttcctttaattaaaggtaaatgttcacgtgcagctagaagacaacaaaagctcgacgttttggatgacgatatagatgaaattctcaaggagtttggtttaggagattctttaagagagatgaaagaagttgaggagattgtaaataatggctgcgacaactctataggctgcagatcttatcaaaataaagtttcaaaggagtttatagcagaaagcactgcaagagcattaggagagatcaaaagccgtaacaaaaaacagaagaaaaagagttcagctaataattattattattag

SEQ ID NO: 192 - DNA, 3939 bp, Cryptosporidium hominis
atggaaactgattttaactacctctctggagaaaaaatattggagtatatgtctaaaaatgtgtcggaatcgcaacgctttccttcatatgcagaaaaattaatactaacacgagatgaagatctaaacgtaactagtatttctcctgtaaaatataaaactgacttgaataggattaaattattcaaggatgaggtttgctggtccatcaataaatctcaagactccatgtcaactcaaaataagaatttattagacgaaacaaaaatatctggtaaggctattaatgataaatcattcgtagattctagccccatctcttatgcaaaactttgggaaaaaacgataaatcaacatctttttattagcatcatagacaattggaggaaaagtgttggttttatatttaatgatagctacaagaacctaaaatatactttaaacgagggaattgagctactacaagaggggatagcactaaataataaaattagacttccagaattggaaactcttgtaaatgctgttgaagaatccctagcattcgaagaaaaaatcaaaaaattactctctatagacgacccaacagtaaatttaggagttcttaagtctccttgcaagatcccaattacagagttatatgaactattgaaagaaggagaaagctgttcgtttagatcaaactatttggatttcttgaaatgccaattagaaaaattgaagtcatggaggagcaatgtgcaatctgcaataattgagaaaaatttggataagtgcaaagacttaatgaaagataaagacgagatacttatagaagttccaggaataaatgaccttactgagcaaatagcagcaagcaactggattgaaaaggttgaaagaagtcttagccgtccaatgaaatttaattttgcagaaaatttattaaatgagcccgcatcaaaatttttggatgaaaaaaatgtggcagctaaacaacaattaattaatagagttcaaaaggctcaagaatggctcaatgttgttcaatctccaccttttatatatagcttagtttctgcctgcaaaactacagctccaaatgacatttctgaaacaacacaaaaaattattgatcaagcaaagataacaatggaagaatctaaaaattggaagctcccaaaacctactgaatatgaaaaagtttggcttgaaagttccacactcaaaattattattcccttaatgaaatatatggagcctgtatatttacgttggagaaaatggaacaaaaaatataagagacttatggatggattgtgcatttttatggaagcacaacttattttagaggaagcagaatatacattatgcgactatctagatatgagtgaataccttccagaattacgtaaaaaaattaaagagagcggtgattggttaaatactagcaaggagtttctcaacacgatctcagactttcacacaaaacaagatattaacaacgtatcttcaagtatttggaatactgttgccgggataaaaaaaggaaatgagttttcaagacttgaaattcaacaagctttagacttcatgaactcccagtttcatgaacgcttaagttatgaaaaactgaagcaattaatagaaattggaaatgagcttactatatatgaaatgacaatcttgcaagaacttacatcctgtcaagatagctgtgaaaaatggctcaaaaagggaaaggaatatttaaaatgctctaagatatctggaattaacattgcaatggcaataagcttgttattagagcgtagttgcattttggtttcaaaagaaacagaagattctctttttgctgaattgcatttcatcatttggaaaatggacattaatgagatccaagctcctattgatgactatgaattaagttcgcttattgaaagatttaatgaagtgaagttatattttgactttgaccattctaacttggcaaaaacacaaaatgaaaatcaaatccaacctaataaattgattgctctatccttacctaatataaaaaaagaaaatgaagaatcaggccctcaaaataatgaagagtcattagctcatcactcaagcgtatgcgaaaataatactacacaatctgaagcaagctatgatccaaaaagtcctgaaattagcattgaagaaatagatattcaacaaataaatatttcacactggaaccagatcaaagaactagaagctgccgcatttattacaaaactacaaaatatcttaatttattggaccaacttaattcatgagtatgagactgaaaagaaagaagttgaagtttggcgtagtattttggaagatctcaagcatcttccaatttcatttaataaacttgaattaaaaatcaacaaaataataagtgattatgatcgaattatttcgattctaaaatgcggagatgaagagtctaatcatttaccagatttaaaacacccgttttcacttttatattcttataagagacttaatgaactaaatattgaggtttccaacttaccagtaaaaatttctgaatgggacaaatggcaaaaacacttggatgaactaaaccaatgtgatgattataccctctcaacattctcttatttgaaagagacagaaattatagtttcaaattgtgaaagcacaagtattgaacaaattgagaggaaaaaagtgatggactacttaaatagtataaacgaaagacttgcttcaaattctgtttggggtattactgacttcaaaagaattttaatagacttgaagtttacaggcaaactgattcaggacttatctatttgtgagtgttggataaaaagtgtaaagggagattcctcaaatgatccaatgggaatcgaacattggaatagcttgcttcaaagaggaagaacaattagaataatcgaccacgaaattttcaataaattcgaagctcaagttaagcagtcaatagaatggaatgaaatatacttcacagttctgcattcggatgcattttgcaaagttataaagtataaaagaaatagtaaaccatctaataaaatactttacaaaattgcagaacttttggttggggtcgattatggaataggcgaaagactcgttacttttagagagttaagacagagcgtaaattcttttgtagaactacgtaaccagggaattaaatatttgaatatatgtattaatgaaagaagagataaagttttttctaggttattaaacaaatatttgaatcaatcccaagtttctactgaacaaaactccgaagttatagaccaaataaattcaattaagcaatttacatcagatttaaagaaccttttggaaagttgtaataaacacacaatttctatggatttaataagttatatacaagatgagattctattgcgtgaaatcaatcagaaaatgttcaactcactaattaatcaagaaaatccttatttcacaacaaatttatacggtcattctgctgcttcaaatgattcaaagatccccacattcgatgaagcaaatgatattgttaactttattagaattaatgatttaaatattatgccagaaaactattcaaacacaaatgagaccaatggctctcaaactcagctttcattcgaaattcatgaaaaaagtcagcttacaatcaaagaactcaaagaaataattttgaattctgaatctgttttaatgaaaggccttgattcaactggaatgttaattgaaaagaaatatattgatgttgatctgttcaaaaaatttaggaaagctgtatatatttctagtgaatggttgaaagttttcaagattaatcattttaacataattgataacataaaagctgaaagtttttataatagagaagttccaaaaagattgttatcagtgagagttgaatcttcaatagattatttgttgtag

SEQ ID NO: 193 - DNA, 4014 bp, Cryptosporidium hominis
atgccaagtatcgaattatctcttttcctaatcaattttggaaaaaagtttgttaaatttgaattaaaagaattctcaaatttatgtaaaatggttgaattttcattgctttggatggctttagttattaataaattcccaaattttataaaagtgagcctgggagatgatatcagcgaaataagtggcattgaaacaataaaaaaacaaaatagtcaattaatttttgaagattgggagaaaaatgtttgttttgattttttcagtacaaacaatatttgtctcggtactattaatactggcgaaatagcaaactctcaatgtaggcgtcttcacaatactttagaactcaaagaattcgtttctttaattgagacatgtgatcaattaccaattcaaataccaattaaatctaggcttgtaaatattcttgtggatgcattaaaatggacaatctccgctagggaagcaatattactattacctagaaatacaatattatgtccatgggtacatattgaaggaatagtggaagaaattactctatgctcaaagaatagtcaaataatgaaaactattggccttgataagaatatttataatatcaaagatgaagaaattatgaatatcatatcaaacttaaacgctaatgaatatgaaacttgttctaattttgaaaagaattgtgaagtagaaattcaagttaaaaaatttccaaggcctagaggaagacctaaaagagaacaggtttgtgtggaaaaaaacgaatcacaatttgaagatatatttaataatatatgcatggattacaaagaaatagaccgcttgcctaattgcgtttttccaaagtcattttattcgtggctattaaatgaaaacaataataaatattttagtgttcaagacttgatatctattacatccaaggatgaggataataaaagttcgaaattaaataattcccaaaactgtaattcaaacattggatgggaaaacggttacttttattggaataaaagcagtagttcagcttcaaatgaatccattgttgaagatgactatggaagtgattataaattgcaatacattggattgattgatccccaaaattatccaaagaaggaggtttataaaaataaattattgttagattttatcctttgcattgaagtatacaataacattcaaaacaatcctgcagagttgtgttctatttgttccaatttcagaagacgaaaacatactaataatatttcacctctaaactgtaactctagctggattatttgcgaagaatgcagccgttggtaccaccaggattgcgttgggtattcctccaagtcaaataatttcccagagaagctatcaaatggttctaattcagcaaatgaattgtcatcttggacttgcccatcgtgcagtttgaggttttcaacttcaattggtcgttctaattcaattattaacttattaaaaaacagtaataatcttgaactttttcatagtaataatgcttacatactttcggatatacactgtaaatctattgatcgagcagaaaaaaataaaacttatgataaatcattaaaaagagaagtcccaactttagaaaaccttaagcaaatcatgaagagcagtttctctgataaaatttctttcattaggcttcatgaaagaaacgtaattgcaaatacattttatctattcaatgtttgggtaaacgacttttatagaatattaaaatgggacccatttgagttttctgaatttaattcttcagttttctttgatccagctgagattcaagaacgcataatgaataaacaaatactgaaagaaaagagcgagcctctggataaagctgaagaagacgaaaatttattaaaagaaaaacatatagagcatgaacaagctgttgctatgtctgatattacacaaactagccgtaaaggtaggctacttaaaaacaaattatcagcaaaggagatgctaaatcctaaattgaattccattaaaccaaagaagggaagaaagagacgtttgctattcccaagtacagtcactaaaaaacaaattaaaagaagttttccctgtatgattgataactcagctggcactctacaaataaactttgaaacggtcttcaaggatatctctcctggctgtaaatataatatcgatccagattatataggcaaaaataaaataattgaacctggcttatcaaagcctttagaaattgatgaaattatgaatttgtatattattggggctctaattggtttggacggagctgttgaatttgagtggctatattgtatattaaaatatttggcattcttcaattctaaattcggattttataacgaaaaccttgcgttactaaacagttttcaactatctgaagaattatcatttatcaatactctcaaaaatcaaaaaagactttcttgggaagaattcaaatatatcttagttcatttttcaccaaactttccaataaagcttaattcttgcaaaattttttatttgaatttaccaaagttgagatcgataagactaaaatgcaaatcaattttagattatattaaaaattctagccaggaaaaccttacaaaacctcaaagtattgatcaaaacaatcgaaatttgtttacagatcacgagcaacacaaactaaatgggaaaaactttaaaactgagttagagtcattgttaattggcatcgtcaaatctggaataatgatccctgaagaaaagattgtttctcatttattgttcacatactatttggaatctattttactgctatatggaaaacaaatttcaagtgtatattgtaaccaacttaatccaaaacctttgcattcaacattagttaatattaatcaacacattttattttggaaagaatcagatgctaatctttcaaagatatatggaaccagattcattcctccagaatataatggttttgttttagaaggtgaaggctcatgtttccaaaatcaggaaaacaaacccttgttacgcattcaacgctttattaaatattgtgaaacaattcaagaatcaataaatcaatgtaatgaatggaatgaaagatacaaatttttaatggaaacaccaaatgaatttgagatttatgttaagtttcttaagcaggggctaaatctaccttgtatttaccctactgtatattcttttggaaatatattagcttcaatagagagctacgaagactttgtaaatcaagtttttgaaagcccaggtaatcctagctcgcttaaaaaagcttcaaatcctccaggtagcttcaaaccatcatttgcgcaaacagttggtgctatagttggctccagccaaccctcgctgaacccaaaatttgaaaatattcagatattaaaaaatgtaagggagttcttaaaaggacttcctatacagaagagtgatttaattttaaaaatagaccaaatggaagaaaatacccaacgttttattgaaggtatcaaacaaaaaatgccgcaattaaagcaacttagttcaactgaagcattaatttcccaattacaactaattaaagaagaagcaattcacaaagttccaataattgtcaataatgtgcctgaacttagggagttattgaataatatccctgattttggctccccccatcacaacttgttattaagaactcaatttcttatgtcattacaatgcccaattgcaaagttaaggaagccactcaatccattcccaaatatcccggaagcttcttctagcctatctaatgttgttggacaaagccaaaataacgagcttcatcagtcagaaactaaaggagaacttatggactctcaaggaaataattctaacaagccgatcttacatgcgccaggtggcgcaaataataaaattaacacatcttgccaactaccaaacagtatgtcatttatctggcaaaacttagtccaacaggggagtaatcctatgagtcattactattataaataa

SEQ ID NO: 194 - DNA, 459 bp, Cryptosporidium hominis
atggaaaacttaataattatgtggagtttaatgaaaagttgttgttattcaattggaggaagttcttgcacagatcctgtgaattttaatgcagattggtgtagtttgatacatacaaatgatgaggaatcaaaaaattttcaatataagttgaactcctctaaaaaagatgaatcttcagaaaaccagaaaaagatatcaatgagctccacagatattaatgatctcgtaaactattttattaaatgcgcattaaatggagtatctgtcgatatttatgatcaagcaagtcagtcttttgtttcaggcaaatattttatcaacagaaatttgaatattattacatttaaatcgcctgtacatacaataatcattccatttaaagctgtaagtttataccgaagtaaactgtccaattcttacaaaatcttagataaatacactcctaaacagttctga

SEQ ID NO: 195 - DNA, 324 bp, Cryptosporidium hominis
atgacctcatctatttcaacaggaactgtagttggcttgaatacaggctttattgtgactaagagaccacaacgacccagaccaagttcgcgcaagggaaagctttctgcaagaaatgccttggttagacaggtaattcgcgaagttgcaggtttcgcaccatatgaaaagagaatgatggaattattaaaggttggatctgcatcgacagctaagagagcaatgagatttgctagagcacgcttggggactgaaagaagagccaagaagaagcgagatgaacttgttgatattattcagcaacagagaaagagagcagcataa

SEQ ID NO: 196 - DNA, 534 bp, Cryptosporidium hominis
atgtttaaacctgctgcatggtttaaaggtatcttattgccccttgcagaagatgagtcttgtacaatcaaagaagccataattattgggagtatattaagtaaggttagtattcctgttcttcatactgctgctgcaattatcaaactctcacaaattaaggtatggaatacatgtcaaacacattttataatggttctactatgtaagaaatattcaatgcctaagaaagtaattgatgagttggttgataattttaccaaatttgaccaaaaattcctgcattataatgactcttcaccattattttcacataataacatcaacctgaattcaacaaacgttcaaacaaatagtattttacctgtaacttggcataaaactctgctggtatttgtccaaagatacaaatacgagttttcatccgaccaaattaatagattaaatgatcttgttaaaaaccaatatcattatttaatctctcctgaaattattcgtgaactttctcactcgctaattaaagttccgagttag

SEQ ID NO: 197 - DNA, 1071 bp, Cryptosporidium hominis
atgttaataattaagtcattgcaaaccaatggagaatacactgagtgggaatatagaagctttattaacagaatgttcgttgaaatagaaaatcaaaatcaaaatcaaaatcccagcaaaaatagacataaatttatttcattcatacttgaatatacacaaacaattttgggttcaagttcaaatgaaggctacaataaatgcgaattgtttaatagttgggcatacaagctattacatagacaatcaattattgcatatttacagggaaatatttccaagaataaatctttgtatttaattgagaagtttgtattaaatagcaaaattttatcacttaatgataaatattcaatgaaaaagaaaatccacaaacttacaaggccgattgatattgccttaataaatccagttgttgaggatattaataacactgtattagcattttatcagtttggagtcccatcttttgaagaaaaattacatttaatggcattacaaccaattattcaagaatatatttatgacaatttgaggacaaacaaacaattaggatatattatttttgcaaacattatccctataagtagtaccaggttgttggttgtaggagttgagggagacaacaataattctgttgaaaaaattgagtcgattatacgtaatacattatacgagttttcaaccagaaagctaggaaatatggaaagtcacatgtttgaagatattaaaaactcattaatacaagaagcaaaatcaatagggaattcattcaatcagaagcttaaccattactgggatgaaattcgttacgtaggcgacctctcagagagttttaatctacaaagagcaatagattatattaataataaaatgactattgaacacctatacaacacattcaacaaactgatcaattctgaagaacgtacaaggtctcattcaacaataaaggctatttactactccaaaacttcgccagagtttaagaaacaagaatttattgataaatatatgaacagtgcgttgagcatagctcgtatgtctttgaaagaagacgatttctattaa

SEQ ID NO: 198 - DNA, 612 bp, Cryptosporidium hominis
atgaatatgtgcgtaaattgtggatacatatatcacctgacatgtcaaagccaggcgaataaaatcacaaaaaatgattggttttgtgactattgtaaaacccatggaaataagcttaaaccagggtcaaaatttcaaattggtgagttagtatgggtaaactataagtgtacattttggcctgctcaaataattgagttttccaaagaacaatttgaagtatttatttttcatattgaaaagagaatagagaaaagttcaaatgaaatattaccttggtcaaagggaattatatcaatagatggacttgcttcaaaaggaacttttgttcgtgaatctacgtcaagtattatgcattggcaatcagtttataaagcaattaagtactatttgaattctttgaggtcaaaacaaaggagattaccgcaaataaaaaaaaaaaatagttcaaatgaattcaaaatagataaaaaaaaaaaaaaaattgatatcatggtatctaacaactcaaactctgaaacaagagtttttcacccaatacctagcgaaataaatgatggattagaacagcattctaatgaaataagccttctagatgttttgtctaattaa

SEQ ID NO: 199 - DNA, 2331 bp, Cryptosporidium hominis
atgaaatcgcaaattgaaactaatcgaaatatgaatggtgggtccatcgctattcctcttattgaaaatatcattcaaagcaaagatgaaaaactagttaaaaggagcaatattttgactaacttaacatcctgcgatatattatctgatgatcagtctctcattggcacaagaactttatctggcgactctcaatgccttgagaattatccttttcttaatatgttaggacaacagccattaaataatgttatatcgggtgatcgtatattgatagattcagtgcgaaatgtaagtggcgatggtaatagtgagggagacatgatttttggatataaaaataccaagtattttgatactgaaattcaatcaatgaaaaatatggatagtaaacttaaacaaacaaatgagaggagggcaggaaggccacccctagacaggtctgattacttttgtcagatttgctctgctacaaaaactcctcagtggagatatatttcggtatgttcggtcgaatcaaagttaagggtctgtaatgcttgttggatgaagcaaagaaaaaaacgtgatggtaaatgtttacctttacagataggtatgaacaataatttgaattgttcaaatattgggttattaaaaacacaaaaaataggaatgaataaggaaaattatgattctcaaaggcaaagttattcgagaggaatgggcggagtgggatataaaataagtggaattgttagtaaaaatttagtggcaaacggtagaaatgtttcaataatgaataatggagttaacaaagaccgtaaagctatctctcacgaccttacagaaaatttgaacgcttatcttcccaatgataacttgaaaaatgatccagccagttgtaatcttaatgcagcgattaataatgtccaatgcatcaaaccaatctcatttaggtcatcaccttactcggcaagttcgaatctagcttgttctaactctacatttgattgccaaacatgcggtaataatcagcgatgttattgttcttcaataattgggtttcaaggcatttcattaacgaatacaattactaatgatattccagaaggatcagggaagttggtttctggctcaagcgaggtaggattacattgcggttatagtaatatttctattgataaaccttcagttgatgtatgcagccaggccaatacaaccggaatgaattacaaaaatagcagttcaaaaagttccctgttagaaataaacaatcactgtgctcaaaatatttttattgatggtaacaaattaaccgaaactcatgtagatgaaagacacagctttgcagaaaacttttcaatcagtgagcaactttcattcgacgttaattgcggtttgaacactggcgaaaacaatataatggtaggtatcgaagaatcttatggaggaaattgcttaaaactgaatgttgtaagtaatgcagaggaaagccctataaatagtatacaacaaagtccaacgcaaagttcaagtattgactcatatccaagtcggattggaggtaaattgagcaatagtgtgttatccagaaagtgttcggatagcaggaatagcatggtttctggtaataagttttctgtctcaacgcctgtccaccaccaagcatctaccacagtttcgcctaacacaaattactgtaatatttcttcttatacttcctctccatgccagtctttctcaacctatgatggaccatttttagaagatccaaacaaaacaatgtatatttcttctgggacatacttttattctaatgctgaaacaagccgatggagcgaagagacgaccgtacaatcttcggtagggttgagttcttgtgttggaaattccaatagtagggaaaatgaggaaaaggcggaaacgctgtcatcctttccattggatcaggacacgcataataccttgtctcagaataacgagcaaatagaacatgatcaagtgaattatacaatctttaacaagcacttggttgctacagagtcatggaattgtgattatttaaacattgatatgttttgtattccaacaacagataaaaatccaataagctctgaagcttcgacctctgcccctcattattcagttggttcaaagttctttaattcatctgtatcttgtacccttccagctgtatactctgcagaagttcagcaagaagatgaaagctcaagtcaaaatgattgtaattcctgggactttgattcctcatcaatttcttgcattgacacatggcaaaatcccctttggtatgactcatattctaatggattctgtaagctatcttaa

SEQ ID NO: 200 - DNA, 813 bp, Cryptosporidium hominis
atgaacttttctttcttattcaataaaaaaacacttgcttcatccaagctgtataggtttgcaaagatttccacatcatcaataatattaagtggcgtagtaaccatttactcttttgtgaattttggttactatttgaaagattcaattaattggaatccaaattgggatggtaattataaacatgaaaacaagagaaatggtaagattgtaagtgataatgcacgcaagtggcaccaaaatatactagttagacatgcccaatatataacttctgctgcaaaggatgaagagaaggtactaaccgatcttgggaaagaacaggcggaagaaactggcaaatatctttcgcaacagtatggagaaaaggtaaatgcaatttatcactcgaatttaacaagggctaaggaaacagcaacaataatttcaaaatactttcccggagtaaagttgatcgaagatcccaatctggcagaaggcgttccgattgctcctagcccttctatcagcggatttaaaccaactataggagagattgtaaaagacaaggaaagaatagataacgcatttaacacatacttctctaaggatggaaagtcatttggagataatgtggacattattgtttgccatggtaatgtaattcgatacatgttttgcaagggactccagtaccccacaagcggttggcttagattaaatcacttgaactgtggcgtaactagaatgtctatctcaacagatagccttgttatttgcagtggcctaggtgatggtggccatttgagacctagtattcatacatataattag

SEQ ID NO: 201 - DNA, 2022 bp, Cryptosporidium hominis
atggtctatgcaatgcataaataccgtcatttatgcaacgtaaaatcgtttatctgtattttagattgctatgaaaatttcagtattcacttattgaaaactaattgggataaatttgaaaaattattgttcgatcttcaaaatttagaaaaggagtggtggatagattgcttaatagaaattgggctcaatcatgagaatttgaacgttcggaaatttgtcgcttttaatactattaaccttgcaattaagaatcacaagaatttacccaactggataaagcgcaatacattttttaatgaatatttaagatatattgtttcatcacttaacaataaaatcagccttcagatagaagagcttttcctgaaatttatttattgcgtgctaagggtcaagattgaatggattaatgagtatttgaaatacattgcatgcaatatcaaagcctttacgccaattcgtgttttaatttaccctttaacaatcggtacaaggaataacttatatctttccaatgattccacgaatatattagaaggaactaatgttactaagattgaaagtttgttccataactttaattcatgtaatattaaaacaaatgtatcgaaagatataaccaacaaatattcttttcaagaacacaaagacttcgaagaatctattattatcccaaaagaattatttactgaagttcttgatatttcgataccaatcattaaatttgttccaatattattgagacgtgaagtttattccaaatggttagaggttatcttaaattattttgtttgtaacgaattttctacggatgaattaataaaaaaccttattttatttttggggataattcctgaatacttgttttctacaaatgagatttatacagttatatataataatattataaaacataaattggttataaattcttgttttgatcctgaaatattaactttatcaaaaacatggtttaatatatttcaattaggagttgggtttgggaggctaaaacaaatctttggatcttttagcgattcgagtctaataattaaaagtcatgttatatttgtctcttcatattataattgcgaagaaatgcataatttaaatagtagtatgaatgacaagataattgagatttccgaaaaaatgaaaattttgtttgaaaactctgatggaaataattttatcgatattgacttgctttggcttgatattcacttgttatcaatattaaaaggtgattcctataatttttatctggaaaaattatggaattggtgcattttagtaataagcgatattgacacacttttaaatagaataaaatcaaatattaattcacagatttcttttgcaatgatattaaagtgtttgatttatttgcaaaaagttggaaaatattcatcgatacagaacattcttgacattgttaataatttattgttaataagcaataaaatgttatcaaatttgttaatgaacaaccaaaatttaattatttgggataaagccagaagaacgaattttttatacgatataattgatatacattccataagcaatgacaaatattgcataatacaatcatcatttttaacgttgggctttccagaaaattactcgagtaaatataataatattattaaaggtaacagacttgttcaattattcccttcaaattaccgtgatttttttaatcttatatctcaattagagtttcagttagttaatataattatttcaaaaaatgcagatgaagctttccgtttagtagagaatgatatttattattattctacaagcttaaaagtctctggcgataatttttcgtatgcaaaaggatctctttcaaattggttccaaacatcacagaaatattgttttatgagattgaacactggggctttgatagttttatattgggtattaggggacaattacttggcttggatcatggaagatattaaatgtggagaacactcatttccactcttgagaaaaattgaattataa

SEQ ID NO: 202 - DNA, 2223 bp, Cryptosporidium hominis
atgattcaaattgattcagaaagtcttagtaacattattatatttgcaaatattttagttgaattgatcatttttgaagagcaaggattaattgacgggagcaaagtgagatttcaagaattttctatagagaataatgttggaataagtgaaatgattgatatttatagaagatgtaagatatatgaggatagtggtagttttgtaagacatgtaacaattatttatctgtcaaatattatcgaagattcgaattcgaaaaaacatgattcgttaataaaattcatctcaatgacaattattttattgacaaaaaaattagaaggtgctattccagcgtcagttcaagataagctggctttaacaaatattcaagtaaataaaactgatttaaatatttcaaattacttcttaattaatgaagccgaaaatagtttcaaaaatgcaaaaaaattccctcccttgccaaatagcaaccatcataaatttctaattaatatttggcagtcgatttgttgtttaatgaatattttaaattcaagcgaagacaaatttattaattatttaattggattctacttcaagcatctacaatacctttataatccagatgttaggcagtatattgacatgtttggttgcaatattgtcgtatattttccaaaaaagtgcattgaatacattattgaaggcctttcaaacaatattaacaatcatacgcaagtaatttattcttatctttgcatttcaagctatttgatacattttttgaaagatgtctctcctctaccatttaacgataactctgagacggaagtaattagcgatatttttgcttttgaaggagatttatggattaaaataaatattgaatttcttgataagtacgtttcgttctttaatttgtttaccagctattcaatatcaaactcatcccttttgagaaatgttgttctatatacattatatgatgcatataataataattacgtttttgaaattttacaaaggtcttttgaaagttgctactcctcagacactgaaaatattcattcattggcgattgattttaaaaacgccttcaagattgaagaaactaaggctaaaatagagataatccgaaattcaagatattatgcgagtaataaactagatacttccaaacgaatgtttttacttaatttatttattttagaagaatcaaaatatatgagaactttagttaatagtattttcaataataatgatatcttgaagatgctaaagaatttatcaatagtttggactatttggaaaccaattaaatattgtgcagtagaaaatattattccgcgagataatttggtagagttctcggatcaaaaggaatcccagaatttctttaattgttcatcatgcttagattcaatcttaagcaaattggatggcaataccgatatttatgaaaccaactttgaaaaggagctacttgcaatgcaagataaatgcgaaacatacatactgaactcccatctgatatttggagatcttagaccctcgtggagtctttactatctactgaagaaaatcatatgcaaagaaatgagcggatactacgtacaagaaaaagaagagaaagaagagcctaacgcaatagaaattcagaggtctcataactaccaactaaaattcgaacctccacactacgatagcctcatttccggtgagccaagatcaaggaggtcggataaccagttgttaaatagatcagggctaatagtaataggaagccttgttgacaaagttccaaatatagcaggaataactaggacctgcgaggtcttccgcgccaatgagttattgttgagcagcaagaaagttatgaacgaccctattttcagacaaatctctgttacagcagaaaaatggctgccgataaacgagctggaacctacaaagatcaaagaatacgttcagaaaaagcgaatggaaggatacaagatatttggattggagcaaacgtcctctagtatctccattaaagaatgcgctttcccagaaaaatctgttttgattttagggaaagagaaagaaggtataccctctgaaattgtttcaattgtggatcagtgcattgaaattcctcaatatgggataataagatcgctcaatgtacacgtatcagcttcaatctttatatatgagtacacaactcaatttatgcaaagcttatcgactaattag

SEQ ID NO: 203 - DNA, 1245 bp, Cryptosporidium hominis
atgattaagaggaccctagtctcaactattgtttttgcatttgccctcatcaaggatgcaagatctcaggatgttattctggaaaataacaatgggaacataactgaattggataaaaatagcacactggaaaccttgtcaaattttacgtacttaaatacttcagaaatccctctagtcttgccgtttgaagtacttgatcttaacatgtctgtgcatagaagcttgcgtgcaaagaaggagcagaaaaaatataattgttcattcaattgtataatttctgacttggatggttcattagctggagttggttcgagttatattgccgaatcaaattcaatgattttcggagacattctctcatctaatattaattttttccttgctactggtaaatcatacaccagctcattgaagtttattacaaagaatcttaagaactctgtattcaccggatttccaggagtatattacaatggtgctcttgtctttggtcctggtggcattaaggatgtattatacgaaaccaggattaattccgaagatgcattggaaattgttaactatattaaaaaatttgctgtatctaatgaaaagtctttaagatttgaatcaaatataaacggaaattctaagtatgcaaagatttctaataatgaagagaaggatgatgaatctgctgattcgctacgcctattgaacatcgcaattgagaactctaatggcctattcgttgatggatttgagggcgaaaacatgaaggagtacataagccaagagattgatagtatggttcataagggtgttaacttgtcgaagtttttggaaccaagagaaggtgaaaagattaagggaatattcaagattgtcatagtggagaaccctgatgtgctccttcatttaagagagcatttggagacgtttgtcagaatgtttggctgcaaaatctacaggtcagtaccaaatgtattggaaattgtccctcaaaatgcctccaagctgaatggtgctagactcatcttgaagaaactcaaattaaaattccaccaagtagcatatttgggtgacggcgaaaatgacttggagataatgtctaaagtcggttttcctatcgcagttatgggttcaatccctgcagtttcttatgtttctagggctgtccaaacgttttccccagaaactagtttttctagtttaattgctgagtactgcgaggtagaatgtagcaaaaagaaacctaattag

SEQ ID NO: 204 - DNA, 786 bp, Cryptosporidium hominis
atggctgaacatttgcttaaagaaattattttttcacttagcaagaaggactatgtatggataacttgctcttttttatcatttttacttgttaattattacattactaagtggatatggggcagcaatcttacatcttctcaaaatgaaggtagtactcgaggccatgagattgaaacagcaattaatataatagacaaccaaaaactcaataatagtttaaaaaaaaaaattagaattgaagagcttgcgagcaagcagttgataaacgctaaacaagcaagaaaacaaagaagagaggcgtatgaagctaaacaaaggctaaaggccgtgaaatatgagcttcatgaaaatagaattaacaaaaaagttcttgaaaagctgtctgaaaggaaaaaagcgctaatatgtgaacaaaaagaatacgagaaatggaggctcaagataaatattaatgaaactggtaatgagttcgaattcggagatgaaaatctcaatagtgaatatgaagatctaagcaaatttataaatgcgataactagggaaaagatcactaatatcaacgatttaagcgttgaatttaatataagcattgaagacgtcatttccagaattaaccagcttgaggagcaaaaaatcatagatggagtaattacagacaaagggcaatatatatttataagcgaacaggagtgggaaggcattaacttttgtattaacaaaaacggaaaaatatcaaagtcaaaagaccttacattaatttgcaatgatgtaatagccatgtaa

SEQ ID NO: 205 - DNA, 1539 bp, Cryptosporidium hominis
atgatattaaaaaatatgcatctaagtaagaatataatttcaagaaaaagtgccaagcttcagttttaccgtttttcaaagctctggcatagcgaagtaatatttaaaacagttatagtggcattactaattgtaataaacattatattattgatatatacattgataaagattgatggaaataaatgtgatgatttcttaggtttatttgggtggatgctgttacttttatattgtggagtcttaattgatattgagtcttccagaagtttgaaaatttgtctttcaattttagttcttattaatttagtgtgcattgagaaaaatattttaatggttggaattacaattgactttttaaatttaggagttctctggcctatttttaagtatggagaaatacatttagattcagaggaaaattatgaagatgaatatattctgccattaattgacagtagtaagaagttattaaatgtatactatgaactttggagaagaaatagctatggaggaattaaaagctacaatgggctacttgtaactagatgtgtaataatgtcttgtatattcctttgtattttattatttaatacagttgataaatacactaattttggcaaaaacaaattgacagaattggaaaacataatctatttaagaagtacaagaattatatcaaaaaccgaatctattgataaaatatccaaaattggaggtaacggtatatttatagcacaaatcatgattattactttagctgtgttgctaaagccggtcttatcaaaacttgttaatttaataatagcattcaagaataaatgcatattaacgctgaaaaacaatgaaatgagtgatgggaaagtaaagcaaatagttaaatttaacgattatgagtttaatcatcaaaatttggatattgaatctaacaaacagaatgcttttattaatcagaataaattgctcaatagttgtgtattttttttttccgtatttctatttggaataataacatgtgaaaatagggaatttgatataatttcaaggatgtttttgatcgaacaagataagtcaattgtgctatgcattttattgcccttaattggcttgctaactgaaatttctatgttcagagattggtgttggtacttcattttctcatgggttatatattattttaatatttggtcagacaattcaatggtaaagagtatcactagtttactttcaggagtgcttttcaacatatcggcgatattatttgttataaatcagacaaaaaattcaagtaataataataaagttcgggaatatattcttacaagttatatttttcacaagatgtgttattttttggggtgtagtatgtcgaaaaaagttttctcaattcatgaaagtagcattataaaaaatatatatttaatcatcacaaatattataataatttttaacttatattttcttctttattttagttcaagtcaagaaatagcttctaagcaagatgacaatgaaattgagtgggatgtagtatattag

SEQ ID NO: 206 - DNA, 1026 bp, Cryptosporidium hominis
atgaactcgaactattataggcacgaactttcaaatttggtttggatacaacggctaagaaagggcgagaaaaaagttgatgaaatcttagaatcatttgtacaacaggatatgaagatttggaatcctgggaagtatctattttcaccaaaaattgcaattattttgttcttaattggtggcgtctttcatgcagtatttgcagcatttttctttttcaattatagaagcaactcatatgtagagtatattagtgaaccgatacaaaataacgtaagcagcctaatattcaacatagagaatgatattactggggcagtaaatataaatatatatatagataacttttatcaaaatttccgatcttatattcaaagcaggccttcagatattttccccggttttacttgtgggacagcaaaaacaattacttacttacgacaagttcgtggaaacactcttgataactatataaataaaatccaagtagaaaaaaatgatgaagaaactggtgaagaagtacccttgataccatgtggattgtcatccatcacgttttataatgacaaatttgagatatatatgttaaaagaggatggcaaaaaagaattgattaacgttgaaattgaccagttatcactgaaaaatgacttttcaatgtttgcagtcccatataacaaaatgatgtggataaaaaccacagacatacattacagaatctggatgcatggtgcatggcttcccagcttcaaaatggtttgggggcaaatatcccatggattaaaaaggggaaaatacgagattaaaatgattgataatatgtggccagcagaaaattttaactcgaaaaaaagattaggaattgaaagagtgtcgtttcttggtagtaaaaatattaaagcaagctatttcttctttatttggagcgtatggttattcacaatatcttttttatttatttttatgttatcttgttcgtgcaatacattaaaaattatattgagaagcttcttagaatcgatataa

SEQ ID NO: 207 - DNA, 1383 bp, Cryptosporidium hominis
atgtgcggttttgacttagtaggaatcattttaactgtcaaatggccatatcaagaacctgagattatattttaccatcccccaagctccttttctatattaaatgagaaaaatgttattcaaactaaggaatgctttggacatgaatgctctaaacttgcacctttgattctaccatctgactcagcattatggaacaaaatgtccgatttagtcattgagtccaaagattttcaacatagatttgtttttttcccaagttcaacaatccatacaaaatccttaaatcaaaccttatttaataatattcaaaaaaagattaatataaataatagaaatctcaagttggataaatttatcgagagtttctccgtaacattagtatttattgcatcaactttgataaactatgaatttatagaagaaaagctatttagaattgcaagtactcttttatcatgtgaaattgcaaataactttatttctgtagaaattttgaggtccaatgaaacttcgttcgagtatttgaagaatttatacaagagttgccagaataataaaggtggtgcgtcgattggaagtgaacacattaacttaagtgggtctgaaagaagtaatttgcaggagcatatcttttctatagttgagaaaaacaataggctttcgaaaaagcttattaaatattttacgagattaaaaatcgattgcaatgattttacagtaacaccatcaaaaccacaccaatttttttcttctatagataataattgcctccaaaaccctgtagagagttcatatgatgaattaactttttatattgataagtctaaactttctaatatatataaagaaaatgaacttataaacgaaatttcgaatattgcagatccacacttatccatcagagatatttcagttgaacttttagaacaaccatcaaatattttgaaggtttgccaaaaactgattactaaaaaagttgcaaaggttttggaaataataagatatgacaaagtttatgtaatttgccctgattcgataaaaactcaagtaaatagatttaacttaaaatacagagatattattgattggaaaggatgtaacccacttatattgattagctcatttttttgtaatggaaagaaactttgtgatgttagaagtgagcttgttgaattcttccaaaaatttactagggaaaaaagagcatctgagcgtttaatttattatccatatgaatcctctgataaaatatactcttctaatcgcgatgaagcattaaaaatagtaaaatccataatttcatggttatatgtaaacggctgtatagaagttaaatactcaaccaacgcgccgaatgacaatatagacctttttaaataa

SEQ ID NO: 208 - DNA, 1983 bp, Cryptosporidium hominis
atggaaaacaataattcaaggccggagcccagcatatttcatgcatcaataattgatcgaataaataacctcgatctttcaatcctaaacttttcagctgaaagaagctcaagaaatttattttttacatttttcgttttctttgtaataataattcttagttttgaaaataaatttcaaggcaatggatccattaccagttcgaccattacttcatctgctttttactttggtgaatttcaaatgaacacttatttggataattatcacggaaatccccacgataaaaatggcttattcgcgggtagcaaatcaataccagctatttatggcaattcaaaatggcaccttgaatggacgaagtcaagtatttcctcaaaatctgcattggtttcgttaattatacagctggacaaaaatgggaaagcatacaactggaactttgaaaagattattactgaagatgagttaaatatggtatttactagcaaagtaaatgaaactccaacaaaccaaattcaaaactcagattcaaattactgtcttctggaaattgatatctctaatgataccaacttagttaatcaaatattcccacagaaggaaaatgaaaaatataaatttagaggtagtaatataaatgaaaaaggggaaggtaaaagccaaatagaatttataattaaatctctggattgcaacttcaatgtacttttgaaaggggagccattctcaatgagtttgttcagactaaatattattcacttctcattcatatataatttaaaggtacttatggaaattagaggaagcgtaatacagcttgtacacagtaattcaccagttattggggcaagcttcgtcagtaatacatctatttcttgcttatttatgcagattatattagatatactggaatgtgtatttattttatattgctcatttgctctaccttcactactgttttcttcgttttcacttatgatactttttaaatggattcatattttttacatagaaataaagtatttattttggatttggaagtcaaattatttacaaaatgctccttcaagtgaaataactatcattacaacacaattttatagaaggctttatgtatttctatttggaatagtgcttttctttatacttctattcggaatatgcaattcaagtatactatttagcacttttgcaaagagtctaagtaagagaaatataataatcattcaatccgtgccatattgtatttatgtatcactatttttatttctcatccctcaaattctaaatgacctacttgctaatactattcatttgaattcaactctaccgctccacccatattttatacttacatctttaattggcaaggcattcgttcctatttacgtttggggatactctaattctatattcaatgctccagtattccagtatttgaatctcatgcctatctcaacaaagaactctccattactatctattttcatatttttaattacttcaatacaaatgataatttattttgtgcaattaaaatttggaccaaagtgtttaattccgaagatattcaggccaagaccgtataattacttcagattaacaagtaaagacatttacaatggagcttcaaatgaggaggatacacgagaggttaatattcctattgatggagaattaaattctgaatcgttaaatagatctaaggttaattttgctcaggaaaatatttcaaataccgaaccatcaggacttgatgaaattgaattaaccaatttcaacgatagaacgcatacaaataagctctgtgtgatttgtatggtgaatgtttctatatttaaggactttgatcacgaattgtgcgcagtttgcactccctgtgatcatatattccaccaaaaatgccttaaacaatggatgagcgttaagctagaatgtccaacatgtcgtaggcaaatacctccattcgatactaaatga

SEQ ID NO: 209 - DNA, 1485 bp, Cryptosporidium hominis
atgtttgaaaaagatgattcagcgaatattaatcaactcttacaaaaaagctctgcaccagacgtagatgatgctatatttaatcactatgatctgaataaagtaactcttaatgagcaaataaattctttttcttgctcttcaaccgcattcgacttaaactttaactttcaaaataaaagtacaagctcaaagaaagtagataaaagaactaaatttgatcagaaaaaagaagtttattttgagaatttaagccaagatgtaggtgaaaaaaaactaaagccttcaccgaagaagagcaagtataattatattggaccgtggagaaaagatcaaaaagaaaaagtcattacagagaatatcatatttcagactgaagaagatttcggaggagttaacaatttggaaagtgaatttaatgatgagactcaagaatcagacactgatgattcgttgacagacgaaaaatatgccgaaagtacattccttggcaaggaacgtactgattatcaaaatagatcttggattatctctccaaatgaaactaaagaaagacttcctaatgaacaatgttatgcccctaagaaacttattaaagttataagggctcattctttgggtgttcaagctattagatttattccaaaaactgggcacctattattatctgcagggttggattctcaaataaagatttggagctctgatagcaagtgtatttatatttaccatgggcacaaaaacgcagttagagatattcagttttcaaatagacaaagggactgtaaaagtttctatagttgtggatatgacaaacaaatattgttttgggatgcagaatatggaaagacaaagtggaaaattttgaatgataagacgccctactgtgtttcagttcatccaaagaatgagcaaagtattattgttggctttagcaacaaaaaggctattcaatacgatacaagatctaatgaagttgtacaagtgtacaatgaacatcagggagcggtaaatactgttacattttgtgaagacggaaaaaagtttgttacaacttcagatgataaaaagatgttcgtttgggatgttgggataccaattgtagtgaagcatatcgctgacccattaatgcaatcaatgccatatgttgctttgcattctgatgggcagcatttagtttgtcaaagtatggataacaaaattttagtttatgatacgcatgccaattatagatgtattaaaaagcgcttcactggacttaaaaattcagggtacgcaattcaatgcgatgtaagcccagatggacagtatataatatctggtgatattaatggaaaggttcatttttgggattggaaaactacaaaaaattttagaagttttaatgcccatgaaggggtaagcataggttgtcagtggcaccctgttttcccttcacgcattgcttcttgcggttgggatggaactataaaaatctgggagtaa

SEQ ID NO: 210 - DNA, 783 bp, Cryptosporidium hominis
atggaaaatgaaaaaatgaaagatcaagagaatgaaatccaagctgaagaaaaggagtctctagattctagtattagaagctttgagaacaaaccaatttattctgataagtctagagagctccaagatcatgagaaaaatgataattgttctggagaaagctgcaaagtaaattctaaacaaattgcacagaattgcaatattattaatgaaaaaactaatagttttgatatggacaatcgtaactctcaaaatataactgatttatatcttgataataaaacaattattacggaaaaatctgaaaaaaatggtaatgcggaattcgatcttacaaataaccaatcgtattttaaagatttggataatttaattgaaaaggatgatgacaaaactcaaaaatcagctcaaaaattagagaaaattagtcaaactgaagagatgttttctaataataaaaataaaataaaaatggaatataaagttaatctaaaagacaggaaaggagaaattaaggagttattggacaatatcaacaaacttaaaagcaaagctagccagaatgaaacttgtattgtagcaaagttaatgaattctagaggggtttactgtggaatgcatacagaattatctctatatgaagagttactgaaatacttgttctcaaagcgtgacttgaacgaggagacgttcgaatccattgatattgaagataatgtgtcattagttgatcagtccgaaagcaataccaataatttgtttcatctggaaatagagaataca

SEQ ID NO: 211 - DNA, 156 bp, Cryptosporidium hominis
atgtcaatgggcggaaatttacatatcacatatattggatatcctagattcaataattccacaagcaatattggatattacatgccattagaggaaggtctcaataatattgaacctaaggaactactatccagtactactgaaataaatctttaa

SEQ ID NO: 212 - DNA, 618 bp, Cryptosporidium hominis
atgacgaataattggagaatgttaaattctaataaaaatccggaatcactgagtgtatttagtggtctaagtattgattttgaggcatattgcaaagaaatagacaacaagcttatcaatatttcgtggataaagccagcttctgaatctttagggtgtagaccctgttatttaatgtttggggcggtattcatattagttttaattgtaagtatgggttatgcaggagcattgatttgtaacctagttggctttatctatcctgcatatatgagctttaaagctctagaaactccagggaaattggatgacaaacaatggttaacttactgggtggtctatgcaatatttaatattttagaagtttttattgatattatacttttttggatgccattctactacttatttaagctctgttttctattttggctatttttgccccaaactacaggagccgtaactttgtatagtaatatttttcgcccactgttaattaggtttgaaaaaaaaatagataatacaattgaaaatgttttggatgtatcaaactccgcaagactagttgctcaacgatattcaaaaaaactactcgaaggttctgaaaaaatagaataa

SEQ ID NO: 213 - DNA, 2793 bp, Cryptosporidium hominis
atgattgaagaaagctattcaaactttagtaaaagaggtgatatagagaatcctattgaaatattagataatggaactttccaagatagggaaaacttgagtgtaacatcaaatacacatattgggaaagattcacacaaagtcattccatttgaatatggcaacggatatgggtatttatatacaagattgaagtggattttggacaacaatgaaacaagtggtcaatttaagaatgaaatgtactctttacttgaaactattggcgaattgagagttttgggagtgtataatgagccatacaaaaagtatcggaaggcatttgacattttttcaatgaaatttgattcttacagtgaatacaatgagaacattattggcgatttacgttatcagtgttatcaaagctcttcatctggtaggaaagagttaaaaattattgataaaggtattaaggaatggagtaagcgtgatcgagaaaataaattattgcattcatacagggatgcaatgtctgaatggctaaataaaagcgagttagggataaataaaatggaacccaaagctattaatagcgaaaatatttttaaagaaattataaattattcaaaagatacaaacaaccctctgcaacaatcacaaatactatcatttctatcaatatcatatatttcagaaaagctatttccatttatgtcggggcaattagctaatacttcaagtggagtgtttccatgtggagttcttagcgatgcaataagatctgaaacacaaaatccaaatggctctatttcttctattgaattagttaacgaaaatgctgtagaagatgcagctatttcaatcgaggaaaaacaaaaccctttgagaactgatttccctttggaggtaatccaaaaaagtggcgaaaattctcttaatagtttaagaatacataaaaatggatcagttatgaactggataaaaagcaactctatcagaaggcaagatgctaacagtcaaaagcctgaactaatttacgataaaatccgaaaagaaagaaaaaaacaactatcatcagacagagaaaagattttgtctcagaggctcactagaagttcatatgatattaataaagatatgtcaaattctttaaataaggactttattttaaaagaatattttactgattatttctcgatttacaaattattcatttctacgagggagaatttatacagccaacgtgaatattataaatcaattccaattgttggatctattcgatataagaaacaaaagattgaccttgaagaagtacgaacaagacaatttcaaagcatttacaatgatggaattcactccgaactcgtgagcaaaatacgaagagtcttaatctataggagtgaatggaaacgccctccaatgtacttattgatcactcataagggaagaaattgcaaaggaaattatcctttggcaaaagaggacaatattaactatgatattgatacagatgaggaatgggaggagcaatttggtggtgaggacgtagaaaatgttgatgatatacctgatgtttacgaagaagatgatgacaacgatgcggtagcttcaggatggttagttccagatgggtgttttcaatctgatgaactattagatgacttcacaattggaaattcaattaacgatcatcgcgcaaatatggtaaatctactttctctttcatctcaatatccatctcctgtcgtagtttcattcctgaatcacacaagcgttgattttggagttggcatttcgactccaaacgaagagtatgtaaattctatattaaaaggttatttaatacatttgacacaagatattagttggatatataataaaatggatatgtctagattttacttgagtattacaccagatgaatcaaatttccaaccctcaaatatatcagaaatttctaatgcaaaaaaaaacgtcctcgacttgcaattcaaacaggatttatcttactttattcatggaaaatgggcgtcaataaaaaaattagtcgacgacttttttgaaataaataactataaagatattaaaaaggcgtcagttgttcacttcattaaagagaatgtaagaaaagcaaagcttacaggagatgtcaagtttagatggtatgttaacgagaattgtgcgaatcttggattagatccgggaaagttgtcagaattattggcgcagagaagggcagaagaaaaaaatctttctaataaagtcgaactcacaaaaattacacaaaatcgggcttacctacagtcagatacgggctccccaagtcttaaatctcaaatacaaaattctggaaattgcccaaactccaatggaaaaggaaagcagccagaatcatgtcaatgctcaaatggcattgatcccgaatattatattaatcaaaaaattgtctcagagaatgatgagaataacaacattaattcgcaatgtagcttgaaaagtacagattatgtattgaattatatctcatcctctcaaggaagtgaacgatctagtatcaacagtcaagttattgataaggaaacgcacacaggaacagtgtacaataaaaagaggaaattttcgactccaataagaaatttgcctgatgatcattctaattacccatcatttaaccgaaagagagacgcagatgaaacggatggggttgggagcattcgaacaaatactccggaaagtaagaaaagtcatgcgtatttatataacaattcacttattacacacttcttcccgcccaaagcaaaaggctaa

SEQ ID NO: 214 - DNA, 450 bp, Cryptosporidium hominis
atggatgacctatatttcgggctcccacccccagtttcaaaaagaagcaatcctgatactgaaacatcgtcaagttctggcgtcgaagcaatttccgcaattaaaaagtcaaacacatggaatatattcattgactcatcaataaaccgtaatatagtttgcgaaatggaggggcaagacattcgatgtgggaataaaagtggaaaccttttagatctggaatacgatcctatatcaccaaatacttatactatacaccaaaataaaagcgagtcccccccggcagagaataaaatttcagtcgagaaaactgaaatcaaatttgaaataggccaaaaactacttgaaaaaatgggctggaaacaaggagagggattggggaaaaataatcagggcataaaatttcctattaaaatatatagaaaaaaggactttatcaaacgctactaa

SEQ ID NO: 215 - DNA, 1131 bp, Cryptosporidium hominis
atggaattggatttgattaaagctaatgatcagcactgctactcaagtgaaaaaaataaaacagggataccaatattaacgggtaggaacaatgttgacaaagttgtcgaatatttttgggagcacttggagagaaacttatcatttgaaacaaattcaagggtttataaacccttaatatcggcattattttcactgtcgagagttgcttcagaaagccttgcaacaaactcgccagaactaattacagaaataactgcggcgaaagagattttaatgttgagtttaagtgacgaaaaggctctttataaacttgtttctgagttcggtacaacgaatatttcaatcgccccaatttgtaaaatttttgaatccaaaatactaagtttagtgcttgaaggttgcgactcattcgaatcacaagttacattcttgaaaaatataataattgaaaaaacagatagttttgtgaataactttatttttggaatacaaaaaatggttgatttatctttatcaatctttgtaaaggatagaatgacaatattaacatttggatatagtgaaaatgttgaaatggtacttgaaaatgcatgggaaaattttaataaacactataatttgtttgttgttatgccaagcgaagcaaaacaaaccaatattgaatctgaagtccgtaaaggattatattcttaccaacaaaagaaggtcagcgaatgggaaaatggactgactaaaagggggattaatatttctatattatctatggacacgatttataatgcaatgaatattgtggactttgtattactgaatattgaatgcatacttgaaaatggatcagcaataggaatttgtgggactgcggcaatatcttgtatcgcaaaaaaagttttcaataagccagtttatattgtcacgcattcgacaaagttcacaaatttattgccttttaatatgaatataaataatattctgtctgacattacttaccagaatcatcagctaaatagcagtccagttacttcaatcgtagatatttcagagagctcttatatttcaatgatatttacggacattggtgcaatgacaccccaaaatgtctcattagaaactaaacaatatacctaa

SEQ ID NO: 216 - DNA, 1464 bp, Cryptosporidium hominis
atggatttgctttaccttctatttttatcgttccttatttatgtgaacggaataagaaactttcctactttggacgtcaaagaattcagatcaaatggcctatcacactttgggagagttgatgttgggaaaatagatattattgaggctaatagtctttatgaatccgaagaggtacttaataagcttgttttagcaacaaaaagacaacaggagctaaaagaaaaggaaataaacattaaagctgcaattggttctaatttgcataaattgaatgcaataagcgagctattacaaatgttaattgaaaaaacatcgattgagattaatggagttgtcactgaacttaaaagtactgttaaagagtcggagaaaacaaaaaacatgtttttagtgcagcagaattacaaggttgtaccaactaaaaagcttccattggcagagtattcagaatcagaacttgatactttttctaaattttctgctggtggagagtatcatggtctagattgtccattaagttgttctccaagtagctgcgataataagccaaaagaaccaactcattgtttcaaagcagaaactctaaaagacggtacttttgcttctaactgtgtaccatttacgaatcaaaaaacactgacgtgcccaaaaggttttattcgttgtgctttatcacaaccaagcaggggaaatttatatgaaatactaaaatctacggaggcgagtccagaaaattcgattaaaactgtaaacaataacaaaaaaagatctattgcgatttcaggtagaaacatgcatcaatgtctaagactgttagttgtttccaagaaaacgagctgtaatatagaaaatatctttgctgcagttgacgagtcaagacaactaattattcctaatggaaatagtgtatttccaactattaaaggcgatgttgctttatttgaagatgttcaagttaagaaggcaggaaaatttcagctttgcctattacaattttaccaagaccctaatataagtgggggggaaggagctagaattatgggttcagattctattggcgagttgaacgtgttaaatgaagatgaagaaatcagagaagatttaaaatccagtggccagaaagaaaatacagaagtatatgaaaaagatgaaactattgtggacacaggcattaaagatgaaaaaggcctgaacaatcaagaggaagaggatgaaaaaaaagttatgttggaaaatgatgatggaaatcagttggatgatgataaaaagaaaagtcattggggagtattttggtatatcttacctattatattaattctattttcatctggagcagggtttgcatattactattatttaaataataaagaatttgttcattcaaaaataataaatttgccatatcttagtgcattatttaatgttccaaattccattacccatgaaaacaaggaaaaatag

SEQ ID NO: 217 - DNA, 612 bp, Cryptosporidium hominis
atgaaaaatttaaacagttgcatagatgaaaatgggaaaaccccacacttttattaccaacgctctgttatacttgaacaagaattaaaagagctcaaactgaaatatataaagattcaaaatgaaagtaatagaaataaggaaattcttcagaaccaaattgaaaagctagtagccgttaataggaaacaggaatctttactttttgaatttgaacaatacagacaaatttgtagaactggaatcgcaataatatgcagattctgtggatctattatcgaaaatgaggcagtaatgcaacaccttgttgatatccatttatttgaatcgatagaaaataaatcttcaagtttagaatcaaaccaaatttttcttatgaatcaacttgaaatagagaaaaaatttgatagtattggttcaaaatgttttgaattaattacgcaagacgcgaatgaagtagataatattgatatagatatttcaaagccaagtgaaaataacattctgattaaaattacagggtttaatcacgataaaaatgacatattaatttgctctacagatagtctattcaaactaagaatacaggtaatttatattataataaagtaa

SEQ ID NO: 218 - DNA, 507 bp, Cryptosporidium hominis
atgtgcgaaacaacgttcattgggagagctagcgatggcctaattcttactgagacttgggatgatttaagctccaacagatctctgcagagttataagcaccaagctaaacaaatattaaaaagcatcgggagtgatcaaggagtagaaaaatgttccattgatagtggaaattatgtcttccattacattgtaaatgatggtattatttatatgactttatcgggaaagtcatacccaaagaagttggctttttcttttctagatgaaataaaaaggttatttattgaagaactagggagagaattcgcaaatagagatgaattcaagagcctgattgatgcaatagataagccgtattatttcataaagtttgaccgagtaattcaacgatgcaaatctgaatataaggacccaaactcgaacaagtcgctacaaaaactaaatgactcgctaattgaggtatgtttactacttgtttttaactataatgctcaaaaaaattaa

SEQ ID NO: 219 - DNA, 207 bp, Cryptosporidium hominis
atgagaagaaatgtggatgatattttactgagaggtgaaaatcttaatgatgttgaaagaaaagctaatgatttaaaatttgcatccctggaattttctagagctgcaaaaaagctttcattgcatgcattaattcaaaaatatgcaccaatattggccttatcggctatagttttgatcatcattatatggaagcttatcttataa

SEQ ID NO: 220 - DNA, 714 bp, Cryptosporidium hominis
atgaattttatcgtatccccaacagaacaagagctttacagcgagttaagttctaaatatccgagcctgcacatttgcactcaaacaccacaactaaaaggagttatgacaatacttagagatgcaaacacttcaaaagaagacttcgtgttttacacagatagaatatgtagaattgttcttgaacatgctttaaaccttcttccttatgattttaaggaaattaaaaccccaaatggaattgaagtcaagggaattgcatttaacacccccatctgcggcgtgagcctaataggatctggtgaagcgatggaaaatgcgcttagatttgtatgcagaggttgtagaatagggaaggtgttattaaataactcttctgaaaacgaatttgacaacgctatttctgcagcatatgtaaaattacccgaagatgtctcagaaagagttgtaatcgtaatgagcccagtgttaggaactggtaattcactatgttgtttgatagaagtgttgataaagaacaatgtaaaagagaaaaatattatttgtatggcactgctttcatcaaaattagcaatcgaacgagttttctcacaatttccagaaatcagactggtaatctcctcaatagattataatcttgatgaaaacatgcaggttgttcctggagttggtaactttggtgatagatactttggaattaaatgtagcaaataa

SEQ ID NO: 221 - DNA, 996 bp, Cryptosporidium hominis
atgaatttaataaataaactttaccgaatatataagagagaaaaaaaggaggatttaagaataagtgacaaagaagagccattaataatatcaaaaacaagaatggcactattagaactagaaattaaaactttagcttatattctttctagagaaataaaaacgagttttcaaatttctaatctatccgaaatcaaatgggcagaaattaccactgatgacttggatagacttgaatccatcttgtttgaaaatgtctacgaaatagaaattaacccgatcattaagtcattaatctctattttgagaggactattagatacacgtaacaagttttttaatggcaaagctatgccgttttatgtaaaattaaagaatgagaatgttcaaagtacatttattttagaagaaagcgttgattttccatttagaaacgatagattaatcaaacaatgtgaaaatataaattctagtaatgctaccccaaaatcatatttctcttcaagaaccccaagaaaccttccagactttaatcaaaaggtagaattgccaattaaaagtaggtcaaaccatataaatttaatttcttcaactccaagaagtacttcgtgtcaaacacctaagacaaagaatcacatgagacatacgaatttagattattctacaccaaaatccgaaataaataaaaaaaattattatatttatagtgattcaaataccccaagaagaagctcaaaaactggaatttgtggcaattcgaaaatatctaacaaccagcaaggaagtataatggcagcaaaggcgctgcttggattaagtgttaacatacctgcaactgagcaagatattagaaaggcgtatttgaaggcagcaatgaagtggcatcctgataagatgaactcaagtacaaatgaaaaatcgcatatttgttttactgcaattcaaaacgcaatggaaatattattgcaaaatatgtcaaaaaatggagaggtttaa

SEQ ID NO: 222 - DNA, 1419 bp, Cryptosporidium hominis
  misc_feature (1414)..(1414): n is a, c, g, or t
atgggtgaggagacactatgtttttcaccaataaataattacaacgaaactggaatattggagtctcatacgcataattatctttatttctcaagtgaatattataaaaaagatgaaaatcatcgtactttggaagttcattactcagataacttggttggatgcggcaaaaaagtacagaagcaggttaaggatgcgtattttaaattgttacattcattaataaatggtaaagcagtagcttcaaaaggagctgagattttaaaaataagtttgtttgcttattttgcattgaaaaaggccgaaagtcatgattttttaagaactggctttcctgatagaattctatacctaatgactggttgtaacaagagctgtgaattaggaaatgaatgcataccatcagtttcacttggaccctatccagtattcctggtctattcaattatatgtttaaaatgttctttgcaagaaaactcagcaattaagctatctttaatattttcttcatttgtaggtctttctcactctatttcaatatctggtgaatttaaagggcaattaacgtcaagagaactttggagaattagcgagatttacttcatgggaaaaatattaattctcacatcaaaaatgaccaattttttgaaaaaaattgaaatttcaaaaacagaacaaaaaatatatttggaatattttaaatatatttttaatagaagacacaatattaactcttcaattaaatcttccgaattgattgatgatttgtttataaaatttttttatattaaaccaagtattctttctaatattatttgcagagctttagattcaagtaaccaaatactacatttttactgtatcaaatttttatggaaatttcttccattaacttcgacaaaggatttcttagaacaatactctgggaggttaattccaaataattacttaataaagtctaaaactcttgaaaaattaaactatatcgattgctttgaaggctatttagaaaaaataggccaatcattggttttatttaacagttttgaagaagaatccaagatcaatcctccggcagtattagttaattctttagaaactggactcttatattcgttcaataatcaattgggatctttattagacaatactaacagatttataaataataatgatgacttttataaaaatataatatttttgttaaggttaattgcattgtattcagaaaagagtgaacagaaatataatgaagttagctttaaaaaaatagatatagagctaatacatatgggatttgttcaattattatccgagcagatatataaaattccaactttgcttgattcactattaaatctcggcgaacagataaaattcgaagagtttataaatgtattggaatgcttgctgntataa

SEQ ID NO: 223 - DNA, 474 bp, Cryptosporidium hominis
atggaaaattgggaagataaatttatctcaacaaaagtaaaagataatgatagttttgatcctcgaatttatgttgagtacttgaatacatattcgtttccaaaaatcaaaaaggaaaatatattggattcttctaaacagcatgataaaaaaacaaaatttaattcattacttgaatctcaacctattcagttaatgagagaattttttgttaagttgtattccgaaagtatttttcaaagaaaatattggccagtttttataggcacaattccaatttgtgatttggagccttctaaccattattctagttcctcactagattataatcagagacactcagagaataaatcaatttgtgattcccaatcatttgtttcaaatttaagagaaatgaatgcaccatgcagtgtttcattctggctattcccaatcaccttgacaatatcaaggaaaattttcaatttcaaataa

SEQ ID NO: 224 - DNA, 771 bp, Cryptosporidium hominis
atggagaaaaaataccctgtaagaatagatgagctcggaaaatactgtaattcgttcaaagaatacaagcttgagagagaatttttacatgcaacaaataacattagaaaggggattacggaaataattcctgaaaacattttagaattacaaacttctgaagaactggaaagattgatttgcggaaacccctctttggatattgatgcgttaaaacaacatacaaaatatactgggtattcttcaaatgacaaaattattaattggttttgggatgtattatcagaattgacagtgcttcaacaacaaatgtttcttaggtttgtatggggaagaagcagacttccaagcaaaggagctcagtgggagtgcaatatggaaatagtcagagtttatgcttctgaaaacacaattcatggtgggggagctactgttgttgaaaatattgatctaatacctagtttctctaatttaaattcagaagagtttgattacatagaaggtgaattagaacacgataatgatcaattgaacactgaatcgatcgatcaaacgtatctcagggagcaatcaacttcgaatatcatgtcaggagatttatctatgcatggaaataaggaagatcatttacttcctactagtcatacttgttttttccagttagaattacccggatactcatctaaaaaaatactaaaggaaaaattattgtatgcaattactgaaggagttgcaattgacatggacaatgtagtacttgataataattag

SEQ ID NO: 225 - DNA, 1230 bp, Cryptosporidium hominis
atgaattcattagtacaaaactctcctttttcatcaatgatgaactttactttttttgaccaagcaaaaaagatattacaatcagaagaatctaataaattagaaaagtataaaatttggaaggaaaacacatcattactctatgaaaacataatgactcatattttggagtggccatcactatcagtacagtggatgtgtgaaagtagtatttctgatgttgaaagcttttactctgatgaaggtataaacgaaacatcaaagtattctttgttaacaggcacccatacatcaggaatggaccaagattatattattatattggatgttttattgccaaattgctccattccagaaaattgtaggaaattcgattctcatagcgattatgctggctttacaataccacatatggaagctgattccaataattttagtcaaagaatcctaattccacacgatggagaagtaaatcgggttgttagctctcccatgaatgggaacattattgcatccaaaactgtggtgggggatgttaatatttacgatttaaatagtttagtgaacgaaaaaatggttaaaggcactgttaaaactgaaaataatccatcattaattttatgcggtcatgagttagaaggttgggctttaagttggaataaaattaaagaatcctatttggcaagcggttcggatgataatgttatttgcttatgggatattcaaagtaaaccaaataattatgaaaggaaattaaaaccgattcttaaattcatggggcatgaaaaaagcgttcaagatatctcatggaatccttcaaatgagaatatcatgatttcagttggagatgatgggttaataatgatttgggatattcgcgaatcggcctcgccatgctgcactacaaaaacgttcaaagaacattgttctgacaatgcaaaaattaactttggttttaaaaagtcggttggatattcttgtattggccattgtagtacaaatattaatagccttaacacaattgaattcaatccatttcaaacaaacattattgctgttggagggagcgaccccgtgatagcgatatttgatattagaaacatgagcaaacgacttcactcacttaacgggcattctggacaaataaatcgtttaagtttcctcttagaaaatgagtcattattggcatctgcatcttcagactctacagtttcggtaagtttaatttaa

SEQ ID NO: 226 - DNA, 234 bp, Cryptosporidium hominis
atggaacaaagacctgatgaagttgaagatggtgtaccggagctaatttttactcatagtgggcatacttctccagtaatagatttgtcttgcatgactaactatttacagactacatttgcaagtataagcgaaaacaattatttgcatatttggagcccaggggaagctatgtttctttcagatgatgaggatgaagaacttgaaaggataaaagatatccaagttgaataa

SEQ ID NO: 227 - DNA, 558 bp, Cryptosporidium hominis
atggagtacacgaatagaaagctttacggcggagcaataacattaaacatcccaaaggaatttgatgatatcagtaatgtgagagatattcctgatcatcaagaggtttttgttgatgagttttcagaaagtagtataattgttgaaattttggatcctattgattttgctggatgcaggaacgtcgcagaatattattttatggatatttctgaattcaacagttcattagatacgagaataatatattctgaaccactatctacgtattccaatgatttagaaatttccaaatgttttggtaatcagaaattagataagagatatccagatggaattcgaagagaagaattagatttatatttgctagtattgagagttgtctcaaagaaggctgacattgttatatctttcaacaatccaacaggatgtgcagctatcaaaaaatccttgcataaaaataccgacaatagaagacatacagaaaaggaaataagagaaattatggacgagatattaaggagcttcataataaaagattataatctattcttatag

SEQ ID NO: 228 - DNA, 1242 bp, Cryptosporidium hominis
atggattctggtgaacaattggaaaatgttctatcaagaatacaattacttccatggaaggaacagcatgacatcgagcttctgcttaaggtattacggaagtatgaggtagaaaacagagtattgaaaccgttcgacaaagtttatattgatgaaaggaattattttgttgtgttgttttgcgatccagtagaagggggcgcattatctgagtccactcaagtatttgcaaatggtaagccattaatgtcgttacaaaaagtgcacttcttggcactgcctccatttaatgctgcgctttcacctcttgcacaaaaggtttctactattcgactaaacaggttattgcaagatcaaagagaatttgaaagggaaattgaagtgtcaaattctgaagttgaaaatctatgtggaagtgatcagctctgtagactttacattgagccatactttcagaaaaagaggaaagaacctatatatgttggaagaaaagtggaaatagatgggataacatttctcgtatgggcatgcgagccaacacaagttggtgttattgacggaaatacagcggtttatattaactgggattgttttggtgaatttaaaagaattcatgtaatgccattttcagatactttgcctcaaacatattcatttgatatattccaagactatctcaaaccattcctatcgagatatacattccaccctttttcagaaggggaaagctttacatacaatggtgttcaatttaaaataattgcaacagatcctgctggtgtaaaagctcggataggtgataatacaacaatttattgccaaggcagtctaacaccatcgatcgttgatcttcttcctgttcacttattagaaaatataatacgccttccccctagaagcaggccattttcaatattgcaggctctcgcccacctccctccttcagacgtcgatcgaatatttggctctgccgactccaataatagccgagggataaataatgaaatcgtcaataaaataacacaaaaatcatactattatggagaagggaatgaaacatgtagttcatcagatgatgctccgctgtgcacagtttgcttatccgaggtgaatgagggagattttgtggttagattagactgtcagcatatctttcaccatcagtgtattaaggaatggttcaagatgtctgtaatctgcccactttgtaaagtcgatgtaaggggaagtaatagtaactaa

SEQ ID NO: 229 - DNA, 603 bp, Cryptosporidium hominis
atgtttggagttattacaatcgatgatcaaattaatgtcttccctaacgagttaaatcacttctctgaaattcatttaaaggatatacaaaatataaacccgagaattaacgaccctttggttattttgaggaatcgaataaatgacaagtacttaaataaagttgtgaaaaatgcaggattaatgatttatttcgtaggatttgatggtgttgaccatgcagatattgataatgatgaaggaggattgttattttgtgttacatttaaaatgatatcatttagaccatatgttggtgaagtaattgaaggggtagtcattgattcagattcaacaggattaactgttagccttggattttttagtgacattaaaattccttgtaatgatttaagggaacccaaatcaatagactccaacacaaaaatatggtcttgggactatgaaaatcacaaattgtgttatttaatcgattctacgataagatttaaagtctcaagtgtcgtatttaatgaacagtctcatgatagtagtgtgtcgtcaatggtcgttgttggaaatgttcaaaatgatgggcttggcatgatctcatggtggagttaa

SEQ ID NO: 230 - DNA, 570 bp, Cryptosporidium hominis
atggttaatgactatggaaggcaggctgcaactacgattcaaaattgtggtaatcaattattaggaagtggaagggactatctgcaaaattcacacataataggggaagggcccaagccattgagagcgctatgtttcgttggtggtattttcctttctcttgcctcattactcggaatttttagtattagtcaattgtttttatcacccggaagctatttgtttgaagctgtcttatttgggcttggtattgtagtaatgatagttgaatcaaaagatattgaaaaattgaaacctttcagagatttctgtctagaatgggcaaagtttttgactgttcctgcaggaaaaggtactctctatttgctttccggtatattggctatgtctatctttagaataaactttttagaattatttgcaggaacttacatggcattcttaggagtaatttgtattatggttcagtttggatgcagaaatcaacttcaggcagccggtatttcaatagactctactggttctttttctagagaaaatacaaatgaaagatttaatagattagcataa

SEQ ID NO: 231 - DNA, 1494 bp, Cryptosporidium hominis
atgaatagctttgatctctttctgacagacttcggcgtttatccttggtacgagttggggatgaatgaatacaggggaggacggacttttgaagattggataaaatccaaagaaaacagtcagaattgtttcaaaaattttattgaaagtatatttcacaataacttttcggattgtgatgagtctgcaaatattcaggacaagttattgaagagaaacgaacacctcaagtttgtaagaaggatgaggaaaattgaatatccagaaagcagtattgaaagcgaatcaacaagaatattaatgatctattggagcttgcactcagaagaattactaacaaatgatagttgtggattattgctagatccggaagatgatactaataatgaagcatttaattccaaagctgaagagattcaactttttgaagactcttttgacattatagcgacaatattaaaattccaagacaaatctggtggatttggtggaaattttagtcatatgcccaacttagtttctacctatttagcggtttcatcaatcatcataacaggagataccgaagctttgctaaagatagatagatttaaaatgtatcagttcttcaagaaattgagagattttgaaacaggtggtttcaaaattcagttggatggagaagttgatgtcagagcattttattgcgtatcggccgtggcaagcatgctgcaaattgttactgaagaattgtttgacggtattgaggattatattttaaattgtagcgggtttgatggaggttactccggggattttggtggcgagtcgcatggaggttatacatattgtgttgtttctgggctttgcattttaggaaaatcatcaataatagatatagactcattgctatattggatagttcagagacaatctgggattgaaggagggtttcaggggagaacaaataaacttgttgattcctgttatagtttttggtttacagggttattattttgcattgaagaaattttgagaataaggacatctataacagaatcttacatccaaagttgtctctgtgatttccaagcattggcatcatatatattaatttgttgtcaactttctgaagggggattaattgacaaaccaaagaaaccaagggacttgtaccatacttgctatgcattaagcgggttgtcacttgcacaaaggatgaactcaatttatagaatatctaataaacaaagtctgcctcctttttctgaatgtcaagtttttgatgataaatatgtagaaaaatgtacctcatacacccctttttactcaatatcaatcagcgaggaaaactcgattaatacaactgacccatttctaaatgttaggactgataaaatacgaaagtctagactaattttaaatagacatcctttagtgctcacgataaatggatgtataggaacagaaggaattggttataaagaatacatagaaaatgcaaatgccatatga

SEQ ID NO: 232 - DNA, 495 bp, Cryptosporidium hominis
atgtatccgactgatgaagacattagaacatatctttcatggagacaagctgattgccacataaataatctctataatacatgtttctggtctctagtgtctatcaataaattgaatgagagagaagcaacggaaaaacttaaatttacagattcgtcctacaaaaatgaactactatttaaggaatttggaataaattataacaatatttctccacaatttaggaaaggaacaacgatttataaggctaggccgaaagaaaagaaatctagggatgaatatttattgttgaaaaataaagatattttattacttgacaagtgtaaagaagcgacaattgaaactgatcacagagattatacagaattagataaaccgtcaaatccaatatggaaaatagacgatgaaatggttattattaactgtatttataagtgtcattgtgacataattcaagataaattttggcatgaaaatgatcatcttttaaaatag

SEQ ID NO: 233 - DNA, 2094 bp, Cryptosporidium hominis
atgaatctcttgaatggggaaaaaaagggtggttcaaatgatcatggaagtactattgagtatgataaattaataaataatgtttctaacatagtttctgaatctcaatattacagaaagggcaatatgggcaacccgaacagttttaatagtgaattgacgagctctaattttaatgagagttccgaatcttctggaaaggtttggagcaaagaaaagataaatatgaaagctactattggcaacttaatggagaacttatctgggtctattaaagccagggaggctattaaccaaataaagatgctagataccaaacataaaactaagggtgagatagcggaatttctttcacctaataaactgtataaattagaaagaaaaacacaatatgatttaacacaaaaagaaatgaaacactggggagcaactattgaccggataaatcgacaggaaatcatttcttatggagaacctgaaaagatggatattgtttcaactggacaattagcaactaattaccagcctttggatgaatttgagcaagagtttgataacatattaaaagcgatgaatagagatgactcaaaaaatgctgagatattgggacactgtgatatttctccctgcaataaaattaaagatcaatcagaaaaaagtttcatgaaaaaacttaaattcattttatttcaacagcagagagaaaacaaaaggttaaagaagattaaatcaaagacttggagaaagaaccgtagaaaacaaatgcaaattgaggaagagaagttactgagtttaggagaggttgaatatccagaattagttaaaaagatcagggaaaggtatgaagagaagagagccaggataagattaatgagaagacaaactgcaaggcaaaaatgggctaagatggcattaagatttggtggaaatgagttacaaaagaatatttcggatcaagctcaaaaacaacatgaagagaaaaaaagaattgaacaaataattcaaaatgtttcaaaaaatcttgatgaaggaagtgaactcagtgactctgataatgaaacagaatcaaatttacacttcattgaaaaagctcggaaaaatattaatgaattaaggaattcatccaacaacctatttgatttgaaatttattcagcgtggtattgaatataataacagtctattagaccttgaattaaaccaacttgatcaagaaaattttcaagataaaattttgattaatgaaccagaagggcatctatccaacaatgtttcagatgaaattattcagttatctagaccttcagtaaatgaagtaatggaaacaaagaatcagattcaaggagttttgaattataatcaagatattattgggattaatttcaaggataacaacttgaataatcagcttacatcaaatatgaacgattcaaattgtctgaaatctaaaatgaatgaaaagaatttaaatttaacgacaaaaaatgttgaaaaaaagaggaaaatatatttgaatattgaagatgaacttgagagaatggctaatatagatattacagaaaatcaagaatctgctcaagcaaatagtgagttattaaaacatatttttattgaagggagccccgatcacatacctaatagcgttgatattgataattcgtccgagccaaagagtattattagatcttcgaataataaatcggtacccggctggggtaattggtgttcatccgtatctagaattatggacttaaatattcgagaagaagaagattcgtcagggaaagtaaaaaaattaattaattctaacagatcaattgataaaaaattgaaaaaatattgtgttaatcaggtaccttatccttatacctcaagcgatttatatgaaagtacctttaggcatccaatcgggcctgaatggaacactaccgcgatacataacaaactcatccagccgaagatacaaacaagaattggagcagtaattaagcctctagtatattcaaagcatctaaagaatattcaaatttcagattcctttttagaaaaatggaacttaactaaaaaatgtaatagaaccaaggcaaggttttaa

SEQ ID NO: 234 - DNA, 1899 bp, Cryptosporidium hominis
atgccagagaactgccaaaaaaacattggtaaaagttcgaagatctccgatttgtctttaaaaatcagagaggcagagaaagatttgtcgatttcaagaggaatacaattaaaaagtgcaagtacaggaaaccactttaaaccaattaatgggtttgtattcgataaaactagtaaagatctgaaagaggtatcagaattacacatattaagactaaaacaaatagaaacagcccaaagattaaaagaaacattaagaagaaatgtagaccttatgactgaattacagaaggcacgaggagctgtgagaagcttagaaaaaaaaataagtttattagaacgaggagaaggaattaatttattccatagcagtgtcaagggcgcaaattccccatgcagccattgcccaaaacaacaagaagaaatcaacaaattaaaattacacatagttgaattaaatgatacattccagaaaagatgggatgaaacacaaaaagagttgcataacgcaaaaaattctctgtctgatgtttcaagcaagctgctcgagtcattaagtaataatcatcaaacgaagatcagtcaggaaactgagcagttccgaaatattaatggagatgatatgaatcaattcatggaggatagtttacactttgacgataatatactagaaaattataaaggcaataccaataatagtaattttcgtcgaaatgtatctgaagttcaatcgccctctacctacaaactatctaggccatctagctcaaacttttctaatgatttaaatattcatcaaaatataaacgcatatccgcaaatttacagcaatattaatcatcttcagtacaatgaatattctcgacaatcagaaacacccagagctagttttactaacacatataatagaagccaactattaaataaccaaaagagcgatccaaatattgtaattaaacatagtaggccacaatcagaacacctaattaagtatcctgtacctgaaataaacaggaatacgtcgaatagtcatcattcaaacagcagcttctatcaaacatctaataatggagttagatacgaccctgctgcacgaattcgctctttagattcagttacaatcaatcctggattaaatagtcatgcaaattcatttcctcttgggcttgcctgcaatgtttctaaccgcagatatgatttaaatcctcgtgattcagttctgaatagtctttcgaaccctatggtttatccaaatacctactcttcaaacattttgtcatctcataataaagttcaaaccccaaatgactcatttatttctagtgttgaaatgttcaactcgagtaaaatgaaaaattcaatgtttcatgcaagtaataatataagctatgactctcaaagccttgagaataattcaataatacaaaatcagatagaatgcgaagaaccaaccggaatctccaactacaattcttttccaataaatgagcctaacaatattaaaaacttggtgagtccttcatcccactccaagagtatagttgagccaacaaaggaccaaacggtgaataattattccgctacacccctaagcgataattttaatgaatatccctcttcacccgttacgaagagctctctgaatgaacttgaaattgatcaaagtacgtatggtaatattagaaaaaccctcgaagaattgaagaggactcaagaccaaagagttcagcaattgaaagatgatagagaaaaacttcttagggcggttctaaacgacctacaagaaatgaaagatttcaaaacaaacctcaatattataaaagaaagccagggaaaaaatactaaaactacctcaaaaggttttttttcacttgaagatagtagtaaatacgatgtctaa

SEQ ID NO: 235 - DNA, 621 bp, Cryptosporidium hominis
atgaaaatgataaagttatttattgcgttaatattatctaagattgtgttgaatttaagttcgttaattgggccaaaccaaatacatctttatccttcgtttgagaattctccgttcataacaaattcttggactattgggatatttgttaggctaaaaatatccttatgggcacctctttttgaagatgttacagatcaaaagctctttagagaaatattaactttatgtattaatagaggaatccctccaccgcagccaccaattttcattcgaatacttgaatatgagcatttaacaggacttactggaatactgttcgaattcccaaaaaatgataggacaaatagaattgtaaatcgtggaaatattctccaatttttaatgcaatgccgagaggataagctgggaggagaagctcacattgcatcgaatatattgttgagaaattctccaattgtgcaaaacgtaagctcaatgcaagagtttaaattaaaaaagattgaagaggattattcaatggcaactacatttacaattacttttttgatggttgcaactacgctttcagtcattagcgcatatgtaatatactactcagtagctaagaataaaaagtaa

SEQ ID NO: 236 - DNA, 1557 bp, Cryptosporidium hominis
atgggttctattatcgtaattttgagaaagttatgtcttatcacggttattttcttggtgctttgtgcttctgaaggcgatgctatcagtccgaagcttcaagatgagcgtattaaatctattagtgacttgactcaaatggatatcatttcattgttaattgttggatgttttgcatctattgctgtctcagctggtggaggaggtggaattatttcaatgcccatttttttgggtcttatgcgagttccattttcgcaagcagttactttttcttctgcaattatacttggaggagtaatttgtgcattggtaactaatttattacaatataaacgggcagttcctgaatataatgatgcaactacttttctcaagttggctgttactgagaatcaaatccacgaatactccttctcgtttatgccagtagaaaaggcgccgttgattgatattcaaattgtattatttattgctccacttcttacactcggaagtttatgtggagtatttgttggaagatatgtttccaatttagtatcaatctttgtcttaaatgccttactattatatgttttaaaagtatcaatttcaaagtttaacaaaataagggagtctgagaaaaagactatcaaaatcccaaattgcgaacctgaactactttcacccacaatttctcagacaaaacaattggtaaatggcgaaaaaataaaagataatctaaaggttattttgtatctatatactttatctattattagagtagagaaaatcgtaatgaatagcattaacgagcaaagtagcattattcaaattgcttctccactacatcaggacaaatgggtaaaatttagaaactacaaactgtggattacatttattttgctctgctttttctcagtttggatctctattttagagagtggcatactattttcaaaagaatctcgtattcatttgctattgtggctatccagcgtgattatactgttgctattcccaaacatttcgcttccaaaacgatctttgaatttgataacttcaataattaattcgcaagaaaggcttgcaaaaatcgcaaagactttccacagtaatgtgacaaaccaagattataacgcaatcgatatagtgtcttatattcggtctaaatattgtaataatttttcaaactatattttggcaagcttggaggtactctcagttggactaataggtggaattacaggtgcaagcggggggattctaataagtacgattttctattcctctcaagtcgacccttcttcaattgctgcaaataactccacttgtttgatcatatcaactttgacatgcttttttacatacctatttgaagggagagttcactttgatttggctattttactacttgttatttcagttatttgtacccttattggtaaaaatattattgactattatgttagaaaatataaactttcttcaataatagtcggaatacttattatattaatttctgcaagtctaatctatatgaatttgagattatttgtattaataataaattattaa

SEQ ID NO: 237 - DNA, 1581 bp, Cryptosporidium hominis
atgatttcaaacgatcatttgaaaagacttgcatctacttccgcagtaatgagttgcacacttggaaaggcaacttgtttagggatggacaaaatttgctctcctttagcagataatgacgtaacccaaaggaagacgcaaatcatctgtacaattggcccaagctgtaataatgtagaatcgttgattggtttaattgacaaaggtatgagtgttgctagacttaacttttcccatggtgatcacgagagtcacttcaagactttacaaaatatcagagaggcagctaaagcaagacctcactctaccgttgggataatgctggatactaaaggcccagagatcagaaccggaatgttggaaggtggaaagcccattgaattgaaggcaggccaaactttaaaaattacaacagattactctatgttaggtaactctgaatgcatatcgtgtagctattctctattacctaaaagtgtacaaattggaagtactgttttaattgctgatggctcgttatcgactcaagtgctcgaaattggcgatgatttcattgtctgcaaggtattgaatagcgtaactatcggtgaaaggaaaaatatgaatctaccaggttgtaaagtccacttaccaattattggggataaagatagacatgacattgtggactttgcccttaagcacaacttggattttattgctctttcctttgtacagaatggagctgatgtacaactatgtaggcaaattatttctgaaaatacgcaatactctaatggaatcccaagctcgataaagattatttctaaaattgaaaacttggaaggtgtgatcaactttgatagtatttgcagcgagtcagatggtatcatggttgcaagaggtgacctgggtatggaaattcctccagaaaaaatattcgttgcacagaaatgtatgatttccaaatgcaatgttgcaggtaagcccgttgttactgcaactcaaatgcttgaaagcatgattaagagcaataggccaacaagggcagaaatgactgatgttgcaaacgctgttttagatggttcagattgtgttatgctatctggagaaactgccaatggagcatttccatttgacgcagtaaatgtaatgtccagagtatgtgcccaagctgagacatgtattgattatccagtattataccacgcaatacattcctcagttccaaagccagttgctgttcctgaagccattgcttgttctgcagttgagtctgcccatgacgtaaatgcaaaattaatcatcacaatcacagaaacagggaatactgcaagactcatttcaaagtacaggccaagtcagaccattattgcatgcacagctaaacctgaagtagccagagggctaaagattgcaagaggtgttaagacttatgtcttaaactcaatccatcatagtgaagttgtaatatctaatgccctagcacttgcaaaagaggaaagtcttattgaaagtggagattttgctatcgccgtacatggcgttaaagagtcctgtccaggatcgtgtaatcttatgaaaatagttaggtgcccctaa

SEQ ID NO: 238 - DNA, 765 bp, Cryptosporidium hominis
atgatgagaaatatggatttaatttccggaaacaattcgcttttctattataatgaccaacttatttggtttcaaaagaataagttattttcattttctctcgttgattatcaacaaacagaaattgctctaggtaatgaagaagatactttagtttcagtaaatatttcaatggatggcacagtgactgcttgtagtagcaataaggttatttatataattaagatttgcaattttagctttcaattaataggtcgatttgtacattcaaaaaggttaaatatttcaatattcaaaccagatacaaacgaagtgattataggtgataaatttggtgatttatacttattgaatgcctcctctattcactcagcgattaagaatggtagaaatttaccctcgtttgataatgactcagatagtgaagaaatactaaacaacgatatggctgattgtataatccccaaaatgggtcacttatcaacagttacatgttcaataatcagctacgactccaaacttttgtttactgggaataagtgtggaaaaatatgggtttctaatataaagcatttagaaaatacactttcaatattatgtggtcacggtgacgcaatctcgtcactatgtgagataaaaatcgctgaagaatcatctaaattaattattagttcatctcttgataaaagaatcaagctttgggactatttatacggaactgaaatagattcgattaaccttgaggtaagtaacattcaattttga

SEQ ID NO: 239 - DNA, 219 bp, Cryptosporidium hominis
atgactattatattagttggaaataaatctgatttagatagaagagaagtaactacagaagaaggggtcgaattcgcagaacaaaatgggctcttattcattgaaacatctgcaaagacatctaataacgtagaagaagcatttttgaaagttgctgaaaaaatatacaaaaatatcttagatggtatttatgacctttctaatgaggtgagtatttaa

SEQ ID NO: 240 - DNA, 1500 bp, Cryptosporidium hominis
atgcttgaaaatgactttccacataatgagttggtatggtggagaatgacaaggaaacagaggtatttgcctgggcgtacagtaacattggaattagaaaataaaacagtaggaatagaagaagaacatgaaaaattacttatgaagttagtaaagcagggttcagttattattcattcgtttgatgatatgaaatatgctgtttgtagttctagtaatgttaggttatatccagcactttctgaacaggagcaaaagtcacttgaaaaagaatgcattcgatcaacaaagatgaattacagagctttgttacgtattaaaaaaatagttgaactcagaaaattagatcaggcacaatttgaaaatagtgaaacaaatatgtctctattagagattcgtatgattcaatttttcaaagacagggatagcatcaccaatatttctgagagtatagaatatcttgaaaagaacactgcaattgaattgctaggagcaattgtaaacaggaaaactttgaaaactatgattgggcagagtccacaagctttcttttatttagataaaactatatttaatgagaaaagtaagcatctatctgagaaagaggacatttcagtaggatctattgattctaagcactggcaaaatgaattaaatgaaattattgttaataggaaaacaatttgtgaattattaagttgtataccgtttgaattgttatcgagcagtcataatggtaaaaataacatcgaattaatggctgggcgaatttttgtgaatgatcctgaagattcattgattgaagaattttgtgaaaaaagtattgataccatttatcgtgggaagttcattatggaatatattaaattatcaattttgtatttgcgtatattgtccaaatcaatcgcacttagagttgtaagtgcaaataaaaagaaaaacacaagacagagatcaatattggaatatgttatagttttatctcttgaattattattttgtgatccatatgaagctaagatgctttcattgactaaattaaagtacgaagaaacgggtatttctaatgtaaacaattgtttggtgtccttaagtattgacgttgattcgaacaattcatctgaaaaaatgccagaaaatattagtaaggcggagaaaagtaatgttcatggattattgttaaattttaaaacaactgttcctagtagagactctaaagaaaatgaattatattataaagttgacttaaatcgtattagtagccagttggccatttcagaagagttacaaaacgcctacagttactacaataagaaatttacccttaaagaactggaaaatcgcaccaaatcgttccatgttattaaaacttcgtgccctataatgattaaattgttaagggagtggattctgaatgcaaatagaggcgaatttgaccatatagataatattgaccaacttaaaaaaataaaagaaaacttattaaatgttgataagtag

SEQ ID NO: 241 - DNA, 693 bp, Cryptosporidium hominis
atgcaaaaaaagagagagaatttgcacaaacttgcaattttgatactaaattcattattaattttagcaacgttttttacgatattttttttaaatattggttattacaggtggggattctcaaatggatctaatgttaagtatagcgtttgcttgaatcgaatttattcagaaggggtttgcattaatacatcagtcattgactttgaaaactgtactgaaattattgaatttgataattttggatcaagcaaaacgcttaacagtgtagctacaaattccttaacgaaatcaatcaaaaatacaatcataagtattcagaatgcgagtttaatacttacatgcttaattgcaacatatttggcgtttttatcattttcaacgcttattttactaattaaagaatacttacataacaaaagatatgcacatatattttccattattttaatgggagcttcggtattatttatcaaatcagggttgctttattggatttcaatgcacttttcttgggggaaaacttttaggacagaaaataacagcgcgaccattcaaaagatatatcattcattaggatctggattctatactttaattggaatattatcattaacgtttgctgaattaattgtcctaattaaaatactacctagagatcatgaatatagcaaatattcattaatttcttaa

SEQ ID NO: 242 - DNA, 1116 bp, Cryptosporidium hominis
atggagactatattttgctataaatgtaaattaaaaaaagctgaagttaataccagatttctatcttgtattgattgctttaattcatatattgaaggtaatgtaagaaaagaaataaggacaggcccaattgaaaggttgaaggaattaaaaagtagttaccaatcaaaaaagcctccaaaatcagagctttatgttgcgcttggatttggattttattcacatgctttattgaacttgctatcagtaataccaaagacaggaaaaaggcccgactattatattaaatcttttattaatgtcgatacatctccattggttaatagagatccttctgaatattacaaaagtttgaatgcatgtattcaatcaatctatagccataatgcctattcaaacggattccaaattataccaaagttacaaataatcccattctgttcaagcattatcagaggcgatactcagttagataaagaaaaaagacaagcgattttagatgaaattaagtttcatattgataggggaaccgatcacattaagttacttattcaactaattatttttaaggatattaaacattatttagatagtatagaccattctaggcaaaagtgccttgtgatagcatctacatctgaatcgctgggctctgagtctatccaatatatgacattggctagtggagtacatattaaatcaatttatgaatatcttgattttagatttcacactgagaaatcttcgttccttttcattcgtcccctaagaaacttaacttcaaaagaagttatgctttactggaaattcaatatatctaaaatgctaaatagttcgattggagcagagctttctttaaataaatctcccattgaatatgaaattagtaaatttattctttctcaaaatgagaagatatgcaatattactaacatatttatgaagctaaatgaaaacaataatgaaacacacaaatattcaatctatttaaaagaaaacatattctgtaaattatgcggaattatacacaataaagtaattgaaaacaaatattgccaaatgtgttattcattacttaaaatattaaacaacttaactggaaaagtaatagattaa

SEQ ID NO: 243 - DNA, 1050 bp, Cryptosporidium hominis
atggggatattgctattatcaatttatctagcagcgaactatccaatatattcagccataatattcacttgtttagtatttacaaagcacttttttattgtgcttgctcctgtatggtttatttttctactaaattcttgtatccaaagatctgaaggaaaattttttattcttattaactcttcatttaaagttttattttctattttatcagtgtccgcttttgcaatcacaccaattattttttatgggcaattaaatcaatttatttcgaggctatttcccatttcaagaagttttatccattttattcctgcatcaaacttatatactttatattcgatatctgataaagtactcgcaaaatttaacttaaacttttgcaaaatttatcatcttgatgcagaaggccattatattaaatcgatgaaatgtatcccaccagtaaaacctattttttgcatgttaatttgtatattatttataattccagtattagttcgtctatggcatagtttgagtaatataaaagagtcaatgaagtctattttaattacttcttcaatctcacttttaatagcttttcaatttggatttcatattcacgaaaaacaaatattatacgctattatacctttaggaatttacacaattttattttgtggaaatgatcaacaactcttggctcattatacttacttaagtaattggtccaatttatctgtcatggttttgttagaaacatatcctgagaatattattaaatatgtaataataataacttattatgtactggaattattgcttttaaatattaatttgagaaaatacagcgttcacaacatattatttatttttggactgacaacaattttttttctggaatttttcgtacaaaggttggtatttgacaagcttcagcttgtgttcatctatcatgcactatcttccctaatctgtatattccccatattatattacacattctacttttactatttctgggtctttgattcaaccaagaactcaaataggcaagaatcgaattag

SEQ ID NO: 244 - DNA, 1650 bp, Cryptosporidium hominis
atgggtaatcttcaacttctttctttggacaatgaggaagatttaagcaatttatttttagaatttagctggcttgaggaaagtggagaattaataaaagaaagtaggatttcattcgattttaaagtatttgatcaagaacgtaaatgctatgagatttataaattttttggaggattagataaattttcaaaaattgaccatggtaaagaactggataacggaatagaaaaattagactcccctgccttgaattttgagcataatatcttttttaatgaaactctatcgcaaaatagcctgaaatactttcctagtttaaatggcatgtttttcgaaaaaaatgaagacaatattatgaataaaatattatcagtaattgaaatacaaagaaataccaagaatagcactttctatccaaatataattttttatgaacaagctaataaatctaaaaattatatatattttaaaagagttatgtgggaatcaaccattaaagataaattagatgagctacctaaaattaatttattgaataatgtacttaagaattggcttgaatttcaatctttaatatccattgttcaattacattctttagaaatatttcatggcaatataaaaacagaaaatatgctagttaatcacttttataccgtaaaaataacagatatttcgccttggaagccagttttcattgatagctcagacctaagattttggaccattttttttgaggaccaaaattgtaatgctagaagtaatgttttgagttgcaatttgtctccagaaagatttttattagaaattgatactaagaatatcgagactgagcttaaatgcgaaattaagaataaattatttagcatggatattttttctctaggttgtgtattgaatgagatagaaaatgaagaatcaacatttacgataaatgaaatattacaaatgtcgaaatttgaaaaatattgctctaatgtaagtaaagttaataatgattggattagagaaatatttctaaattataactgggaaaaaagaccagatgcatttggaactttattaaaattattaaacatgaataaaataatacaaataaactccttaaacgcgtacttattcagtcacttagaaaaaaagaagtttaatttttgcaagtcatttccattgttcttttatccactctcaataattatgcagaataaaatgtttagtgatttaaggattcaagtaataattttaaacataatcttgccaatttttttggagttatttattattaaaaatatttatgcaaataatatagaaccaaataaaaaaaatatttgctttgaagaaatattttcaaatcttaaaatcgaatatactcatgattgggatttaaataaactaaaaagcacttttcaaaataagtttgataatgaactaatgaaagacttgattttaagtattttgatatcagatcttaatcaccaaatatttgatgaaaagacaaaactagaaaatattaattcaaacaactactcaaatattaaaggctttttttcaattttccaacttttacttaatttctgggacaataaaaaggcagaatttagtgaggattttaacttaactcactatataaattatattatatttggatga

SEQ ID NO: 245 - DNA, 657 bp, Cryptosporidium hominis
  misc_feature (9)..(10): n is a, c, g, or t
atgaaaatnnattctaaagaattgattatttctgcatatagtaacggggatatatattttattgaatccgagagcttgcaaacagaaatcagtttctcaattcccctatttttagggagtgtaattgactattcagttgacaataattctaatgatcatttaatttcattcgctactgatgaaaatatagttattattattgatttattttatttgaagagtatgaaaatttggaaaattgatcatgaattaagaattacaaatattggtagttcaaatattaatgatcaatcttcaaaaatattgcttaactttaatagaaatggtgtttttgcactttttgatccaattagtggtgaaattgattctaatgtagattttaaattccggataaccgaaataaaagaaaagtttattcatattcacagaccatttttgttttcatcaaaaatggttcacacagactttaaaagcatacaaaagtgtaattgtctatattgtcaaactcaaagagttagaatttttggaaattatttgaatcaatatttaataatgagtcaataccataatactacggttaaaaaggagcgtctaattaatagaaacattattgggccgtttagtaccactcataacttcataggcaaaggccaataa

SEQ ID NO: 246 - DNA, 2805 bp, Cryptosporidium hominis
atgataagaaatgaaataatggctgttggatatatcaattctaatgacgaacttgaagctgctatgaaaaatatgaagagccatgattcaaataaaagaatacaaggaattcagctatttgctgacgtaataaaaacagattgcagtctcttatcaattgaatacattaaaaagcttcaaattgtttttgaatgtgagcacaatatagatgtgctattgcaacttgctaaatcgtgtacaaatttgggtttgatttcgctttttgaggagcaaatttgtaggttaaatattaatgagtttgatttctttagtaagggatgtatttttaacgctgcaaaacaaatcatatacaatgcttacgatgatttttcgactagatttcatacatctaaaagaaaatcaaataaaaattcattatttaccatagaaaaaataataactttaataccaatcttacaagacattgctgaacttgatgacgtatatgtaaggctagaaacaatgaaatctctcaaatcactcattaatattattacatttcttattgaggaaaacttaaataacatacacaaaagtactaaatataacgaattggaattaatattcaatcattctcttgaaatttttcagaagttggcaaactctgatattcttagccacaaaattctatcatgccatattattcctttaatactggagcagaaaaggctttctgaaatttttgttgatgaaaaaaacattttacttgctaaatattcagatttttgtgtccatcctgcacctattttaagaaaacatgcatctaaagtgttcaatgctattttggaacaaattgaatttgaagaaagcattatcgaaattctcttatttccaatcattaggaatttctgttgcgatgagcaagaaggtgtgaggctaattgcaatagaaaatatagaggcatttttcttacaagttttcgaattggccaactctaataaagaatatattaaaaaagtaattattttttttgaaaagctacagccttttatatttattctttataatgatgtaagctggaggattagatctaatgtatcaaggccaataattaatatttactcaaaattgtctcgcttggttactttcggtgaagcagaaaatattgatattcatcgtatcaaagagcaatcaataattaaatccaataaagtaaaaaatgaaaatctaaaaattgtggataatgagaacgaatctcaaaatttagatatttcaatagatggggacaacttgtcttcgcatccttgcccaaaagataattcaagcgtgaacgatatagactatttaaataagctagcatttattctaactcaattattgatggatctagagtccgaaacgagaattaacaccctttcaaacgtactaaaaacaattgaagaacaaacaattgagtccaggcccactatcacagatgataaatcaccaatcccatatatttcaaaaattttgttttataatgtaattattcaacaaataaataattcaaatactctcctagcagatcaaaatgctgcagtaagaattaatctatcaagaataacaaaaattataatgctagttaagacaaactttgaaattgacgaatttatgaatattgaactcgaaaatgccttcgatcatttagttacaaaattgactcatgacgaggatgaccaggtgcggcaaagcgttgtattagctctctgctcgggagtctccgaatcaactgacattaactttttgataaaaaagataatcttaccccactcaagctcaatgattcaggataacttttggcgagttaggtactgctccattattcttctcattttatcgctttataaattgctatcatcgtactatgaggaagacgaaatttggaattgcaagattaattccaacaatgatgaaaacactaaagattttttgaattattatgaaggaactatagatgttttgatagagctcataattatgaatgttacagacaagacgagcatcattaggcagcttacttctattttctcattgccattattatcttcttggttcggacttgaatggacaaaaaaccaactttggagcaagaatatattaccaatgataacaaacgaaaaatcatatataatgcgaataactgggttactttcagctaattcaataatatcgggagtatgcattcgttcattcaaggagctgctagatgttattaagcacgtaatacagcttattttaattgtggcccctacgctagatccaggaaacgaagattatcagccttatcaagaacatttagaagtcattaatagtcaattgaccacgaatcaaagtgatcgaaatgaacttataaaaaataccgaattcttaaatagtggcttagcgcaaaataacatatttagcttgagctcacgaagcaatcatctaactgaataccttcctttgattaatgcttcaaatctaactttatctcttaatccatcagacaaaaaccataatactaggaaaaaatctaaaagtatctcattcgacttcagtgagttccaattagagattatttcagtggtcctacaatactctgtaaatgacatagttccaaacgttcgggcaaaagcgtttcaaacaattaactcgatcattgatcgaaatggattaggaagcttccagaaatcagtcattgaccaggtaaaatattcatatgaaaacgatctagattctgacgtcaggacttattgtcgatatatcttgaaaaaaaccatggacgaaataaatgaagattatgactaa

SEQ ID NO: 247 - DNA, 1923 bp, Cryptosporidium hominis
atggcttctttaggattgaaaatcgaaaatgaacatattaatgttgtatcaaatacaacaaattttattaaacagatagtagaggatgatctaaaaaatggtaaacataacaaaattgtcacaaggtttcctcctgaaccaaatggatttcttcatttaggacatgcaaaatcaatctgtttaaactatgggatagcaaagatttatgacggcagattccacctacgctatgatgacacaaacccgtattctgaagagcagcagtatatagacgcaatagaagaagatgttagatggctgggtgttgactggggcgaacataagtactacgcatccgattactttgaccaactgtatgagtgggcaaaaaagttaattcttgctgggaaggcatatgttgatcatcagacagtagaagaaattaggaaaaataggggagattcgaatactcctgcagtagaatctatatatagaaatcgttcaattaacgaaaatatggaactctttgagagaatgaaagatggaaaatgtgatgaaggtgaatgcgttttaagggcaaagatagatatgaaacatggaaatccaaatttacgtgacccgattttatataggattctcaaacagtctcatccccatactggggacaaatgggttatttatccaatgtatgactttgctcacggccaaagtgattcaatagagggaataactcatagtatttgtacattggagtttgagcttcatcgaccgttgtatgattggctacaatctgagctagaaattaccagaacaagacagattgaatttgcgcgattaaatatgacatatttggtactaagtaaaaggaaacttctgttactagttaatgaaaaacatgtagctggctgggacgaccctagaatgcccaccctctcggctgtaaggagaaaggggtaccctccacagtctctgtgggacttttgcgataagataggcgcttcaaaaagagatcaaatgatacatattcaactattagaggactgcgtgaaagaaaatttgcatagcatatgccaaagaagatttgcctgcattcaaccactaaaagtaatcattattaattgggatgagtgtttccaaaaagaaacagttgaaataactgtaaaaaaccatcctgatgataatattgacatgggcgaaagagtcctgtacttgacgagaaatttgtggattgaaaagagtgatttttggttcgatgaaaatcaagaaattgattctcaacaaccacctggtgattttaaaaggctatttattggcggttcagttagactaaagtattcatatgcaatcacatgcaagaatgctataattgatacagatactaaggaagtaaaagaagtacattgcattattcattcctctgataatgaaaatgattcaaatgttaacaagagaaaattggctgcgatacattggttgtctacaagtaatgttactaatgttgaattcaggctttatggccgtctttttacgcttcctgagcctgaaaaccagggtaaagattggaggcaattcattaataacaagagtcttgtagtaatacatggcttttcagaaaagaacttattgaatgatgaattttttaatagtaaaggagaaataaaaatgaatagataccaattcgaaagaataggctacttcacaagagatattgttgattctaaacgagagaatgacaagatcaatctcgtctacaatctaaccgtacagcttggagaatctccagacctattaatcaaaatgctcactgaatcgggagctagggaaaacactaaagacattgaaaggaggaatgcctatcacactaacagggaaaaaattgcagctgagagagcagcaagaaagttagctaaagaagccaaaaaagtgcagaaaaataatttatga

SEQ ID NO: 248 - DNA, 846 bp, Cryptosporidium hominis
atggatagatcattttggacaaacattttatttaagcacacaaatccagaaaatttatatgagaatgttttagtaataactcattcaatattattagaccttggatttattccagttaaatccattaagggtgaagatgacgaaatagataataacctagatcacacaagcattagcgaagagtttggagttccaataaattcacgggacgatggtatttcaatagagttattgccttcaaactggaggtcgaaaagcaaaaaaaatagactattttatataagcaaaatttgctccaaaaagatcgacaaagtaataccggaattaatttttgacttaaactcttctgaaacatcggttcaattattagtgaagagcaatcccataggagaagccatgaaattggaatttccctttaaaatatcagaagaccacagtactaatgaatctttgatgtttgaattatcaagtttgattagaaatgaaattgatggattccttagtaaaagtagaatttatactaacaattcgaaaagtaatacaaaagaagggcataaaattcctataataaaatgtgggcctttattagaaactgaaaggagttttgaagaatatattggaaacaattttcgcaagagcgttgaccctttaattgatagtaatggtgttagaggaagcttagtagggccagaaagcattattttcaaaaaccaaccaaaaatattcggtaaaccaaaaaatattcccatctcttccattccaggcgggactactatccctgataatgatatgtttttccccccaggaaataataatagcaactatatgtttaattttcgtgaataa

SEQ ID NO: 249 - DNA, 1296 bp, Cryptosporidium hominis
atgcgcgatgagattaatcaaataatggaatccagacaggaaataaatgagcaatttaatttaaattacgatgatcaaaatttacagaataaattagataaaattaaggccagcttacttagaccggaatataaaataaaggcaatttaccctgaagcagtcagaatgttgttattatttatttatggccatactacttctttgcgaggagcaaatccatatttaattctaacagtattacatgaagcaagaaggtttaaagtgcaattgctagaggaagaattgtttcaaatgttaaattctccattgaatattgatataatcgttcagatgtcttcagttgcagaatcattggaaatggagggattgatagagctaacagtttatctattagcagattgcgcacaagctctttttaaagggcctcatttagcacttggccctgacgtattgttgaaagtgttaaagagcgaaaggatcattatgggagagattgatatattcttggcattaaagttatacttagtccagagagaaagcagcatgggcttactttcaaataaaagaaaaaactctctagaatttttaaaaaacattagatttgaacaaatggcacctcatgatttgcttaaaatccgaacaaaagagctagattcactattattagatgcaacacttaataagttgttgggaaatgagggtagtgggcgtttggtgccttggaaggaaaataacgagtttacaacaaatacacatttaggtctttatcctatctcactcgcaagaaggacatcagtatcgggtaaatacaagtgggcatggacaattggcgattacagacttgtatcagacatgatttggcaggtacaggtgtgcaagacatacatgggtagaataaggataggagtatgctgtagggggtcatctgaagcgaaaaatacatcacaagtaccaaaaattttttactatgattttatggaaagatgttttggtagtgcttttcagactaatgacgtatataatctgagatctagaataaactatgaaaatgggaaaaaagaccaaataattcttaaaactaatatggtattgcaagttagactaaatattagtcgatacaacttgatattgacaattagcgatattacgaatccatcaaagatagagttcgagacaagtcacacattcgctcatggatgttccgtaaccaacgtagggattacaaaaagacctttcattgaaaccgcaaattttgtggagatgctcgacgatggggataaactaaaattaaaataa

SEQ ID NO: 250 - DNA, 2250 bp, Cryptosporidium hominis
atgcacatgcacgaatatttgcatgaaatattaaatctcattaaacccttttatgaaaacttcttaatgacattatttaataaaaacagaaataaaaaggaaatagggcatatagctaataacagtcaatattgttttgttgatgaaatgggtgttgaacaaggcccatttggttcgaacgaaatattgacttggattaggaatggattttttgatggtaaaggtgacctattgtttcgaaatttgacaagtagccctgcagaaagagtttcccttgaacaaatacttccagaactactaaatgaggctgaaatgaacttttcaaggaaaatatgccccaataaaacatcaagtattaagaaaaaacaagcggagcctattgaagtcaaagaaataacgttaattgatgaccaaattaaattattagaagagaatgatgaccaacataaggatttaatattaatagttaaaccatcattaaaagctacggatattcaagcgcaaatgcatacaacaaggtcaaatattacagcaattttcgtagatcaagtcaatgcaattaatacaaaaattatggggaatccattggaatttaaagatgaaaaatataacctttcagctccatattttgaaaattatgccgaacaattctttggaaatgaagaatttaaaagcaatgattcatttgcttttgcaccaatattaaagattaatgtgcatagcagtgtattggcaacctcgtcacctttacttaaaaatagtatgaaaacactattcgaagaacatttcaggcttagagaaagggttgcagcaggtaaatgcacaattgaagaaagagagcaaagcttgattaatccagttcttacaattgaatctgactgtccaattgcctttcaagcaataatacgttatatgtatggccatacatccgaagttctatcaatgaataaattgttgttagtatctatgtggaaagagtctaggcgttttatgttcaagaaactagaagatgagttattaatacatttattttctactaaactagatattgttgacttgattgaaatcgcagcagcggcagcaattttaaaattcccaaaattagtggatgaaattataacaatgattgcaagttgtgcaagttatatacttcaaggaccatatttagcactaagtgttgatgcttatgtaaaattaattaaaaataactatgtgatgatggacgaaatacaagtgttttatgcaacacagcattttatacaacaaaaagaaattgaagtcggagtctggacagaatcttttgaacaaagtgattataaaaaagagattgcaatatataaatttgtcagatatgatcaaatgtcagcggaagaattaaagtcaatacgcgtaaaaaaacttgatagtttaattttggatgcagcattaaagaagttgactaattgtgaagaagaaggcagacttaaaccatggctaccgaattcagagtataatgtaatttatagagacggtgagtatcctgtggggttagttagatctggaaagctaaatctaaatagcaatggattattccaatcaagatgggcatggacgacaggagactcgagattgattagcgaaatgacatttgcatttaaggtattgaagtctttcagaggaaagcttagacttggggtttgctgtactgggaaacctgtgataacagaaactcaaaatattcgaatgtcgaaggttttttattatgatttttcggaaaaagagtttgtttccgcatttttgggtagtaatatttttcaatgcacttcaaggattagatcatcagttattaaaagggagaatattaaagttaataacttcaggtttggtaactcaatatggaaaactaataaagattctaaaattaatgagatgccgggcacaaagcttcgaaggtctactagtgaagataatgttcaagatttatataaacaaactatagcatttgaaagccgcatagaaaaaggtcaaatgtaccatttggtagtttcaattcatgattattccgttttattaaggatcgaaagtattgattgcggaacttacatcgaaaattattatgatcacgggtttcttgtggaaagacttgaagttagtaaaaagccttatatagaaacgaagatatttattgaaatgctggatccaggagattcgcttggtataccatcgtttttaactataacaaggcaacaaaaaaccaatagatctaaataa

SEQ ID NO: 251 - DNA, 639 bp, Cryptosporidium hominis
atggctgcagatatttatttttattggcaagaactaggtatgaaagacgaaaatttgtatcatgcatataaattaggaactaaatcaatggaaaactttgtagcaccaactacagcattgttccccgaaattaacttcaattctcttataaattgcattcatagcgtactttcagatcaaataaatgattctttctctgatagttttatcattgattcactacttagtagggagacaattgaacaaatagttggtcaattaacccttaattcacaaggattaaatatttggggtcttcatctttcaggtaagttagataatggaaacatatctgataatgaacctacaattggaattattaaaggtgcgtgtatatgcgtaatacaatcatgttttaaccatagttgtgacccgaattgccatgtatatactatagatgacagcacaatatatgttacaacaaatagagatgttatgaagggggaggaactaactatttcatatgttgataacactcttccattggctgaacgaacaagccttatccagaattatcattttacatgcacttgcagactatgcaaaaaagaggaaaggtcaaatcatactgattctggaaaaaagaaaaggtttgagtaa

SEQ ID NO: 252 - DNA, 1170 bp, Cryptosporidium hominis
atgaaacctataatcggcaatggtcatttagaagaaacaaatttagaaaagaatttattaaataaacgtttattttcgaataaaatcaaaatatttggtaataaaccaacagaaaaagaaataatcgataacttagagcgattatttgacagtttcagcaagaaccttcttactgatactttaattgatttaaatactgttttgagttctgcggaaaatacagcaaacgaatttgatcaatatcctagggaatcagattttttaaataaagatagcagctcaaatatttatcacgatgataatgtcatacctttattggaaaatctgggtgtgcaagtatttttaaatcgagataattgcgattcacatagaaatttatgggactctttaggaggatatcaagatgttaaacgtcaaatcgaggaacacatactattaagtttcaaatatccagatgttcttgataagattgttaatggaacaagggcgcaaagtaattcaaacaacaggcctaaattaatcttatttgaaggtccgccaggaactggtaagacaacttctgctaaaataattggtaattcaattcaagtgcctctaatatatgtttcactcgaaaatattgtctcaaaatggtatggggaaagtgaaaccaagctagctcagatcttcgatattgcaaaaaaatttaatgaagggtgtataatatttattgatgaaattgacactttggcatcttcaagagataaaacgtttagtatgcatgaaggttcaaaaaaaatactctctgtgttattgagaaagttggatggttttgatacattaaattcaaagactctcttgatttgcgcaacaaatcgtagaagagatattgatgaagcgtttctaaatagagtcgatacaactgtactatttaatctaccgaatgaaaatgaaagggaactgattttcaaacagtatgcaaaacatttaacatttgaagaacgaatgatgcttgcgaaaatgtcaaaaaagttatctggaaggtcaattcgtcacgtttgcctagaagcagaaagggagtgggcttccatgattttgaaaaagaaggaaaaaggcgaataccaacgggatgaaattgagctacctacagttgagatctataaagaagcattaaaaaaaagggttagctag

SEQ ID NO: 253 - DNA, 675 bp, Cryptosporidium hominis
atgattaaattatctgcttttacatccttcatgctagcaaatttaggtgaatttggatttgtgttagcgtcaaagggaatatcacttggaataatatccagaaaagtctaccttattcttgtagcaactactgtaatttcgcttttatctaccccaattattcttaggatattctctatcattctgaaaagaaggaattcaaatattccatcaaatgaaaataactataaaaaatttaatgttaaaaataatgaaatcacctcaattaaacagaagttcaatttttcattaggtagttcgttctataatgcaaataaaagaagagcatttaacataacaaacattataaaaaatttgggtatttttagtggaaatagtcacagcttagattcttcaacaaaggattataaatttgatatatatattagaaataattatttgaattctcgttttcaagaggacagaatttcgtattcaaatgtctttgaaaattcaagagctaatccaaacactgacttctcattaaatgaaaatgaattggaagatctaagtcaagatgttgtttctaatgaatcaaagtttgggtgtaaaacttcaagtattagtttggagaaaatagacgaatttacacttgctcatgtcactaatttgggcaactcgtcctcaaaaatgtag

SEQ ID NO: 254 - DNA, 1377 bp, Cryptosporidium hominis
atggatgacttaaaaaccattgttttgagacaaaatgaaattctaaaaaaactagaaactgcattatcaaatgcaattattagaattgaaagcattgagaggctgtattgtaataaggagaataacagcgttgcggataatttatcactcattttgcccaaagaaactgactacggcctaatgaaaaacaactcttgtaaatcaaaggacttaaataaagaaattggtaattttgattttaatgcagttaattctgcttttaaattaattccaatcgactttttaaaaatggattttaataatcaccctattaatttgattaataatagtaatgataagaattcacattttatcaagaatctaaatagtaataagtttgtggtgaactccaatttttatcattctgttataaacacagattttgatcatcaacgactagaagagttatcagaaaacatgtttgataatacatccacaaatattacttcaaaactaccagaactagaaactaatatcaaacatgaaaatcaagagcttgaggttttttgggaagataaagaaaactattcgaatgcctcaaataacaattgtaaacttcaaatatgcatatgcgagaatgaatcaaaatctgatgataaagaattttttccaaaagaaacactcaattttatagcaaataagctagatatgtttaatgtgttctacaacggaaacgaaaatcacattctttctaactgtataggaaaaaacgcactaaatattaaatcatcaaataaactatatatttttgacgaagaagataattctagtatgaggcttgatgatcctctagatttagagattgcagaaaacgaattttactacttaaaggggcatattaaaagaagttctacaagagatcgtcctagaagctctggcctagataactgtcacctctttaattgtctatatcccaaaacaagagagatcaagaatagctgcgataatattgacaaattaggagtttattctagcaatcagctaaccccagtagataacagttatttaataagagaaataaagtaccacaagccctatgaaaagattgtagggtatgtacaaattccttacaatgcatttttaagtagatcttttgaaagttctggtcacgataagattaagaacaaaactcctttgaaagaagtaaattatttagattcgcacaacgtacataaaaagatcagaagttcttacgaaaaacgtaatattttttcaagtaatatttatcaatataataggcagatcgcccatattaaagttaactgccccattttttatcaatttttttgttttcaacgataccctattttaattttaaggccgcttttcagtaattaa

SEQ ID NO: 255 - DNA, 360 bp, Cryptosporidium hominis
atgttgttagttgatagaataagtaatcttgaggagaaggttaatgaacaaaatgaagcaattaaaaaaattgctttatatgcactagagatactcgatgaaaacgacaggctttggaaacacattatgaaagatattactatgaagcataacaggtcttccccacaaaatataaacgaacctatttttagatttagatcaaaaaccccccctcctctaaaagagccgaatcttccagagaaagaacaatcatttaaggttataagaggaactgaaaagtttaataacgatgtgtttttatcaatattaacaaaggaaataggtcaaaggaaagtttttacaaaaaatggcaaaaaataa

SEQ ID NO: 256 - DNA, 642 bp, Cryptosporidium hominis
atggaaaccaatcccgaagagagtaaccaattggttaatacaagcgctgaagtaattagaacataccttaataaaattgtaaccaatgataacttggatacacttacaccaaaaaaagtcagagaagagttggaaaaagctcttgggcttcctttggatagcttaaaaccaaaaaaaaaccaaataaatgacttaatagacgccattattttagaaataaaagaaaaaaattctaccaattctccaattgagcaaataacgaacaatgtatcaaatgttaattataaagatgaagaaaccaatgccaataacgaggaggaacataacggcttaaatataaacatcccagaaataactaaacaaaatggaaaagcaacaaagagaaagcaaatttcaatgtcgattgaggaatttctagaaaaatcccaaacgctaagcctaagtatcaatggttcaagcgaaaaacttgctatttctccgagacaatttagcacaggaagtgttggttggtactacggaggcaaagtcccacttccggttggagacgatttggaagtcttgtgtcaaatttcagtcaattgtacagtcgtaggtagcaaaacgtggtcccaaaacacatccaaaaagtcgaaaattaagtga

SEQ ID NO: 257 - DNA, 1197 bp, Cryptosporidium hominis
atgggctctttggacaagttaggaattatcggagtgttagatagtgcaatttggagcgtagcatctcatccaaaggatagaattattgcatcatgcggtagtagcatagttgtctggatggatacaaagttaaaaaaccacaagtggtaccaagaaatagaaattgtaaataaatgttctatggccggaaatagttgggttaaagcctatgaatttggaagtttggaacataagagactaattagaaagattgcttggtcaccatgcggaggtatgatcatttccgcgagtttcgatagctcaatttcagtttgggaatttgtatctagggatattggatgggcttgtatttgcaagattcttggccctgaaagcgaagtaaaatgcgttgattggagtccttttaataattttgtggctgcttgttgtagagatagagcaatttggtttttttcattggatattggcgaaaatagaaaattgggaacacctatagaatatgattgtattggagtagtaactgcgcatacaaatgacataaagaagattaagtggcatccaactattcctatggtattattatcatgctcatatgataatacaataatcgcttgggcgccttcttctcagttattaggccacgatgaagttaaaagcttagaatgggttaagttatacacgctcaatgggcattcttcaactgtttgggattttacttatagccccaatggtgaatttcttttatcttgttcagatgattcctcgattgttctatggaacagtaatcaagggaatgaaaataaatttaaaaatttgaactcagtaaactttgcactaactgatacttttaaaatgattttttacaatacaccgaatacaaagaggctttcaaaatatattcaaattgaccaagcaaattcattcataaataattatgataaagagttgtatagctatcctatttattcaattgagtggtgtaattatattaattgtatcattgtttcatcagcagacaaaagcctgcatttattttccgttactgattcaaaaagattgaaacatatttgtgagaaaccaaatgctcataacagcgaaataaactcggtttcttggttaaacgacgataaaaaaggagaatttatttcggcaggagatgatggagagattgctttgtggagatttgattttgaataa

SEQ ID NO: 258 - DNA, 948 bp, Cryptosporidium hominis
atgtggatcaacaagttaataagtgtgatacttcaaataataattgcgattaagctatcagttggacgcattacaattaatgttcacaatacaaaggatgaaaatggatattattttattaatgtttttgttgggaatccgcctcaaaagcaaactcttatacttgattctggcagctcccaaattagttttacatgtataacatgcctaaattgcggttcccacgaatatcccccgtttgatataatgaaatcaataactggaaagaattgtaatagaaaattactaggaggtgaaaaatgtaaatatttccatcgtttcaatgaaggaagtgttatttccgggaaatatttttctgatactttaaggtttgaagaagtccaacaaaattctggaattattaaggatcactttgaaattaaatatgattatttaggttgtaatgagctagaaactaaaaaaatttaccgtcaacgcgcaactggagtatttggtattgggctaaaatcaagtttggatgaacatgcaaacattattaattctttattaacttctttagaaagtaatataaatataaaaggctctaataatcttgttgtttcaatttgcctattgcactcaggtggaaggattgtaattgaggaacatgatgaaaaaataaccaataggaattcaaatttttcagaaaataaacgcaatcatgtttattgggttccaattatttacccatcgaatgtatataaagtgagtttggaagggctatcaattggaagtggaaaattcagtttattggaagaaaaaacatctctttttgctattattgatgtaggttcaacctattcgtttttcccgtctaatttatacaacaaaataatcaatcaattctctaaactctgtgaattgctgaataaactcaatattaacagatgtattacaattaatcaataa

SEQ ID NO: 259 - DNA, 387 bp, Cryptosporidium hominis
atgacgattggaattccattaaagcttttatatgaagggcttgggcatattgttacaatagaattaaagtcgggcgacctttatagagggacattaacacatgttgaagataatatgaactgtatgttggaacatgtcaacgcaactatgagagatggcaaaccagtttctcttgaacagtgttatcttagaggaagccaaattagattctgcatacttccagatatgttaaagaatgcccctatgtttaagttagctgcgaatgcaaaaaatagagctagtgtattaggagcagctggaaacaaaaaggcatttgcagcaagatttatatctagaggaactagtagaggaagatctggtagaggattagcagttcagaattattaa

SEQ ID NO: 260 - DNA, 435 bp, Cryptosporidium hominis
atgtcacttccttcgtgcctttttgaagatagatttgttattaacagcgtagatagcggaaagtttgatcgaattggaaggataagaggtagaagtgttggctttgatgcagatttgattttagatataaataatgaactatttcctgttagagaaaaagagagcctatacatcggactatcatcccaagtttcagtaaatcctaatgatattgtatgggataactctggacctcaaactcttatggaccaatatgactatgtaatgtatgggaaaatatatcgtgtagaagaaaagcaatcagatagaagaagcctttatgcatcattcggtggtctcctaatgtctctaacagcagacaaaaacttggtaggcgacttctcactcgacatgaggttatactgcctagttaggagatctgaagatatcatctaa

SEQ ID NO: 261 - DNA, 558 bp, Cryptosporidium hominis
atggatagtatattttataggtttcaaacagcatttaaactccttgggttagaagttggggccagtaccaaagaaattaaatcatctttccgtagcttggcaaagaaagttcatccggacaaaaatagggggaagcacgagaaatcagctcatgaaagtttcacaaagttgagagattcttatgtgcttttgtgcaatgaaatagagagaagacgattcgagaaggaatatttgtcattgaatgacagtaatacagttcaacaaaaaagtaggcaagactcttactccaatcgttcattaactgtgaatacctccaaaacagatggactgttgaagaaggaaaaactcgatagaatggatctagagttacttcgtagagaatcaatacacttagttaatgcattcaaagactattttgaaccaaaagttgttaaggaatacaagagaaacaaacaaaatttgaaatgggcactgaatcacgcacgtatagataaaataattgataggttcagtgagtttgaaaaaatagttttatttaaactcgcacacattatatga

SEQ ID NO: 262 - DNA, 1992 bp, Cryptosporidium hominis
atggctctgcaagatacagcttcaactgcggggatactagcagagttgaataatagattaacctcatatgagagcacaatacgtgaattaaggtcaaaaaatagggattttgtgaataggttaagagacaaccaacaaattagaaaagatttatgtatcaaagttaatagtttgcaaaatgacctggaaaaaagagataaagaattgaaagcgcaaaaggaacaaaataaacaacttaaaaaaagagttgcaaatttaaacgagttaaattccaattaccaaaataaaattgagcaactcaaatctgtttgtgaaaaattacgcaataatgcaaaaaatactgaattaaatttctcggaggatctaaactcattaaataccgaaaatacaaatatatcatcaattaataatatcaatgaaaaaagattattcaaaaatacgaatgacaataacaatatcaattgtaaaagcacagaaaattgcagcaaaaatgcctcatcaagttcaagtgtattaaatgaaactactaatattaatcttcaatcagcattgcaatcaaaccaaaataagtcactcttagttaagaaaggcgatttaaagttctcagttgaagaaataaatgatttgaatatgaaatatattcctgttcctgatgatccaatagacagagcaattgcaacctttacaaatagcagggaaaacaaaattctttttactagggttaaacaaggcacatatgtttatggaaggctaatggttgaggcaaaacttgtaacaaaaccaggagttgacaaaaacaaacctttgctacgtattgtatctagagggaagctttatactcttgcggatttcgtaaatacacacgaaaacgaagaacttaataatatcgaggatagtatacgaaatcaaaatagtaatttagtatcagatggccaagcgttggtggtagcttctccccttaataaatttagaacaactcaagttttaactccatcttcaccaataaagattacagcttcacctttgcaacaaaattctgcaaattcggtggcatcagctacgagcattcagcattacatgcaaagcccactatcatatacttctaataggattcccattattgacccaaaacataatcaaggagttaatttacaaaattacatggttaattatcccaataatacccatgagatgatgttgtcagcgcaaaatgcaaactcaattgttacaccaacatattataataatataaatgggatgcatcagcttagtcctatcaatcataaaaacgcatcctttatgcaattacaatctattgttccacaacaacagtttccttactaccaccatttaactgaaagttcaaatttaaataatcaatttaaccaaaatttaagttattcaaaatcaaatattccagtacttgcgcctccgcctgttgcagaatatatgcccgtgacaacacctattattatggcaaggcagccgatgaatgcattaaactactcaaataatacttctggtattcaacaaatttcaactcaaaatatctcacaaataggaaccaagtctaatgaaaccaaacctctatcagtaagtaataagttagagtgtaatattcaacaagaagaaacagaagtaaaggatttaaataattcattgtcactttattcaatttcaaacacgaaccagcagcaatatcagtcattagaaagtactaatattcaaaacacaaatgtagtacatcattcaaataagaatgaaacaagttcaacaaaagatattggtaattattcacaccttgaagatgatttaactttaaataaaaataactcattaactcaaaaaagtcctattaaacagacatcatctccaataaaatcagtaagtgcttccactattggagaatggtataggcaggctaatattatgaaaagatgtaatagttatagttgtgaaaatttttctgttacatctaataagaatgcttag

SEQ ID NO: 263 - DNA, 2100 bp, Cryptosporidium hominis
atgctcaatagttataatgcttttttttcagaatcaaacttcttgaaaaataacgaaatcgtctttaatgaagaagttgataattttaaggaaattccggaattttcgagagatataccagaaaaacattacagttcctcacattttattcaatttaacggaaaacaaatattaaggacaaaatcattgttctacaaggatcattttcttagttcaaagacaataaatatacctggaatcaagcctaaaggatttaatagtgctctaatttcgtccaagaaaataagaaatatcttaatattgaaatcaaaaaaagaatctaatattaaattgttacaaaaatatgaacaatttaccatggaaaaaaatcataaatttaaatttaacaaaaatacaatgttgatattaacaatattcttttttataaacattgtttcaaaggccttcataaatatattaatttttggattttcgttaattaacattaattcaatgagttattataattgttttcatgaatttttgaaaattattttgtcttcagatgatcctatttcagttattaatgatattgagataagaaaaaatagatattgtttatatcttttcaaagaaatatattggaaaagaagtaaagttacaatccattatctaactttaattcactttctcaatttattactcttttttggaatttcaaacaacttgcattataccgttggaattagagtattaatgaacaagaatctgcttattattacgatattgtttccaattttatataatattattaatttttcaaattttaatattaacaaaaccaaatattcaaatctcggatgcaattcatttgattattattattacttgaataaaagcaactcattaccatggttcaaactccaaatatttaaactattaaaacttaaacaggaaaatctcaaagaattttctagttttaaagtgaatttactgttaaattcgttcattttatcgattgtagtttcatttctatactttttattcaattataaaaagaatgaaaataatcaacagctgacaattgatttaataacacttctaccaatcatattttttttaattcaatctattcatttccatattactcaagtatcaaaaactaatacctctcataaactcaatctttatagttacataagatggttaaaaacatcaatgcagaaagcctattattttccaatttatataaataaatcagcaagttcaacaactccaaaaactaatactagcttttcgtcaaataaaagaaatagtattttatatgaagatggatatgaactttcaacaccaatatcaggagattctctgaaagttgacccgataatttctattagttcgacaaaaattcatttgagctctaatattgtattaattctgatcaatcctcttttatttctagataattctttgacatttggatatggaaaatcgcctctatttccaattaagcaattaaagacagtaaagattaataactttgatagaattgcagtaatttccaaccataatttaatatcatcatattggacaattaatatggttttagatccgaaaggcatgtatacaaatgacaataaaagccttttgcatacattaaaattattagacattttccctaatgtacttgacaattttgatcagaatgtaattttgaacatgccagtacgagaatatttagaattttttaattctcaagttgttggtggcgaagcgtctgttaccggtgatatcaaaattacaaattttgaacgcgatattagatcacaagatttgaataaattagagcaacacataagtaaagcagaagaaaacttacgtgatacaatttatattaaaaagttattgctttttggacattttgcactttattctatgtactacagagaactaattttacacttagattataatatggatcttaatgtttggatttcactagtcaaacaattttttgataacgaggaatctttaattaataatataataattatttcaacagaagcagatttaccaaatattattgaaactgaaactagattgtataatgacgagaagtaa

SEQ ID NO: 264 - DNA, 1323 bp, Cryptosporidium hominis
atgaggtctgaaagactaaataaaattattcaaggtcatgcaagtaactctagtaataacataacattatatggtgaaaattgtcgtaaattggttaatcaaggtaatttacaagtcatgaattcacaagatatgaagaatgcaggtgttattacgaataaaccaatcacaagaagtatgacatcatccgtagggaacgtaattaatatatcaaacgcatccatgggcaaccaaaaacactcgagtaaattgactgatgctaattccaaaaattcaaatgctgcgaagctaggcagcaaggcaattcccggtttgtcatataatgaaaaattcaatggtaaagaaagtcctactaataaggaaaatgttgttaatcctaacacattcgcagaaaaacagttgaaaactgttggggcgcaatatactagtactttggaaaaggttgttaatgtagatatggataatactgatgcttcatttttttcagaatatgcagaggcaatatatcagacatcaagagacctcgagtctaaaaaagaaccattgttattcacagcatcacaagtcgtctctgcgcagccaagcgtaggtaagcaaattttggaatggaaaagaagtggagtgaatctgttatttgggcttcaaatcacgtttaatgttcctgatgaggtaactgttattgccaattctatgttggatcgtattttaggccttaaacatttccaaagagcatcagaaatgacgcttgtgagtgccacatgcttctggatagcccttaaatatgaagctgcatacgtgcaaggtgaaaacttgaagataccgcctcttcctgcattgagtgatgtagcagaaaaatgtgggcttaatattgcggcaatattgttttgtgaaggggttgtgcttgatgctttagactggagtattgaatttccgaaaccaagtgattatattaagcgttattgcttagtatttaaagatcaatatactggcaataaagctactagagtcgaaagtttatcaatttatctctctcatctagctattcacgagcccgcgatgatgggggtttgtgcatcgaaacttgcatgcgcatgcttaatgttggcgcataaaatagaaggtgttgaagagagttgggcgcctgcagttgagtattacacaggatatacaagggattcactcaaagaattaacaaggtatatgataagtaatttgagaactattagaaatacggaaaatggagaaaatcatgcttctcctagtcactaccagaatgtcaggaagaaatggtggagttcatggggctccaatgagtggggataa

SEQ ID NO: 265 - DNA, 843 bp, Cryptosporidium hominis
atgaacattgtgcagaacatgaaaaagaattcagctggagttacattaaataaatctaaaaatttttcgagtcacaaatattcatttcaaggaactcaaaatcaggttgacaaaacagctgttattaaaggtattaattctcaaattcaagctaaaacaaatgatcaaattccaaaaaaaaatgtttcagaaaattccaatcttaatgattctgagttgaacactatttcttgttctaataataattcagaaagttctagcttagcttttaatagtacatttcatttaccatatagtttcaaggaagttccagaaccaaaaataagaagcgagctaatgaaaaaaaaaatttcaaaattagaatcttatctatctctctgcgaggatttatatctagggggtatttcaaaaacacaatcagtttctgaaatatttcaatcgttgataatttcccataatattgaccatgaagaacaattcaatgcattcttaaaaaggcagtcgattaataatggcttcacaaagtcaagtacaaaagcaaactcaaaaaactctaatttgcaagaaccgattacaaacgcagagaatattatatctcctttacagctactaacgcatccattcagaaacaaagaagtaattgacttatggggcccacatgaagtaatcctctttgagtgcggtgtttgtaagtatggtaaggaattcgacaaaattcaaagaataattaaaacaaagactacaaaagaaatagttgatttttattattgtatttggaaaagaacgagtagatataaggcttggaaaagtaatagacaactttctgaatatattttttcttaa

SEQ ID NO: 266 - DNA, 546 bp, Cryptosporidium hominis
atggaagcatgcctttttgatgttcaatcgttggtaaagacaattcaaagcctgcagttaagcaaggctaacaaaaaaaatggcgagggacaatttttaacgtgcatgatttcaacgcaaggaatcaaattgagcaatagcactttgagcaaagacgtttattgctgctcttggctgaggaaaaatattttcaaaaagtatctatacgaggcaagccaaacaaattgttcacgcttcgagatttgtttgggtacaattttaaattgcattcaagtgtttggtttagatgcaaagatggttattttaacctatgatcatgttagcctgcatttgagcattacagatgatgatggcgctgtcactgattgtagcttatgcacctataacatttctgaggaaactgatgaattttattattctaattttttagattgcaaaaatgttgcaatttttgatttggattatgtgacaatgttcccaatcatattaagagagctattaaaagatctttgtgatgttgggagatctgaaagcaaggtaagttaa

SEQ ID NO: 267 - DNA, 1686 bp, Cryptosporidium hominis
atgaatcaattaaacaaatctcactcgaaaggaagaataaaaactattattaaaagtgctccaaatgagctatggtacagtatattcgatcaagaaattacaaactcaataataaggcacccattcgtcgaccaatttacctggattaaaccaaactgtgaaaatgtgaatatagaagaaccgctaatgcaacaaattattggaccaaaattttatctatttgaggatgtttttcctaacagtattttatcaatcccatttattcaaaattcaattgtcaataataatggagtattcatttcactccctaacttgtcaattgaatccagttgtgcgttatctataattaataagcgaactaaagaatcgaatgaagaaaaatcaaagttgatggcaattattagaacgccaaacacactatttaaaaatgtactaaatgttgataagtttatgaaacaacccccacatatgaaaaaaacaaatcatttttcatttcataaaattgaattaagtgaaaagtcatattggaatgataaatcagagaatatgaataagatttcaggtaatttccaaggaagtaattttaattatgaatgcctcagctcaattgatatcctaaatgcccacgctgaagttcatccatttttctttaacccattacttaataattgcaaagatatcatttttccaaataatagtaaaataagtgatatatatgtatgtgtttgttgtaatagtggagataaaattcccaaggatttatgttactgtaacgcgatacaagaatctaaaaatccgccttttcagccatcattaaagaacttgtcatataacgccaaaggatcaggaaacaaccaattttatttttcattacaacagcaattcggctcctcactttttacaaaaacagactttctgtgctactttgaaaatgataagctgttgaatattgaaactgaagcgagacttttaaaaaatctcaaaactattctgtgtataaatggctccccaaatgtaaaaatcacaccgataaatgttaagtttatttcagaacgaattaacaataagttaattgatgaaaaaagatgcagtggtaaaggtttaagtgttattaccggaagtgatccctcgagcaaagactatttatcagatatgctaatatttattgatttgaatgctttagtatcgttaattttgacctctaccaacgcaaaaatttcaaatacacaaatttttgaacaaataatagagtatttcgatatattaatccatcaaaatctattttccgataaccaaaatttaattaatccattttatttttgggatttgagatttggtcaatctattgtttgtgataatgctcctaaaatatgtaacatattgaaatgtgtaccatttaaagaagcaccaaacgaggttattaaaataattggcttattaaggccaactatattgcaaagactcatttggtttgttgcaagtcaagtggcagctggagcatatttatggagtttattccacttaaaaggtgttgagagttctcctatttctattaactataagcctcattttattgatgaaaataaaaattctgttaatgatttgtacttattaatatttcgaatgaatgaagaaattagtattttgtgtatatctgttgttaattttaacgatgcaaatttatag

SEQ ID NO: 268 - DNA, 915 bp, Cryptosporidium hominis
atgagcgatttagacagacaaattgagcagttgagacgctgtgagccgattaaagaatctgaagtaaaattactatgtatgaaggctagagagattcttgtagaggaggcgaatgtgcaaagaattgatactccagtgacaatttgcggagatattcatggccaattttttgatctaatggagctttttaaagtcggtggtgaacttcctgacacaaattacttatttttaggtgatttcgttgacagaggatactacagtgtagaaacattcttgctcctcattgctcttaaagtcaggtatccagatagaattatgcttatcagaggaaaccatgaaacacgacaaatcacacaagtatatggattttacgatgaatgtctccgtaagtatgggagtgtaaacgtttggaggtattgtacagaaatatttgattatctctctcttgcttcattaattgaagaccgaattttatgcgttcatggggggttgtcccctagtattactacaattgatgaaatacgaagcctagatagaaagcaagaagttcctcatgacggttccatgtgcgaccttctttggtcagatccagaggaaataaatggatggggaataagcccaagaggagcaggatatatttttgggtcagatgtagtaaagagtttcaatcattgtaacgatattgaactgattacacgagctcatcagcttgctatggacggttataagtggtggtttgaacaaaatttagtcacagtttggagtgcgccaaattattgttatagatgcggaaatattgctactgtaatggagttagatgaacaattaaactaccactttaaaacatttgaggcagctcctgctgaacaaagaggaattcctgccaagagacctgctcctgactattttatttga

SEQ ID NO: 269 - DNA, 972 bp, Cryptosporidium hominis
atgaagaaaattaaattctttttaacagcaacttcatcgcttatatctgcaatagtaacttcttttttacttcatccgctagatgtagtaaggactagacagcaagtagcagcagtatccaatggtgcagtgatcgcacacccaacattgatatccacaatcaattttataatagatactgaaggagttattggattatataagggattaaacggccagttagttgcatctggagtctcatggtttatttttaggtacttttttgattttatccgttattttatagaagaaaataagtgttttgtgttcagctacgttgttaaaagtcaaacatactttgatcctttacaaatttctccgttctcaaattcaattgcaacaatcattgcaagtgtgttttcgactgctctggttcatccactttggttagttaaatccaggttagaaattcaatcagtaaatacaaagaaaaggggctggaagcaatattctgctgggctacatggcattgctgaatgcatgtatagtatttaccaaaaaaatggaatatgtggtttatattctgggttcattccaactttaatgttgattccgcatacattgatacaacttgtaatatatgacatatttcgaaatcaatcaattaattataattcaaaacatctttatctgagtaatctacgcttcttcatctttggattcatttcgaagttattagcatcagcattgacatacccactacaggttattagatccaggatgcaaatggctaaaatagaaaatatccaactaaaaacctacgatatcaatatattaaaattaagccataaagagtttgtcaactttgcaagggacaattatttcccaggactaatgactcatattcctaaagttagcatgcacagtggaataatgttcctaatttatgaagcaatgataaagttatttgaatcaatattgtcaatcaattag

SEQ ID NO: 270 - DNA, 1689 bp, Cryptosporidium hominis
atggagaaaataccattagaacttcttgcaacagttagcgagtatctacaaatggtagatatttttagtctattgcatctcaatagaggctttaactatctttggacaagcctagaatactggagcatagtatgtagggggagaagaaattatctgaatttacttgcaaatgagtttaattgtatcttagaagacttgaaatcatttagtttgaacaaaagtaaccaagacgacttagtagatagtgataataacgaatattttggatttaatttaaataaccttaaagccagttttaaacagatgggttgcaagacgaagtgcagtgataaatcaattttatggaagatttttgttaagagaagattaagaagattggacttagcacatttgacttctgtttttcaggatgttaaaatatacaaatacgataaaaaaattattgctgttttttcccctttaatagcaacaatttcacaacattttttagaaatttatgaacttagaaatgataattatttaggtagaaagtattttgataccacgcctgaaaagctaattgatataaaaacaaaattaatcacacgcctaaatatagacttacttcaaggtcaagagaatgttacatggaacaacattgagccgaagataagaacgaccaatatagtgaaatgggcattttttgataaaaacacaattctttgcgttacaaaagattatgggatttatattcatgaaatcagcaatttctcaaaaagaatagccttaaagaaaccgctggtaaacaagtatccaagtttaccaaaagtcgtcatttttgaaatatctggcagcctgcttgctatcggcttagaagatggagttgtagatatttggaagcttttatcttctgaacgtgcatgttctaacttgaaatgggaaaagtggtatttgacgcatcactgtacaatttattatgaacatacatattctcgaaaaaatttaattgatatttttgaagaaataccctcgcctttaacatgggtgaatatatctcataattgcaacttgctactggcaatttataaaggggttgtaaatgaaattcgaatattttcaattaacaatttagatttgaataataacccagcattaatgaacaaaattcctctctatagcgacattcaaatgtgccaaatagatccgaagggaaggtttgtaatttgcgttgattcgaacaaagaaattcaccccaaaactcgattttattccctttcatctggtaaacttcttctggtacaaaacttcagaattatttgtccattatttacctcttgcggacatttattgatcggcgcataccgtgcacacccgaacattccaattgaaaaatctcaaagtacaatgaaaatcattaaaacatcacctaaacatattaatagtgagtttacgagtagttattttatctctatttggagtattccgtctctaaaggaaatatattctttcaattgtggaaaatcagaacaaattataaatattcgtttttctaaaactcgtaactcgacgtctataattacaacgacaataaataaaaatagttcaaactatattgatggatcaataatcaagacatcttcaaatattcattttatttcacatgatttttttacaagcatgaaaccgatgaaattgccgcattttttctaa

SEQ ID NO: 271 - DNA, 660 bp, Cryptosporidium hominis
atgaaaacaattactgttgcgattgtattatctttggtttggatatatgtacacttttgttcaagattcgaaaacaagataaaagatattgcattactcaagcttagaggttctgtagaaatgggagatcaactaaagggtggtcctcactatacagggatgatggtaggaggtaggcatgttgggattgaacattctttggatcttggcgatttatcgcaagtatatcgctgcttgttttattctactcacccaggatcatgcaatccttcagggacggtaataaatccttgccatttttgtagaactgaagtggtttatgctgtcgcttccgcgaaatgccctggagacgagtcattccccccaagtttggctcctttatatatgtgggtcttgaaaccatatcatattagaaaaagattagggcatcaatatctttgcgctgtagagccgaatcctgcagctaaatatgcatctcgcccttcaaatgaatcaccgctttcatcagatgaaaactcatatccgctacctccagaaatcccattttcttcatcgaataatcaaaatgaatccttaagtgagagtacattgatgattatcatagggtcaggcgttttgctcacgctattactttgcggtatagggttgtacatggtttaa

SEQ ID NO: 272 - DNA, 1011 bp, Cryptosporidium hominis
atgaaatactacttgcctttcggagtattactcttaattatacaactttatctttcaaggtgttctgaatcttcggaagatgtagaaagcgaagaagttctttcgattcaagattcgtctgaattgaagaattgcagacaagctataagaagtatatcaggagctggttgtcatgaatttacattggacccttcactattgaaagtaatttcggaaatgagtaatccaggccaacaatatcgatttattgtaattgatggcgagcagcagaactatcagcaggctgatgatggtgattcatcaagccaagtaaattatttaagccaacaagttcagactccaatgcagatgccaatgccagttcaaatgtcaatgcaaatgccaatgcaaatgccaatgcaaatgccaatgcaaataccaacacaaatgcaaatacaaagaactaatcagggattacaattcggacatggtaatatggtacaatgggtaggtggaccagtcaactttgacaacatggttgactgtaagttctaccgtcaaaatccgggattttgtgtacctatgtctatctatactccttgttcgcgttgtaaggcgcgtgtgagaacaatttttagaactagttacaaggttagatgccctggccaggaatctttcccagcgcaattgaggccttactttgcttgggtgcctactagtcatcgaaacccaaagagagagaaaggaatattttccagatggagacgccagtttatgtgcattgtaatggcaatttccgatattccaaaggatgtttctttgttttggcagcattctcaaatcactttcgattctgcatatgaaacaccacaatatgttcctttacttctcggtccatatggagatcagtctactgcactgggatatgctgctggcacaaacttccttactactagcggcttaagttatcaaggggcacaacattatattcaaaatcaaaatttagaacgaaatggccacgaagcttcctaa

SEQ ID NO: 273 - DNA, 297 bp, Cryptosporidium hominis
atgttagatttccaatgcaaattactattggaaaaacttgaaagtttcccattagatatggaaaatcggcgaatagaattaaaaagctcacttaatcaaattgagatagagatattaataattgacgaaaatattcaacgccttgaatttgaaattcaagaaataacaaataaaatccaatttgccaacttggaaattaaaaatctggaaattgagcactgcaaaaggaaagattttttgaagaattctattaaagagttagaacaagatttcgaatttctctttcaaaataggtaa

SEQ ID NO: 274 - DNA, 780 bp, Cryptosporidium hominis
atgtttgatatatctaatcaagatatttcaaataaaacccttattcaatctcttttatcaattcgagaagaagaggctaatcttaatactaagatcgttaaatcaaatcaaattattgaggaattgaataacgtgataaaattgatgaataaacggaaacaacttgaatcatctaaaaaaaatattaatatacttaataataatatttattcactactaggaataagtaagctagagtgtttgacagaaactgactttggccataataaaagttttattcaagaattataccttaaaaaaaaaaatgaattggatgttcttcaaatagcaatcgagaaaatacgatgtgaaatatcaaaactgacaggcgaatataaggccaatgaaaactggctggaaaagttcacatgcgattcaaaaggctattcttctatagaggagttgtctgaaaagtacctaagtggagtttttgaacaacagacaatgagtttgtgtgttaaagatttggagaagtaccataaatctcttcagaaagcactaatgaagtttcacatagataaaatgacagaaattaatagaactataaaggagttatggaacattacttataaaggtcatgatattgactatatcgcaataaggagcgatgcagaggataatgaagaaaatttcactgtggaaaaaaaatcatcgcgaactccttccggaactaagtcatttaattatagagtagtaatgatacaaaatggtgtagaacttgacatgaaaggtaagatttaa

SEQ ID NO: 275 - DNA, 1170 bp, Cryptosporidium hominis
atgaacaatctatctgattatgcaaaatatattttaaatggggagttagttgcaataccgactgaaactgtgtatgggttgggcggaaatgcctacgacagatcctctatattaaaaattttcaagataaaaggaaggccaataaacaatcctttgatatgccatgtacacagcttcaagtttgcagaagataatgtttttgagttgtctgaaaggacaagagtcatatataaaattttgactgataagttttggccaggtccattaacagtaatttctaagaagagacgtaatattgtagatgaagtttcagtctcaggtaaagttggagttagatgccccaacaatcaattgacgttagacctgcttaagttgtcatccgtccctattgctgccccttcagcaaatcggtcaggccatataagtcccactagtcccctgcatgtatcaaaggaatttgatcaaagttatatgaatgaggtaggaataaaagtttggattttggatggaggtgaatgctgtagcgtaggagtagaatcaactgttttagagtattatgaagatggcaattttatttctatatttagatgcggtaaagttactaaaaatcaaatatgggaaactttgatcgataactgtagaaataatgaatggatcaaagacattaaaatatcgtattttggtagcaataactcatcacctaatagaaactacttatctcttcatgatacagtcgcaattagtcctggaatggatattaaacactactcgccaactatttgtactaaattaatatcatttatttcagatactcataaatgtacaggtatagatgttgatttaagaaacataatattgattgatattggatcaaagctttcatttcttaggtattatgtccgtcattatttttctttgtgtgacgattacgatttttcgtcagcatgcaaaaacttatttgcaactttacatcaagcagaggattttgctaatagcctcgatgatctttcttccgtctatattttcattactggatttgagacggaagataatatttcattggctctttgggatagagtttatagagcttcatgtggagagttgatttattgcaatttgaacgaaataaagattcaagataaatacattaaaagattttacaaagtataa

SEQ ID NO: 276 - DNA, 936 bp, Cryptosporidium hominis
atgaacccatttgattttcctattgtgattgatactggccagtttcaaacaagaataggtagttcaattaataagcttcctcagattattattgatacaatcttatttgaaaaaatagaagtaaaagaaataaagtttgataaaaaaattttttcagataaacttggaattaacgaacattgtattgaaacgaagtcactaagttcatcaaataattggaacccgcaaaaaaaatcacttcttgtgaatgactaccaggatattacacatcctttcaattatcttgatggacttgattggaatttgttagaaacgttttggactgacataatttcaagagaaatgtgttatgacactacgatgtgtcctgttttgctatctgaacctcacaacgcaccatttgactttcaggatcattcaatggagtttttttttgaatcgctttctgtgccttcattcaattgcatttctcaagaattactttcggttgatgcagttcaaagagggcttccaaatatttttcaaaaatcaaatagcaagggctcagttggaattatcgtgcattttggtgactcaagtattagaatacttcctattgcctctggatatttattatcggactatattggaattattaatttaggagggtattcaataacaaattcattatttgataactttaagacaaattttaaatcttcttctccaattacacacaaaaatattgacagcattaaatcgtatggcatttttgatggaatcatcaccaaaatggctattccatatatttgtgatgagataatctcggttgctagaaagtgcccagtcgactatttacgacttctattgaaaaatataatatttattggcggatcgtcaatcaactctctgctttccacctatttcaagaactattttaaggtacgttttaattga

SEQ ID NO: 277 - DNA, 1386 bp, Cryptosporidium hominis
atgattaatttcctatactccattttgtttagttgtattttaaatgttcgcctacttttctttattttcatagttgtaaatgcagcaaataacagtgatcaatgcataaatattctcaatagctgggatttacgacaaggaatggaaaacaaatgccccaactgggtggttgatgtgtgttggataatttatgatgtaaaggatggagagggattcaatctccaaagaaatgtatttgacaggatggcactagttgtctcgagtcttaatgaaatcatgtataaaaaaaacgagaataaatttgcagttctaattctgcccccattttgtaatatcgcccattggacttataattccaaacgaagattaccttggtcaacgttttttagcataaaacaaaatggattaccaacattggaatatgatatctacaagagattaactggtatagttaatataggtgctgaagtagtcgggttaaactttgactggaacaacaagtcacttcaatcaagtacttcaatagaatattataatagctttaaaatatcagaatcaagacatttgaattcaaagtgcttctttaacaattatgttagaaatgggaatgtagtttatggagggcgttgtgaattagtaaaaattagaggtcttatttgtctttctttttttaagttaatgagatttaaagaagtctcagaagaaatatataaaatattagagtcaaacaggaaagaaggaaaacttcacaattatttaatcaagcatacggaaggaattctcgttccatggccttgggaactaagcaaatatagagttctggatgtaattagctataataacaatataagaagatatgcaaatttatacatgtctgcaaatactttttttgaagaaaaaaaaccttatataagtgttcacttaagaagaaatgattttgtatttttaagaaatgatgatataccaacatttgatcaagttattgatagattattacagctttcaaaggatcttaaaacaaaacgtgttgtaatatccacagacagcaatgaatatgaaaaaaatgaattattggatatttttttgaaacacaatcttgatttacatattattaatattaaggatcatcttgatgatggaatcatttcagcagtaagtcaagtaatacttctgaacggtgaatattttattggaacaaaagaatcacgatttagtttttcagttatttgggactgtattttatcagtaatgaacgattttaaaaatgatatttcaaggaatttcaataaatgtaatgaggtattttgcggaaaagctaatgagaagagctcaatatgtagggaacacccagacagacttccaaaatttaatattgatgtcgcttaa

SEQ ID NO: 278 - DNA, 2748 bp, Cryptosporidium hominis
atgcaaaaaattaaaacgcaggatgatagcttatctcaagggggtgtaaatacgaattcagctctaacttttgaggaagtgaatagctcaatacctgcatttagagatgattttccagttaatgcaggcgaaattaaacagttaagaagagaagatttgttgaacgagcatagaaggaggcatttggagagctattataagagctctgcagagtggtctaattatgagaaacgtcaaaggaatgatgaagaacttgaagtcaaatcattgagttctttcatacatgacttaattttattatcaccaaagacaaaggaggaatatgaacatgtgataaatatacttaggaggcgtcataaagttgcaccaagcaaggcccaaattataagagtatatgaagaattagtttctcaaaaaggaatagagctttcaagcgataacattactatgttatttcaggaatatagttcaaaaaataatcaacctcaagttggaagtaacttagaaaaagctttgctttcaaagaaggctgttagaagtcagtcaggggtaatagttatcacaatattaacttcacccggtgcattctcttgcaaacatgattgccactattgcccaaatgaacctggacaacctagaagctatctttctacagaaccagcagtactgagagctaatcaaaattcgtttgatgctataaagcagtttagagatcgatcaattacacttaaaaacaatggacatattatagataaaattgaagtattagtactaggtgggacttggagtggatatcccaaagagtatcaaaacgcttttattcgtgacatttattatgctgcaaatactttcacaaataaaaataatatttatgataacagggactatatagataggggaaaactacctctttctgaagaagttgagttaaatcaaactgcagaatgcagaataattggtttaacattagaaacgaggccggattatattactctagatgaaatacttcagttacgggaatttggatgcactagggtacagctgggaattcaacatactgactattgggtcttaaaactcataaacagaggctgctatatgcgtcaaattgtaaagtcaattagactgcttaaagatactggatacaaagtcgatattcacttaatgccagatttaccgaatccttacgatcatacaagtactaatgaatttaatttggctccagatgaaagccatatattatcaaaaagaatcactttgcttaaaaacttgcaggcatatataggatttgataacgcacaaactttgggagttgtcaatgactatttgatgctttctaatgtattaagcgacccaaaacttcaatgtgatcaatggaagctttacccgtgcgaagttgtaccattttctaaaatagaagaatggtacgaaaataaggcctaccttccatacgcagaaatttttccagatacactttgctatttgttattatcttgtaaagttggtcttcatccttggattagagtcaatagagtcattagggatatacctaaccaaagcattattgcaggtaatagctgtacgaatttaaggcaaatgattcatgataagatgaaagctttagacttaaattgcagatgcctaagatgcagagagatcaaagataagcacattagcaacaaacaactaaatcaattaaatgcaaattcaaatggaagctttaatgacaaggaagaaaacggtaataaactaaaaaataaaaaaaataagaaagctaagaagcacaccaaaaataaagaaaacggtttaaatacgaaggatagggacattcaaattgtgttaagaataaggaaatatagtagctttgggggggctgaattttttatttctgttgaatcgaaggatgaactggatctttacggatttattcgtttaagagttagattcaaagatgaagaagtagtagctcaaaaccagtcaagttcaggaagtaaaaatgaatctgatatacatagcgagtacaacatggaagaattcattgaagacagtgaggaaattttagaaaagtttccagttttgaaagattcagcattaattagagagctacacatttatggaacagttgttccgcattacaataatgagaaagaagcggattctgcagtgcaacatagaggatttggtaaaactctgttgagagcagcagagtacttggctttaattcacggcttttctcgaattgtggttatttctggtgttggggtacgcgaatattacgccaataatggatacttccttcaggatacatacatggtaaaaaatattgatgcttcatcaaatattaatagtgaatttgatgtttattttttggattacaatttagaaactgatttatttaaaacactaaaatatattagatctttagagtgcagcaatcagtttaaagggcataattgcaataatattatacccggtatggctgaatataaagaaatgacgattgagaattatgctagcaccattaatgttgatatttataataatgctcttaaaattttgccagaaccagaaaataatattcaatataaaaatactaaagattcgaaggtcaagaatttattaaataacattaaatatttaatatttaataattttaacagccgattctcttggattgttggaatgagtatctttacttcatctatatttggcttaagttatttgaggtctaaaagaatgatggtttag

SEQ ID NO: 279 - DNA, 573 bp, Cryptosporidium hominis
atgtctaataaaagttcagaaagaaagacttttggaggatactataattctcataataatagaaggaaaaaaagagatttagtagtcagtaattgctcaaacacaaacggatcaagttctactgcatacaataaatactataataaggccaacagggatgatccaggagctttgattttaaagctattacataatggacgaaacattgaaacagcatctgtagttccgcaatccagcagttatattagaccgcaaagccgtactaagaattgtgaaagcgtggaaccgaacttcaagatgcaaagtgaagagccaataaatgttaattcagaaaatccaaatgcaacaaatgttaatttgtttgcaactccgcctcctaacagaaaaggaagatacagtgtcgcttcgtcgtatggaactaacaatccaaagtttgttaactattctaatagcggtggaaacaaatcgctacaatccagctcgtctaatccaacgaattttgctttacctatgtatatgagatctcctaatccagaaagcattccaatgccttgtggctttccaattggataa

SEQ ID NO: 280 - DNA, 951 bp, Cryptosporidium hominis
atgagtctgactgaaagagtcgaatgcatagctaaaataactgatttaacgcagttaaattactttatatgcgggaagactcattcagatattatagattttattaaattgttgagtgagagcattaaagggaaaatattagtgcagcaacacgaatatgaagaaaggggcaaagaacgatctgatatcggatttaactcaattataaacattcttaaattgttatcgaaattagattctaatattgatgaaatacctccaataaaacaaccgatgagatttggaaataaggcttttcaaacttggtatgacaaaacgaaccaaacatgcacatcttatatttctgatattctaaaggaaaattctgacgaatatttgcaagaggttaagagttattttgtagaatcatttggaaatagatccagagttgattatgggacaggacatgagcttaattttatcctttttcttatgtgtattcataggcttggggctttccaaaagaatgatcttcctgatcttatattggtcgtattctatagatatatccttttaatgagaagacttcagtcaatatatctactggagcctgctggatcaaggggtgtttggggactagatgattaccaatttctcccatttttattcggatctgctcagttaattaactcaaacgaactatttcctgtgcttacaaatcagatacttgatcgctctatattggaaatttactctgcaaaatcgttatatattaattctatacaacatattctcaatatgaagacaaacgtatattttgcagaatgctcccccattttatatagtttaacttccgttcccacttgggaaaaaatttactctggcatgatcaaaatgtatgtggcagagatattaaataaattccccgttgcacaacatatattatttggaaatttaattccatttaaataa

SEQ ID NO: 281 - DNA, 1191 bp, Cryptosporidium hominis
atgtcggatgtgatcttaagctcaggaataggaagccaatcttctagcatcattctggatattggtactcaatctattagagcaggatatggaggtgacgatttgccaaggagtgtagttcctacatgtattggaattcccaataaggaggttgatttaattgattcgaatcgactttccaataccatttttcctctcaaaccatgggagaagcgagactacattgaagttttacatccattacaatataatattcaagaaaaagcaattgaatttaatgaggaatacttaacaaaaattattcaagaattgtctttatcacaaaaatttacaaatagcacctcttcatttttaactaagcacaattacatttttgaaccactggatgacaggatgaatggccaaacacttttgatccctattcactcaacatcaaaccccaataattctattaaacttgcagaagttgcatttgaaaaacttgaagttgcatcgttatttacatcaagaaggccagtactttcttgttttgcttgtggtaggacttcagggattgtagttgacatcggtgcgtcagtatcaaatgtttcttgtgttcaagatggacactgtattcaagggagtattcaggagtatcctgttgcaggagactttttggataatgaaatttataaaaaaatacacaaggtaaacattattcctgaatttggaatattcaaaaatgaagataaaaatgggccaagtgaatatcatgtacccttaacaaatgttgatgaatcttacttaaattggggggtaatgcatgtaattagagaaattaagcattctagcctttttttcccgaatcctaattcaaataatgacaatgagtttcatctcccagatggtaacgtaattgacactacatctatacgtaacaccattccaaatttactttttaaatctggaaattctaatcaaggctacccaggcattgtacaaatggttataaattcaataactgaaacttcaaatatcaataaagaaatttcaaacattacttcatctattattcttgcaggaggaacaacattaattaatggatttgatgccaagttgcaccaaggaattatcgatcagagaccttcaataatatttaataattctgtaagtttccagaaatcaaattacaaaatttattcagcattttag

SEQ ID NO: 282 - DNA, 324 bp, Cryptosporidium hominis
atgtattccttaactaaaaatagagatcctatacaaattgaggggttttgtggtcaactcatttctgagacagaaaaaaaaagctataacggcaaaattgaacataactttaacccttatatgaataacggtggttcatgcgtagccgtagcaggggatgattttgttgtaatcgccgcagatacaagactcagtaaaatgtatagaatagcctcaagatcagtttctaaaacttgtcaattaacaaataagtgtatcttagcttgtagtggaatgcttgcagatataaatgcacttaggaagactttattagtaagtttctaa

SEQ ID NO: 283 - DNA, 1899 bp, Cryptosporidium hominis
atggaatcaattactaatgatatttttgatggattaagtaatgaaataactgttaaaaatgataatttcggagactttggtgtggaaatcggcgaaagaattgagtttccattgctcgtcattgtaaaacatttacaataccaaaatggtttaaaacataaggattttgcacaatatacacggtattgttctcgaaagcttcatcgattaagatctggactaaaaatgaaatgtggaaggagtaaatttcaaaaaagttatactgaatgtagtgactacacaaaccataaacacttactactgttaattcttttaatcgagagaaatttgagttcaggggctgatctagggtgtggaactactaaaaatgtcaatacaagactaaataaagtaaacaatagaggaagactgcatgaaatacgcaagcttaggagaggatgcaacttgtccaaactccttgtagaagttgccaagaatagatgcactcatagaagtattgttgaagttcaagcctaccaaagttatattctcggtaattattatttgaaatgttcaaattgggagaaaggtgcaattgaactgaacaagtctttgaagctctaccaacagcttaagctagatgtttcaatatttgaaaaatttaatattttgccccattataatatttctaaactatctaaatctgaatgtgtccaagcttatgatgatcaaatcatggaaatggcaccactaattcgactttgtttatatcattgtaagcgtcttgatatttcggttcatgtatgcgataatacagttaatgtgctaaaaaacaatgactcgttcaataattcaaatatgaaatttttttacaataataaagaatacaatgttccaatttcaaatttggaaatattactagtcgaattacaggaaaattataaagcagttaaggagtatattccttctggagacactgagaaaattctaaagcttccaggtaatgtagtaattgaattattctctgaaactttaatgtcttcaaccactttgagaaataaaattcacgaggaaatgacaaaagccagcgcaaataatgaaacttcagtaataaatagttgtcaatcaaatgaatgggttgcgttcgaatcttacactaaagaatttaattcatttgtttctatcgagagggatttaatatttgtatttcagttgatggaatacttcaataatcctgaattttacacgaaattgacttttcttaatgatgaacattgggtaaatatatcacatgaacttcagaattcaactgcaaaaaaaatcaattcttcaagatatcctgaagaaggagttcgtatctgtgacatagttaattacactgtttctgagatctcttctagcaacaaagccactcatatttcggatttaatagatattttggaaattgtaaataacaattgccgcagcttgtttttgtcacactgctttggacaaaaagggaaatttcaagaagcatttgtactttgcgacttggtgaagtcacgtcttgaaattaaggaaacgaattttaacaaaatctatctagacaaagatggaatatttcaaagaataattactctaattaaagaaatcaatattaatgttaatgatatggcagacaagtcatacaatatttacctttcaaacgccgcaacttatgaaactatacaaatcaaagcgatggattttaaaaattttaatgaaacccttaatgatgaagcaataagtccaagagttcttccgattccagtaaaaccaatcatgtttgatatagcttctgattttattttatccccagatttatcaaataaaattaaaaaaaatgggttagtgaacaaaattttctcgaaagctacttcaaaatttagattattcaaataa

SEQ ID NO: 284 - DNA, 879 bp, Cryptosporidium hominis
atgctttttaaaaagatttacaaatgtatatttagccatgaaatcgacattaatgaagctgttccatacgtagtttgtgcagtaatcaaagagccatggtctattctgtctctggatatttcttttaaagaaaagaaaaaaaattcaaagatcactataggtctatacaatatattacttttattattaatactgttggtttttttgctgattctattttcaggaggaataactattggacagatggcaccccctcctatttttatagggaatatctacggattacccataaaaacagactcattgaccatttcagcagacggaacatttattgcgactctaaagatgccagtatataataaaagtttgctgagtggtaggctctcaattagaaatataaattttgttcctgtttcaacaaaattcgtttgtactcctaacaagagcaataataatattttttcgcattctatattggatgaagacctatcaaatggcttcattttcccattaaataagaaattacctacagataatgataaaatactaatcgcaaagaaggtgacgctagtcacggaaaacaaagatctacgtcaattagaacatatattaggacgttatggcgaagcagaagcgaaattaggtgcctggctacctcctggaaagaacgaatttttaatgctaattaaaggtgatgtggactttgaaggtgcaaaaaaagttttgaacgagacattgggctcaaattgcataaacggggtagtgagaagttttgtagtggatgttcaattagattttaatatgaggtattttcttggatcaatatcgtatgtgcaacaagatattggatatgtactatttcctgcgtgcaataaatag

SEQ ID NO: 285 - DNA, 321 bp, Cryptosporidium hominis
atgaacttgagtaaatatggaaaaagaaagaggacagaagatttaggaatatatacatgcgaaaaaaaggagatagataaattttatgaatcccaatatgaatgcaataattcaggaattctattggttcccacgcaaaataatgagtttgaacagctgagtaactcagagttatttaataattcggaacttcaaaaagttacagttgacagaaatattgagaatatgcaagaagtttgtatttttgatgaaactttatcgaagaatttgttcgaagaagaaattgtgcgcaattcaacgcctactcctacaattatgtaa

SEQ ID NO: 286 - DNA, 1695 bp, Cryptosporidium hominis
atggaaggtggggtaataaacttgaaaaaagaaagaagctcagttagaacattcatcagattctgtccatctaaaaaaacaattatcgaagattcaaaagaatgtcaatgggtattcaacacaggagatcatggaaagtcgattagagcaagtagaaaatcatctatttccagaaccagaagttgtactgtcactgatgagatatttaaagaagatgcttgcaatagcgaaatttatagaaaaactatgttacagcagcatgctgttgatgtcttagatggaatctctacgaatataatagtttgcggacctcacaaaacaggtaaaaccaatttattaattggttctcaaagaagtattgggatagtgcttcaatcaatatatgatatttttgctgcaatacgatgttacacaaatggtattcatattaatgaaaaagggataaatactgagacaactggcaactttgatcgactttttgttgtcaaagcatctgtattagaaataggagaagactcttcaaactttaaattagataatgttcgtgatttaataaatccagaaaacccactacaattgattaaaaaattgggaggagaattaggttattctataaaaggtgaacatgaacatctatttgagaatgaggaaaaactagtggcatcaattttatctgctgtagcaagaaaaaaagttttagatgcgattcgtagagaaagagttaataccagaaagaaaaaaaaaactcctgagcaaatacaaaatacaatatttggtgaatttggagaaagatgggttaaagatgatatgattggtagcttgttgataactatttcagttgagtcagttgataagtcagaattggaaaataatataagtaagaatgaaaaaatagcaaactcaacccatgtaaactatggtaccttgcgattttttgaaatttcatcttgtattagcgcaagcccaaaattgaaagcagtaattccgcttttcggtttgctcgatttagcattcgagatcaggaaatattgttatacaaatgaaaaaagtaatagaatcaatattacgaatattagtagttatattgcttcaaccataattgattcaaatttaactataattggcacgttatctaggtttccttcagagaaaaagtgttgtattcgccctttaatagcaccttacgataatcaaacaactgttcaaccccattcaatttttgatacattgcaatttttggaatatatcggtaatagcatgaaatttcccatatatcctcaaagaaattgttttaaaaagccttttgttcaatcaaaactaatggaagtttgcaggaaaaatttaatgaatggctccaagaaaattcatagtaaaatgataattaaatcagaaagaggaatctggcaaagtgaaagtagtggaagagtaactagaattatccggctgcttacatttattaatcgttcaattgaaggttcaggaatattgagaattttgctgagtgggaatgaagatgatattattcgaatttattgccaaactcttatcggatccgccgctctcgacccccgaggctcccgccttcttttgctattcgcacccacgttcctccccactaccccacaccgtcctccaacctgtctcttccttctcatcctccccatccccccccttcttcgttcccggccttcctga

SEQ ID NO: 287 - DNA, 2097 bp, Cryptosporidium hominis
atgaaaaatcttgactttacaattgaaagacctaaatttgaagataataattttaaagagatttcagaaaacaaagctcctaataaatttggaaataacattaaatttgacgaagttttactttcatcaagtacaaacgaaagaaatgaaagtagtgagtctgatatagatattactaatatattcgattctacagcacttgaacgtaataaagataaattagataatgaagattttaatgtaaatctgtgcgaacaatttgataagtcaaataaatcaaagaaaaaaatatttattagcgaaaacgtaggcaacagtaataattatttgaatgttgacgaatacgttggcgaatcaaataattttaatgatcaaataaataaaggaataggccctgattcaaacctatttgatcctgtaaaacaatatgaaaaattactaaaaaaaactatttcgcttaataaactacaaaaatcgattatggaaagccaaaaaaatgtacttcaagatgaatctttatatgcaaatagtaatgctaatagcatgaatgattatatttctaagttagaagggaagaaaccttctaaccctctttcattagttaataaaaaagctattgaagctagtcaaaaagctattgaagctagtaaaaaagctattgaagctagtaaacatttatatgagagggaagtaaaccactcgagaggaaaaatacatgatcacatacctgcttcgaaaaactttccacaaatcgatatttatgcaccatcctatgactcagatattgaatatgacaaatttcacaacccagaagatatcgtatttgatttcaagtcatcaaacgaaagcgatgaagatcataaggaaagagttcttgaaagtcattataaaagcaacttcccccataataataaaagttgcccttgctgtgaccagctatcaaaaaggagtaagtgccgttgccattatgcggacgcatccgtaaatttcaatggaataagcgaaacatctgtgaatactgataaatctctgttcttatattatgaaccaggagcaggtaaaaatgaattaattaaaccaaatggcagaagttgggatatttttgttaatgttcccaagaagtttgcgaatgtaacaacccttggattcgaaaatgggaaaaaacttcaaagtgataaacaagagtttgagaatccttttgagaacgatgaaaatattgaagccccagattcgcaaataataagttcatatgaagctttttctgacaaagatatttcaaatattacatcagagtttgatcaaaattcttttcaaactaaaataaatcttgattcgttacaaagagaagctatagaaaacaataaattaagtgaaaaaaaggtgaattatgagagtaactcaaacatggaaaatgaaaatcaaataattaaaaatgatattttggacgaccttatggagattaaaagacaaacttcaaatctgaaacatcagttcatattggatcccaaattgtttaggcctctctatgaaagtgacaacccggataaatgtgatcgatcaataaagaaaattgatattgatcaagaattaaaaagtgttgagaaatattcttgttttgagcataactcaaatatagatagactatcttcatccgctaatagcaatgatttaaactttaattcaaacttcaattattcagattatcccaatttcaatttagaaaattcatctcaggaaaattcttttgaaggtgtaactccctacaactctaagattaatcagccttatattaatagttcttcaaataactattctgatgacaaatacttggaagaaatagaaatggaccttaacgaacaattgaataatttctctaagtatacgaatacaaatttgttaaatacacacctaagcgaaagcaatacagacagaagtattgaaattctcaaacaccaggaaattccaatagaaaacgttattcgagaaattggatgctgccatattaagtatattatgccatttccaaaagatctaaaaccaaagatatttaaaggaactagtaactttcagtttccctatttaagatcattatattaa

SEQ ID NO: 288 - DNA, 2484 bp, Cryptosporidium hominis
atggggaataaaacaaaaagaggaggcgataaatatgaggtatttggcgttgggggaattaaagttcaacaaatattagatttgaaaaatggagaatatgaagtatattacaaagtacataaatgtaacttagatgattataaggaaattaatattaaattatttgggcaatttatcaaaacccctgcattttatccagtatctaaagtcttattagatgaaaaaacaataaatacaaattatgagattgatcaaaataacttgttaaataaaactattttgaagttcgataatttgtctattgatattaaaccagcttatacactttcaatggtattcaaacactttaatgagatgaagaagatggggaatgagattgacatttcgatacccaacttggtcccatttccagaagaaaaagaaagcaaaactaatagagaaataattaagaggcttggaattttaaatggttcaaataacttcgaagtaaatgatgacatgattttaaatgataaaattagagctagtatattggttgattataaaaataatattttgaaaaatatcacaaataagctgattaagaatgaggagattttgaatgatctgtctaaagctattattctgcattgcgaaacaggtaaaaaacatgatagaaaacttgctaaagatgaaaaaaaactagagtctgaattggatgaaataacagattgccaacagagaatgtttgcgacgtattcttgtttacaacaaggtggtattgatagtttgccagtttcatttgaattggaagatcctggaaaagtgaagtcccgacagactaaagatagaaaattctacatagatacatataatttactagaaaagaagtttgaagaaattaatctaagaaaggaattatttgagaaaaaaagggatgaatatacacagaaattacatcgaacgttggcaacaagacagaagtctataataaaaactcaaaggagctataacagaatattggatgagttggacaaagtttattcacaattatcaaaaaaacaaactagaagacaagatttatataaaaatttgaaatcagattcacttaaagtatatgaaggactagagaatcaaaaagtattggatttccatttaaagaaaaatacagtaataacaatgaataatgaaagacacgaagttgataagcttggaaattatgatgacaataataataataataaaaggattactgggagggatagaaaatataacaattactcttgcttagtccccacagatcctgaaagccctgcgttttggtttgcagaagcatcatatcttagagatgaaaaggaaaaaatcaatcagtacaaaaaacatgatgatgattttaatataaataatctattaagtgacaatccacaaaaaattaaaaggtgggatttagatgaggacagtagatggataagctgtccttcaagcgtttcaataacattttcaacaatgaaaacgccggaaatacaacctataaagcaaaaaggaatgttcaaaaatgatctttatactgaaaactttaataaaattaaaaatgaaattttatctggggaaaaaaaagatcctatgctgcctgaaaatatgaatgatgaagaaattaatgttattattcaaaaagataaggaaagaaagaagctattcggtaaaatgataaatactaaaaaaagtaaccctttggaggataataccagtcaatgggttaatgaaccaccaagtccaagaaaaattaaatcattttataataaatatttggattattacaacgaaaaattatttaatgtaattaaagaagaatctaataatgaagaattgaaatatgaaacagatataggtcatgattacatagatattaatttattaaataaagatgttaaattaatacctgaattattttgggataaagattttatacttaacttaaatgctggagcaacacagaaagaagattttgagaagataaagaatgtttgggaagatcagctaaaaacaggccgtgaaatgaagaaaagtatcgaagcagaaaaattaaagctgatgaagttacttccaaaagatgattttaatattaatcacttagatgttatggaataccatgacgaaaataacctggttaacaatattaaagatagtaatatagtgaaaactgactggaggcaaatcaatcatacatttaaaagcgatcttagagatgttccatgggaatttttggatgagatttctaaattgggcactatgccaagccaagagttgaataaggaagatttacaaaaatatattgtagaatcactggtattgaatggtaaaggtttatttaatataaaaaatcaaattaaagagagcttaattcaaaaagaaaaaagtattaggagggcccagagtaataaaatgccccaccaaggattgggagatgataatgatggccagaacccaaaattgggagcaaattaa

SEQ ID NO: 289 - DNA, 519 bp, Cryptosporidium hominis
atgtgttgttctaataaacagaatgcaattagattgattaaagatacccatggagtacatagtgcaattattcaagatccaactaaagacgatttaaatcaaataaataataaaagtttgctttcaattgcaatgcaaatgacattccatcaaagctttgaatcagttattttgtttgaatcatggagaacgtctaatagatttgattatttcatttcatgtttatttataatattaatggggtgttttacaatgttcatctcttctataaacaaaatatacgttaaagagataaaaaaaaacagagtagaacacgaaaatttaggtataaaagttatatgtacgaatgtattattaactattttgtactactttatgcattatctattaatgctaattgctatgacatttaattggggattattcttttccgttattatcggtctttcgataggctatggaatatttgagctaggctcaataactataaatgaatgtagctgcaatagcgactgcgat

SEQ ID NO: 290 - DNA, 930 bp, Cryptosporidium hominis
atgagtagacttcagcacgaaactgatgggggaaatgaaagaacaaataaatcattgcaatatgaaaacttttctttagaatcccaaagtatatttcaaagagaaagttttgatggttttagagctgaagtagctaagtctgtcacctcaaatttacaaacttcttattcattacttttaggcacttcaaatattaaaggctattcttatcaacttggaccttcgtatcaaagctcatcaaaaaatacactcattttagctagagttaatgatgaagggacagtcagtggtcgtttttctcgttgctttggaaataatattgagggtagaatttcaataaattcaagcttgtcagacgaaaataaaaacatgagtgaagtttctgtcgattataatggtgaagagagtagctattcattaaaagttgcatatcaaggaatatttttgctaaatggactattttctcaattgatcacaaataaactgcaattgggtggtgaactaacatggattacagccaataatacatcaataatgtctttggggtcgcgatattgtcacggaaaaaatattttttttaaccaaattacaaggcaaccggatttcacgagcccaggacgaattttcgcaaatattcactcactcagatcatctttctataggaaattaagtgataggttatctttagcgagcgaattggaagtatcaatacctaattttgagtcgacattgcgctttgggtatgagtacttattcaaaacagcgaggattcaagggatgatagatacttgcggaaaaatatcactacagtgtttagataacaaaggatttgggatttctggagcaatagactacttaagaaatgactacaaatttggatttatgatgcaattttttccaaatgaaaaagatgataaattagatgattaa

SEQ ID NO: 291 - DNA, 2229 bp, Cryptosporidium hominis
atgaaccaattggaaacgaagtgccttttagaagagctctcgttttcaagtttacaacattttcttttgtcaaatacaagaccaaggattgagaaacttgcattaatcacaggttttgggaactggattccctttggatggtgcgaattcttcgttaagctattcgagacaaattcaaaacactatcttcagaggttatttttgaaccacgaaaaggtaaatatcaatagtaatgacttcattaatttattggttccattttacttgccaagtttcgtaaatttagaaattatgtttagaataattaaaacaaagattaagacgagagatgaatggattgatagcatgaaaactaattcaaaaaatgaatttcaggaaaatcaaattaacagtttaattcatccagatatatgtaacaacatttttagtaatttaatgattgtgataaattcatcaataaaaataacagatggtttaaaaattcgtagttatacgaaaaacaaacatttagattttcaaacaaatacgcaaaacagctttttattacaaagcaaccaattaaattgggaggaaatattaaaggattttgattcattttctaattttatgtctcaaattaatttcgtaactcctgatctttccttgcctggtatcagccagactttcagagggagacaacgcactgaaaatcaaaaaccaagtcatgaaaaaacaaatgaattaattcattcgacttctgataatgttttagagacaattccaatatttgggaacatgggatttgatcaaattaaccaatctgctgatacggatgagtttaattatgaggaaataccagaagtttatagcaataaaattgagaagcttcacgatgaaatcgagtctccagaacaaacgataatgagatcattccaaggaaaaatcattgtaatagacgactcctcagacgctattaaatacgataatagtgaaaaaaattcttctgacggatgtgaaaggttgattgaaaaatctacaaataacgagttacctttaacttgggaatctgtatttttagattcacatgacccgctattaattataaaccagttacaatatcatgataggatatatatgggtatgtctccaacgaattacatggttcttcataggtcgttgtatgagaaatattcatttttgagattgaactatgaatccgagtatctatttcgcctattatggcatttttctcattgctgtatttaccatggaagtttgctgaatagttctactttaaatagagattttgaaagttccattattcacccattacaatgtatcttgctaattataggtattttaagaaggtcattggagaatccaaatcattctgacttaaaacaactcaactgggaaagagacaatagcgatgatcaatactcaggttttaattcttcatgtattaattcaagctcaaacaaaaagttgaatgtagtagaaaggatacttgcaatttctattgagttacttgagaatggagtttgcaatcagattgtaaattaccaaatgaattgcaaatctaattatgacccatttattcttggaagcaatattcaaggtattttggattcaaaaaataatgaatctttgaattctattttacatgaaaacgaatcaaacttagagtctagttccaattgcaagaaaaatattaattcttcttttgaaaaaaattatgaggcaaatataaataaggaagaaacaaaaattttaaattgcaagaataatctatctaatgattcttcgttatcttcttcacgtatatcgtcattagaatctgtgatacaaaaagtttacgattgcaaaatcaataaaaatgaattatcaaacgctgatagaaaacaaccacgcaaagtcgttatttattcttcaacaactaagtcaatacataaagataatttttttagagaagaaacgggaattcttaaaaggatggttaagaataagcagatgaaagaaacgaggattgttaacataaaccagcaatccaagaaatttaacacattttctcctacgttagtagctaatcaagatttagataaaccccagagccagaatattttgagatctattggattagaatctacaaacgcattttgtgaaagaaatcacgaatcatacaaggatgataagctacaaagcaaatttaaggtttttacctcttctccactgagaatttttaagaagtag

SEQ ID NO: 292 - DNA, 744 bp, Cryptosporidium hominis
atgaagagtttattctcatttgattttcttggaaaatgcaattctcgttgttttaatattttgttgacagggcctgcatcatcaggtagaacaacattcctacttagacatttaaaaggtaggtatgtagattcagcaacaactgaagatatttattcagctgtgattgaaagagaaaattgtgtactgaatattgtcgataaggacattttttcccaatccgataactcttataattgtactttaaaaatcaaaaatagaaacgagattgataaaaatggatgcattgtaaaaaaaaaaggtaaagataaaatgcaaattattagtaaaggtactataaataatgaagataatagtaatattgatggaattttgttttttattgattcaagcgaccatggtcgaatacctcttgctaggaggctgttgatgcaattattaaagaaagcaaacaaacaaactcctatattaattattgcaacaaggcaggatataatcggcgcattagctcctggagaattagcagcaaagctaaaaattgaagatatcgcaagtatgtttgaggaccaagcctgggactacggcattattggagtctctgcatatacagggttgggctgcaacgaagctttagactggatttcggaagccatttggagacatcagttattatgccattgcattccattcaaccgtttttgttataatttatgtaactctggcattttaatgttaaatttttga

SEQ ID NO: 293 - DNA, 771 bp, Cryptosporidium hominis
atggacgggtgtaaacactataaatctaggtgtggaattattgcaccatgctgtaataatgaatattggtgtagacattgtcataatgagagccaagaagaccatcacgaggttgatagatttagcattaaagaagtggtatgtagaagatgtaataagcgtcagccagcgagtaattcttgcattaatagcgcagagtatggtgaaatatctggtaaaaaatgtgatgtaactcaatttgccaagtacttttgtagtaaatgcaacctttgggacgacaatggaatagaaaaaaatgtatttcattgtgatgaatgcggaatttgtagagtgggcggacaagaatcttactttcactgcaaagtttgttgcatgtgctacccactgagcattaaagaaacccacaaatgcattgagaattcatgtagacgtccatgccccttatgcttagaagatctattttattcaataaaaactgtgtcaattttaaattgcggtcacactatacatgaagattgtttacttctactaggagaagcaaaggggctaaccagcttacgttgtccaatttgcagtaagtccttgggagacaattctcagatatggaatgaaatagataaaatgatcgccgaatccccaatacctgaggaatccaaggaacttgtaaatatattttgtaatgattgcaatattaaatgcaatacctattcacacccttatgggcttaaatgccaagtatgcggaggatacaatacgaggttagaagattga

SEQ ID NO: 294 - DNA, 2259 bp, Cryptosporidium hominis
atgccaaatcaacaatattcgcttaataatgcatttcaaaactttcaaagacaaatttcttctcaaaatcaaagttcttctgagcaaatatcatctcaatcttcaacttacactaatcaaatggttaacaataatattagtttaatgaaaacgtttgtgcctcatactcaaaatggtgttgagaatgatagtagtatttcacaagttattaaatacttaagaaaaaatgggtatattgagacaattgatactttactatttgaaatgaatgaaaatgatagaaaattaaaaagtaattctcttgataacgagatgactgattctgaagttgaaaatttaattaattttactaggaaaatagacaatattgacactcaagtgatttcagataaatattccaagttcagaaattggattctaaattcgctatcttctgttcgagaagaactcatttctgtttgttttattgtttttgttaatatctgctatatcttatacaagaattcatctattgaaagatatagaaatttcttaaataagttttcagatgatttttcgctgtctaaatatagagaagctatcacattattaagaaattcaaatgatttgggctatttaaaaaatgcagaattgctaaaaccattttttggatcaaaatttcatatcatcctaaaccgaacatctatttcattattgaataacttcttattgtcccactgtgatactctaattttaggaattatgcaagagaaattgattattcatgcttttgatcacaagacaaataatagtgacgttacacttaccagcagaaatgaagaattgggttgtttgaaagaagttgggaatttccagattggcgagctttattccgaagactccttattcattgaatttaactcaaaaaatagccaaaaaaccaatacttatggcgacatctctgtagttgcaaaagatatatcaaaagtacttgaaactgatatgtcaggtaaaggctattcccaaaataattctattatcaactgggggcttcatcctgagaattacagtggaataatttccaaagaaaatgaaatgaaaaaatccaaatttaatcgatttgatgacgaaattacagaagaaattaaaaacgttgaaatagaattcaatcccattaacgattcaaacaactcttttacgtttaaatataaaaaacatttatatgaagaagtatcaaatcgaaaatttgttgattctacccatcttccctctataatttgtagcagtttggaatgctcaaattgtaatgaaataattgacatgaatatttcacataaccatgaagttggcgcatattgtaccgatgatggctgtatacaagtttttgatatagaaaatccggaatcaaagattgaacctatatggatccatagaaacagagtacagtgcgtaaggtttcacccgtggaatccggagtttttattatctgctggaatcgacagtattattaaactttcaattattaccaaagatcaagaacccactttatatcaactagttacattctctgggcattcaacaaattcttgcatttgggatctcagctgggatgatcatgggatttcctttattagtggctcaagcgaccgaagtgcaagattatggtgtacatcaaggacttatccaattcgtatatttacaggtcactttggagatgttagatcggtgtcaatacatccaaactcttctattactgtaactggtggcagcgataatcaaattattatttgggatgtacgtacaggaaagaaggaaggcacaattcataacagaaaagttatgtcaggaattattaatcaggtcaaattcagtcataatggatatttgttagcttcctcttcaattaataatcaagctactcacttttattctcaaaaccagcttatagtaccaatttgggatattcgtaaattgtgcaattctaatagagctactaaattttatcagctttgtcaattcccaaatgatataatagattcaaaaaaacaaacgtttgttaaatcacttgatttttcatttgggagccgtgtaattgcatctgcgactaatagtggtatagtttccatctgggatacaaacgtagagacaagttttaatcaaacggacaatccaaacttagttaacaattctgcgcagatttataaattaaagaactcaagtacaaaaagcctcaaattcctatctagaaatttactatcaatatcgtctgtaaagttatag

SEQ ID NO: 295 - DNA, 525 bp, Cryptosporidium hominis
  misc_feature (454)..(454): n is a, c, g, or t
atgaaaatttctctttccggttataaagtaattaatttgtttgatcttgagcttaatcgcttgacaataatctcaaaaaataaatcgtttcgaatatcgattaaaaagttaaaaatatctgttttcaattggtttatatttatcatttttgttatttatattcgtttaataggctacagacatattgatttatttttcaattttttttccaaatttactgagaagaaaattgcaagtttaaaactagatcaagtagaaatatatcatttaaagaaagatggatctagcgtaccagatgccaaaaggtcaaatcttattaatttcgtttcttcatattttgatttcgagcttttcagtgttcgtctattatcagaatataaactattaggaaaaacatttttatttggcactaatattggatcaatttacaagaaaaattattcattcaggaaanctatcattttatacgaaggatttctgtcagatttaatgaatattttgatgatatctctacttacgatataa

SEQ ID NO: 296 - DNA, 2142 bp, Cryptosporidium hominis
atggttttttttgctgaaaaacttatttttaatttaaaatttctaattagagaatttgtatgcaaaattgaagcagttcagctcaaagtttcaaaaaatttgatggatgtggtagtaggtattgcgtttgactcggaatttagccataaaaaaaatgaattgtattcaataaagtattatcggggaacaaattcatttcattatttattcgatttgaggcagtctcgagcatttgtaaataatctaatgcttttatcaaatgaagatgtatcagttgttccttattttcatattaactgtttaagtaacgcaaaatttaatataaaaaatattgaagtaccactattttataactcagaatatttgctcgatttaaataactcattttttgacaaaatatattcaagttataatgagcctttttattctcgttatttcaatgataacattttttccatcaattgtagaatagatttaaacgtttttaacttgaataatatcagcagcgaaattccatactccaaattatgtgatttttcggcaggcaatgccactgttggattaaaaatttgcttttcctcaaaagtattcaaagatctgattttattttttggctctaaagttccaacttgttcggatatatttgagagagctatcaaaataaggaaaaatcaaaaaattgagattccatttgatttgattgctgattttccaaacatgatggttttcaaagatacaaattccataaatataatggaatttgattcggcattctctcaaaataactcagtaagtattattgacataataaaaaatgtgatagaaaaccctaaagcattttatttagactacaatttaattaattccagtctttgtattggatttgagtgtattaattatcgtggatcttgcattaatataaatattttcaatattattagcataattaatatttcaggagagtctctgagttttagtttctgtaatccatataacaacaaactagaatacgaatgtattgtggaaaatttaaatcaagaatttattgacaacgttgacactaaaatagattcggttctgttaattaatgatccaatgaaaataactcatcgattttatatcgaatttaatagagtatctcgagctgaaaatcattgttcaattaaagaaaatatcatcgaattaaatgaaactggatcccaagcaaatagtaagaattacagattatcgctgattaaagacaaaattagctttattattattatttggtgcccattaataatagtaaactactcaaaccttgattgcattttaaagattattaatgcagaaaaccaagaatactattttctggaagggaaaatatctaaaaacaattcatggaattcaagagaaaaaagaaatttcagtaataaaaacattttttcactttccaatattgataaaaaagattttattgagttagaaatacagtcaggatgttatattagtacattctcaccatcaagacaaagagaaaacgatattttaatagaagtagaagattataagcatttattaaaaagtaattttattttaagtatactagaaagacattcaattaaaataaaggttgtaaagctaatgccgatatggtcaatcagaaacaaatctaacttcaacattagaattacatatggaaagcatgttaatatccctattaaatcaaactctggatatctagataatacttatttagttcgtaatacacattttaattatgacatacaagaacaaataaagatagtttttgatgaatttgttaatttctttttaataaacctaacaaaacatgaaccttatgaaaggctaattaatttatatcgtaatgatagaaatccaaataaggaatggaaattaattaaaatatctttttacccaatacaaaatggctctgttacaaaatttaatactggaatttatatagaacttaacaattttaacgagaacgaatcctctaattattttgtgttcgaaaataagacaagctttacgtatttgctgacacaagcaaatggcctactagactttaatagcatacacgtaaatattcatagaaaagaaaacttaacacaaaacattcgggaaaacactttaatgtga

SEQ ID NO: 297 - DNA, 339 bp, Cryptosporidium hominis
atggattttaatctaaacttgaatatttacttccgtaattttttacataattttgttactgaaagtcaagtaaacctaaatgatgcatacaaaccaacaaataatgaatacattttgattattgacatctttccctatgaactgtgcatcaatgaattatttatcaataaaaaattgagaatcgtgaattgcaagcactccattaactctcctaaaagaatcgcgattaacgaatttaactcaataattaacttatcaaaacatcttctaaagaatacaacttatattattgtaaaaactttattaaataaaagtctaaatcctctaatatatttttag

SEQ ID NO: 298 - DNA, 1422 bp, Cryptosporidium hominis
atggttcttcaacgtatgagagctacgtcttatttaagacgtacaatgtcagatccattttcacgtcgaagaacaactttaccttatattgttggtatttttagtcagaaaaacgatttatgtaagaacttaatgaacacaggtataagtaaaaattcattcaaagagacaaaaatacctaattatacttggaaatctgatgcaatcgctgttttagatatattttttacaaaactaaatatattatttttatttgttccttttggagttttgagttattatttggaatggggcgctctagctacgttttggttcaattttattgcgttaattccccttgcaaatcttcttgggatatttacagaggaattagcattacatacaggtgaggttgttggtggtcttttaaatgcaacatttgggaatgcggttgaagctattttaacagttcagggaattagagcaggtcttatcacggttgtacaaggaacgcttttgggctcaatactttctaacctattacttgtacttggaatgtcattctttgcaggtggaatatttcatcatgtccagaaatttaacgaaaagggtgcatcgttttccacatccctactcatgctatcatgcatggcaatctcaatacccacaattgtcgcccaatttgaccttcctcagcataatattttaatgatatcaagattaaccgctattttactttcatttacttatgtattatttttattctttcaattatatacgcatatcaatctattcagagatgaaagcgttgcatcaaatgataaaagctacccttcttatatgattgacaatataagttcagttaaatacccaaacgctctttccaacattgagatatataataacaacatttataagaattaccctattatttcacaaaattttaacaactaccaattatacgacgtttgccttgaattacctactatttcatggcaaataggaacagttctaatactattatgtactattctcatatctataatcagtgaatgccttgtcgattcaattaatggattcatttcagaatggcgattctccgaaaattttattggagtaattttacttccacttgttggtaatgctgccgaacacattactgcagtatcagttgcaataaaaaacaaaactgatttaacaattggagtagctattggaagctcaactcagattgctctatttgttgttccgttcagtgttattgttggctggttattaggaaagccaatgacgctttcatttacgcccgtctctgcaataattttactgttgacaaaccttattgtaattggaattgtccaagatggtgaatcaaattggtttgaaggtattttgctaattatcagctactgtattgttgctgttgtatattggtatatataa

SEQ ID NO: 299 - DNA, 738 bp, Cryptosporidium hominis
atgaaaaatggacagcttaagttggcagattttggatcatcaattcatttagacgatgttgtttgcaactcccaaaattgtggttcttcgtgtgaatgcagattcactataaacagaggtagaagagaattcaaatattttgttgggacgccgcagttcatggcacctgaaactatacgaaataagccaccaacaaaagcagttgatctatggagttttggttgtactgtattccaagtgatttgcggataccctccatttaatgctcctagtgaatttcttgttttttgcagggtttttcaaaatggattgaggtttcctccagattttcccgaagatgcaaagctattggtagagtctttactcaaacaagaaccttctgaaagagcgacaattgaagaggtaaagaagtccaaattttttgaagatgttaattttggagaattaataagtgaaaaagaatatcttaattttccaccttcattgaaagatttatgcctaattcaggtcgcaaaatcatatgaaaagtataaaacggaagatctagaaaagctaaatgctttagataattcaggcacaattgtgggaagattaagattcgaagttgagagaaaggaatatgaaggcccgcgcgatacatggcaaaacgaattttacgaccaaattttcaatgagaatatctcaggaaacacaaataattgcatttcatcttcttcatctgaaagcaatagtgagtaa

SEQ ID NO: 300 - DNA, 291 bp, Cryptosporidium hominis
atgaccagaatcaaaatcaataagctaagaatgatagggtattggaattggctgtgtggtgatgacctttgcagtatttgcagtgaatcttttgaattaacatgcccccaatgccttaagcctggagattcatgtccgccagcatttggtgagtgtggtcactctttccaccttcactgtatacatgagtggctttcacgtgcaagaaatgattctggaatgtgcccaatgtgcagaagagaatttaaatttcaatctaacgccaatattctacaaagcactgacaaatga

SEQ ID NO: 301 - DNA, 2598 bp, Cryptosporidium hominis
atgagaaatttagatcgagaaagagaacttagacgacgccagtacctggcagatcgagagaaacgtcaattagagttagctgagagagtattaaagagtaaagaactactttatgcttcaattggaaaggaagtcaatgaaaaaaaaaagaatgaattgaccgcagagcaaaaaatattagctgaggctggtaagatggttgaggagagagatactgatggctcactatttgaaacatatattatgccggaaagttacgatgaagatttacaaaaaagactcagtatagcaataattaaacctcaagataggttagataaacgcagaaaatttaataggtcagaccacgatatatgggagtcaaaccaagcgagatctggtgatatttctttagttgaaaataatagactgtcaactaggaaagtaattgaccaagagaaaaattccaactcattaattctttcagacggatctctgattgattttgaattactagaaacaacaagcacagaagttagcagcgaatttttatcaagaaacaaaattatagaaagccaggacattgaattgattaatgatgttagaaactctctacctgttgtgaaatttaaggagcagataataaaatctctagaagaacatccaatattgatagttgtcggagaaactggttccggaaaaacaactcaaatacctcaatacttatttgaagctgggtattacaaaaacggaataattgcatgcacacaaccaagaagagtggcagcaatgagcgtggctgcaagggtagctaaagagatggggtctagacttggaggtttggttggatattcaataaggtttgaggattgtacaagcgaagaaactgttgtcaaatatatgacggatggcattttattaagggagtttctttcagagccagatttaaaaaattattcgtgcatattaattgatgaagcacatgaaagaagtctccacacggatattttgtttgggcttgtaaaagatgtttccagattcagaaattcagatatttatcttgaaaacgatattggaaagaatgacaagatagaaggctgcgccaattataataaaagtccctttaaattgattatatcatctgcaacattggaagcaaacaagtttagtgaatactttgataatgcaccaataatatacataccaggtagacgatttccagttaacatttattatacgaagtcccctgaagcaaactttattgacgggacggtcgtaacagttttgcaaattcacttttcccaaataaaaaggtctaatgagaatatgagctctaaaaagatcattccagttggaggtgatattctttgtttcttacctggacaacaagaaattgaagaaacgcaggcattattagaaagtagactagtaaataaagatccaaattcaccagagcttattatacttcctatatactcttcacttccatctgaacaacaagcaaagatttttcaaacaactccgtacgggtttagaaaggttgtacttgctacaaatattgcagagacggcattaaccgttgataacatagggtttgtagttgattgcggcttttgtaaacaaaattcatataacccaaagacaggtctagaaagtttaattaccgttccttgtagtcaagctgctgcaaaccaaagatcaggaagagcaggtagagttcgcccggggaaatgctttagactttacactaagttaagttttattacggaaatggaagtatcaaatgttccagagattcagagatgcaatttgggaaacgctgttttagtaattaaatctcttgggattgatgatttactacattttgatttcatggatccaccacctccagaaacattaattcgcgcattggaactcttgtattcattaggtgcgcttgatgataaaggggagctaacgaaagttgggagaacaatggctgaattacctattgatcctatgcatggcaaaatggtcttagcatctcaaaagtacaacgttgtaaatgaagcaactacaatagtatctatgctttctgttggaaattcaattttcattagaccaaaagaaaaagctaagcaggcagatagtattagaaaagctttcactgtacatggaggagatcttttgacactattaaatgtatataaccaatggcagagcaatgatttttctggatattggtgttatgataattttcttcaagtgaaaagccttaaaaaagctcgcgacattaaaactcagatagattcgcttttaagtgaaaaattagatattcagatttcaagtaaccccaatgagttagaatatattagaaaggcaatcacagctggattttttttacaatcagcacgcattaataaaggtgggaactatactacaatcaagtggcgccatatagttgacatccatccttcttcaacattgttcaatttaaagccgtcagcaattacatacacggagcttgtacttactacaaaggagtatatgaggaatcttactgaaataaagacggattggctacttgaggttgctcctcattattatcatactgatgattttaattcaaaaggcaactaa

SEQ ID NO: 302 - DNA, 480 bp, Cryptosporidium hominis
atgcctcaagagacagctctaatttatcgccctttgaaactatctgatattttcaagattaacaaagttaacttggacagttttacagagacatacaacatgaattattatggagattatctttcaacttggcctgaactttgtttcgtatgcgaagcaccggaccattcaatagcgggctatcttgtttccaaagttgaaggagagggggatcaatggcatggccatgtaactgccctttctgtttctcaacaatatagaaattcgggtgttgcaactaaacttatgaaatttttagaagacataagcacacagttgaattgtcattttattgacttgtttgtgaggccttctaatgaaaaggcagtcaaattttacaagcaactcggatactatgtacaccaaacaattccctcatattatactgatgaagatgggtatgacatgagaaaactgatttgcaataaaaatctggagtaa

SEQ ID NO: 303 - DNA, 288 bp, Cryptosporidium hominis
atgttagagagtattggaacagatattaaacatttccatatgcttgcaaagcaaaggcagttcacaaataaaccacaaggtaggaagcagttattttatatccctgaaaaacaatattctactcctgatttgtggctcacaaagtcgaatagtatttataattcgtattcttcaaatgccaaagagattgttgagaatactttggattactaccctaatataggtcgtgagtggtatattaaacgatggaatgatataaaatcgataaagttccaaaaaggaaattaa

SEQ ID NO: 304 - DNA, 1512 bp, Cryptosporidium hominis
atgagttgcgttaaatcgaaagagaattctaatttaggagatgcatatggtgacattacacgtctatttagtaccgttacgaatggaacaacagtagaggcaatcaaatatattgtggctctagtcgggagctctaaagaaaaaatggatattgaagagcatttgttggggtacaaagatggaaatggaagaaatgtttgtcattttgtctgctctgcaaaaagaaatgacacattaaaggctattttaaaacttgctccaggaatagttaatagtcttgacaacagtaatgaaaacccactttttctctcggtaagagctcaagatattgaatcagtcactacattgttaaaaagtggggtcgaaattacaagaaaaaattcaagtggttgtaacgtactgcattatgcatgccaagttgcagacctcaacctggtgaaactgattatttccagcctaaaaagtgaaaacccatctgaaatagacttatttgtcaacacatgtagtgatgaatttggaactcctcttcaatgggcttgcatgacgaacaataaagaattgattagttaccttttaaataataagagtaacccaaataaagccccattaggtaaattaattccttctcctcttatgataactattggaattgggaacactgaacttactgaattacttttgaagtctggagcacttttggccgaagctatggattccgaagggtatacaccaatctttgctgcagttgaaaagaatgatgttgagttattatcactaatcattaaatacatgaaattgcagtcatgcgatgcttcaaaccaaattgttaaagggaattctatttattcatatgcaataaacaaccgttgttctgaggaaatcatggaaattttgaaaagtcatgcattagatagtataaaaattgataatattcagcaaattgaacaaggacaatccacacaaactgaatccatcgaatcgattgaatcgagtgaatattcttcattaaacgacaaaaaaaaatctcctgagcccgatatatctcctgaagtaattattgaacaggatttagaagatataagtaattacaatgaagttgaggctgaacggcttaaagcagaggcaaattcattttttaaagaaggccaatttgacaaatcaatcgaaatgtattcaaatgctctcagccatttaatgatgaaaaagaacaacttatctgaaggagcaatcactctcaaatcaagcatactttctaataggtctctttcttacataaagataggagactcttctaaggctttatttgatgctacatcatgtatttacataaatcccaaatggagcaaagggtactacagatgctctcaagtttatcatatgataggtgatgtagcaaatcaagcctgttatctatgggatgcaattacaaacgaaaattcaaatagcgcactaaagcaggaatatttggatgctttttcccaaataatgaaaaaacacaggcaaaaccaatag

SEQ ID NO: 305 - DNA, 624 bp, Cryptosporidium hominis
atgttaaatgtactggatatatacgatgatgactcagattcaatcggtgacgctttacttgctgatatgggagaacttttacggttcagacctggcgtttttgatggagcaataagtatatctgttttacaatggctttgtaatgctgacagaaaatcacatgatccttataagaggcttttagttttctttaaatggcttttcaactcgttaaatagaggttcaagagcagtgttccagttttacccagattccccttctcaagtggaaatgattacttcagctgctttaaagtcgggttttggaggaggattagtagttgattttccaaattcttcaaaagcaaaaaaatactatctttgtttatgggcagggttctattctactatacctcaaaccctcccgcaagggctaacagacgaaaatgatgaagaaatgacttcagcaagtaatttgggaagatcaggatgcaagttaaagacaaagaaaagggggaataaaagagagcatagagtaaagtcaagggagtggattttggaaaagaagaatcttcagagacttaagggctttgaagtccgtccagattccaaatatacaggaagaaaaagaaagagcgggttttaa

SEQ ID NO: 306 - DNA, 204 bp, Cryptosporidium hominis
atgagatacaaaggcacccttgtttcctttgatgaatatatgaacattcttttaaatgactgtgaagagtggatagacaataccaagaaaggaacattgggcaaagtatttattaggtgcaacaacgtattgtatataagtagagctgaagaatctaaagaaactaaaactgatattcaaaaagatgaggaaatggcagaatag

SEQ ID NO: 307 - DNA, 1224 bp, Cryptosporidium hominis
atgacggataatactgatgagttaaatgagtccaagattttttcatgcgaaggctgtggttccaaaacaaaatcaaaattatcatgtcctcaatgcaagaagttgggactaaagacatcttttttttgttcccaagtctgctttaaagaaaactgggccattcataaactaaaacatcaattaggaggaagtaataaagaagttgctaaagtttctcttgacttggttaaaaagaatgtaatcctagacgatcctagaacatgggttaattgctcacatatttcaaagtttataggctttaatggtttcacaggccctttaagaccctatccaataagtattaaacgaaaggttccaagccatatcttgaggccagactacgctgatgataaggagggaagaccattttctgaattaaaaagaaaaaaaagttctgtaattgttacagcaacagctgaagaaattgagctccttagagaatgttgtaagataggaagagaagctctggatattgctgcttctatgataaaacctggagtaacaactgatgctattgatgaagctgttcataatttcattatttctaaaaactcttatccttctccattgaattattgggggtttccaaagtcatgttgcacctctgttaatgagataatatgccatgggatccctgatttcaggccattggaggagggagatattgtaaatgttgacatttctgtatattataaaggagtacactcggatttaaatgaaacgtttccggttggaaaagttgacgagaaatcaatgaaattaatgaaagtggcttatcaatgcttagaggaaagtatcaagatttgcaagcctggtacaatgtacagagaaataggcaatctgattcagtcaatttgtgataaacaaggcttttctgttgtaaaaacttactgtgggcatggagttggagctttatttcattgtgctcctaatgtgcctcattataagaataacaaggccgtcggaactatgaaaacaggacatgtatttacaattgaaccaatgattaatgcaggtagatttgaagatataacttggccagatgattggacatcggcaacattagatggaagcagatccgctcaatttgaacatactttgttgattaccgagactggagtagaagttttgactaaaagattggaaagctcacctaaacttgaaattctttctgaaatagagtaa

SEQ ID NO: 308 - DNA, 1068 bp, Cryptosporidium hominis
atgatgttgggaaagggaatgagatctcctaaggcggagattacagagttaactccaaactcaataaggtttaccctttctaacacagatttgagtatggcaaatactttgagaagaataattttggcagaaattccaactcttgctattgatcttgttactatgatagacaacacatctgttttgcacgatgaatttattgtccatagaatgggtttgattcctttagacagcacaaatatacgtgattttaacttcaaggatagatgtgaatgtcaagaacgctgcaataagtgctctgttgagtatttgttggatgtaacatgtgagggtggtgctacaaggaatgtaactcattatgatattcagccagttgcaacttctactttagttccaatgcctgtcccaaagaaggacgactcagttgatggcatgaataatggaattttaatagctaagcttggcccaggacagagaattgcaatgagaatgacagcttgtaagggtattggaaagtttcacgcaaaatggatcccagtttcagttgctacattcacaaatgaagcggatgtgagaataaactattcgctttcttctaatctaactttgaaacaacgtaaggaaattgtcaattgttgccctaaagatgtttttgctctgggaggtaatacttcaaagactgaatatgccttgaacaaaaactctacctattctaccaaaacaaagacagaggaacttcctgatctagaagttgtaagttcaaagtcatgcattttttgtaacgaatgtgtaaatctaactaaaaattatggttacattaatcctgccttgatcagagttgatactaaacctgataaatttcatttcttggtagagtcgacaggagccctacctgtcgaaagtattgtagaacttgcttttgaaattttacaggaaaaattaaatactttaagtagaggagttgctcgctctgaaacagcacagagcggattggatactaatggttctggtggggtaaatattactgctgatgaaagagcaatggatttagtactagacttatcttag

SEQ ID NO: 309 - DNA, 2280 bp, Cryptosporidium hominis
atggaaaaaaatgaggctttctctttggatgacccatttgaccttgaattaaatctcaagagatcaagtatggaaatgggctcagaaaaccattcaaaggaagaaaatgaagcgaaaaaagcttgcataaatgatgagccaaaaaaaggttttggatgggaaatttgtgtatataatgaagatatggggaaaagtcaaacctttcatgtttctgaggaagtggggaaaagatttaactattttagattattgggtgaaagaagctctactttggaaggtaactcagaagtccaaacgacttttgaaattgcaaagattatctttcaggattacggccataataacaatggtatatttaggaaactcacaccagacaacttggaaattatattaattaccctagactacatggggtttctccctatggttggttcagataccaaatgtcaagaaggtgaggagtttgatgttgacgtattctggtcaatgctagccaggaagttgagttgttttgactggtttgaatgtgaatcctcaatagttagcatgaaaataagacagaagatattaaacctatctttgaaacttcagaatgggtttaaactccttcttgaattggtgcaatatcaccagatgagggatgtagtgatttcacttgaaggagggagaataattagagaaattttcaagaataagagtgaaatttatggcataaggattatcaatacaatttgtgagtctcttggagctcaatggtcacctgaaacttccaaagttgaggatttccttaaaggagtcacagaagaaaacgatatctttgatgcaatttcacatgtttggcaacctactctttggtatattagcgaacgaaaaacaattaataaattcgcccagagctctccacatgtaattacaggcgagatgagtgggtttccaatcgaacttgaactttacgcagaccaagataacgaagggtctgcaaccactgtaaattttgcaatggaaacacttccaccaagtcctgacgcttcaattactagtgtaacatcacttggaatttttgcatatccaaaaactcgctgtaccggtttttttaattgttttgcagctagagctaagttttacttcgaaaacacttttcttggagaagctacatttgatttgtcttccgatggtatcaaagcgttttgtccgataatatcaggtggtcccaataagactgggctgctcgtaacatgcagaatagatgagtttgtaaaaaaaaataaagatgaactactaaagctcctaatggaaaatcaagcaatatttagaaactctgaaaccttaagaattttacagccttcacttaataataacatttctcttgaccagattactatcagtcatttgaatgtagacattaagattcggttctttccgttgaggacattaaccctctatttactgtacaaaaggagccttgaggtagatacaaagtttgtaactaaattttccttttctctccaacaagatgtagccgaatggcttggaacttattttacatgcgtttggatacaaatttcaaagcagagagactctctttttacaaatagatataaatcaattctctctctctcatccaaatcattgcgaggccagaaaggcacaaacgctgacttaagtgtaaagcactctgagaacaatactccaaacccctcaacaagatactcatcatcatcatcatcatcatctgactcacttgatttcctttcattaattgagaatgagaggcatttatatggcgaaagccctcatgacaatctgctaagaacaggatctaggacttcaagcgctcaaacttcagacttcataggcgaacttacccaagattctgaattaaaggacagcccattttcttcatgtttttctgatatgctatccaatacatgttctaagattggagttaacaattgctatattgacccaatatctccaggtatttctccatttcctctgatcactgcttggttcaaaggagttgggaagccaagcgacagttggtgtattcataatatactttcagaaatactctctgatgatttaattactaggcactttacagatgtgctaacattaatacagacttgtgagtcttgggttgatgcagaatctttatcgaatataaggcagcagtttattcattttatgaacaacaacaagctcgattctatcggtgcgctactgtttgattggattcgtcgcatcccaaaatcccaaattcttgagttaaaagactag

SEQ ID NO: 310 - DNA, 1323 bp, Cryptosporidium hominis
atgggtcctggacattctaccataggatccggaaatagtatcggagcaaactctactgtgagctcaggtacaacaacgggggcggggcccaggcaaagcagtcagatatctcgcatctatgtgggttctctggattattcactgaacgaggcggatcttaagcaggtttttggctcattcggcccaatcgtgaatattgacatgccaagagaaggcaaccgctctaaaggcttctgctttattgagtacacatcacaggagtcagcagagatggctttggccacaatgaacaggtttgtactaaaaggaagaccaattagggtaggtaggcctactaatgcggcatctagtaatggtaatcaatccggaagtggaggcataggaggagggggctcagggaatgtcattaatccaaatattgctgtttttaataacaaccatattacccatcaaaatcatcaaattcaatcagaaactactcacggaacaggaattgcaacccattcacaaaacagaatttatattggctctgttccttactcttttacaactgacgatctgaggcatattttcaagacttttggtgttatccttagttgccaattaatcccttcaatagaaaagccaggtactcatcgtggctatggctttattgaatttggtactgcagatcaagcaaaacttgcgatagaaactatgaatggctttgaagtaggcggaaaacaactcaaagttaatgttgcaactgcgcttaaacctcaagtaggcggtgggggcggaggaactcaatcaggagtttctggagctacagttggccaaatacctatgattaatcctattcaaaatgtgataccctcccaaatgccatcaatgggtattcctcatcaaatggttttaccctcaatgatgcaaatgcctaatgtggctccgcctccactcccaatataccaacaaccacctgggtatccattgagcaatgggccggccccataccagatccccagtgcaatttcaggatctgctagtggctccaacattattctgcttacaaatatggttggccctgatgaaattgatgatgagcttaaagaggaggttaaaatagagtgcagtaaatatggaaaagtttacgacgttcgtatacatgtttcaaacaatatttctaaaccttcggatagagtacgtattttcgtcgtatttgagtcgccatccatggcacaaattgctgttcctgcacttaataaccgctggtttggcggcaaccaggttttttgcagcctttacaatactgaaagatactactcctccttcctcgatgactaa

SEQ ID NO: 311 - DNA, 2586 bp, Cryptosporidium hominis
atggatgatctactttccagcattaaactcaagatactatctgaagcacaatctgagaacttaggtggtagctttccagaaaacataagaaaacttttagggacggttgaggaagagctcagaactgttagagagtcagtactagaaagcattgatatttcaagcataaactatgtaaagtcaaagaaagaattagactctctacaaacagaaactgtggcattgaggaaaacaattgcatccattgaaaccaaggttgaggacgatttaggttcttcaaaaggagttgctgaaatggaagaaatatatagcattaagagggacctagcaactctcaagaaagcaagtattttctttgaaactattgcacagcttcactccatatttgccgaatttgataactacttggttgaatatgagtttgatttggcagcagatgccctaagtaatgctgatcaaaagctgaatgagatcaactttgacgacagcaacattaaccaaattggctcagaaaatattacaggaaaccgagctatacaacaaattgaagaagaaaaggacgtttttgaagaagtgaagattgagtacctccatagaaggggaagacttgtgagtatcgttgagctactatttagatatattttccacttcgaacgcaacgaaataagaataagactgagtcttccaagaagcgtgcttatggaggtatcagatttcagtcttgggtatgactcagaaaagccttgttcagaagacggggatgaggtcagaatctctcttcaagatgtctggtactctcttatatcacttggcgttgtgaatgaacatgtagcgtatctttcaaaactttgtattgaaaatattctagaccctctggtttccaaatcaggcaaactctctacagagaaaaattgcgggtataagttgcttccctttgaaactagatctcacaatgaatgcaaatgggaatataaggttgtgtgtaacaagtcaggtgacaaaaataaggaatttgatggagtagaagactgcaataaccaacgatcagtttatgaacatgcaattcctgttttaatctcgattcttaagtttttatctgatgactgctttacaggtaatattcaagtgatctccttgtttggtaagtacacctggagttggatttcacctagattattacacggtgtttcttcaacacccaccacaaaagattgtcagattttgagagaatttgaagttcaagccagatcacttcaaattatcccagcaggagaagacacgatttcaaattacgttaaccaactggagacaagtagatatgaggagaggaagttgcatgctttgaatttcgcaagggagattataatgcgcgatgatccctctatcattttggttgacgattccacagaaattggatctcttacaaatctgcttgagcaatgtggggtacaaaaatcaaaggcggataaatccgacggcctttcaaacctaattagccttattggtgaaggagatcttatcggtaatatggaaattgattcattttcttcaatccaaaatgaaaacgaaagttttctccaacttcaaatttgcggagttagttcctgtgcgcattctctgattcaaaagatacatcagcttctcgatgaagctctcttggatgctcaaaagcactgcttaagctctgcaaagcaaggatacttccttgtcagggagttagtaatgctatttatattactcagaccaactattcacaaagaaaggttagacagtgatcctctctttgctgctacattttatacagattgcacctatttaattcaccatctaatattaattccttttacatatggtagtaaatttccgccaccaattccaaatattggttcgtttgttgacctcctattaactctcaggaaacttcaagaaactgcaatttccagccttttaaccaaagagtctgaatcaatacgtgagttactagaagaaaaggcactttcaatggaatcaatgaagaatatgtctttagatcaaacatttatagaagttgaaactataattgttgacatagtccaacggcttaaaagagtttcttcaatgttttcttccactcttccaatcaacatttatctcgaaagctttggaattcttgttgacgagactataagaattactcttgaccaagtcttaaaacttgcaacctcagacgatgtgcaggatgtttcaccagacgatgcgtctgccttggtcattctattaaataacctggcatcacaaatacaaagactttttgaatgccatatattcaaaattaataataaggatggatccgcatctaattttggtgtgcacaactctagactaatatataatgacccgccttcccttgttggctaccttaagcactgggactctctcaccgtacttagagatactcttgatgcagatattgcgagcgtagttcagcaaaaacataaaataaaagcacttttccaagattatgaaataaggggaatcctaaacctgaacccatttctctcatctaacgtcgatgaggtatattatattattgtttcctctaattaa

SEQ ID NO: 312 - DNA, 1887 bp, Cryptosporidium hominis
atgactgtttataagtctctactgaattcaaatgcactaaatatttttagaggatacataaaaggtattttatcagataaaaatggagtttttagcccacgatcaacaaacatatgcatatataagcaagtagcagattcactttccaataatattaagggtctagttctgcatattcttaatgaagaattggaaaaaaataaagaaaaagagttagcaagcacaatcgatcttaacttaattgatcttattactgataattacttatatttaaatgctccaatattgccacttgaaagtctattaaacaatgagtttgaaagaataattagcagtagcaaagataagtccaataacttcataattattgaactcccaagatattttacatctaaccccttattctttaagaattcagctaataaacaagttgaagaagaagatggtctagactctgataatgagttttgtaaagaagtaacacattttggagttttcaacactaccacagatgatgcctccaacaagcttgaagaatctatttacagagtgttgaaaagatttattgaacgcgctatgatgcaagaaaattttaatattcacttaataatgctttcaccatatttcaaaccacctcaatttctattaggaaagggaatgttcgagatctacctttctattgaatgggaagctagtaaatctaatttaattcaactaattaaagatgtttttaagggtattgaagttgagaatggtgtaattgagatgataattgcttccgtttcacatcaagacagtgcattttccaaattgatcgaattatgttttgaattaaaacactctcttgctactaaatatattggaagaaggatcttaaaaagagaagatatagatttaaattgcaaaatgaaaattagaaatgaagatgcacaagatttcttgcaaaaatataattcaaaattattaaattcctactattcttcttctattgactctttgattgcaaccaaaatctcaatagataatgattttgtaggactaaatgagcttagaaaatctatcaaagactcaataaatgcattagagcagtttagtgaacgttctgaagtttcagaaaacgaaattgatatatatggatatccaatatcttggtttttatggggaagctcaggaagtggaaaaagtactcttgtcagaagtatggtatctattagcccaaaagtaaaggtattactttgcaatgttattgatttaataagcccctttcacggaattacaacacgtaatcttagacgcatatttaaaaatgcaataaattctagaccgtgtatattggtattcgatgatattgaaactttgggagcttttacaaaaaaagatgatatatctgaaggtgaagtcagatcaaaaattaataaagagcttgcatctacttttctatatcttctggattcagttatatcaattaatcaagatggagatttgggtaatgatctattgcaactattgaatataaacatacaagaaaggagcttagaggaggcgattgatcatttcaattctaaagtatcaagaaaagttccaggaataatgatcattatgacaagtagaaataatatgggtgacttctcaactgaacttttactgaaagtccagagacattcttttttacaattaccatctacaaaagaacttttagaaagtatacgtgaaaaagataatgatgaagtatcagctattgcagaagaaattgccaatgaaattcagaatctgcaaggtgagcggctaattaatgttagtgagtttaaaatccttgttcaaaacaagctttatgaaaaatatgcgagcagggaagcaaattcaaaaacttctgaaaaagatccttaa

SEQ ID NO: 313 - DNA, 1194 bp, Cryptosporidium hominis
atgccaccaaaaaagaatgaacagaaggaagttaaggtgcttttggggagacccagagggaatctcaagatgggattagtaggcttgcctaatgtgggaaaatcgacaactttcaacctactttgtaagcaggcagttccagcggagaattttccattttgtacaatagagccccatgaggcgaggatgaatgtaccagatgatcgttttagagcactttgtaagcatttcagcccaaaaagtgaagttcctgcaactttgacaatcttcgacattgcggggcttgtcccaggagctcataagggtgaaggtcttggaaacgcttttctttccaatatccaggcagtcgatggaatttatcatgtagttcgagcatttgaaagcgacgaaattgtacatacggagggggaggttaaccctgttaaggatttggaaacaatcagtaatgagctgagaatgaaggatttagagagagttgacaagctaatttcagagttgaacaggcttacgaagaatgggacagacagaacaaagaaggaacaagtagctgctttacaaattcttaaggacgtttatgctcaccttgaggctggcaactggattagtagcaaatatgattggaagtcctcagaggttgaattgcttaacgagcaccagtttttgacagcaaaacctgttgtttatttagtaaatctttctgaaaaggattatattcgtcaaaagaataagttcctccccaaaattgctgaatgggttaaagagcacatagatggagtaataataccttacagtgctgagtttgagacggctttggctgagctccacactgaagaagaaaaaatggcatacatcaaggaaaagggggcctctaagagtatgatcgacaagatcatcaacactggttattcggcactaaacttattacattatttcacagcaggagaagatgaagttaagtgttggactatcagaagtggaacaaaagctccacaagctgcaggtattatccacactgactttgagagaggcttcatttgcgcagaagtgtacaaatttaccgacctaatggaattgggaagcgaagctgcaattaaagctgcaggaaaatatttacaaaaaggcaaagattatgttgtcgaagatggagatataatcttctttaaattcaatgttactaattcaggaaaaaagtag

SEQ ID NO: 314 - DNA, 3846 bp, Cryptosporidium hominis
atggagtaccagactcgggatagactactttctgcagtttggccgcacattgaatcattcaatacattcctttctgttgggttaaaaaatattgtgaagaatttacccaagatttatgtggactctggatttattcaagatgattgcgaactaaatgcagcttatagcccagctgaataccttagaataggagttacatctgcaaaaataggaaagcctatttttgggtactctgaatcatctggtacaaagctgactcctcagcatgctagaaatggacacattagttacagtgctccactatggctagaatttgaaggttataattcatctttagatactgtttcaaagcatagtatttatgctggaacaattccaatcatggttaagagttcaaattgtcatttatttggtcttggtacaaaggaattggttgaaaaaggcgaagatcctaatgaggttggcggctactttattatcaatggtaatgaaagagttattaggtatgtaattcaacaaagatgtaattatccaattggacttaaacgtccaaggtttgcaacctttgattcatttggctcggaatatgccgttttaatgaggtcattaagagacgatggaacttctacagcaaactatctatacggaacgtctgatcatcaatgtatttacagagttttattaaatagacaggagtggctaattccattctggcctttattaatggcagtaggatcaatttatgactcaaatgtgcttaggagcaagatcctccaatattgtaatccaaaagatgaaaatttattcaacacaattaatatgcttactcttgaatggggacttgataactcagtcggtgttgatgcagaatttaattctgtgtcatttggaaataaagggcctggagatacagatattttagaaaatcgatacttacatcaaataggtagattagtatgggagggcgtagccttccatcttcctccaggtagccttttacaagaggcaggaagattcttaatagataattatgtgttagtccatttggaagagtggaatgcgaaattggagtgccttattttaatgtttataaaattaatcaaacttcagcttaatgaaattcgtgaggagtccatagattcttttgcgtatcaggaattattatctccaggaaacctatactcagcactatttaaagatgcaattttttcatttctacaaaagataaggtctacatatttgattgagataagatctaaaagcggtgagaagaataaagagagtaaaaatggtgctaacctgcttagagatacagcatactttaaatcagttttatcaaaaaatatttccatgatacctaagcgtctccaatattttatggcaacaggtaatgtgaaaaccactcaattggaccttcaacaactatcaggatggactgttgttgcagatagactaaattttaatagatttctatcccattttagagctgtacatagaggacagttttttaccactatgaagactacggatgtcagaaaattaacaggtgaaacatggggatttctttgtccagtacatactcctgacggtgagccatgcggtttacttcttcatctttcccaggattgtattcctgtgactcaatgggattcacaagaaactctcagacgattaaggaattatttaatttctcatggtatttcatgcgatgatgggttgggatctctttcttcaacttggggtatagagtcatcttcaagagatgatttatattcaccagatttaacaaaatccattcctgtaatgctagatggtagagttttatttcatatcccgagagaagattttatgatatgggaaaataaattaagaaccttaaagtggcaaacaaacccctctgtattaccggttcatgcagaaatagcatgtgttccaccagattctggtatgttctcaggaatttacattttcactgctcctggaagacttgtaagaccaattatgcaccttgaaactgctcaagtagactggattggaccgcttggccaaccatggatgaatattggtgtaacggaagaagagactcgtaaatcaacaaaactccttgaaatccaaaaaagattaattggtatttcggatactgagtctgaagaacagctgaaaaacgaccttaaagctttaaagaaactaattaaagataatgacagagtgctttcatctgtaccggttaactacactcacatggagctccatccatcaacaattctatcagttactgccagccttattccttatgctcaccataaccaaagtccaagaaatatgtatcaatgccagatgcttaaacaaacaatgggtaccccttgtcttaactacccatatagaaccgacaataagatgtataggcttttaactcctcaagagccaactattattactaaagggtattcatcatttggtttttctgaatatccaactggaacgaatgcaatcgttgctgtaatgtcatattcaggttatgatatggaggacgccatgattcttaacaaatcatcttatgatagaggaatgttccatgcctgtgtctacaaaaccaaaattatttcagcagctcctcctagcgctacaaaaaagagtgatgcagaaagctacttctttcataatattgggccagacggtgagctagttgttaaagagctttcagcagatgggcttcctaatattggccaaagacttacaaaaggctcaccaatatgtagggttgaacgtacaggctctggagggggcccttccaatgcaactattcaaacttatcatgacgatgaggttgcatttgtcgagaaaattaataggatcgctagcgggatttctattgaacttcaacaagattctttaagtggagggggaggagatggggcttcaagttcttctggttacggagaaaaagtgtctatcaaactaagaatcgtaagaaatcctatggttggtgataaatttgcctctagacatggccaaaaaggtattctttcaatgctttggccacaagaaaacatgccatttagcgaatctggtatggttcctgatattctattcaatccgcatggttttccttctcgtatgactatcggtatgctcttggagtctatgggaggaaaagcggcttgtatccatggagcaagaagtttggatgcaactccattcaacattaatatttctgatgatctttcaagatctgaagagaattgtgaggatgataaagcaggtgaaaagactactgtggactactttggtaaagctttagaaagggcaggtttccaatactatgggtgcgaaccactttataatggaatgacgggagtagagctcccatgtcatatatttatgggagttatttattatcaaagacttcgtcatatggttgctgataaggctcaagttagagcaaccggtccaattgacgcgttaactagacagccagttaagggaagaaaaagacatggtggtattagatttggagagatggaaagagactctctaatttcgtatggtgtcagctctattcttgttgataggctacttatttgctcagacgagcacagagcatatgtttgtccaaaatgcggacttataatctcttccatttcaaagagggctatggcacaatcaatctctagtagcaagctttcaaattgcatcccacctattgcagtttgtagggtttgtaaatctccctgcagaattattacgcttccatatatctttagatatctttcaaatgagcttgcagcaatgaatatagttattcgtctacatctccaacaagaggatgttcctattagtaattaa

SEQ ID NO: 315 - DNA, 867 bp, Cryptosporidium hominis
atgaattataatgattatgggtgctttaaaccattcattctttccacttacaagagctatttcaatatttctcttgggaaagctcttcaaatatggagtattatttgcatcatttttaatatattaatttaccagataactttcaaaaacccaattggcctcccttttttagtatatactgcagataaaaccactttttattattattattttacaatgctttcttcatccattctggctttactcacctccatattttctacaagaaagcttgcaatttcctgcttatctttgactttaatcaatctaatagctaacatagctatgctgaaaaatatgaactacatttttcttgataaatcttcatttggaaatcgttgcatttttgaatccgagtttttccgagattggaagaaacctttactgcaacaatgttctgaaagctattctaagatttgcatatctaatgaaaagttccatagcgatcatctgattagaaattgtggcattttaatacttgaagacgatttaagttgtagtaattttcagaaacaactcatttctaatggtattattgataaatttgtcaatatttgtattagcccatcaaagtacaaatatcaggcttacctcacaattttcgtcacgtatttgcactacttgttcattttaatcaccactccaattggattttctattttgagagtagtttactcaatttattgcattgtttctgttggaggtactggatgggaacatttgtcagctgaggagttattgctttcacctcaagccggattattaaatgaaaatccaattattcctttcagatattcgttaaatggcaaaaattttttaagagtttaa

SEQ ID NO: 316 - DNA, 225 bp, Cryptosporidium hominis
atgattattactctgaatggtcagtttaaggtatcttctgccacaagcgcagtgataactttggaaggagttggaataaatccaaacaacactgcaggacaaattttcctcaagcatgggtcagagctacaactaattccaagagatcgagttggttgtagcatcaactccaacattgttcgcaatacatatggtaaggggaatcttttttatttaattttttaa

SEQ ID NO: 317 - DNA, 522 bp, Cryptosporidium hominis
atggataatgcaaatggccaacaaaatatagtttcatcttttccacctccaccaccatacttccgtctctttgatcatgaagacaaagtaacaaaaataaagccacctccctgcattgaggggccctttacttgctttggctctcagctctcttcggatatttcaattcatccgttagatagcgacacaatcttgtataatgaatccaatgttgacttgccagcagagttaatgatgttaaatgaaatgtttcaaatggaaatactcaaacttttggagaattcaggaaagggagttgtagatacttcatcagtcaagaagataattaaaatatataataatatgaaccatatattggagaagctcagaataatacaaacctattaccagatttgcgatgaattagaggcgcaggtgaatgagaaaaatcaacttttggatcagatgaaacaacatttagaagaatataaaagtttgctagatgacttgtctaaagaaaattctgacaaaatgagcgattaa

SEQ ID NO: 318 - DNA, 1095 bp, Cryptosporidium hominis
atggaaattcaggtacaaacttgcactttttttataaagtcaaaatctagaaattgcaaatttcctagatatggagattccaacttctgcaacttacacaaaggaatacaagatcaagtttgtgatgagaatcatgaaaaattagttaacaagattattccttgttttattgatggtagacattttgtttctataaataaaataagatctcatattagaaagtgctctagagttagagatattgcatatgaacttaatcagccattttgtatgcataataatggacctcctcacaacttgttgaatattagagagaaattacaagtaactgaaacttcacatatagaagaaatcaatcgaaaagcgattaaaaacaatcattcagactccaagaaaaaattaatagtttcaaaagaaagattggaatttgttgataaactccatgatttttgtgtacgtgaatttggtaaaaacccccattttgaatcaagacaggtagatattgataatttaaatttgaataggcatgaactacaagctataagtatttccaaagaattcaccaagagactaattaatagtgaaaattctatatcttgcaataattcaaataacaactttttatttgatgctgaaaactctttaataatagagtatggagctggaaatgcaattttgtcttattggttcattaaagaatgcggaaagcctcaaaataagattaaatcttctaaatttagaagtgtgataattgacagagagtcaaggaggaaacaaatggaaaagcttgatgaatctatttcctccatcagattaagacttgatattgaacagtttgatattaattctctaattttggtttgcaatagtgaagacatttctaaagagtcaataagagctcatatgtactcaagcttgggaaatggaaatgtaccatggattattagtactttacttgagcaaaaaatatggatgcatgattcatcaggaaaacaaattcagacaattgaagaagttgaacagctcagtaaagaagaacttaaatatatcttgacgactttatcaaatggaggcggccccaatatttcaaggtaa

SEQ ID NO: 319 - DNA, 978 bp, Cryptosporidium hominis
atgctaaatagcgacagaacagcagatttttttaatttcgtagaaaagcatgacagcacaagaagtgagggaaggataggaaattctgggcaatcgaacagatattctaattcgatccagggtagtcaatttaatctattggcatcagaaattagccaagaaatgaactctacatctttaaagattgaggagttgaataggatagttaaacaaaaaggtcttttcagggatagaacaaatcaaatacatcagcttactgaggatattaagacaagcgtaacagaactaaactccaggcttgaagtcctacagcaacatgctcaacaaggctttccatcatctggcggttattatcaaagcaaccaacattatatgacaatggtagaaactttgaaagcaagaatgcttgatattacacgagacttcaaggatacacttcagaaaagaactgaagtaattcagcaacaagattggagaaggaatctatattcatattcatcaaattcaaataatttatcaggttttactgggagctcaataggagattcaaaaacttcgtttagtagcggaacaaagtactctaagatgagtagagttccttttgatatagagagtggagaacatggtatggatcaaggggggactgagtttgaatttggagcagcccaaagtatgatgcaacatcaaaatcagtctttttcatatgcaagatctagagcagaagctgtagagaatgttcaaagaatgattggtgagttggcacaaatcttccagaaagttgcaggaatggtcactcagcaagaggaaatgattcaaagaatagatgaagatatctcaaataccttttcaaacgttgaacatggccatgcagagcttattaaatactataactatgtgaaatccaacagaggtttgattattaagctatttttactattgattgctttcatcatattctatgtaatcttcctaacttga

SEQ ID NO: 320 - DNA, 4482 bp, Cryptosporidium hominis
atgtctcagtataactatgtggtgacagcctttgaatcggggtcttttaaagggattttaaaggtggatttatttggagatggtataattagactattagcaataaaaacaagaagtatggaaatatatgaaattaataaggatgcagttttttttgatgagaaacttttggatgatgaaattgttgacatacctgctttgaataaagttgggacagtagaaatatacaaggacataatagaaattgatagatttcgtccaaaaaaccaggatttcgatgatgttttgatttttaccagggaatatgagctcattttactaagggcatatttgctgaattctgattctgagaagattttatgtatgagcatattagataaggtttccttgtatagagagaatttaagaaaatcacaattaattaaaatgatggttcattctgaaaagaatagaatagtgattttggcttatgagggttgtctacaggttgtgggatgtgaaatttcgagcaaagatgaagaaaataaggctgtttttacttcccctttaattatccgactttcagaactatctataactgatgtttgcctagcaaatactacaaatgaaaggagcctattgggaattttatatgattcagggtattcaaaagatcctagactgatgaaaattattgaactaccgattgatctacgtaagtggtcttataatacaaatatgggccatgttatgcaacaaaatgtcttcaaaatagccccactatattataggtctaaaaaacaaaaaatggttaagggtttctttttatttggagatgggattgtagagtaccgatcgattgaggaaattatgccaaataaaaccaaaaattcagaaactatttcaagtaaccaaaaaatagtgacaagcagatttaattcatcagcattcagtggaatggatattggtctctctcctttatcaataactgatattttgaacctggatgacggttcaagatggctggttctagacaatctgggtcggctttttataatgcttgtagagtatgatcaagatgatatcgacaaagtagttgatattagactgaatatactcaatagatactctccattctctagaatcgtaaatctgggggacgatttattctttctagcttcaaagctttcagattccttgttattatattccaaaaataacaatttttatattatttcgagtttgccaaatattggcccgataaaagatctcctttttacaaattttgatagaaaagaagaaactaaatatgaagatattccaagccaaatatcaaaaagagaccctttaccacttattgcagcttgcggatttggatcaggaggagctttgaagttgatttgtaacggtattggtctccagaacatatatataagtaacgactcatttgtagggcaaattacaaggatattctcactttgtagcactattggcaaagttattgtgacaggaattgatcattcttattgctacaaaatagcatggagttatgagaaaggcagagatgattataaagtaatggattctgttgatagctttaataaagaaaatcccaaccaaccaaaagggaaaaattcaagtcctgtttctcataagaaattttttattaacttcgaaaagtgcgaactacgggggcttgtgaaagatgaggaaacaatcaaagtttgtacttttagaggtaactactcctatcaagtaactccttcaggattgttccccacaggagagaccaatgatcatcataagaaatggttgctaaaagataatctccctcctattgccgattctggtttggaatatattgagaagtttgatttttgtgaaaaaaacgaagttgttgtcatctgtactggtactggattattgttattgtataggtttgatgatgaaagtgttcttagcttgatttatttcaaaactaaaactgaactttttgaactaatctccgaggacttgggaatcaatcacttatcagaagaaagtaaagatttgaataatgaaaagaatatactaaataattcaatttcgaatacaatggatgaagtttgtattatgggactcttttctatagacaactatatacttatcatcttagggacatggatgaatggaagtaaattaagttgtatttattacaataagcaggaaactggaaaaatcccaaattttgaacttttattgaatattgaaactgagtttcgagaatatgagactatggttacctctttaaaggtctttgagctagaaaggatgattgaaacacagaataaaaaacatacagaagaatttattggactgatagttggcacaaataacgggtacttgcaattgcaatatatttccaaagattcaataagaaagttaatgagaaatgggcaagaaaaggtcgaattaaaggataattgtagatttaaccattataatacatggaaaatctccaatagctttatttctgaaatttacgagacggaaatttctgaaagcttaaatagacattttttcatttgttgtgaacaacctaaagtcttgttttggagttataactctggtaaaggaaaacacgggcttggcgtatggagcttctttaacatacattcatcatggattcctttcctatgccaaattagaatacctccaagccctctactaaaacaagaattaaccaaaaaagataattatgcaaccaagacatgtattttgtatataactcatgaagaaaaagccgccaatgaaattcatattgataacttggcaaatcaagatcctgagaaattgggtggaatccaaatttcaagaaaaacaagccaacaacctttaataaaaatcggacttgtagacactcttcagaggtacaattgtaggagcattcctcttgaatttactccagaaaaggtttgctttattaaggatctcaatatgtatgcagtagccggagttaaggaaagatataagggcagatccacaatactcaagcctattttggaatctgaaatgattgaaaataatgaaaaagatgctatcaaagtaaatgaattaacatttatacaatcagtaatttgcctcatatcagcaaaagatatgaagattcactattgcaaatttttagaaaccaatacgtacccaacatgtttggaatatgtaactttgcgtgcttctaatgatgaaaatgatgttagatccttcttggccattggtaccagtaaagttgaatcaaatattgattcaaattctaactcaaatatgggaaccgagaatttcggaaaaattacgctttattcaattatcaacaaacattattcatatactctattagagtctgccgtatatgagactgaagtcgctccatttgtaataaaagaattcaaaatgtctcaattactaatttctattgagaattcactaatttgcctggaacttcacatttccaaaaatttagcagattcttctagttcaagctcttcgagctcatctgatatttggatgaacacagaaatggatcttgaattgacaagtattgaacttaagaggaaagaaacttattgtactcatacaatgatagtgtttattaaaattttgaatgaagaatatatccttgttggagatctgatgagatcagttggactttgggagtttgatagatatactggtaaatttcacgaagtttgtagagataactccatagcttgggtagtagaggggatattcttatcaaaggatatgtacttaatttctgatgagaatcgaaatttgagagtccttatgcgaactttaaacccagaaaatgatgaaacttacactagcttgtcatgtattgctcatcttcatgttggagaatcaataaccacctttcaacaagggaagtttagtcaagcatatcctgagacgagaaagtgcacaggtggacaagattgcatggaagaaagtcctgggaaactaatgtttgatgaacaaatagctttcgggagttcccaaggaggaatctaccttttattcagtattaaagatgatccaaaatttttctctcagttagtattgattgaagaagcaatcattcatgctttaaaaaatagtaatatggacatacaattaagaaataaggtatacaatttaagggattcggacttgaaaaagttatttataagaaactccaactcctctgtatttacaggagtagtgggagttctttgtgggaaggattacctaccattaagatgggaattaaatagtacgaaagaaagttataactttgaatatgattgttcaggaacccccagaggatttgtatgcggagatactatagaattattccttgattttcctatagatctgcagaaattagtcttaaaagaactacattcattcaagtctgcaagaaaactaaaactacctgacaatgtaaaccaattagaaactctaattgagcaacttaaaaatatgcattaa

SEQ ID NO: 321 - DNA, 3468 bp, Cryptosporidium hominis
atgatcggtctggtaaaagagaacacaagtaatatttccaataatataatttctgatgatatttatgcgaatgaaaactccaaatcacatagtataaattcgcaattccagaataatgagcataagagagcttctaaaaataacaaagcagtgggggattctgcatttagagcaatagccaacaatttcatgtctttatttgggtatggagatactgttcagtcggttaatgaaacaaacttctcggaggtaccagttaaccaaaaaccaaatatcggaaggcagaatgtaagtgatataatgggtgttcatcaaattagaggcggtgacattgttgcagttgggactgatgttgaagatgagaatccaacttctggagaaggccaaattgttaattcaagacttgaagcaagtaactcagcaactttattaagttctggaagcaagccgaacccatcgagcaaaacaacttcaaaaagtaatggaggagcagcttcaaaattagcctatgaaaagaatggtgataactcacagttgcaaattatagcacatgttagtggcagaccagtacatgcaaaatactcctatggaaagaataagtttaaggtagctcataaaattgttgagcaagcagatacaatgcattctggttctgaaaaggaagtggcgcaaatcccaaatgctccaaatcctaattcaataattgtgccttctcccataatacaatttaggcagattccagttcaaatggtaggtaaacagcatcagattgtttataacactccactaattactaaaagggttattcctcaaacaaataaaatcgtctatcagcctatatatactcataatcaagttgaaatgggtagcaatggacttgctggatctctggggcatggaatagtacacaagaatttgtactctcaagaagctattgttgggacaaataatttaattctaggaaaagaattacctggactttatccagtcggagtgggagcgataaatgcattaccaaacacgaattcttatctatgtaattcgataaataaccaaatattagggtttggaactccgttagttggttatagaagtatgtctcacgttccaaacaatggtttcactaatatagattcgaatcaatcttctggcgcagagcttttggatgtgaaccaagaaacaaggcttcaatcaagtaatgaagctgctgctagtagtgtgagtcatcccagaaatgggactgtaggctctgtaggttctgctggaagcgtatgccagcctatttcatcttttgggcttgggattccaatacaagtaaaaactttggaagaagacaatataaagagaaaggagaacgtatcttctagcaaacaaactgctcaggcttctaaacaagttttaagaacaaataatgggaattttcagactctttcacttacaacaacaacgtctagtgatactgggagtgtgacaatgagtaatcatgtcgttaatgctaaggcaatacaagagagaccttccaatactaatttggatactacgaaaacaatggttaaagagagcagtaatactcaagaaaagataaagagtgagaatgagcatgatttacataagggatttatccctcaggctagtccagtagttaattatagaagtactttggattatcttgtaactccaatggtaaggtatagagatattgcaagtaatcttaaggttaaaactgttcctcctcaactttcaagtgatgatgcatgtaaatatgttacaacagagattacagggaataatggtattatgagctcatcaaatggatcaaattctccaagaaatatgaatgttatgggtagtaatgaatataaggagacggtatatacgcctgtagctcctttatttattccgaattatcctgttgtgccgggtggagttggaagccctggagttattgagatgaacaatcccaagattaactcaaatattaatataatacctggtactgtcggctatactggcaattctctaccaaagcaatctcaagcttctaatactcaaggaagtaatccaataaatggattagtccctggaagctcacggggtggaagaatttttgatggaggtttgaattctcatatttatagaagagctcctgtgggagttcctcaaaaccttggatatagattagttagaactgtaaaaaattatgttgggtccagtaaggctcctattggagggagctctattcacaaggaaaattataccagagaggagaatctcaattatagaaatcaaaatacaagaaaaggatatgtaaataaaatgtatcagtatttagcggattcaagccaatttcctcctctaccaaaagaaatgtatgtaggtgatatagagtttctaacacgcccaatttcttcggaaccaagtgcaataaaagttaaaagattccccacaaattctcaggatggtgagacaaatgtgagccaagtaaaaggttctactcctgggaagggaagggaatgggatagtatcaatagaggaacattttgcacagtatataaggtaaggcataatgaatgtgttgcagctgtaaaatgtccccaaaaaagaattcatgattcagacccattaatgtcaagatatagatgttatactgaatggaagttactttataggtgtaacaggcatccaaatatcttaaatctaattggaggaattaggattaatgaatatgaaatttggttggtaacggaatatatcaggacaggtgatttgttcaagttgattcatggtaatggttctcgtagtaaagcttttagagaaagcgtggaatataggtacaaagtgatgtatcaattggcagattcaataagatttttacactctttgtctccaaaaatagtacataaagatctcaagtcaaataatattcttattgatgagaattacaatattcgaatttgtgattttggtgatgctgaggaactccattataatactataacatgctgtacagcagttacatggcaatatgcgcctccagaaattgtggggtgtactgacccagcgagacctaattcaaacgctaatgagaaggtggacgtttggagtatgggttgcatctttttagaaatcttatgcaagaggactcctttgcagcatgttttggataaagttgatgaaagtggtaagcactcaacactctataacctgattcattcaaacaaaattgaaggagaattgaaaattcctccacttcccgattctttatacaacttgattaccatgtgtctaagacctaatcctgatctcagggcatcttcaaaggaagtatttgattatctagtcaatagcgagaagaagatattgaaacaattgagttatattaatcaatataaattgagtagtggccattcaattgtgaataatcaaaagaatgatattaaagctttatctcagttaagagctgtataa

SEQ ID NO: 322 - DNA, 663 bp, Cryptosporidium hominis
atgaacaatttaagaaatatatcaaaaagtggtattgggtatagtttttgtcgcttgttagtcaggaaaacacataatttgtttggattcaaatttttgaatattggcattaatcaaattaatcttgcaagagcagctaggtttaattcaaccattaaagactcgaacactggtgaaaataacaaatacgtttactttggggatcgtattgtggacaaagatactaaaaggaagctaattgaacaggtttttagctcagtttcgaataaatatgatttaatgaatgatttgatgagtcttggattacataggtgttggaaggacatatttgtagagaatatcatttcaccagaatcatttttgagaataaaaagagagaaggacgaagatttctcaaatgtaactattttggatgttgctggaggaacaggagatatttcttttagaattattgataagttcagaaaagataatattgaggtcttaccaaatattatagttgtcgactctaataatgaaatgattgagcaaggacagctaaaatcaattgaaaaaggagactgcagcattatttggattaaagatgatggagaacaacttagtcaaattcctagtaacagtgtagatgttgttgcgatatcgtttggaattcgcaactttaca

SEQ ID NO: 323 - DNA, 2079 bp, Cryptosporidium hominis
atgaatttcatttttggagcaattttgtggggcttgttaatctttcctgctctttttcaaaaatgtcatggtaataaatatagaacaaatttagataaatatactaaaatatatcagtaccaaacaagcgaaattgaactttattttccaaataatgatatttttgagaacgaaagagaaaactcccaggctaaagaggatataaaagatttaaagtcaactgaagtgagcgatattaggtacagcttcatgaaattaggtggaaaagaatttctatgtggttttgagggacatggaaaaaatgatagccttaatttatcagaagaaactaatcaatcttgggataatatgaattctaaaatcaagaactatttaaagaagagtaaaatttcatggttaatagaacggtgtttcatatatacaaagaagaaagatattaataatggtattcatgtccaagtagatacctttgaaatatgtgttggtgtttcagttcgtcacaaaagacagataattgacaaagaaaccagtgacaatatattggaaagtcagttcaatattgtaggcgattataaacctacggaagatacattttatgaaaatggaacaatcatccactactataacccagcgatagaaaacctaaagggagattctgggtattcggcttcaattgaatttaaatgtagctataataaatcaggaatcagtcaagtaacagaagatgttaacaaagaatttaaacctgtgattaaagtagactttttgtccccttcattttgtgattggagggtagacgaaagcaagaatattacatctttgcataagctggaatctttactgctaccattagaaaacagatgccaaaactttacggattcaagattttggaattatgagctttgtaatctgtacgccgtatctcagttcaaaaaggatgcctcaactcaagaattgagactattcaatttaggaattcatccaaacactgctcaaatactaaatataacagatgatttagaagaatatttatctaagaatttaatttcaaatatagttaatacaataaagcctggtagagtttctttacttgaaaatataacaacaaaaattgaaccaagaaacataaacgagttgatttctggaaaatatgtgcatagtaaatatgttatcacagtaatgttgttaaatggaactcattgtccagaaaataatcagaaaagaagtattaaattagtattcgaatgccctgataactttgagagtatctctgattattttagaatagtaaatgttattgaggattcgacatgtaattatgagatgttaatcatttcccccgtaatctgctctcaccctttgttgatgcctcctccaatttataagcacgggaaagtcaaatgcatacctaagaatttgattattaacaaattaatagaggatgaatctacagagcatttatttgaatctcaaggaacaagaagtgaaagtgggctagttagtattagtcaaattggcaatcagtttgaagcagttaatatagaatatataaattcgatcaagaatgggagcggtactcaacatttctttactctgagcgattctcccaggattaggaactctaacctaaccagcccaaaatttttggtcggtcagattgtgcaacatttatggtggaactattatggcgtcgtagttgggtgggattgggaactaaatgcaccaaaacaatgggcagacaacatttatcaaaaataccctccagaatcaaggaaaaagcctcactatttgttactagttcatcagaaagaaactctcttcaacaactcatcgccaattgaatctattccatcaaatctcacacactcgtacattccagaaattgcattgaaacgcgttcccaacctagattctgataataatttctccagcaaaaatatcattattaataaatatctaaacacgtacttctcctattggtcagaaatccatcagagattcatacctaacacaaatagtaccctttggagaatttacccgaaggatttcgacaaactaaacgaaagggatgaactatag

SEQ ID NO: 324 - DNA, 2946 bp, Cryptosporidium hominis
atggaggtgaactcaagcaatttgttagttcctttacatagtataggatttgtgacagatgaagttccgtttgcattggagaagctaggagatgaatattttattgtagttgcaacaggtcactactatcaagtatatgacttggaccaactaaggattaaatatatatctcagaggatggagaatagaatagagaatttggttacaaagtatgagatggtttatgtatctatgggcgataaaattgctggttataataggcatgaaaagacgtttgagattgaacataactcaagagtaaaaggaatgcttgttcttggtgaattattgatttcatgggataaggagaccataatagtttctgagatagattctaatagactaaaatgtaaaattctggttgatatggatgtctctgaagaaattgtcacaattttacatccagtcacatatttgaacaaggtattagtagttacatcaaaaggatgtgaactttggaatattaatactaaaaaaatgatacataggttttcttcaatacaagttgttttaaatgcttccaaaagtatgaagaataaaattgaaaataacgataaacagaaaataattactgcagtaacaagctctcatccagatatagttgggattggaactcaaaatgggatggtttatacactagatattgcaaatgatatgattttactttctctcgagcatatgcctgagcagaaaggggtgagaagtgtaagcttttgctctgaaaaggccattttgatttcaggttgtgaaaatggagatattgtactatgggatttagaaaatgcacgagttttaagtatattagactctgctcatgaatctgaggtcgttaaagttcagtttgttccaggtgttttaatgtttattacctctggtaaagacaatgcattattggaatttgttattgataaccaaaattctccacctagagaacttaggtctaggagagggcacttaagctcaataattaaaacacagttctataatgctcttccagaaaaaagtagagacttactttgtattagtaacttcaagaattgtggttatcttggaaaaacatctacaatacaacaacatcaaaatcgcattttttcacaaaactctcttaaaaagaagtttaatgaaaagtatcaattcccctttagtaggttaccacctataatagatttctcatttgcagaatctaggcattttgactggccaaatatagtaactattcatcaaggaatgcatgaagtatttgtttggagtgggcataactttgcattaactccaaatttaataacattagagaacgtccaaaggcttgaaaaaaataagcaatcaaagagtaatcaatcccaaaattttgtatcgcatggtctaacagccaaaagaaaatctctacctttagcaaaagccatctcagtttcaggttgtggaaactatgtagttgttggatactctgatggatctatacatagatttaatctacaatcatgtattcattctgggcaattaattcttcctgataattccgaaattaatcaaccaactatggaaattctttcaatacatatttcacactccacaatggttctctgcattataagagacttggataattactacttatcaacatggtcgattaagcctattaaatatttaaataccaagattatactaagtagagcttctgttatatcaaatatagagactcaagaagtgtttatttccaagatttttggatatttattagctttaggattatctgatggcagggttattctttatgacttccaatcacaaataatttctagagaattccaatgtggtcatcatcatattttagatattacaatgtcttcagacaacaggtggattgtagtttcaacaaaaaatagtgaactttttatatttgatataatttcttcaaaccttttggattgggtcaaattcaaatctccagctatttgctgtgtatttgatcattcagatgcatttctaataacatctcatgatcaatcaaagggattactttctgtttgggcaaataaacatgccttaagcatttcagttggaattgaaggattatcaaatcctccatctgaaccttactatatagatgatcctcctaatagagtactttactttgaagattcagaccaagctttaaataatgataaagattctacaaaggaatcagaatctagtgacaatacaaatttgtccaactctgatcttcctgaaaatggagactatgatccttccttaatagacagaaaactaatgtcattttctggaattccattttcaactcttcaagcaatcttatttattgatgaaattaaagaaagaaacaaaccaattgaaccaccaaagaaaccagagagtgctccattttttctaccaaatacttcagaattctcatctacaattcataaaccctcaaaagaaagcgataatgaggaagtaatctcaaaagatttggcagaatctaaagatccaagttcatcacttaaaactgagctccaagaacttttagaaaaaacttccttggatgattcagactcttttttaagtattactaaacttttaaaatccaaatctccttctggtgtgaatcttcttttgagacaattagggcctctcagtggaggatctttccaggaaattgctcaaatgatacattactttaatatatctatatcaaaaagaacagattctgagttgattcaaacatacctaaatatctttcttaaaattcattccacaacaatactggaaaatgaatcggaatttaaagattttcaagatattattcttaagcttaataaccttgtaaagagtgactgggactctctccaagacaggcttcagaatatctcatgttttctaaagtttgttacaaatattcaaatagattaa

SEQ ID NO: 325 - DNA, 1773 bp, Cryptosporidium hominis
atgaaagatagaaactttgaacaattattagaagtaattaatggtaatagtactcaccaaagtaatttggagaaactaataactaattctataccagaattggagtcaaattttgagattcttgaattagaaaaaaagctaattattactaagttttcattgggcctaatggaatttaagtcagattcgaaaacttttcatcaagcaagaatgtctttattggccttaattttggaaaagcaagaaattaaggaaatacttgaatttaactttaatggctttaatccttcagtccatattttgcactctgtggaaatagcttctttggaaattagattattcttggaatctaaacttgtagagttggaagactttaaatttagccttgatgaatcaaaggataaaaaacaaatacaagacgatgaagaaattgatcttttaacaagtagctttcgaatattagattctcttcttactcagctaaacaaagatgaaaatttggattttttggaattttctgagaagattacaggagttcaggtagttgagttattagattcatcaaaaggtactgcaaaacattgtattgaatttgtattggatattgaaggaatcattcgagatgaatatgaaatggatcttaataagggagtattagaacttaaaggtaatactaactctaagacatcaagtttgtattggattatttattattcttgctcaatatcatctaaatggcaaattaacgagcctgatcaagaccttgataagtatattaaattgctagaaattgcatctaggtatttgaatcctcttcattttgcatctgtattccccacactaatccatatttctgtaatagactgggcaaatattcctggtatattagaaactatactaacatcaatgctttcattctctactttaattaaacaggaaaataagaaagaagggatttatagtggattatattatgcagcactcctaatcacatctgcctggtggtctccaggaatagatacatatagaatagcagcttcaaaaataaaagatggttcaagatctcttgaatatatttcaagaaattatttaaatctggatcacttagataagatacaggacagtaaagtctctttatcaaaacttagagtagaagaagagcagaaatctgggacaaaaatgccagaattcgtacctttagatacaaatgcaattcccgaatactcattcgaggataatcctggagtagatagagttagaaggatctcactaattatttttggactaattaaagagatttatcaagaagatattaatcaatttcaaggagaccagattaataaaatcttgtttattagacatttagatgatccaaattcacaaaattttgagaaatgttcagcttttattcagaccattatttgtattttaacattattaacttgtagagtccaaaactcttatataccatcagaactttggaatattatatttaaactaataattgtattgactccaaaatctagtaaagggtactattacgattcccctagaaaaatcacattttttatttcattacttagaactacagctatcgcattttcgagtggatattctgatcaagccaaacaatttgataaattactcgaggatctaaaaattgaaacaacatataacattccaaagctaataataagagacgattgtgaggaattctctgagcaagatgaagaatcaatcaaattcttccgtaatttattagatattagttag

SEQ ID NO: 326 - DNA, 420 bp, Cryptosporidium hominis
atgcaaaaatatataaattatagaataagagtaactgttcaagatgacagagttatggttgggaatcttatggcatttgatagacatatgaatttggtcttatctgattgccaagaatatagacgtgtaaagaaaggagaagagccaaaagagctaaagagatctctcggattaataatgcttagaggggaaaatattgtgactttcgttgcagaagcacccccaaagaatcaatcaaccaagcctgttgaacctacttttgcaggaaatattcagactgtagctagaggtccgcctttaattcctcctcctatgatgcctcctgggcaattcccattaattaatccttcgattggaggcctacccattccacctccaggagtccctcctttacctccaaatattcatggtaataaatag

SEQ ID NO: 327 - DNA, 663 bp, Cryptosporidium hominis
atgagtttagaaacactctctgctttgtatccaaaggcaacaaagtctaaaaatgaggcagaaaggctgctggagcagtttgagttggggttggatcgttcaattgctttacaacaaaggttatcagctatccttaatgatttttgcaggcaagtaacagaattaaaacaagttcttgataaactaaaatcctccaaatctattgaccgctctcaagaaaagatttgggatcgaagaattgataatttagtatctgattccaattctttaagagaatctatttcaaagcagttagaccatattcacaaaagtcagattgaagagcagaagaaattatcatattcttctccagaaaagaatagtggggtcggagccctaatacgtgaaaatgctatttggcaagagagccatattgctattgatcatgcactagagcaagcaagaagtattgtttttaatctaaaaaaccaaaatagaatgcttaaatctgtaaggaaaaaagctctagatatggccagtcgattaggaatcagccactctttgctttcaaatatcgagagacgaaacctagttgaccagattctagtttatggatgcattctccttacatcactgatttttattactatttatttatttattcactatgtttatcgtaagtga

SEQ ID NO: 328 - DNA, 405 bp, Cryptosporidium hominis
atggtaattccaacggttgaatttagtattagagttctatttattaatgttaaaggccatggaattcagtatggcactttgggaaagagtagtctgaaaagcaatgttgggctttctacaattattcaacagtcgttaaaaagtttaatgaaaggttgtcaaattaagtttccaatggaacttgttaatatcaaagaatttaactataaaagctcggtagaaaaatattcaccaatcatttccaagaacttggcatctatggtgatgagatcggactccatagtatttaaaaatggcctatttgaaatactttctagatgcgatcctgagaattcaacaaatttgtcagatttactaggtgggttttgtgtggtaaatcacacaattaaaaatatatctttctaa

SEQ ID NO: 329 - DNA, 777 bp, Cryptosporidium hominis
atgatattactttatgctacacaacatggagaaggaaacgttaaagttaagatgagaatgggaaacaagatttgggagtttactctgctttgtaacttgaatgatggatctttttatgtagggaatagtgagagttttgatcataccaattgggattggataactgaattctcagtgtctatgaaaatgagcttaggactagaatacttacaagagaagtacttttctatggaactttatgcaaaatcatgtcttaagaagattcaaagttatttggtactttctaaattttggaatagccatattttcttaaactttgaaacaaatatgaaaatggatacttctgatttgacaaaaggagatatcaatttatcatttttcgatatttttgaagataattttgttcggtattcaagtaataaaggatctaaatataagattgattcagttttcggttttttgagagaatttcatgtaaaaaaagaaaaccaagtagatgatattgaatatcaaaatattgataaagaaaaccaatcaaacttaaatatatccaatacatctcaaacaacttctctaaagacaggctatctttacgtttaccgtttttcgaatggaatgccaattatttgtaaagatacagaatattgtgatattgtaacatcagttaaaagcttcattagaaagaaaggaaatatctttggaatgaaattggcaaaaaaagatgaaatagtagaaaataatcatgagaaactttcagtgttttctggggtaagttag

SEQ ID NO: 330 - DNA, 651 bp, Cryptosporidium hominis
atgaagagtatagaggagatgttttacagtaggtctactgaggatgaggaacagtttaggtcaagaactatgggacttgtttctatggaaacttataaaaggcatataagtgatattcggagggggattaagcctgaaaatgtttcaaagaaaacaaagatcattccagaatccaaacctaaaaagatgaaatacaataccttatcgttcgaattcaatcaaggagacgatgtaccagaccaaattcctgataaagaggaccaatcagagactatatccaatgaaattactttaacaactataaaagattctttatcaggagaaaacaaatccacagaatctttagaaaaacactcagagtttgactttagtacaataggaaaagatacatctatagatacatcctttcttcccgataaaaaaagagagcttgaagaagcgaaagcaagagaaaaacttaaacaagaggaatttgaaaaggaagagaaactgaaacaagagataattgaagttgtattttcatattgggatggaagtgggcacagaagatctgttcatgttccaaggaatactacaattggcgaatttcttgagaaatgtagaataaagctaaaatcagaattcaaagaattttcaaggctttctaggtaa

SEQ ID NO: 331 - DNA, 2256 bp, Cryptosporidium hominis
atggaaaatttggggaaaatgagtaatccaaatcaaaatcttggagctcaacatcttaaagtgagcggagaaaatcagcatattgagcatgattatgatgagccaactattccagcagattgttggaatgaatcacaagaggattacaaagttggaggttaccacccagtatcgattggggaggtttataatggtagatatttgattgtttcgaagttaggatggggccatttttcaacagtatggttggctattgacactttaagcacacctactacttattttgctttaaagttccaaaaaggagcccaagagtaccgacaggctgcatatgacgaaatggagatattaacggctactaagaaccatgctagtggggaggagtggagggaatctttgaatagacatttagaaagttgcattgagaattttactcgtccattttcaaggaactttaatggtgttgtaggttttattgattactttgaggtttcaggtccaaatggccaacatgtttgtatggtatttgaagtattggggccgaatatcttgcaattaatcagcttgtatgactataaaggagttccaattgatatagtcaggaagattgctgcccattcgttaattggattggactatttgcatcgtatttgtggtgtaatacacactgatatcaaaccagaaaacatagttgtttcaagctcttctattcccatggttgattttagagttatcaacactgaagaaaagtacgatgctgattcctcaaacatcaaagaatcagacgaccaccacattcgggatggttctaattctgataataatattaaagacgttactacagcaactgaaataacaaattcaacaaccgctgactctattcataatagtaataccaatgaccccagcaatggaaattcaacccagtatcatggtttaaacgctaaagaaagaagaaggttaaagaggaaaaatcagagaaaaaacaagcaaaagttaggttctcaggctaccgagtcaagtaacgctgaggaagacgttattgaatgcataccaggcgaagccaaaaatactgaagcttctgaaaaaggaaaaagactatctactcctccatttttaaagcttcatctgaaaccaatgccttcagacccaactcattcaagttattatcaaatcaattttaattcaaagaagttggaaaaaagctctactgagcagagcaaattggagaattttagcttcaattcaaacatgaataacttaaaccagtttcctttaataaagccaccttatcatcatcacttgtatgaagtttatcatcctcagcagtatattgcaaatgatgagcaaagatatactcatttacttcctctcactcaatggaacaaaagttatgttggaggttcagaactattattacaagaaaatcataagttttcaaagaactcgagggcagattcgaaagctcttcgttttgaggttaatgaggaaaaaattatggaggtttctaatgttattaaacaaattagtgtgaatcctaacacgttttctagaaatgaagcagagtatttcattgtagatcttgggaatgcttgctggatgaataagcattttagtcaggatattcaaaccaggcaatataggagccctgaagttattgtaggtgcgggctacgattggtctgctgacatttggagcttaggatgcacaatctttgaacttctaaccggtgatcttctcttcactcccaaggcaacagaagattttagtggtgacgatgatcatcttgctcagatgattgagcttcttggagaatttcctaagtctttgatcaaatcaggaaaacattcaaagagatttttcaataaacataataaattacacaaaatctccaagcttcaatattgggatctgaagtcagttcttattcataaatactgtatcaacaaatttgaggcccacaatttttccttattcttatattcatttttggccctagaccccaggatgaggcctggagctcaaactttgcttgatcatccatggctgcgtatcagaggagtcagttcggattatttggaaaatatgttagctcgtcttgagagacctctcacattagtagatgaagagaatatctccagagatctacaatctcttacgatttctgagaatgatcaaggagattacaaaaatttatccattaaacaagaattatccgagtggtttaatcaatttaagaagacccttgattcataa

SEQ ID NO: 332 - DNA, 1170 bp, Cryptosporidium hominis
atgatggaaagtatccttattcaaggtctggttggttcaatcattgtttatatggttttttctagagggaaaaataaccttcttttgtttccaaggcttaataaattcagatatattatatctattttattatgttcgtcaataatagcttacacaattgtctcaaagccacaaacatattatgacattattcaagtagatagatgggctcctagaacagaactagttcaagcaattagaattgcaaagaagaagtatcaccctgataaaaataagctagatgaaaagtcaaactatactgaacttttctatgaaattcaaaagattgaaactgtgttcagttctgaaactaagagaaataattataataaatatggagattttagagctgatggtaatatcgaagatagaaatattattctatgccttattttaggtgctgcttttcatgtttactcctgcttatttggactattcttatcattcccctccatattcagaaaatctagaggattatttccagtatattccattgcagttttttgtgccgaactacatatgagactttccgatgaccccaatccactttcatttttaccagttattggaggattacttccttttgaaaagattcgagtgttaagatctctttttacatgcgttttgattatctcctttgtctatgcatcaaattactaccgagattatgatgaaatacttaatggtatgcttaaaggaaatctaattactaataaaagaattattgatttgactcagtcactcattgtacaacttcagactcatggaataggctctacctctacatctagtggtcaaaacaagaacaaaaagaaaagtaattcaacatcatcatcatctaacgctactcctcttcctccaaaaattaaagtggatagcgatcatgaacaagaagatcctcaattagaagtaattcagcaactcagtgagcctcttaaggagcttgcatctacaatgaacgaatcccagaaaaagcaacttcaaacagtcttaaacatcgcttttactgccaagggaaaggagaataagaaggaaggaggtggattcctcagtcgaatttttgggagcagtttcttttggattattttggttggttacgtttttcaaattatcaagaactatctttcctaa

SEQ ID NO: 333 - DNA, 729 bp, Cryptosporidium hominis
atgaaattatcagaaggagcatatagagctaaattggctgatatggttggtaactacaaggatgtaattaaagtactcactgaatcttctgactttagagataactctcttatattgttattggctggatccctaagaaacagagttacttcgattcgaaattctctcaaatctattaagagccaagaagaaaagctaagaaaagaaaaaagtctgaataatgaatttattcaagttatcgaggatattaaacgagattttgaggaatctatcctcctagaaagtgaagatgttatacgcattattgatgataacttgctaatgtattcagaagaaggtgctagagcattttgtattaaacttaaaggagatctaatgagatatagagctgaaattttcaaagatgatgaaaagaatcaatgtattaaacaagctgttgagttttatgaagatgctcttcaacgtgaaagatcattcctagaaaaatacccatcagatcctttatacctagcaacaatccttaattatacaatacttaagtatgacttattaggtaatccagaaggagcaatgaaatttgcaaacagagctattcaagcagcagagaattctagatcagactctgagcagttttctgaaaatactgaaaaacttctcaaaatcttaaaagataatgtatcccagtgggaacaaggatgcagtggtctgctaactagtgcattcttttaa

SEQ ID NO: 334 - DNA, 411 bp, Cryptosporidium hominis
atggcctctattcaagaaaaacttcaaaaatttactcttggcgagtctcttaaagatgaatttgtttctatttgtctagtacgagatatccacaactctaaagagctcttggaaattcttatgaaaaagaatcatccaaaattactagaattgactcaagatcaatctagacaatttgttatattaatgaatgcaaggatggtaggttcatttccggatgtatcttttctcaaattgactagtaaaatcttttttttttttgaacattattttcagatatataatttggaacacattttaatttccctttcaatttgtctattaaaaagaaagtttcagagtaaaacaaaaactaaagcctttgagacagaagttatttataatatatctccttcaacaaatgtaagttag

SEQ ID NO: 335 - DNA, 438 bp, Cryptosporidium hominis
atggcgaaattaatgagacaaggtcgcgtggttgtattgcttaatggccgttatgcaggaaagaaggctgttgttgtaaatacctttgagtctggaacaaaagaccgtccattcccatttgtcttagtagcaggtgttgagaaggctccattaaaggtacataagagattatctaaggaaaagctcaagaagaagtctacaattaagccattcttgaagtcaattaatatgaatcatgtgatgccaactcgttatgtggtctctgattttgacattaagccacttctccagggcattgatatgcaggaagctgacggcaagaaacaagcattgagagctcttcatcttgctttcaatgacaagctcatcaacatccaatctgaaaagggtaaagcaccaaaggatttgattttcttaagaaagcctttaagattctaa

SEQ ID NO: 336 - DNA, 855 bp, Cryptosporidium hominis
atggaggttgtaaattctgcagtaacaataatcagtgatcccgaaaagtgtagaacttgggtatcccaacacaaatcttcagttaaagcttatatttctctggcaatattctgtgtggttgtattttttttcctttctgatggtgatttctcatttcttttaaccttatcatccttaacatcagccttcagcttcgcaatggtttgcctcaagatagaaattacaaaatcttgtgcaggggtgtctcttaggatgatggaagcatatgtaattctaatatttgcaagattgtgttctattattccatttgaaggatacttaccttacgatcgaagcggagattggctataccagaccttagaagcaagttgtatgattatagcaggtaccattgtatacttatgtagatacagatacaaagagacttatgacccaaattctgatgaattcaatagtatgtatttgatcatccctgcattcttaatggctctcgtattccatccttctcttaattcatggatgcctgcagatattgcatggacttttgctctataccttgaaagtgttgttgtcctccctcagctctttatgttccagaaagaacgcaaggtcgttcctttcaccagccatttccttgctatgcaggctgtaagtaaagtcctggctttcatattttggatttcttcctacacagaacttaacgacccatccaaagttctcaagaagcatgttgggtactgggttattataatgcagattgtgcagcttgcacttatgggagactttgtctatcattatgctagatgtataaccagaggtgtcccagttcagtttattctgatggaaaatgtttaa

SEQ ID NO: 337 - DNA, 1077 bp, Cryptosporidium hominis
atgtcaatctgtcaagaaagagcaaaggaattagcagaaaatgcaaagaagatcgcaagcccaggaaagggtatattggcagcagatgaatccactggtacaattaagaagagatttgatcaggctggaattgagaatactgaagcaaacagagcagcttatagagaattgctttttaaaactgaaggtttgaatcaatacatttctggagttatcctatacgaagaaactcttttccaaagtacagcaagtggtgagaagatgaccgacttattaaaaaagcaaggaatcttaccaggaatcaaggttgatatgggtttgactactttaccacttactgacggtgaaacttccacaactggtctggatggattaggagccagatgcaagaaatactacgatgctggagctcgttttgcaaaatggagagcagttctcactattgaccaggctaagggaaagccaagctgcctttcaatttctgaaactgctcatacattggctagatatgctgcaatctgccaagaaaacggtcttgttccaattgtagagccggaaatattatctgatggatcacatgatatcgagttttgtgccaaggttacagaaaaggttttggctgaagttgttaaagctcttcatctccaccacgtattattggaaggctcactattgaagccaaatatggttaccccaggttctgactgcccaaaaagagcatcttctcaagaagttgccttttataccattcgaactttaaaaagaactattccatcagcaatggcaggagttatgttcctctcaggtggtcaatctgaggaagaagcatcacttaacttatgtgaaatgaacaagatcaaggattgccctttattcttgtccttctcatatggtcgtgccttgcaagcttcagttttgaaggcatggaaaggagatgcatccaatgttccagctgctcagaaggcacttttagagagagccaaggcaaactcagaggctcaattgggagtctacaagggtggtgttggtggttctgctgcttctgaaggattattcgtcaagtcttatgtttactag

SEQ ID NO: 338 - DNA, 1632 bp, Cryptosporidium hominis
atggatggaattacctcaaccacaagcattaaatctcagtttgttgtaggaaaggcaaggtggagaccgggatttccttcacaaattgcattctgttgttcagctattgactctgcaatctacgtttatgacctactggatcctattcggcctattcaaaggttttctagacatactgatgtagttagagactttgattggcttgaatctgatgctattatgagctgtggagctgataagaagcttattctatctgtatgggaggacgcagcaaaaccaaataggaagattaaaacatcttcttgtctttatactccgaatttccacgattctattgaagcttcccaaagagtagttttcaatatatcacacgagttctttaggaaaaccgttaagaaaaactttgaaatttacaataatccagtttctggagaaacttccaattcaaatacagaactgaagaaacaaaatagtgatttcaagtccaaagtaagggaactcatggataaatctgactcaattttcaaattttgtagtgaaagaaatgagctattcaagtattctctttattcagtcacaggatttctccctgacattggtcttgttcagtttcctggagaccttgcatcaatattagatccaaggtgtgagctggaaaggaggctccatatacatgaacttaataataggaaatctgattggataaggataatccacagacttggggtttttggactgactccaagctggagttcaatcttctcaagcttaggctccaccaaggttcacaattggaaagtcaaatggggaccacgcattattgtacataaaaacaaaagtatctccgaactgaatgggatggtttatatttcttcaggcagaggagaagacccaagaagttttttatttaatagagatagtttgaagaaattgactttagaagaaaaagtggagtgtatttttgaattctttctcgaagtttttggcattaagatacttcaggaacaaagatatatgtatataattaagaaaaaatgctctttaaaggaaactattgaagctatttcgaatgaactaaatctccaatccaacatgaacaatgttgtaatttgtcttttaattgtaaataacttattaccttgcataacacctccagattcaccaatcttaaaatccactattttgttgcagttaaagttgactctaagcttaattaatttccttagaaaacttggacttttttgtctctcttcacaactgattaagtctagccaaataaagaaaataagaaatctagggagggaaaatatatcagaatcaaacttttattgtggaagtattatacaaggaaatgaaaaggactcttttttcgagtcaaaatcttattgtgaaagacaaataaagtcagaaaaagctctactagataagaacttccagccaagaacagatcttcattcatgcttgaagtgtaattcaagcaaaaatatttgtgtggtttgtagtgaaccagttctaggactctgggttggatgtccttgctgtagacatggaggacatccaaaacatataaaggagtggttcctttcaaattcaatttgtccttctggatgcggccacttatgcctctattag

SEQ ID NO: 339 - DNA, 753 bp, Cryptosporidium hominis
atgtctagaaagtactttgtgggtggtaacttcaagtgcaatggcacaaaagaatctctaaagactctgattgattctttcaaacaagtggaatcaagtaattcagaggtttacgtattcccaacttcactacatatttcattggtcaaagagtttttcggtaatgatcatccaggagtattcaagattggatcacagaacatttcttgtaccggaaacggagcatttacgggcgaagtttcttgcgaaatgcttaaagatatggatattgattgttctttagtaggccattctgaaagaagacagtactattcggaaactgaccaaatcgtaaataataaggtaaagaagggtttggagaatggcctgaagattgttctttgtattggagagtcattaagtgagagagaaacaggaaagaccaatgatgtcatacagaagcagttgacggaagctttaaaggatgtgagtgatttatctaacttagtcatagcttacgagccaatttgggctatcggaacaggagtagtagcaacacctgagcaagctcaagaggctcatgcatttattagagaatatgttacaaagatgtataattcccaagtatcttccaatttaagaataatttatggaggatcggtcactcctgataattgtaatgaattaatcaaatgcgccgatattgatggtttccttgttggaggagcttcattgaagccgacatttgcaaaaatcattgaatctgcacagtaa

SEQ ID NO: 340 - DNA, 540 bp, Cryptosporidium hominis
atgacattatcaccatcctcttcttcttcctcttcctcatcttcatcctcatcttcatcctcatcctcatcttcatcttcatcttcatcttcatcttcatcttctatgattacatcaacttctgcttcaacaattttaaaaacccaacaaactttaagtgatcttccgggagttttttataatgatggaactcgaaatgaacaaatgagaacatataagtggtttaggccaccatttgggagacttacaaaacagcaatacgaactggtagtatctaggggatacaacgttgtaatgtgtgatgtatacccaaatgatgtttcatttcaaggattcccccaatttcttgcccagttttgtaccagtaatgcttctcctggttcaattgtttgcttacatataccttccaatagtttcagatcagctaacattgaagttttaaagctaatgcttccagaattatccactaaatttaaatgtgtaactctatctcaattggcagaacaagtatacagagagcagagttccgataatttatag

SEQ ID NO: 341 - DNA, 222 bp, Cryptosporidium hominis
atggggaaacggagaaagaagaagaagttaagcatcttaaggcttttgatgaccgatggaaatgcctatcaatctgatttatcagacgattctgatatagttgggaaggatgtctttgaaaatgctgcaatcaatagtttggttagtgggttagaagatgatgaattgggtaagttttcaagagaaaaaaaaattggggttattctggaacttctgattgaa

SEQ ID NO: 342 - DNA, 2655 bp, Cryptosporidium hominis
atgaaaagcaagtcaaaattgcaagttgatgttgaggccaaggctgaagctgaggttgaaactgaaactgaaaccgagtcagagactattgcttctgattttaaagtaaagattaaaggaatgaagagtaatcggtttaaatttgaaagttacattaatcgactttcttctattgagttaaaggttggagaggataaaatttggaatttcagctcagaaaatgttgaggaagataagtggtattctgaagacaattttcaagatcaaaaaatggatagttctgagtctgaggtagaggattactcagaaattgctcttgaacagcaagtaaaagaacaactttctaagactgctttcggagatagcctaaaatactgggagggaactgtcagatattcagaatttgtcgatttggttagaattttgaagccatataggcactctcttgtccatattattcaacacttggagtttattattaaggaactcacacatagaattaacgaatgtgaatatcctgaaactgctgaagctatttcttttctaattggagcattagctaaagacacacgcctagaactttttcctatgcttccaaaaatatttgaggctctatctattcgtttagaaactccatttaatgaggtatctattactggtaaaggaggagttgggttatataatgaaaaagttattcagtcagtattttcttgtactagtactatattcttttatctttcaagctatattttgaaagatttaactaattatctctctatttacaggaaatggatataccacagtagctccgtaattagacatttctcatctgaatcaattgcatatgctcttaaaaagagcaaagaaccggatattattaagtctttggatattatctttcaattttcattcaatgaatataatcatgtttccacaaagactgactttttgaataaatggttatctgaagtaattgttaatgtcgtattttcaattaatggatgtatctcaaatcaagggaatcttgtccttagatacttatatagacatcttggatttggactccaaattgagcctaaatacttattcaatcaaaatcaatcctttcaagaagatcaagaaattatttcaagctttctaacttccattaatgatggagaaaatgttcgaaattataactttaagagttcttgtaattttgatttcagaaaatcatttacttctcttaaccttattctaaaagatattcttaatcaaatcaatgatcatatatcagatactggtaacgtggaaagtcttcaagaaattctgagtactttattatccatttacttagaaattttggactcttctttccctaattcttccaaatttcattctaattctgattttaatatcgagtatataactcttcatttaattacatgtattcaaatgattacaaatacttgtcattatcaggttaatagtacaaatcttcgttcagagtcttctgcttataagaaaaagaggttcagattcaactttggtattattattttacattttattttagctaatataaaaaatggagtatttgagaaattttatattgaaattaatcagtctcaaactgagtggtctctattattttcccagcttattgtgtcttatatggactttgtatcaaaaattactatggatggaaccattctccatgattccagttgtatacatgctttggcttattctgactttaaattatcacaaagtaattcattcattaagattctttcatctactgtctcatctttaacttttcttgcttctaataaaggatctttcaactctcatccttggatttggcttaaatcaatatttgaaatctgtaaagatactaaacaagtcgaaaatagatctaacttaattatattggtaatgaactcagctttaaacattcttcccatatttaataataaaaaccactattataatgaatttgaaagttttatgaatattattttagagtaccaaaaattccttttggaagattttctcaaatccaataactctaattatgaaccaagtctcaaaatattatctaatatctccaagtttatcgcccaagatgattcatttggtactaaaagtctatatttgaataattctgacttatctatcttaattttaagaaattgcaaatatgttattgctaatcaagacttggaactatgtaatctttacatagtattagaattacttggctatttctgtttagaaaaccaatacattttcagttcaaatctagataccagccttcttcaagaccttaaatctagtttgcttctaatatatacaaaactatttaaattaaaacttgacagcgatttgagaattttagatacttttgaaactttagaatatattcaagtattcaagttgttttgcttagtattctcaagattagatatgaatcaaattactttgataaaaatgactaccaaaataaaattctggatgaatttgaatgatctttcatcttcaagcatgttgaaagattctatttcaagtatttctactattccattgcaatatgatttagagattatcacaatcgtgcatattctatttaaatccaggcttggaaaaatctccagattccatggacttaaataa

SEQ ID NO: 343 - DNA, 936 bp, Cryptosporidium hominis
atgagtttactcctttctgtaattattgatcctcttgtcaatgttaaattatctttaaatgattcatgtatttcaaatcaagataatgattttgaaataaatcattcaaaagatttagaattccttaatactcttaaatcaatttcctccacaattttatcagagattcccgaagttgaattaaaaggttattgtaagtcctttttccttaataccattattagtcatgataatataaatcaagtatccaaattctggatatggactcaatctcatttccaagaaaaagaaaagatacctgaagattttggatttgtatataataatcaatgcatcactttatcttcatataaaaaagatcaaaatcttcaaagctcattttctaacaaaattaaaatctcaatgaaacatattaatttatacacttctcaatataagattgttttaagattcttatcttatttggatcatttactcaattttatgtctcatactattaaagatcatattcatgtaatactaatcattcttacaaatattttatatttaaaccataatatcatgaagatagctaataatagcttggaatatgaaaaagatatacaaccagtatctttaaagcttcaaaatgatcatgatcttatattggaagaggatgaagaaaaagaagatatacaaagaaaaattgcaatcaatagagttcgaatgacttgcaaacaaatatttatttcaatttcaagtatattaaataattattctgaattttcagcctatttcaagtatttgatatctcccatttctcccttattattatcaagttttgagaataatttgaaatctttatcaaatcttcatatttcttcaattatgagttttatgataaatttatcaaaggaagaaactcttttggatttctatacttatttatttccataa

SEQ ID NO: 344 - DNA, 3963 bp, Cryptosporidium hominis
atgcttacaagaaatatgaagaaaacaaatagtagacaagaaataattacattcaaggagttaattttattgaaaattctggcatttgtggaaatcaataagagatcttcacaagatttaatgaatatagaaaaagtggaggattatcataaaaacagtagaaaagatgagtatttgagtattattaaaatcattttattacttttactttctacaataagtaaggtacattcaaagaatgagaatataactagctttaattggaatatttttaacttgattttaaatatgttaaggattttggatataaatattcatattagaaaagataatgaaaatgatgagacacaagattataaattttgtaaagataagttaatagatagaattggttctttgataataatgaacaatcaagaattgataaatggagatatgaatagtttcaattcttcatttttaattttaatttcagatattatgagttatttacttttaaagacttcaaatttaaagcttagaagtacaatttctgagatctttttattttctgagttatctttatcaggaaaaggaggctactttaacttgattttagattcaatggatgaatattgtaataattcgagtagaaaagttaataatttacaaaaagaagagttattaaactttgaaggatttactattaattctattttggttaaacataaagatgtgataggtttaagtccagaaattactagtaatttgaatattttaatacctttagctatttatgggttaaataaaccaagtaagaaaaaaagagtattagattcatctggaaatattgatttacaattggatatattaaaggatttagagataatattggaattagatacttgtattaagatattgaataaatatctaagggttttatattccttaatttctcaacaattatatttgattggaggaaatgaaggtgtagatttttcaatttcaagcttaagttcaagatttattaaaaaattggttctttcttggtgtaattcaatcaaaacagttattttggataattcagaagcaaatagaaatgataaagaaaaagatgtaatgattggatatatattgaatatacttttaaaccttgtgataccttatcaagaggaagtgattagatattctcaggatttgttaataaagaggaatattttacaattacttgacgtgattattgagaattttactccattattagaccaattcagtgtaaagatgagtatttctagagatcttttaatagaaaagttccatttaagcttgtttcctattattacttatacaacaattgaagataatgagcaagtaagattatttgaagaattgacacatatacaaaaacatagaagagctagatctttgaacttttttggaaggttttctaagttctcttttgagaaatttggaaaagataaaatggataatgttgaaaatgacattatgtacttgggaaagtataaaatgcaaatccctgttaatgtttacactattaaaactataggaattcctttagctttggatgcacttcttcagaagggttcaggtaaagaaacttatagtttaagtttgggagacaattctttgagatctattgaagcttttgctttattttttgactggagattttgtattgatttaacggggtacctaataaaattactaagattatttccacaaagaaagacatatataattaaggggatttgttctttattgaattcatttgattttcaaattaatgaactagttaccagcaatattttggacattagtgatttgcaatacaaggtttcttcagttaacgacccggaacaggaacaggagcaagaccaggaccaagaccaggaccagaaccaagatcaagatcaagtcagagctcaaaatccaggaaagaacctagaagaacaactcaatgaaatgcagacaagtatcaaacaaaggcttttgcctctcttgaggtcaattatggttgatagaagctataaaatagattcaaagaatgaacaaagtcaaataattaatccagaacttaagcaaaagagtggagtttcaaaatcttcctctcaacaccatggactaattagatctgacattgtattaatcattattagagttctaagatgtttaccttcaaaacaattccattcagaacttccaagacttattacacaattgatcatggcacttaaatcaaaagatagagaaattagacgcagctccaggtcatccttaaaatctattagtaagactctgggagtacaatatttaccttggatatttactcaaatgtccagtatacttacaacagggtatcaacttcctgttttaatctttactgtacattcaatacttcatgaaatctctatttctctccataatttaaataaaaacgagtcgaatcctatattatttgatgattgtattccaatacttggtaaaatggttattgaagaacttaatagaattgctgatcctgataaaagaactacatcattagaaactattgatactccaatgacaggatctgttgatgaaggaaaatatgttagatcccctcaaattattagaatcatatcaaaattcgtttctctccaaggagctgagaaattatttgaattcttagaagatttattaagtggaaaacttggaaatagagaagaggccagtgttatttctgattctttcagccagaaatatttatattggttaaagaatcttcattttcaattttgtattggatttatcaacaatgaaaattttggacaaaatactaaactcaaattctctatatataatttagcaaaaggagtagttattgatagaagtatgatcaaaaattatgatatccgtatattaatttcatctcttgataaaaagatcttaaatttattccaagatcctctcaatttaatagaatctattaaaactggaacttataatccatctgttttatcaaatactcaagcaccaaaaattgatcgaatggaaagaaaagagaggtattataaaatacaaccaggagcttccattggaagaggtatacatcaagttattaaacgtcaaaaaggatttgaaagtaaagttaaatcagttgtattaagtagctcttgtttatacttattgaaccaattactcaaagttgttaataatgttaacttaccagagttagtttctgaagatggaaatctacaatatttttcaattaatctccttcttgatcatcttttacctcttgttactatcaattttgcaaatgaatccagtgaattagcatcattttcatgtaaatgtttaattcgagttttatttattgaatctatggaatctaccagaaatcttggtattctagaaattgatcatttaggatcacttatttcaaaaactgctctaagtattatggagagatctggagttaattctttaaacacttctaatggaatggctgaattaatttcatcttctatgaaactttttgtagctttattaatcagaccaaaatctgttgaatggtttaatggactgttttttgatcatagtatgaagaaaactactttattctacacgaatatacttaaacaactacatattacaattaatgataataggcttagaattacatctcttcaacttttgagacaaattatattatatggaaaagatcaagtaactgtatctagtgattctttgggttctctttattcacttgttgattcagttcttcctttaattgttcaatatagtggtatggaaccaaaaattgtagctatgggatgtaatatttatgtagatcttctattatattatccaatgtcagaacaatcacaaagaccaagaatttcaggttctactttgggatttaccagattatcctacctccagaaggaagaccaggccttactaacagccatcatattttaa

SEQ ID NO: 345 - DNA, 492 bp, Cryptosporidium hominis
atgataggattattaccattagttattaatgattcaagctttaattgggagaattctataatcataggttcactcaagcatgcaacaagagctctatatcaaagttctacaatgcttaaaaaacaagatttcacagaaaaaggattccatatgtataatataacaaattttgaatgggttcaagatatacaaaagtttggagtatatcaaattataggtcagacttgtttatttgctcaaagagcagttgaaagatgggacaaagtctttaatgatattgggaaagcaaacattttgttagattgtctttcagatgctagaaagagtgtaatatcaagtagaatggaaagaaagacaaaattaagattagatactgttagaaatccagaaatagcttttaagagaaagaaagcaatgagggaaaggattaaagaaaacaaaaagaggaagttaagagtaaagattgaaaatagaaagttaaatagggtttga

SEQ ID NO: 346 - DNA, 864 bp, Cryptosporidium hominis
atggatccagctacaatgaataatacaagaaggtttagaaggctttattttggtaatctacctataaatctaggtcttactgaatcaagctttcaacaaattgtctggcaggaaatggcattgagaggattatgtttgaatcccaatgaaaatcctatattgtgtgtttggtttgctcaaaaaaaaggtaattatggttttattgaatttagaactgtagaagaaactgaaaaagctcttcaattagatggttttgcttgcatgggatccaaaattaaggtctctagaccaaatgactattctcaagcactacaatcatcatcttcttcaacagcagttggaggatcgggaacaaatattcaatcaccttacaattcagcattaaatcctattaataatttgaattcccatacaaccataaatggagcaattaccaaagataatgctttttatttaggacaagaaactgcattacaactactattcactctagaagatacttattctttaggtacacgtaatttggattcaaaagttctaagaattacaaatgttttagatccttgccaaattcaagatcctcaagagtctagagaaatcaaaagagatttctgtgatggagttcagtataaagattcaattatatcctctaggattatcacaattgacgatatatctagattatgtcaagaacttgctgagaaagatattcaattggaaccagctgatatccttttggagtttgattctaatacaaatcttcaattaagtgtttctgcaatgtctattgcaagttacaataataagattccaaagatgaatttatttgatgaagatttctatcatagtcatctgaagggatga

SEQ ID NO: 347 - DNA, 1221 bp, Cryptosporidium hominis
atgagcagcagagactatcgaagaagaggggaatcttcctttaaaggaggaggttttaattcttctaaagcatctagatcaagctcaaactcttcctatgatagaagaagatatgctccagccaaaacaaacacaaggcaaaaatttaagtcaagttcaagatcaatgtcaaaatctagctcagaatatgggtgtcgatctgaatctatgtcactatcaaattcaagatcgaattcaaggtcatgtccaagggcagggtcaagacaagttcaaagaaaatcaatagaaagaggaaggtccaaagaaagagtaaaaagaaactatgaatctagtccggaagaatttaacgatggttattatcattgtcatcattataaccaccaacgccaagatgagagaggcttttctcactcgagaagatcacaaaagttaagatctgtttcaagctctggagacagaatagagaatagaggaagagctcatgaaagatccgaatttaaataccttagaagtaatgttaaaaatcattctagaattaccacaactcatagggttggtgatgaagattatgagttaaataatattacaacttattctcactctaaatctgtccctggacccataaattcaagtagtagtagaagcagaagtccaagtattgaaacgaataaaagtgaaaacaaaaatgatggaagaaataaaattagagacaaagttaggcaaagagacagagattttgataaagaatggaacagaagcaaaagtagaagtgtctcaagatctaggcattcttcaagatcaaagcatatatctgagtctcaaaataaatacaaatccaaatccaaccccagaaccagatcatattcttgttctgatgaggaatatatctctaattcgaatacaaaaacttctcgaaatagatcacaatattacagaaacgagaattactatgaccaaggctacgataatgattatgcttttaacaaaaatactgaatatggaaatagaccaagtcatggatacaactatgatcatggaaatagtaactacaacgactatgaaagagatagttataatcatggagacagaaattggaataataccagatatttaaataggtaccgagacagacatgaaaattatgttaatagatcattttctgaagaaagagaaagatcaagagagagggaaagaagaagaagaagaatgcaagcaaagtaa

SEQ ID NO: 348 - DNA, 1833 bp, Cryptosporidium hominis
atgaataagaacaataatgtatgtcttggaagaagaggaagacctaaaaaaaaccagccaaagccttctctaattgactgtattgaagctctttcggagattgataactttagttttttcccaatatataaaaaagaattatcaaataaaaacttcagtgagataaagcaaatttttaagttgaagaataatttcaatagttggtacactttgaataaatcttcatccataatggattttcagagtgattttttaaatggagataccttaaactctacatccacttctgataattcgatcaaagtttcattcaacaatgatttggaagaaatgatactaaatgtgaattcaggaataaaaacaaagtcagattttatgccatttcttttctttaccaatgggcatgtttggaaaatggcatttagtcctccatcttattcaataaataagatttttcttgctataggtattcattcacatgaatcccccatttctcaaataaacaaaagatataatgacaaaggaataatccaaatttggagtattccttttcaaaatccagaaaatgaggctgataactctttattacctcaacaagtttttgagatttatcataatggacagttttgcagatttcttgagtggattccccaaagtgagaagccagaaaaaggatcagctggactccttttttgtgttctaggagatggatttgcatatttactttctattcctttgcttaataatatgatattaaatcgattcaatattgatgatttggttgtttggaaatattcaaatccatattacacaatttgttctgcttctattcgtattccagatgttgaagcagaatacttaagaattgttggaactactgttgaagggatcttattagtatggacttttgaagcagaatctaattctaaacagaacttggtgcttctaaatccttcagaacaaattatcttagtatcccaaaatattccactcctttcagcttcttggtgtcccatttactcctcaagtttgattgccgtttgtgattacaatggaaaaatctcaattgttgatattagaagaagcagtaataatttaatcaaggaatttgaattaccaaatagaccaataacatgtattatttggagtagatttgttaataatatttacctttctcatggaattggagccatagttttgtcagttgagacaggcgattatacccaattcactattgaggcatacaataaaaagaaaaaatattcaaaatatgaggaagaacaaatttctcctattttgggttccagatcctggacatgtagttcatttcttcatcatgccatatttggattcaatgatggatcaacaattattggaccttgctttgaatttgaatccaagtctttccaagaaacgattttgatcaaggctttggtaacaaatttaaatgaaaatgatccaattcatattaatgagttagctgatgataataatgttgaaatgaacaatgagttgtcttctatcgaatgcaatgatccccacgacgtaaataacaacttagataatgaattagaggcagccaataatttaaagttgtttaattctatgaaggaattaatcacgaataattataaccaaagggtaaacagaatgaaacagggatctattaatatcatatggaatcatgaaaataataacttgaatgctgttgactttcttgaagttcaatgtataacttccgttgacctatttaattatcccaaattaatagaccaaccttatgttgctattgcttattttggaggccttgtagctatccataaattcaaataa

SEQ ID NO: 349 - DNA, 2538 bp, Cryptosporidium hominis
atgagcattgaaaatggctcaattattagacttccttctgaaataattaatagaaaggaattctcatcatcagacacacaaagattttctcaattttggatagtaaataacataattaattccttattttccactaataacgcacacaatgagttaatgaaaaattgctgctttaaagaaagtttgtttgaagaaataagattccagcttaatgttatagttaacaaccttgaattgatccagcttaacgagaaagagaacagtaaacagttccaagtctggaaagagttaggaagttgtgtttccgagtttattattgaattaatgcaaaaatgggactcaaaactttgtgagttacaatatcaccaccttaataactgcgaagtatcatttaatgagttagcttccgaatttaatcagatcggagcaaaagttcaaggaatggatgtgatcgaaagttttattaagcaggaggatttatggggggatgagcaactattttgggaagttgattcagtttacccactccgtgaatttcaatttggggtaatgaacgagcaaacattatgttcaactccgattacgatcgtttatcttagcagtttattacatccatatttaaatatttggtcaaatattcgctcttttttcaatattttgatcaataaagtattcctggctgatttaagtaatatcaagaatgcagaaatccaaaagattgaattaaatatattcattctcgaaactttatttggtaatattgaaaagtcgattttaatcattgacgaacatttattgaatatatggatttctttattaagaaaatgtattgatacttttattaagtttattccaaatactccaaactctctcaaaaaatttccatccaataaaggaagtgatacaatcgaatttcatgactcaatatgtatcctacatgatattttaaattattacaataaatacaatacttgttatttatataacattggaaatatttttggaatccaaccaaagaatgaaatttcaatactagattctatattgagaacaattaaagttgataattttcttccaaatacttctatggacctatttagtgatgtaaatcttcaagatcaatcaaaagcttttcctataaatatgttattcaagagtagtgataataataaacctcaggttgtccagagaagatatacttttcaaagtaacattggagaatcattcagagagctaaataaaagtttgaagacctactataaggaattatttattaaggaaaatgaagagaataaagtagattttgtaaatccaatcataactcaattaatcaaaaatcaaattaactttgaaagctatcaaggaattcgaataattaatattttatcatgtttaagtgaccttgtaattttagaagaatcatctaccgaacaattaattaaaaccctacgtttggattcaaaaagaaagtttccaaatatagatgttgatccaacggaagcaaatctttcaattaaacttttatataataaaggaatcaaagatgatgaaagggaaattaagaggaaaattatgtcaatgtttctattagaatttgaagttagtaactcaaaagactatattaaaggtcaattaccaacattctattccttaaaaatcagaattaataatacaaatcctaatttaatttcaaatataaatccatcaaatactcaaatgttgatttgtggtatcccaagttatttaatattgcaattctttgacaaaaataacatggaggagtattcaaatatctttagttttttattagaagtcaagagatgttcattatttttaaatcaagtattccaaactcttatttttttaaatcgagaaaaacagggaattctgctttgtaagcaaaaagcaaagaaaatggcaaatgatgattttgattatattaaattctgtaataataattgtctaattattatgaaatggattgattcgttgctttatataactcaaaaaatacgtttttcaattcaatttattgtggatatttattatggttatttctcaatgcaatatccaataatatgggaagacttcaaaaatcatctcaatagcaataactctgtttcatttatgattaaaagccataagttgtatcttgaaaaactacataaattgaccctagctccaaataagagagatcccaataattcagaaatagaccaatcatttcaatcaatctctataagttttgtaatcttactcaagcttggaagaagactaaatatattaacttataaaattaaccagcttgtacaattcttgattaatgtgaataatgttttaaagagtaaaaagtacgttccatgtatgattttaagaaggaaaatacagaaaaccgttaaaaagattgcattagcttttgaattgctttactcggagtttaatgaaagtaagcaacagttcatcgattcattaaaaatatatattttatccaatccaaataaaggaatggaattcttactattacaactcaataattaa

SEQ ID NO: 350 - DNA, 1749 bp, Cryptosporidium hominis
atggacctccatcctcatattagagcattggatgtagtagagacattttgggaaacattcaacgagcttggaaatgtcataattttaaatccaataattgttaagtcttctttccctataagagttgatatggttagagatgcaacacaaaaaatgatacaaaggcatcaatcattgagagtacgaataatttcaaagatgaccaatagtgaaggaaggaaggctttaaagagatattttatagacctttgcgacagtgcagaggtagtaattagagaagaatttctatcagtgcaagaaaatcaaaatttagaatttgaaaatgaaccagtttgggaaagtatgctggtcaaagagcagaatgaatttttcgataatgaaaattctccattatggagaattagaatgatgagacttggaaagtgcggaaatacatacagaacatgttttattgggagctttcatcatgcaataatggacggtctaagtcgtcagtatttctggacagaattattaggtttatgcgcactttctaatgaatttccagatatagctattccaaaaaatagacccacagcccttccaaagagtgtttgcaagtactttccttcttcattgaaggtaaggctacttaagccattttactcttggagggcaacagcagcacatggagtttgtttatatagaaagttggtggcaccatttgaaaatccgtgtagtcttgaaatttcacgagacttatatgccgattttaaaaagtctcctaggacaagcattttaccaataaaaatttcaaaggaattattaaagaaattaatgtcaaaatgtaaggaaagaaagattcaattaaatggtgcaatagaggcagtttcagctttaggactaatggggttaatatacgaattaagagaaaatagaatgaatagaaactctggagatatttccgagttgaaggatgatgacaaatcaccagaaaatcaacgcaatagagaactatcgactacattaaatttaaattgcatgaataattgtgctcctttcaatattagaggaagtgattgcttcattcaaggaggtgagggcaatacaataattccaattagaacaatggttgcaattaactgcagaagatgggtaacaaaagataacccttcagtacgcccagaaacaagcaaagatgttgaagcagatttaatgaacgtgttagaagtaatgcagaataataataacagtggtacaacaaccacaactactttgacagacaaaaatgatgagcttgctattaaaaatgactcaactgaatgctcaaatttaaattctggggatgaaaatatatcttcattggaaaatactgaatttaatgaagcttcttatgcaaatagatcaagaagctataaaagccattctagggaattctttaataatctaaataaaataaatatatcattaacaaagttgaattcacaaagtggagagaagatcggcccatcgtggcttaaaaaagcagtttctaaagtaatgagtcccaaaaataaaaaatctaaacagattaaaacagttggtttaggttcctatgcagtgcttatgggattggacatgaaagttgagaaggactgcatgtcagatattgataagatgtgggaattagcaaacaatacaaacaagaaaatacattcaatagtggattcaaaagatccatcagctgtaacatttgagtggcatgtaataagtggtaagttgcttcattaa

SEQ ID NO: 351 - DNA, 207 bp, Cryptosporidium hominis
atgcagcttggtgacccaacaatcaggccttcatcatttctagttagtaatggagggttatgggattcaagcccattacaagaactaattaaaaggattaattcaatcacaactgagcaggaagtaatggtggaggtagagtcatcatacagctgtgttgcacaacataacgtaagtttaatcgaaagaaatttggtaaaaatataa

SEQ ID NO: 352 - DNA, 2079 bp, Cryptosporidium hominis
atggcagtgcaagtaagaaataaaaagaaggacaaaaccttatggatttctgcggaggaagaagtagatgatagtactagcaatgaagagttggaggtaatgaatatcgatgatgactatgattcttcagatgatagtgaaggagaagaccaatatgaagaagaaggtgaagaggatgatagtgatgaggatgaagatgaatcaaatactaaggactgggggaacaaaaaacaagatttctatgacggaggttcttcaagtacagatagtgagggagagaactggtctgatgtagaaatgcaagatgaggaggcacgaggaattcaagcgagtagaatgatgaggttgagtaaggaggattttggcatggatgatattatcgatcagggtaaattggaggaggatgatgaatcggcagagaatgaggcagcctcatttggattatctattaatgattcagaaacactattggaaagtttaagtaatttatcgaatacaaagcaggaaaaagagtcggatgttttagcagcattgggtaatgacggattggatggaatagagggtttggattcagaactagctccaatattaacaagtataaaggaaaaagttacagaagtaaaagagagaatgcaggtattattaaatttggtcaaaacaaaggaaggttcaggcttggtgacagaaaaagggatggagtacttagactcgaagaatactttgctcttgatgtatattggttatttatgttattatatgatgttaaaaacttcccctgatattaacattaaggagcatccaattttgttgaggctggttactttacgaacaatgatggaaaaattgaagccaatagatgtcaaacttcaaccgcaaatagatagaattttggagttagcagagaaatcatctcaagtggataacttcttatcatcagctccaaggccagacagattcgtatttgaagatgaagataatgataatagcgacattgaagaaaatgatatttttaaacatgatctcagggatgagtttgatgagtccacaaatatcgattcagatgtagaagtaactgaagaagattcggatggtggaaaaggcgtttataaagctccaaagaatttaccagttgagttcaacgataaaaagttgagtaagactgagaagatgatgaaggagttagaaagagaaagacagaggttattaagaactgatattattcgccaaatgagatctagtattcatgaaggccctgaggaagttggaagggaagaaactgaacaactacctcagttggagcgattacaacgacaaataaaagaacgaattaattttgaggaggataatatgatgaggttaccaaagactaagaaggataaaagagaagaaaagctttataagaggttaatgagccaagttgagggaggcgttaatactttggacgatttagctcaatttgcagaaagagctacagatatggtaactgattcgaaaaagaactcactttcaaagtatttaaccaatgcttcaaggctcaatagggagattacaaaaagtaatttggctcaacaaaattctgataagagcattacagaaaaattgttaaagaggaaaaaagcacaagccgaattggcccaaaagagcaaatataaacctgaatatgattctaaaagtgctgattacaatgattctgtggatgagtcttatgctgaagcagaaaaggagctatttaagaataattcatatttacaagaagttctcaagttgaatgaagagaagaaaatgcaaaaacaaaagaggaagcaagaagttgatagtcgaaatatgccaaatattgatgatttagtagattcaggatccagaagagcatctactaaagaaatgattaagaataaaggtttgactagaaagagaaagaagatagaaggtaatgcaagagtacataacagactcaagtataagaaggcattgaagagacttaagggaactcagagaagcatgagagattatgagggcagttactctggagaatctactggattaaaggataatgttaagagatcaacaaatcttagttaa

SEQ ID NO: 353 - DNA, 843 bp, Cryptosporidium hominis
atgataaaaatttactctaaattaaaagatgaaaatgaagaaactagtaattccttgagtacttttcgaaaaaaaaatgttagtaaaatcggaagaaacctcacatcaaatatttcaagattttataaaacactctatgaagagaattacttgagaataatatcagaagaaatttttgattttcagtcattaaaagatataaatggtctaaacttggatagttttaatgattttgttatgtcgataaaatctccatatatcaaaaacattgaaagtattccttattttgatcagaaacataatattggaagtaatgaaagatttaaaataatatattggttaagcttacacagtaatcgtctaaaatttcaatcatgtacatttcatctttcatgcagaatttttgacacttttttaatagaaacgcatgtacaatataataactctgaacttgctgctactgctgctgcatgttttttattggcttcaaatattatcgaaacagtatctgatatgattgtaccaagtattagacaattttgtaatgctgcaaaatggttaaatcctgataagatattaaaaagacaattagaaattcttactcatgtgaatacaagttttggtattaattatactcctagtaaacttttatatatttatatctcaagaataaagtatcattcaattttatcaaaagaatttcttcatttatatagaaatggagaaattatccgaatatttgattcatctctagctatttgcgatttattgcaatatactcctcttccaactactaaaaatgggcaatcactcatttcaattattccttgttttatattatgg

SEQ ID NO: 354 - DNA, 501 bp, Cryptosporidium hominis
atgtcttctttggcatatttatgtaatcagaataatattaaaaataatgaacataataatattcaaaatgataataacaataataataataatataattaataataatacaaataataataataatattaataacaataataataacaatacttcagattttggtataccacgtaaatcatcgcttaacagcagcttttcagatcaaatgaatactaatatatcattaagtgataatcaaaatttcagtaatatacaatattcatccaactctaatcttgatattaataaattacaagaaatcatccaaaaatccattccttggatttctaataataacatcaatatgaacattaatacaggtaacgatttgttaaataatacaaataataataatagtagtaataataatacattctttacaccttgtaatgtaccaaatcctaacagattctcaaataaacccaaaaattcaaactcaaaagtacaaatacaactttaa

SEQ ID NO: 355 - DNA, 1155 bp, Cryptosporidium hominis
  misc_feature (332)..(332): n is a, c, g, or t
atgttcccatctcttgaagaatttaatagatcatggtcaagattacgagaaggtggaatacaagattttcttccagaagataaacctgtattaaatcaaatttgtgttgtatgtaaaaataaaatgtatttctataaagaaagtaataaagatcaaggaaatgcatttcttactatatcaccagatgatacaaattgtcatgttaattctgatagaaatgaaattatattattacattcacaaaatgatggaacacgtaaaagaattgtattagattgtgcaaatatggatgaatttacaagatggaatattgctttacaatttggtggttntattaatggtgtaactaaatcttgtatgagtaaatatacatttgatatatcattgtttggtattgtcaaaagtaatggagttgaacaattagaaaacattgatacaaaagaatgtaaaccaatatataaagatttttataatattacagattatcaatcaattgagatatttaaaacatatgaatcacgattaaaaaatacaccattacttataataccatttaaagatactgaatattatttttttgcaaaaaaacgtcaaatagtatttttaacaagaagaggaaaagttggtgaagttaggattattattaatttacaaacgttatcaaactttgatattattaataaagatttgattaatgtagatttcccattattagagactaatagtgcaacatcattaaaagctgagtatattgttggagcaaaagaaggtttattatgtgtatattgtacatccaagaataaagaaagattaattaatataaagaatgtaattaatgaaaataaatatttgaataaaggaagtaataatggcaataataataataacaataataataatcatttagtagaatcagtaactaaaaaattcccagaatgtggatatattaaatatacaacaagtgaatttatgtgtgtggcaagtagagcaggaagatctgttgtattaagaagaaaagaggatgattatgatgcattatcagtaagatgtaaatcattaacagaatatgagaaatgggagagatcaatgtcaatagcaggatttattaattcagatacaacaaataatgcatttttaccaccaataacgtattaa

SEQ ID NO: 356 - DNA, 1371 bp, Cryptosporidium hominis
atggattctgagttttgtattgaagatcttattgtatccatatatggaacagaaatgctactaaaacaaataaaagaaagacaaattagaaactgtctttacaattggaagtataaaagtcagcttgaaagggaactatctttacaaaaaaagaaatacaataaatatatgttggatggattttatgcattagcaaggcaaactcaatccatttgtatgttatttcacactatgaaattgattgaatataaaaaacaaagatttgcaatggataagttaatttccaactttaaacaaagtaataataggcaagaaacaattatgaataaatctagatcttgtgaaagtactgaattagaaaatgaatctgagctattatcattggatgagaatactatgttggaattccaacaaaaccttattagatattttcatggaataaattctttagtgaatattattgaatcaaaaaaagataaaatattttacaattccttttacaaagtcaagaatttcaaaggtaatgaaaaacagaaaacagtcatttctaatcaaaaaatagaaagaaatgttactaaagataatctggtagcaccatctagtccattaaataagtctgaagttaatgataaagagaatatttcaagtaatacattgggaaaacaattgaataatggattaactctaaatagagaagaactttattttgaactgattccagaaaagaagcaattctatactagaaagcaaaatgcatcattcaataatggaccaattagtaacccatctttagaaagaaagacttctaatatctcagaattcgccaaacaaaagcaaatatcaagagactttactcaacaaagttatggaaattctaatcactttcataaacaaatagggaataatgtggtaattgggaacaatattattgattttacccatgcaaatcccgtattattttctactattcaatctcctgttaattcaaatccagttttaactatattcccgccgcattctccaaattttaattttactaatcatgttaataaagggaaatatctacagtttaataataatctaaactatgctaatcagctatcttctggttctaccccactcaacacaaccaaatattcaaaagacaatcttcctaacataaataatgcattttcaaaaaaccaattgcaacataaacctgaattaggtcgcaattttacaattaaaagatactcttcaaacgatagaaaatcacccagatctgctgaaattacaaaaagtattctaaaaccttgtattaatttcactcaagactccacaaatctgattcaaaacatcactgatagctttaagtctgtaattttgaattaa

SEQ ID NO: 357 - DNA, 2226 bp, Cryptosporidium hominis
atgaagcaagaaccagtaagaggagacccaaatcaagggatatgtatatcactagaaaaagtggaggatttgaatgataactcagaagttgcttttcagtggaaatgtagttgttggagtacaaacgatgaatttttgttagagtggaatattaacgttccaaaagacttattaaggtttataccgaatggagattccttattagtctcccaacttggattttttaaatacaatgatatggtttatgttttagttgcttggaatagaagatatatgtgggtttactgtcacgatattaaatcttttactgaaatgcattcacaaggtataaacatttcagtagaacctaaagtgtataatttagagcttgaggatgaccaagatactgaagatcaggctctattaaaagatcaaaatgatcatactgtttctcttgcaattagaactggagatggagaatttcaatttgttatttctactagtactttaaaacttcatactcttagaataacagtatctggagaaattgctcaagttttgggtttttcaatgtcatctaattggtgggatattgcaaaatttaatgaagatatttttcaatctgagaatcaaaattttgattcttcaattttctgtcaagaatttgaaacagaatctaaaagtcacctaaaaagtattgttggactacttaaatcagcatggaatagtagcgagagaattcaaagatctaaaccaagacctgctaaaatacctgaaaatactgaggattttgatgattattctgaatatactagaccttctgaagctcccataagaactccctttgatcgtagaaaaagtgttaaaaaactacgaaaatcaacatttaatgaggatattctcatattttcattcccatcaagttatatcaaatggaatgtatcatttatgtgttttataacagcagaaattcctaatactcttaatggtaaaaaaacaaaaatacttattctttttagacacgactcttttggagtagtagaactttgttggactttaaactttaatcaaattggtgacttttatccttcaaatctgatagcaataccttgctttgaaaataatgatataagaaatcatgaaaacagtatatcaacaatgaaaattcaccttgaaatatctttgggtaattttcataaatttgctcttttcttcatctataaatccaataattccttaaaacttttacaactaacaccaacatcaagtttgttacctgaaactagtgaagctacaaaccctttgttgagttggacacataagccatcatttaatatatccttattacatgaaattatgaatatttcatcatttgcaagtaaaaacgataacaattgttttaatgatatttgcaaccttgaacagaatattcaactggtatcaagtcctcaagctcaagatatctttctgtatcaaaaatcttctctccaacctggtattactcataaatgtatcttatgtacaaacaaacacatctttataatatacattacagaaaatggtcatcagctaatatgtaaaaatattttggatcattcaagccaatcaaataagatttactttactacttactctcagaatactctttatcttcttgtaaattatcaggatattcctctcaaaatagacctctcttccccatataataatgaatcacaagaatacttgaacaatataaataacacagaaaatgaggctacaggagaaagtattggaaattcaaattttgaatttaatcaattaattttaaaatatagagggctcagaaatggagaaatttcgaaagttggcaatatttttgggaattctaattctgaatctatgattactaatttagagatgctacacaaacaaattatctcggatttcaaacttacaaagctaggatgtgccgagtcatcgataaactctataaaatacactaagatacttagtatgattgggcagaatctcaataatcgaattctttccaataattttgaagctttagatgaagaagctactttactttggggaaaatgctcttttttactcgattcggattactggaaggacataaattctattgaagattggaaggaactttcagaaggaacatgttttgatcaaatcacatcaaaatttccatctttacagtctttccttattaagtatctagatcccatagcaataattagctctaattaa

SEQ ID NO: 358 - DNA, 624 bp, Cryptosporidium hominis
atgaaggtttcagttaccccagaactgaaagatttcttctctaaatatggtgataagtcctttaaaaactcagataatattgatgtagatacattatataaagcatattcaaaaatagttaaagaatataactctattaataaagaaaatggaagtgatgaaaagaatgttgacgctattccaagtctacaagaacttcttttgaatagcaaaaaagagattgacttagatcagaatcaaaaaaatgcaacacaaaaaaatttgtctataatagaaatattaagaaaacgctcagaagaacgtaaatatcaatcatcaatcaaaaatttgtcgcaagctaagtattctaaaacttcaaataatgtaccggatgcctttggagtacactattctagagacgttttaatgagtatgaatgcactcattggtcttattttaacatttattggtggattctatgctccattatatatgggtcttgaggatattaactccagaatcttcattggaattgcatgctctattctatgtttaattgccgaagttggtttatttatgatttacgatattaaaagggatatgagagaggctcctaaagttataaaagaagacccagttttatag

SEQ ID NO: 359 - DNA, 3114 bp, Cryptosporidium hominis
atgactgatcatagccaaattatggatagtgtgattgcaaccccaagggcttcaagtaatggtagcatattctgggttactccaacacaatttaatccacaaacaggcacctatcagacacattattattcagatgatttggtaaaatctggaacagttagtgttggaactccaacatggaaaaataattcaatggttccacaagcaattccatcttcaaatataaatagtaaatcagttgcagctccgattttaattcctcctccgcaaagccgaaatttggcgaactttgaagatccggtgataaggataccagaaggaataaaagaattagaatatgaagatgatgatgatcaaagtgttgtagatattaaacaattaggtcaaaattttgattatgattcagagaatggcgataattcaaatagagcaaagaatgtggttgatgctgtagttgcattaggacatgttttagttaaagatttgcaaaaagcagtaccaaatttaaaaaacagtggaagttcaatttttgaaagctgtcttgcaggttcaaatatttctggtttagaaaatgagttggcattttctccaaaaaatatattaaaagatacattaagaaacaatactcaagttaaaccacatttacttcctaatggggtaactatgcaagaattaattgcatcagggggtaatattggaagttcaccagataaaagattcaaaaaaatgtcgagtatgctttcatcttcaacattattatcatcagaattattttttgatcaaaataaattcccaagaatgagcttaattacttatgagtcatctcataataataataaggcaattcaattgaataaggaagccgtaaaacgtttaaattcagattttggagattcacctctatgctttataagcttgattgattgccctagtgaattattctcaactttattattaaatccagatttggaatcattatcagtacaaaagataattaataaagagttatcagatagacaacaacatattaccaataatcaaaatagtttggttgatttatactattggtacaaagatgaagaatttatatatttattattagattttaaaatttcaatgataccaaagttacacgatattttattaattctagcaaattctatttcatctaccgttgttatgaataattctggaataattaatcaagaatctttaaaaaagcttgtaccaattatggatttacaaaaagaatttgaatcacgtcaagaaaaaattattaataaattggttaataatagtaaatctggtggtataagcaataataataataatataaggagtggtgaatttaatactccaccaagagaggttgtacaagaattaaaagatgatgatttcaaaacagctcaagctaatccattgttattattaactccaagatataaacctactctaagatcagaaacttttaatgagtttaatcaaataactgaacaagaattagataaaaataatttaaatcatggtactcctagaaccttattatgcactttaaaaactactccaaggccatatttagtatggttattacatgattttaatttcttattatatgatacagctaataatatgatattaaatagtattgattattttgagacacttatgacagaattaggctgtggttatgaatgtgaagattcacagattacttattttgaaaatctcaagctttatttaagatcatattatacaatgaaagaatgtcatacattagtttcaccatatacaattgataatagtgaaagaaaaattagaatggatcatatgaaacagattgcttgtttaagacagagattacttggaataagtaaaaatcatgcaatcagtcataagcttggccagtataattcatcattaacaattaatcgttatctttcaatattctttaaagtattaaataataatgaaacagaagatctctcagaattgaatgaaattgtacaaagaaggttttgtgatagaatattaatggatgttaatgattattatttatcagaagacaagaaattaatggaatctttacctatgaatgaaactgcattaaaaggtgaaattaaagagatcagatccaaatgcatgcatttatataaggaatacacaagtacattaatagatactgatatttatattgattataagattcaattacaatcagaattacaagatagagagaatgatacaataaaagagaatttaaatatttcagtaaaatattgtacaacatatttgaatgagatagcaaaaaagaatatttcaaataaattatataatggaataaaaagtaataatgcatcatttgaaagtttaaataataaaaatagtaatattaattcaagaaaacaatatagtatattagatcttgagaaggatttggatgatatatatttaactatgttagatagtttgaatgataaaattccaagagaaatatcattgaattgttttctaaaagtggcaaatgaacttagacatgaatggtatcaagttaatggaaatggaaataatatggggttaaactccagttcagttaatagtaaaggagtgggaaatgataaaattgggatagaaaattgttttggtagtaataatggtaataatagatttgatgatgaatttatgagaagaatggaaactcctgaaatgctagtaaataggctgaatgctgatttagaagaaattgattcggagtataatggttattctttgatgcaaaaaaaggagttattggaagatatattattagaagcaacaaagaagaaggatcgattaagtgatttttataatagtaaccaactgtatggtttagataatttaataactgcagtacaagatagattggatgtagtaaattcagaaaggaagagtattatggataataacgagatacaaagacagatgatattaaaacaaaagcataaacgttggagaaagttttttccttgtttaaagaagaatattaattatgatgtaaatacaattaataatacaacaaataattgtaataacattcagatgaatgacatgagtcgttcgatagatgaatcatattaa

SEQ ID NO: 360 - DNA, 2040 bp, Cryptosporidium hominis
atgagcaaattgctaagttttggaaactgtgcaaatattaatggaataggtggcaatcccagtactagtatgaatttaaacaatatgagaaaagtcttacagccaaattcacccggaaattataatcaatataaagtaccattatcagaatattcagataaaaataatgctggaacttattattatacaagcgataatagctttaataatactaataagagttatgtttcatccccaaatgtatatccaagatatattaatcaacataataatattcataatataagtgggtatcaatatttaaatcaaagcaacgataattttaatgcaccaatagaatatgaaactattccaaatagaattaatacaattgatgaatccagtcgaataatcgacagtaactatcaatcaagagaaaaatatattccatcaggaactggaactggaactgtaattggagaagcaggagcaccaataacattaggtactggagcagcaacaataactactgtaggagcaggaacgggaataggaacagcaatgggagccggaaaattgccatcctcatacaacaataatgtaatatcatcaagcagaattgatttaaatatagcaaaaaaaactgaatttggaggttatgcaaatgcaaagagtacagtaagtaaaccaaatagctctaactggaaagaatggaatagctactccaaacttctaccgcttgcagtcgttgaacttgatgttcaaaatgaatgcaactacttgtctactctatttagctcattttcaaatactgttaaaggattcatatcaaactttgaatttgaaaaacttatggaatatgtcaatattattgaagttggatatagaggcactatttttagtgtaatggatagaaatcaagatgattacattacccaagtcgaatttcttactggaatgctcatttttagaccatataatattaaagaaaaaaactctccaaatttcaataggcttagattacagttcatattcttctactatgattccaatcgtgatggattgctttctattgatgagcttgcgaaacttattgaacatattagtattattaaagttactacaaataaaaaaaatggaaaaccaaaaaagaaaactcaaatttcctctgaaaaatctaaaaaacttgcatctcaagttattcgtgattaccttaacaaagagttctgctcttatgatgactttttccaacttgtaaacaatggaattcttaacggtactgttaatcttttaagatgcagaaatgatatctttttacaaaagaaaaatcaatcttcatcattctccccaccaaatcaacaaatttataacaaactcccatacgataattctattcaaaatcttaattatattcaacaacctttttcaccctcatctaactctatccctcaatcccaaagtcaattcccccaaatctcaacatataacacaaatattcatcatcctcaaaactttattcccaagaataacagctcaatctataatacacccattaatgcatcaactgaacagtttcctcaacttaaaactatcataagtccaaatgatgaatatgtgaaaactatctcttcaaaaccaccttcaccatctacactcaataacagtaataaccagcctattttctcattatcatcgatctctaaacccaaaactaatgcttcacttggaattcaaaaccaaaatactacggaaacattcaactataactataataatactaatattaatcctagtactaacagtaattacaactacaattatattaatcataataatcaaattactccaccacataattctattctatcaaaaaataactcaatttctagcacaatcaccagaaaacaagaagaccaattcactgcacactccaactctccaccaaacccgctccttacaccagatccactatcaaactacagatcaacttatgaaacttcttccccatattacaatattccgtcagaaggtcgtcccaacttcaacttttcaccatattaa

SEQ ID NO: 361 - DNA, 1188 bp, Cryptosporidium hominis
atggaattgccacagacattttataatgggagaggcataatgaataataatacatcaacgattatgatgaataatagtcttaataatagtactcaacaaaaaaaagtctcaataaatcaaaaccaagtgggttgcggtttatctgctggacttggaatgggtggaattatggatgttggatataatcaaaaattattttattatcaagggcaataccaacaacagagccatcatcaaaattattatggatatggatataatccatattatagttcaggttatatgtcgggaatgggaactgttcatcctcaatattatgttgttccttctcctttaggtgttagtggtattaataatactacacaaacaaaaacggataacactcaaaatattcctgtaacaggaagaaaagaagaagcaaaaaaagaaaaagttacagaaaaaaatgacatcaatgagtgtaatggatctaaattaactattcagccatcgttattatcaaatcgtaatgcaacaacagcattaaatactgtaaattttgctgctaatatcgaaaataatacttctactgctactattactagtactgcaacaacttctccttcagtagcaactccgaatattacaaatatcaattcttctgtaatttcatctaataaagaaattccaaattcatcattatcgtcaaattcaactaatgctgtttctaaagcagcagaattgaataatagcctaactgggagaggaataggaataggaacaaatcctgtaatgtcttatcaaagatatggtggtttgtcagcagtgggtgggagagaaggttattcttcctcatatgtgccagctcctaaagtaggaataaatgtaaatattcaacaattaggatataatggaggaatcgcatcaggaacaaaaaatgttggaacagcgagtagtaataataataatggctttgtgcaaaatgttaaaaacttttcttatgtgccacctcctttgacaagtatatataattataataataataatattggagaaggagggggccatcagcatctgttccaaaactaccatcaagccaaaaacgttagtagtaggtcaggagggaatgtaagtggaacagttggaggtttaagtgcaaggttaaactttggatcaatgagttatgtgccaccaataataaggaggtag

SEQ ID NO: 362 - DNA, 729 bp, Cryptosporidium hominis
  misc_feature (693)..(693): n is a, c, g, or t
atgaatccataccattatatttcgtggctaacttatatcgaaaataatcaagacttttttaaaacaaaaaatattcattatcattattataatttaattattaagccaaatattctcaatagaattcaaaattatataaaatatttacatattaattacttcttcttcttaaacaacaataatctttttgaatggattaatcaatattccaaaattccagaatttatttccgtatttcacttcaactataatcaagaaaaaaacaatcttaatattaatcctattaatatttttaattatttattattaactaatgtggacaaatattttaataatatcaataccggtatgcacacaaaaaatgacgtaattaaaaatgatattaacagaatgcatgttgcatgtaaaaaaagactatcagaagatatttccgggttgaggggtaaatatttgaatttaatttttgagatattttcagaaaataagaattcttggaatttgggtcattttggatttgactatatatgggactctttatttgagtttttttccagaattaataatgaaattatattaactttcgaaagtaggaatggagatcaatatattataaataaatgtgaattattaattttaatatttaggaataaagttaatcatattttatttgaattattgctagagcttggtaantatagtagaagaggttggttcttccaaaattattaa

SEQ ID NO: 363 - DNA, 708 bp, Cryptosporidium hominis
atgttcaatatgattaacttgaaattacatactactagatttttaattctagtattagttattttaagtaatattggtgaattattatcacaagattttgaaagtgaaaataaatcaagtaaatatgatcatatagctgatcaaatttattataataggtaccattcaaataatgctaaatatttagtttggttattagtattggtgccagtatttatatgtattccatgcttaatttgggtttggtgtagtgatcactgtttacaaattcttaaatatagaagtaatatgaaagtttttaaagaaaagaaacttatgaatgaaattattctaactaatttaagtgatagtatattaaataaggaattgaatggtagtaactcatcacttccttcaatgggagttcctcattctatgcccccacctatccctcatccacctcaacctcaatttcatcctcaaatgggaggagttatgccacaaccacctccaataccacaaccacagccctcttctcatccacagatattatctcaaccaataattggaggacctcaacataatcctatattaccaacacacattcaatcatcaccttcatacattccgaatctccatatacctaggccacctaatatggagttacctcaacttgtacaacaagatcatgctcaccatcatcatcattgtggatttaatggtcattaa

SEQ ID NO: 364 - DNA, 1038 bp, Cryptosporidium hominis
atggaaacaaacatagattttgatcaagtttgtcatgaaggaagtgatattgtaggtgatttcgaacagaatactatggaggaatctttggatggatataaatatacagaagaaaggaattttcatgatattaatagtgataaacatgatcaaaattcaagcttaaataatcattttaaacaaacatatgaaggaaactctgaagttataattggaaatcactcaattggaatggaaattagaactcaaaatgaaaaacaagataatattgaaattgaaaagaaagaaaataattattatactactgacaataatataattaatatacaacaacaacagttaaattcaaaaaaaaaagcaagtgagtggagaaatgaacttctttcgtttccacatatatttaatcaagtatttctatctttaaatagatttaatgattatattgatcaaagatggtctttattaaatgaaagtcataataaattatataatttattgctagaattatcaaaaacttgtgctagtattaataattcggtaccacataatatcgataatatattttttattgaaaaaagtatacacaatagatatatatctttaaaatctaaaataattaatcataatcaattaaattattttagagttactaatatatatataccaggtaccgaattaaattctgaaaatattgttcgtgaaaatgaattcaagatgagattatatgaagaactatataataaatttcaaacatgtaaaaatgatattgaaatcacttttgagagaaaatctgaaatggtaacacaacttgattcaagaattaataagattgtatcatcaatagaaaaattcattaataataaccaatgtttattagaatctcacactaaaccattatataatatagatagtagtgagatctgtgaaattggtattgttaaaagaaaaacaggtgttagaggaagacctccaggttcaggtaatagaggaagaccaccaggatctactaaaaaagcgaaaaaagaccctcagacatga

SEQ ID NO: 365 - DNA, 306 bp, Cryptosporidium hominis
atgaatgttacatcaacattggcatcacctgttgatcaaattattagtgatggattgaatacttcaaataagatatcttctacaaagataagtcattatagtagaattccagtaaagataaaacattatattgtatcagataaagacaatagtaaagaaggagaagatactgatatgggggaaaatggaaaaggcatttttaatattgggaaatatattgattctttatataatcaatcaagagatagtataaatggtaataatacaattatatcaaatatatatgaatcagaagttgggaattaa

SEQ ID NO: 366 - DNA, 582 bp, Cryptosporidium hominis
atgttaagcttagaaattcaaagaaaaatcccaagaatatatgtgatttttataatttttataatttttttttctaatgttgaatgccttttaaaaaaagcgaatcaaacagtaaaatttaaaaaaggtgatactaatggaggttatggattaaattttactccatctaattataaaaatgttattgtttggttacatggattatgtagctcagcagtagaatgggaaagatttttaatacttgttaataaaaaagatttcttaccaaatacaaaatggataataccaacttctaaatatagaaaaatcactgctatctatggaaatgaatgccctgcatggtttaatattacatcattttcaccaaaagaaaatattgaagatattaatggaattttagaaagtgcaaaaagaatacgtaatattattaaatctgaaattgattcaggaattgaacaaaatagaatatttttaataggtttttctcaaggttctgctatggcgttaattacttcaatgattatgagagatattgcaataggaggtgtaatagggagtatctggttggattccaatgattga

SEQ ID NO: 367 - DNA, 891 bp, Cryptosporidium hominis
atgaatgaggatatttggaaagatggtcaaaaacaatattcttgcccattatgcatgacaagtacatattataagaatgatatcaaaatgtactatggtgatccatgtggacataaattttgttcagaatgttcaacaaaagcaaataataataaaaaatcaacaagtatactaagaggaagtaatcaaatatgtccggtatgtcatggttttgttaaatatattgcagactttgaatatggcgaaacagattttttaaaatttgaaagtcaagcaagaaagcaggtatatacaatattaaatgaaacaagaaaagattttaaagatacgccttgttatgataattatcttgagaaacgtgaagatttaatatataaattaatttatggaaatgatacagaaaagaaatcaacacaagatttcttaaatcaatattcaaaagaaaatcaagttgctatattagatagaaaaactagagaagaaactcttttaagaaatgatattcttgaaattgtacaaaaagaaggtactttttatgagcaacttaatcaactttctcaaaatgctacaattgatcatcttcaaattgtacacccacttcaaaatgagtatcctgaattctttcaaaattttaataaaaattctaacaatcaaaacaattctaataatcaaaatattgctcttggtagtaatattcctaatcctatcgacaagaatattacatgcaaggaatatctacatcaaaatgctaagaaatcaaatgtttcaacatattcatccattgaatctaaacaacgtgcagggggatttactgaaaacattgtatggagtttgtgtaaaaatgagctcttttttgggttttatgcttgtcatcatgattctaatccgtaa

SEQ ID NO: 368 - DNA, 519 bp, Cryptosporidium hominis
atgagtgtgtatccatctgaatcacatcacttgaaagaatgggtttttggatctttagatttattaaaaacaaaaaaaaatgacattaatgagaaagcaaaagaaaattggaaggatatttttagacaaatttcgaatgagaattttgagattaatgagttgttattaacatcaaaagatgaagaaactttaatttcttattatggtagacaattgatagaattttgtaatcataaacagcttccatttgtttcaaaatataatgcatcaatattatatcatagattttttactaatcaaagtgtaatggattatgatcctagaattataatatttacaagtatatcattagcattaaaattagaagaatttggacttcattttacattagagaaactttttggagatgtcccaggtttgaatatacaagaagtttttagacatgaattaactgtgtgtaatacattaaaatttcatttatatatattaaatccaagaaatacattagaaggtttaaga

SEQ ID NO: 369 - DNA, 801 bp, Cryptosporidium hominis
atgaacttttcaagaaatagaaaaggagtaaaagatgattcaaaatatacatatgaacctggagatcttgagacaaaagtaacagagaatgggttagatgtatcatttaaaagaaaggttgtttcagatttattaatatgtccaatatgtgaaggattttttagaggagcaacaactataagagaatgtttgcatacattttgtaaagcctgtataattgaacatattgaatcaaaaggtgcagaatgcccaaaatgtggacaaaatattggtatatatcctttgcaaggattagtatttgacagaacaatacagaatattacagataagatttttccagaatttaaggataaagaaagaaagttatatagtgaatttttagaaaaatatggagatgaggctgatatacatgatgaaaaagatctaatgagtctcacaaaacctacagcttcacaattattgaataaaattaagcttaaaccaatagattcaacggcatatttttataatgaaattcttttacctgaattagaaaaaaataaaacagttgattccaataatcaagcaactacaattttggaaaatttatcaatgaaaattaaattagaatcaataaattcagaattttttcaattggaaaaaccttaccttatagttccacctcaaatcactatttttcatttacaaaattatattatggataaatccaacgaaaaatttgaaaagattccttctatttttttaaaagggggacaaattcttcctagaaatcattcacttgaatttgtatgcagatctaga

SEQ ID NO: 370 - DNA, 567 bp, Cryptosporidium hominis
atgagtaattttgaagaatctgagcaaatattttccacatcggaaactaaaattgaagcaggaagacaacaacatatcattttagataaaaaaagactaatcacatttactcttacagatatatgtttactattagaaaaagtaatggaacaacaaggggatgaatcagtaattacatgcagaaatattgattggaatttaatagcttcgcaattagacaaggatccttttgaaattgaatacttttggaaagtttttaacccagatatacattttaaacctactctaggttatgctgtcgttccagtagaattaaatcttaatcaagaaacattactactatatgaaaatgttgaccatcaaactaatgcaatttataactataaattacaaagctcagtaaactctaaaatggattcactcagaaatcaaactactttaaaacctattttagattttgcaaaagtcagaatacaattattaaattctgcattcgaagccaaaaagaaatttaataatttggcatgcactcccgccagtggcgccggcggggaaagtggtaactag

SEQ ID NO: 371 - DNA, 918 bp, Cryptosporidium hominis
atggaatctaatattttatgtgtgtttacagatgtagatggtacactagcaaataatgagaatcaactttcattgaaaaatgcaaaaactatttcagccctaatggactctcatattttgttagtaccagcaacaggacgctccaaagtgggttttctaagaatgttcacagaagatattatggatattgctaaacatcatggattcccaggaatattttttaatggagcagttttgattggtccaaatggaattgatgatattatgaaaacttggacaattccagatgaatgtatgatagaactctgtaacttattagattcgataaaaattgaatggcaacctgaagatgaaggttatgaagaagccaaacttaaaggtgaaacacatagaggagttgcatatagcgtttatttactgaatgaatttgtacacaatgttagaggtagtcatttaagatatgttgaaggtctaagtagagagttttcagtaaaagttgaaagtgttgttgatgttattaaaaaaaataagaatcaatctttaaagtttattattggtgagtctagggaaaaacttgaagaaattaaagatattgtacatgcttttcttagagataaaccagcaagagtcctcttttctcatcctctaatactggagatattacatatagattgttcaaagggaaatgctgcagaacatttactcaaaacacttaatatacatcctgaaaattgtctagctattggagatgccgaaaatgatgttgagttgcttaaactctcaggaatttctgttgctgttgctaatgcttgtaatatggccaaaggtgccgcccagcatatagtttcatctaatgatgatgatggattttcggaagctattcagaaattctgcaatattcaaatcaatttagactag

SEQ ID NO: 372 - DNA, 519 bp, Cryptosporidium hominis
atgaatgataatgaaaatatcgaaaatttggttgggctattaaaaaaagttgagagaaaacagagaagggaagaatttgaaaaatatagaaaagcttcagatgaaatacaacatgaattaaaacaatacttggtaaaatttcatcaaatagctaaaaagtcagagaaaaaagctttagaacaaattaatagtgaatataaacaagaagaaagaagaatagaagaatctttggaacaaattaaagatattgaagtacaatttaataagataaattcagaatatgaaaaaggtaaaaaaaacttacaaagtagaatttcaaaattaaaagaaatgtactcaacgcaattagaattaattcaagaagaagaaaggaaagaattgagaatattaagaaaagagatgaaaaatttacttttgttaagcaaaaaagaggcttatcaattttccaagaataatataaagtttggaaatatgaaaataattaacttaataaaaagaatatcatcagatttaaattaa

SEQ ID NO: 373 - DNA, 330 bp, Cryptosporidium hominis
atgattgctaattcaatgataactttatatggaatggaccctcagattggattaacaacttttaattccaatatgaatattgatggaacttcttcaaattcaaataataccagtagttattccttatataaaccatattctgaagctacatctcaggcaatagataattgtataagaaagattattcatgatcaatattctcgcgtcaaagaattattaattttaaaaaaagagcaggtccataaactttctgatttacttttaaataaagagacagttacaaatcaagatattaatgaatgtattggtccaatgccatcaaaattataa

SEQ ID NO: 374 - DNA, 246 bp, Cryptosporidium hominis
tggtgggattcctgtttttttggagaatcaaaattggatttatctcaagttcaaggtagaaagaatttcagagattgtgatgaacgaacaaaatctgaaataattaaattaataagtaacaataataataataataataattttgatattcatcaagttttaaaagaatcatggaataaagaaaactctccatttcaaggaattgaatacgatccaaagttggtacaaaaattgataggtcctaat

SEQ ID NO: 375 - DNA, 825 bp, Cryptosporidium hominis
atggttcataaagttttatatagagagttccaagaaggttctccaaatgatatttcaattgacgataatgataattatgaagaatatttaaaatataatgtaacgcacattacaagtattcaacataattattatgatatactaattagattaattggtgtacttcaagtgcttggactacttattcaaactatattaatttggtataatctttatattggatttttaagctttgaatttctggctttacttgatctttcattattatcaattatgtatatctttatctcccctaacgttaatttacttgtaatttttggattcttatggttggtctcacctatattaatcacattaacagcttctttcagcgacgatacaattattgcgctttgtactatagcttttttactttaccttttatcacatgactatacaattatttacaaggacctgaaagaaattgaacatcaaaataccgatgttgttgcattaaacctttcaatgcttggatccatattacttgcatctagacttgaaaataatatacaagtttacttttttctatgcttcagtatacatattttatattttagcagaatggtaagacataatttatggaataatttaccaaaggtttacctttatgtactaacgccaattacatctattaccccaatttggtttttatattatccacttaatattgtttacaccattatttgtgctgtaatcgtttccggaactatattatatgtttattgtggtttaaattataaaaatgttatattcggtccctgggatgttgcaacaattaatgaatag

SEQ ID NO: 376 - DNA, 1383 bp, Cryptosporidium hominis
atgattaacaatattctggatctcattaaacaaggtactgaaaaagaaaagattgggaatctggaagaagcattgaatatatatatttcagctcttcaaaaatgggaccatatttgtaaatatcaaaatgatgaaagagttaaaaaagttcttcttactagaatggaacaattagtttccagagctgaacaaataaagaatttgattaataacaatggaaaaggatcaaaaaccatttctaatccaaatttagcttcaacttcaacatcaggtttatcctcatcttcatcttcagaaaatatttctaaaagttcccaaaatccatcaaatattaatgatcctcttaaagatgcaatccgtagttgtattttaatggaaagcccaaatatctcttgggatgatattataggacttgaacaagcaaaaacttctcttaaagaagcagtaattctaccagccaaatttcctgaattatttcaaggaaaattaaagccttggaaaggcattcttttatatggaccaccaggtactggaaaaacttttcttgctaaagcttgtgcaactgaaatgaagggtacatttctttccatttctagtgctgatcttactagtaaatggcaaggtgaatcagaaaagctaattaaagctttatttgatgttgctagagaaagagctccttctatcatttttattgatgaaattgatagtttatgtagtagccgtaatgagcaagaaaatgaagcaaccagacgtattaaaacagaatttcttgttcaaatggatggcgtaaattcaaattctaataacaattttaagcccattctagtacttggtactacaaatataccctgggaaattgattcaggaattcgtaggagatttgaaagaagaatttatattccacttccagatgaagaatctcgtgtattgttgattaagaatggtttaaaatccattaatcattctttaattgatgatgatattaattatatagcaaaaatgactcatggttatagttccagcgatgtctctatattaattaaagatgctttatttgaaccaatacgtaaatgtagtgaatccaattggtttaaaaaagttgttataatgaataataatgatgaaatcactaataataataatgctgaaaattttaagatttattggactccttgttcccaaccttcaaatattgatcattatgataaagaactatatagaaaaacttcactttatgatatcccgaacaaccagcttttacctccaaaattaactaaatctgaccttattcatgtattatcaaaaactaaatcttcaattacaaatcttgatattgataaattcactgagtggactaataaatttggactttctggtgaataa

SEQ ID NO: 377 - DNA, 1134 bp, Cryptosporidium hominis
atggcatctatagaagtttacagagaggcaataagaactgtaatagaatatgtttcaactaaatatggtccagaagaagaaactgtgatcaatatgatacttgagtcaaaaggaataccaggtatttttagaggtcaatcgatacatccggttgaaaatatgatgattggtaggggccatggtattatgttagagaattcaatggatcatgattcaagaataccaccaattgatacaaataataataatactggattaaatattatttcaagtatgattcaaccagcgatgcagcagcagatacaaccaataattcatcatccaataattcaacatccaatttcaccagaaattcaaacattaatacaatctccaatgattgcacaatcacttatacaacaacaacaacaacaaatacattctttaactgctggtactgttgcatcatcttccattactattaatactaatacaaatactaattctgcctcggtatcatctccaaattatttagagcaaccatctacaacagtagtaacaacaactcataattttcatactgaaaattctggagatgaaaaatcaatttcttcagttgttgctgttgctaatactggatgtaattcaccttcattaacttcttcatcatattcattctcatcttcttcggcagaaccgttaatattatcaaatagtaacacgacaacaacaacaactactactactactactactacttcttcttttaccaaaaataatgacaatagtataaattctattataattaccaataataatgaaaaagatattaacaattctaatataatgaatactcacaataatatgacagagtcaactacatataattctgaattatcaaaacaattaaaagaaaattcaaattttaatatagaaactcaagtaagcgatgaaaagactaatgaacagataaatataaacaaatttgatgagaaagaaaatgatattgaagatattagtgagaaaataagaacaatgcttagaatggcaactaatgtgaatgaattgaatcaagcaattaagatggcatattctgttggtcttacatatgaagcaggtctaggtgaaagaaaactgaaaaagttactttgttag

SEQ ID NO: 378 - DNA, 1929 bp, Cryptosporidium hominis
atgaaaaaaaatacaaaaactatacaaagaatgtcaatgattaaaaaagcaattaatagtattaaacaatatccggtaccaattattagtcatcaacaatttcaaatacttgaaggtattggtaattatttaggatctcaacttgaaaaacttatcaaatctgatcgtataaatcaattaaaagaattaaaagattatcaagaaaaatgtattgaatatcgtgaaaataaaattaatgaacttaatctaattgtagatcctattcttacacaaaatccagaagctgataattctatattagaaactcttgaacaagaaaagcttaatgaaaaggaatttaataataaaattgaaacaaataatcataataaaaatggtaatcaaggtatacctcaaatatatggtgaaaaatggagtattattgttattattggtattcttcagattttaaagccttgtaaagatattgatcttgaaagaatacaaggattatataattttctcaaagaattctatgaacctaaaatgactttaaaaaaagctgaaaagactattaaacagcttattaaacaagatattattcaattgaataaacatcattttaaaattgaaggatttcctatagaatctgaaaagatatgttataatttaactaataaaggaagtgaaatttccatggaatgtataaaatataatgaattatttgaatatatatttactaattataaaaaagaacaatttaataatataatatcacaaaataatatatttgaaataattaaattatttgattttaaaagaaagaccaaagtattcacagattatgagattgttatgattattgattatagagaagttaataattttaataattcattaaataatgataatattaataattgttatgatgatgataataataataataataataattttagtagtaaatcttcaggtattccaaaatatttattaaatagattaattgaccagggtattagaattgaatttaagaatcttccaattggagatataatatgggtagcaagaccaaaacttgaagataatgatgaaattacatcaattgatgactcttttgtattaccatggattattgaaagaaaaactggaagtgatatgtgttcaagtattttagatggaagatacgaagaacaaaaatatagactaatgagatcaattggtgttgaaaatgtaatttatttacttgaagatttaaattcaattcatgaaaatatagtttggtcaagtagtagtaatggaccaattagtagtggtaaaattgctccaaaacaagttttgagaagtgctcaagctaatactcaatttattgcaggctttcatattctacaaagtcagtcaattggacatactttgactcttcttattggaatgcatcaaatgattaccagaaatgtaagtaatagatggcgtaatacagaaattaaacaagatgaaatctttgatagatcttatattataacaaaaattgcacaagatagaccatcttttaaagactgggaaattaatagtaaaaaatcttcaaatcttacagttgaagaaacttttggaaaacaacttagaagtattaaaggatgtggtccagaagctactgagactcttttagaaatttggccaactccatataaaatgtacgaggaaatgtcaagtgaaataacatttgatgacttatattcaaaagttttaaaaaaatgtgaagaaattagaaatatgaaatttggacctaaaaagaagaaacataaaccaagtgtatccagagaccttttatttcatctttactgtttattttcagaaaatatccaaaatggtgatttaaataataaacataaatttgaaattgaaactgaagacaagagagatactcaaagtaatgataatgattcctgttaa

SEQ ID NO: 379 - DNA, 1155 bp, Cryptosporidium hominis
atggtagatggcagtgaattagcttttcgccttatttgcaaaaagtatggatgtgatttaggatattcaccaatgtaccattctggattattttcaaaactacaaggttatagagagacaaattttcaaacatgtgaagaggatgacccaatgatagttcaattttgtggaaatgatccagaaactctagtaaaagcttcaaaatttattgatgataaagttaaaggaattgatataaattttggatgcccacaaaatattgcaaagaggggaaattatggtgcatttctattatcaaatccagacttgatggagagaatcatttcaacattatcagaaagtgatttaaaatgcccagtatcatgtaaaattagaatacttgatcatcatgatttacaaccaacaataaatttaatcaaaaggttggaatctgctggtgcctgtatgattgctgtacatggaagaacaatgacttctagaggagtgttgacaggaccagctaattgggaggctttaaaaattttaaaatcaagatgttcaattccatttattgctaatggtggtatttccaattatgaggatattcaaaaatgtttgaattatacgggagctgatgcagtaatgagtgctgaaggaattttagagaacccatggctatttcaaggttttaaaactccagaagccattaataataaaccttcacaatttcaaatagcactcgaatatttggattattgtattctttatccacctccaaatgttggaattattcgaacacatctttataggatttttcatactatatttagtctcccaggagctcatatatttagagatgaaattaataattcacatcaagtacatgaattccaactttttgttcaaaatctggagaatttttataattctaaaattgttcatgaacttagaaatttttcaggaaaaattccacaaattggattctggtatatcagacatcgccatgataagcttgatcataatgttactagagaacttatttcaatttataattatcaacaacaaaaacttcctactattcttcaatttaatgaatgtgatatgactgatgtaaaggtatccaataacttagaaattcaatcagatgatgatatctctaatctattttctctttaa

SEQ ID NO: 380 - DNA, 429 bp, Cryptosporidium hominis
atgggaataaataataaaggatttaaaatacaaggaaatatttcggctgataataaagttaaaattatagatataagtgaaaataagagttttaatccaataaaacatgtaagatggcatatgactcctcaaataataaccgaaggtgatgattattctttggttgaccctcttccattgtttgaaggttttgaatggtatatatcaagagaaactattggtcattatttaagtgttacaatatttagggggaatactataaataagaatcggattaatctaattcaagctaaagatttacattttaatggtcaaaaaaaactgattaatcatgaagatgattctgaatctcttataaaatcaaactttaattcagaaaaagatactgatttagataaatatactacagaagagacaattattgggtaa

SEQ ID NO: 381 - DNA, 165 bp, Cryptosporidium hominis
atggatggaattgcaaaaatatgctataataccaaaaaagatgaaaagaaagagagaagaaaaaaaagaaaattgttaaaagtagttaaggataataagaatgggaatacagaagcgaattctattgaatataagttaaggtatccatatctcaatagaatttga

SEQ ID NO: 382 - DNA, 870 bp, Cryptosporidium hominis
atgtattatttaggttgtaactcaaacagaattgaaaattattttagatcaccatatacatataaattttatattgatccaaaatctaaagaggaatatgattctgaaaaagcagaaagttttaaagaaattgcaaataatgatttgaaccatttaaaaatgttggaaacagaatttcaaaaagtttacgagatttactgtcaaaattatacatatataaatggtggattagaagaagatatatgtgatcatggagttttattgagtaatgtttattgttatgatcttgaaggagattcttttggaacttgttttgtaatgaagcatgtaattaatccattcaattttctaaatgataatattaatgaaaaatcttcaacaaatgatttaactgaaatagtttattttttggatattatacataatgtagaaactgtactttctcattcatcaggaattgcaacatatagagttggatcaacttattattatggttttaaagataaacaaaaaaaacattcatcttctggagatgatgaaaataattataataatgaaacaattttatttgatggatgtaaaactaactgggtagaaaaaaaatttgaattgagtaataccaaattcttaaagagctttttaagatcaaatactaaatccaattttaatgaagaagttagtaatgagaataatatgcaaaatattgctattgacagaaattctattactattattaataatcaaacaatttattatcatatttcaaatattgggaaactgattgaatctattgataataatgttatgaaacaaattcaacatgtaatgattgataatctttcaaatatttccaataatttacatgaatag

SEQ ID NO: 383 - DNA, 1365 bp, Cryptosporidium hominis
atgatgcagctagtatttacttcaaatggaaatggacgttcaacttcaatccttttgtgtgactggctattcacaattttagattacttagataagaaaaaatcgaattcattttatgaaaaagtttgtgaattggttagagatgatatatctgaagtagatatggcatctgtatttgaattacttgttgaaaatttggatggaatatttgagattttgaaggatgctgaagtaaagaaagaaatagtaatacgtgatgatgttaaacgaagttttggagagttatataaagaatcagaggaattctttataccattaatttcaatgcttcttcatccaaagtttgatgaatcaagaattgatacatgtaagaagattttccttgaaaaattaatgagtaaaggtgaaatcccaaaattgagaattaatgtattacaggtttattatgatatttttggtcaagatcttgaacttctagtaaatatattaaaatataaggcacaatatggttgttttaataactttgaaacgatggaatcttcattagatatgttagaaaagaagattacaaatattgatgaatcaaaatctgaattgaagagaaatttgtatttgggtatgtatgatattatatcatcagaatcaaaagataataagaattatttgaataagaaagcttatgattatttaattggattctttgaaacttttaaatcaaaagatgagatttctcaatcaataagatcaaatagtcacatacttgatttaggagtacagtttcttatttcaaccattcttttaccagaaatattattctttgattcattactgtcaatgccaatttaccaatatattaaggaaaattactcaaaagagtataaagttttattggaattatttgatatatgttatcaaggaacagttggtgatttccatgataaacttcaaaataataaccaagaatatcagaactttcttgataaattaccaattttaaaggctaatgaaagtaatattgttaataaacttcaattattaactatttcaacattggcaaaaggtaaatcatctattaagttagatgaacttgaaaaagaattcagactatcatcatttgatactcaagatgctgtagttaatgcaataagtgttggacttattgatggaaatatctcagagaattccaatactgttaatattaattgcgttacaaagagacaatttggtaaagctgaatgggaatctttggataaaaaacttaatcaatggatgggacatcttacttctctttcttctattcttgctaataatagcaataataataataccaataataatgttaataataatagtaataatgagtag

SEQ ID NO: 384 - DNA, 414 bp, Cryptosporidium hominis
atgaaaacagctttccaaggagaattgaatttaatgaataattactatgaaggacctccacaacaaagtccaagactatcagtattagatgcaggagctacagggtttggcttaaatgaaatatttaaagtagcaacttttgcaacaagttttgatcatagtttatttggtataacaaatgcaagagcagcaatggctacatcatattttattggacttggatcctttattggattcataatattaatagctttaattcgaattatatactttgctgctaaaaagagaaatagtagatctgagtattccaatccaaattcacaaagattcgttgttagatcatctgacgatattgtttcaaataattttggatctgatgaatttccagctatttctaatagagcaaaagtttaa

SEQ ID NO: 385 - DNA, 1524 bp, Cryptosporidium hominis
atgaagacttttctgagaattttaatattattggtagtttcaatttttagtggctttgtaaattgctgtcctgaatatggtgtatattataaaggaactttttgtgcagcagcaaatggattagaatggtggggagctagtagctggcaagaatgtagagaaagatgtaggagtaacttgtttagcttgattccatgtaaggtctttgcttgggatagtaatggtggaacttgtacattacaaaatggtgatagaacttgcaaaacaaataatcaaaatgtgatttcaggtaatccagatgtagcagttactggtagttgtgcaacaacatgcactgtttcgagttggtcaagttggtcaagtacttgtgttccaaaagtatatggtggaattacttatagaacaagaacaatcgcaagcaagccaaaatatcctttagaaagatgtccacatcttcaggaagttgttaattgcagtgatcgtaactggggtaaaatgggaagtgctgaattgaatgatgagaattctgctttgaaccatgtattaaatggaattatcaatcagagtgctcttggtaaagacacctcggcaacaaattgtccaaattacgatgttggaattttgggctggggatgtaacctagatgatgacttaaattacggaaacttgttaataacttcaacttacagttggcaggattgtttaaataggtgtaagcaaagatctgattgtacgcatttcaatttcaggtatactggtactggaacttctccttgttatcttattttgggtgaaattggttgtagcttccactctattggttggattagtggaagtcgagacttagctgttaaatatggagaatgcgacattaattgtgtacttggtgattggacacactggagtggttgtgattctgcactttgctctgatggaaaggcatatagcaaacgaacaaggccaatccttacttcaccaagaggttctggggctccttgtcccaaaacaagagagttaaaagaatgttcaaacacacatacatgcatggcgaattcatgtgtagttggtcaatggtcacattggtcttcatgcgacgaaaattgttctattgttgtaagaagaagaaccgttcaacaaattccctctcctggtggtactccttgtcctcatttggttgaagttaatcctgtggataaatgtgaagctagcttttcatccccgttgaatattgcaaatcaattgtcatgctctgtggcagatagtttcccttggggctcctggtctacatgtagttctacttgtggtggtggatttaaaatcagaagtagaaattcaagcttctttaaatattctgcagaatcctgcaataatcaacaatgcagtgtctataatgttgaagagtgtaaaataggtaataatccgaacatcatttactcacaatttaacagactttgcctcattactggttactcgaactccgaagacaggcttaaattacttgtaaattatggtttaaatgtataa

SEQ ID NO: 386 - DNA, 1674 bp, Cryptosporidium hominis
atgtcagtggaagagaggaaaagcggatgtacactaaaactaccaatagtgaatgaagatgatgatatgatggattttttagagatagatgatgaggaattagtgcatgatgtaaagcaggcagtttctccaacatcatctagatctttagaaaatccagatttcaatgggattaacttgcttctttcttcaacaaatacaacaaatggagtaagttcaataggtacttcaacatcttctggacaattcattccatattttggtcagccattattgtttccaaataataatcaaaatttattaaatttagtggcattatgcattagtacccctcctccttttactggccttcctcaaaataatcctttcttttcaagcaatgggattaatgaacaggtaaattttgtcccattttccacagcagctccattattctattttggattaccagaagaaactttaatgggaggtggttatacaggaacaggaaacgcaacaaaataccaacaacagaatcagtttgggaaaagtgttgttggtggaccatcaaatataaattttccaacaaatggtcatattcaagaaattgaaaatggagtttgtggaggaaatggtggtaatttaatggataatgaaattcaatataattctgcaaagcttagaccaaatgtaatccaaaatcagaattcagtatttccaggttgccccaatatttttggagaaagtggttatggaaataacaacaatatggtatacagccaacaaacaaagttaaatccaaataatcaattaggattaatcaacaatttgaattttaatggaggagggtcaagaattggccttggacttggagtgggtcttggctcaggaggaataggaacaggtacaggacaagcaggaacaggaattggaacgggattaagctacgatacgccaattgagaaggaatatgatgttaataatattaaaattggagtaaatgaactgaataggttgtctgatcaaggtcaaaatcacctatactatgagctaaatcagaaacaatttcataaaaatggaaattctaattccagaagacaaaacacaaacatgaatggcgtatccaattctggagaacaactaaatagctctgtttcactgaattctggaggtaataatgagaagaaaaatagatggcaactttcagatccacaattcaaatcagggtataaaggagtgagttggaatagtagaatggaagcttggcttgctttttttgttgaaaatggagttagaaaatctaaaacatttagtagcagaaagtttggatttaatagggcaagagaaaaagctatcaaatacttggatgctcgaagaaagggaatcatactcacaactcctcctccacttagtccttctaaaggaatatatgacagaattccacaacagagaaaaatggaatctggacgagataataactattcacctgggttaaatgattttcaaacttttaataatgataatattaataataattgtatgaatataaatttaaatagtaatagtggaaataatatggatattacttgctgtaattcaagtaataataacgtgccttcaactactgctagttctattaattcaagcagtagtagttctctgctagagactaaccatacagtaatgtgttcttaa

SEQ ID NO: 387 - DNA, 597 bp, Cryptosporidium hominis
atggtatctgataaaaactgccgtgtttatgttggaaatcttccatggaaggcaaagtggcacgatcttaaggatcacatgcgacaagctggaaatgttattcgggcagacgtctttgaagatgaagttggccgttctaggggttgtggagtagttgagtattcatttccggaggaagctcaaagagctatcaatgaattaaataatactacattacttgatcgtctaatttttgtgcgtgaggatcgtgaagatgaatcaagtagatatggtagaagatcaaacaaatggaataacagaggctatggaatgagaacaaggactcacgctccaagacctccactaaaagaggaaaataaaggaaagcaagtctttgttactaacttggcttggaaaactactcaagaggatcttgctaaagcctttaatgaaattggtcctttagaatcttgcgaggtcttttatttcgaagatggaagatcacgaggaattgctacaattgttttcactgatcctaaccatgcacaacttgctgttgagaagctcaacgatcgtgaaatagatggtcgcgagatattggttagaatcgaccagtaa

SEQ ID NO: 388 - DNA, 4395 bp, Cryptosporidium hominis
atggaatttgtctctaaacttaaaagtgaaggattcacgatagaatcctggcactcacttgctttgcacttatataacgcagaagaactcgaaaaatgtgaaactattttgcaagaatgtattgaggagtatgaactcttggatgaaaagctcacacaaagtcaaaaccaaaatcaacactccgatatttatatcaatcgcctcaaagactctattcaaactattggaatgttgactatgcttgaacttaatttagctttgggatgctttgagactaactacagaaagtcagagtcaattattagaagaatagaagaaagacttaagcagtttatgaaactttttagctgtaactattcatctagtaatcattttaaagctattcataaatactggggattcctttatctatataagagtgttatcacaaatgagatagatctttcccagagaaatacttttcttgaccaagcggagaaggaatttaccattacccttgaatctaataccaaagatacccaagctatatctggattagccaatgttctttatcaaaagatggccttctccagggctctaagactattctcaactcttcttcttatacttgggactgaaaagtgtccaaacaccgtcagacttgctatggcctgctgcaatcttcgcctaggtaatctcaaaaagtctcaagaatgctgtaaaagggcaatctttatttgcatttttggcgccaaaaccgatgatgacactattcatgctactggtgatgacaaggagaaaatggaaactttatttataaaaaaggagggtaaagaggaagctcaactcaacagagatttacttgagaatgaaacttttattgattcattgacacaatttgaaaggcaaactctttctgacttacttttgtgctattcaaaaagcactaattacaagggtcttagcctcaagaatgcctttgagattatagctaagatattcccaagtcacccagctcttgttttgtatgccagtaatgctgagttttatttgggttatactcctaatagcaactttgagaaagaactgtacaacatttcaaaaagatgttcaaacttttattgttctcttgaggctcatttccacattgctaagaggcttcatctcagaaaagatattgctaatgctcattctcactatattatagttgttgatgtgcttaaaaatttctataatacagacaaaactttactcaatctttatttatcttgcctacttggtgctattaaaacaagttgtggacttcagaaatgggatgtttcaacacaatatatccataaagcatttgaatctttgggaattaagggatcagttgactctctaaaagattataacctccctattgaatatctttatgagtttttaatccccacaatttcattagttatcatgagtattgaagatccggctatgattcctaccacaatttcaatcttttctcaactaacaattgaagaaagactccttaattgtctgcattatctatttttcatattggatagaatggatgacattaattcaaaacaatgctatattattgtcttccttcttcaaaaaattacgacatgtcttttatttagaggaaggaggacaattcgtcgcagcgactataactatgaagtaattactaccttgatttccaaatatacaaactattcagcaactctcaaacctattcctcttattgtaatattattttcttgtctcaagtacctgatagttaattgtaattccttaccttcaccaagagatagcgaaagaaattcaagttgtgataatccaatgttgaattcaactccttacctcaggtataaggatttagttagggagaattttggaatttacttaaacaatttaggagtatgtatcatggaatgcgcgacatctttatcaccagaacactgttgtattggaagcaacgagtatacaatgttaaatgaatcattggaaatctttaatcaaagtaaggaatggtttaaaaaaagtatattaaactcaaacaagactgttgagattgttatcaggtttaattctgcaatttgtcacgaattaaaaggattctatgccaatgccaatgacgagtataaaaggcttacatctgaatttccttggtttacttctgcttggcttagaagagcttgtctagctttagaaagaaatgactaccaacttgctgctcagtactgtgagctctctttaaattcaaaatctccagatattggaacgctgaattcaggttcaaactcagaaccaaactctaacacaaattcagtatattcttgggctccaggaattggtaacaatcacgaatctgcaaatctcttactctcccatatttatttttgtcaaaagaagcctgataagagttttagtgcattaagtaaagttataaagtcaaaaaatacgtactactctaatattgggaaagttcttcttgggtttgcactttacaataaagccaaatatcagtctcaatcaaactattcaggtgaaatgagcatttataacccaacaagcattcagtctagacttgttttatcggaagtactcagacatgaatcatttaattatattgcaagtaatttaattcttatccaagctgcggaatgtggattatttgaatcttccaaagacatgtggaaatatatgacagatatttcaagtgccttggaaggtgccgcctcttgcatgcattacgtggcactaataaatttaggtgttttgcatgcggtcctattggcagtttctactcagaggaacccgccaccagcccaacataatttgacattgagatcaatagtggatgataataatgttggtggaattgatggaaggaatgaggtattgggttctcatcctcactttgcggagcagaaaagaattatgaagactacggtgaagcttttccaacaggcattacagtttgaccccacagaaaagactatccacatgtcattaattaagtgttgttttgatatgaatatgtgggaagatgcaagaaagttgttggagaaggcaactttgaggtggccaagtgatctgacttttaagatagggcttacttattgtttagagagacttgtatattctgaaatgggagatatggagagagcaaaacacccaggtagggtaaagtactggatgatgttatgtgaggcagttggaaacttttaccattggctttcaattattaaagagacctttcaagtggttgatatgaattttattaatcaaattaagaataataaacttaatgttacatcgctccaaaagtttgttccaggtattgttatgcataaccaggataataagatagttttgaatacagaaaataaagatgatcttagatacaagttatcagcaataccgctggaaggaactgatttgctgccaaatattgaatatttaacaaaacaggaattaataatgagtaggaagttatattctagattcgaagaacttctacctatagttgagcaagtttatgagaaggagcaaagggatgttgaggagctacgaattcgaagtgaagattttaggaagaaacaggaagaggagagacggagaaaggaggaggaggagaaggttgcttctgagagaattaagcttctttcaattgagcttggaaaagaagctgaaagtattgcagctagcttaccagatattcaagttgaaaaaagatctaaatcttctaaacgagatagaagcgatgacctcgaaagggttgaagaagatgatgaagatgatgacaatgatgacgaattagcttcaggaaatgaatcagacccatatacaggttcagattctcaatcagaaactcgatcaaatttggactcttctagtgatgtagaggaaaaaaagagacaacatccttcaaagtcccttaagaataaggaaaagaagagtagaaaggataaaaaaaagaagaagaaaaggcaagaggatagaatcagatcacgtaatattggcagcgaaaactccttttccaattctaacgaagagtctgatgttgagcaaattggctccaaaatgcgtgattctagttctgaatccgacactttggcatcaaaattgaagaaaaacaagaagaaaaagtcaaatgatgccaaaaaaagagaggagaaaagactgctgaaacttaagcgtctagaagaacaaacagctgcacttctagaggaggaagagaaggaaaaaaaagaggctcagccccaagaaaacacaaatcatgatggactatctgataatgagaaggaacttgatcacgaagaaaatcaaggtagattgagattgaaaaagagacgttttctggatactgaagatatagatcttcagctacaaggggaggatgaaagttga

SEQ ID NO: 389 - DNA, 276 bp, Cryptosporidium hominis
atgaacccaggaggatttcttatattgcgttgtaatattcaagaattgggaaaaggacagaatatgaatccacttgtccagattcaggcatcaacaagaacaaactatacatctctgctttataatataaacgaagactctgtagaaattcatgatttatcttggtatcttacaagtagtaagactgtcttgccagataatacaactttttcaagaaatgatacaattcactttgctattggaattgatacaaactctttttctactgtaagttaa

SEQ ID NO: 390 - DNA, 216 bp, Cryptosporidium hominis
atgagaaaattcttaatgttaaaaactgatttaaatgatattacaacaaacccaacaaaacgtaatccagtgccacaggattacatgaaatctacggtaagttattccaataaaaaagagttaatttattatgaattaaaccaattcttagactttaactcttttttattactttttttttctaatattaatataactattctagtatgcaaatag

SEQ ID NO: 391 - DNA, 2742 bp, Cryptosporidium hominis
atgcttgatttggaatcagaagtttgtatgagccaatatggatataaatttccagtaacaaagagtttactcccaacaatatatccatatttatcaattcagtttattgcgcaggttgaaaattcaaaagtttccagatttggctttgtttgttcagattcattatcttatgcagtagttgattgtaatcaaggaacagtgaaaattgcagtattattaccaagtagaacaggtagctctgaaccaactttgcattcaatcaatcttccaacaggtttaaaatgcggaaatccgtcagctcaatcatgggtagagtctaggttaatatttcaagaaaagtcaatgaacgacccattattggttaagggagtggggccatttacttcagtctggacttactcaacagatttgaatgaacatactaggagttttgaattccctaatccctgtccatcaagagaggtactgtttttcactagtggatttaaaaatgttcaaactcaaatgataccaagaagtttatttgatatgaaattttcaacaccaaactctaatttgttattaccatttgaaacagcatcttcttatgtaatatatggtactcaaaagtataatttggagacattttctatttcaatgggattaccaaactatccagatcagaaattagtatatgagacaaactcgagtgatattttatctttggaaaatcaaaataagacaatttcaggaaagcctatttttgttcatataagcctgcttccattcacagaacaaatttcactttcagttaataacaaagctcaaaacattaataagaattcatatatgatttgggataagaaagatattgaaaataatgaagaaatggattcaaagaccatatttaagaaaggagcacctgaactttttactggaggtatatatggattaaatttaacatcatttgatacagatagtcctatttacacaacttacactactggattctgtgcatttccaggagctcagttagttgaacctttatacgaggttgttgataacgtttatggtgttgatgattgtaatattctttgccagaatgatcctcattgttggttatggtcttacaatattgttaacagacagtgttcattccatatgaatgcagtttcattcgaatatacttctgctccagatgttgtttctggcccaagatattgtcaatgtaattatgaaatgccaaaccaattgtttaatttgattggaaagaatgtaaagatttccaataataataataatagtgggggagattacaatgcatacttttcagaaaatacatttgagtgtgactatccaacatttgggtttgcaattactaatggggatccaattttgaataccacttctccatccccacaaatttgtttgaaggaagttcttgcagataggggtggcattgcgtcttattggacttacgatccaattacccaaagatgtgagagtgctgtgggaggttatcttaggcctcaaaagtttggtcctcctacaactccaaaagatttggcaaaaaataatcacggacaaaataacaatgcattcttgttaggaggtgaagtcccaagagtgcataacactccaaataatttccgtaagctaagtcttgatttgtttgagaaactccctacaattaatgaagaaaataagaaaagcatgaattttgagaatttgattcctgaaatgatgtccattccagatgttgggggagtatcgcctgtatatggatttaaagacaataagaatgaaaaggatggcgatggtgatggtgatggtgatggcgatggagatggtgacggagaggaggagaccactacttctactactactactactaccactaccactaccactaccactaccactaccactactaccacaacaacaactactactactactactaccactaccactactactactacaacttctagtaccaccaccaccactgagatggaaattacagaggaagctaatgaagacgaaaagaatactgaacaaaacaccgagttctcaaacttggatgattaccttaaaattattgaacaaaataatgaaaacattctggatgaaaatgaaattaatcctgatgaagaaaataatgaagaatataaaaacatatatgacatagcaactttaatagtgtctcataaaagtattaatgaacttactgaggaagaagtgactgaagctcaatctaatgaacttaatcaagaagaaagggaaagttcaatagaaaaagtgaatgagattacagaaagtatattaaatagtctcaatccaaatcaaatctctgttattgatactcaaattgcagaaggaatacatcgaaattatagtattgcaactttaaagatacctttcaacagttttgaagaaattaaacaagaaatatataataattataattatggctatccaatatatttcttaaaaggattatataaggaaaatgtcttagatttcaatattaatggatttgatgattttcaaatcattgatttgactttcttattccaaaacatttctttctgtgatatatctaaatatcatgcaactattatggttttaaatattgcagctaatatacacaagttacttaattgtagtccacatatgattcaaattacagatttcccaccaaccattattgaacaaaatatgtattgccaaaaacgtgtattggaatatactgtgaggtaa

SEQ ID NO: 392 - DNA, 135 bp, Cryptosporidium hominis
atgtttggacaaagatcatcattaataccttttgattttgtcttttcaacaattaatgaaacaggaactggtataattaatattgagggtgaaaattatcaaacatttattccacaagttaaagattctgattca

SEQ ID NO: 393 - DNA, 345 bp, Cryptosporidium hominis
  misc_feature (231)..(231): n is a, c, g, or t
atggagattattaatagaactcttgattctatatttgttaaatgtcatgatattcaagttgaaaacattaaatatggagaattggtagtattaatcgaatctgatgatgattattctggatattccgatgctgatattaatgaaaattatggagaatttgatggagaaaatgaagacaatggagaaattgctgatgaatcatctgttgaagatgttttagaaattgttagncaagcaaaaaaaaaaaaaaaagaaccaaccatttatgaaattgaatttggaaatgtttcaaacacttcaggaaaatgtaactttgatgatttaataaaattcttacatagattg

SEQ ID NO: 394 - DNA, 435 bp, Cryptosporidium hominis
atgaagctaaataatgcattctgcggattttcattgtatatgatttttatttttttgctaggagatgttactggtatacatatcaatagagaattacagaatttgagtattgaaagtgagggaaatattaaagtgggtaattctgctaaagattcgggagatgatgttaatgacgaaagtaattcaattattaaaggagaagaagaaaaaaataatgatcaaggattgacaacgaacaatacagaaagtggtaatagtacaactacggagaatactagtgataataacgaaacagtatctcagaatataactgaagcagataataataataataataataataatgattcactaaaacatcatgtatacaatggaacttttgatttaaagaaaacattttttttggatggaatagcatataatagtaagttttaa

SEQ ID NO: 395 - DNA, 1485 bp, Cryptosporidium hominis
atggtgcaaaggcacagacttgcagattggcgccatctaaaaagccgtgttgtctttaaaaattgggacaacacacacaaaaaaaggaaggttttggaagatactgagagaaatataaaggaattgagggtaaagaagaaaaatagaatggtgcaagtgaataataagggaatattggatggtgttgagttaagggaaggaggaataaaaggtgatccatatttagaaagagtgaataaaggacatacaggtttgggagcagatgcaggtagcttgaaagatgaaagtaagcaagttttaaatgcaagaagaggtttagttagaatgataatagatattatattagggaaagatactactaaacagtataaagaaggaagtgcagcatattttattgataagatacaaaaaatattaagattaataagtttgatgttttctttatttattttgggatttataattacttctagaattaataaaggaaggaaagatgtttcaagttcatttccagtgggatctttgggaagatcaataaaatttgaaatgatgttggacactttagaaaatgagcatggaaagttaggtggggaaggatcatttggagaaagaagtaaagttaatgttaaaggtattgggagtaaagatgtaaaaggccagaatactgattatgatgaaaatttggaagaatttaatagccaagttttagatgatccagaatattgggctgatgacaatgataaggatttatgggatgatgatattgacgagtattatgacatggaaattgtaagttcagaagatgatgaaaatgatgaagagttaggaaataataatactaataaggaaaatagtaatacaattccaaatgaaagtagttctcaaataatacaagggaaaaggaataagggattaagatcaaaaggagtcgaaatttcattaccttcttcattgatattatatggcagagtaacaaaagaagatacatatattaatggggcttataatataattattgaggagatgaaggatggaaagaaatatcctaaattacatcatggaagagcaatttacaaaaaagaaggaaaaaccaatggaaatactacaataccaaccttatttataatatttgatggtactcatgaattctggacaattacttcaagtttagatcctggcttaaagcctttagcctttctaccagatcatgcattaatacctataagacatgttggaccatatggagctcattcaaattcaacttgggtcttcagaaataataatggtattttgaaggattctagtgttagaattgtggaaaatagttcagttgattttccaagaataccagttcatattaccaaggctacacataattggcacattaaacatcatagggagacgaaaggcaggacaaattctaacaaaaagaatgttagtaactacaatactgatttaaaagtttttaaagatccttacaaataa

SEQ ID NO: 396 - DNA, 1209 bp, Cryptosporidium hominis
atgagatattatagggaaaattccttttcaatgcttaaagtactggaattaagaaatttatatatacctttagacacatttgatcatttaattttaatgttttcactttcaaataataattcaagatataaatttcaaagttatgaaattgaaggtaaccaacttttatataattaccagaaagtttatgcaacttataatttaaagttcgaggatggatcatctaaaaatcattattataatatcaataaatatcatagtatgagtatccaagaggaatctgatttcatgcttaattcagattatacaaacttaggattctctcatcctgatgatatttcttgcaaaaacaaaaacgattatgaccttttaggtatgaaactgaaagataaagataattataatagaaatacaaaagagtctagtaaaattaatgaaaatggttatatgaataataaattacaaaacaaatcaccttttcagcatgattcgcaggtaatgcaaccatttctagatattaaacgatggataataaatatttctaaaacaaaagagaataataatccagaaaatataagtaatgtactatattcattaaatactcatattttaattctagataatcagttacaagaaatgaagtatcaaagtattactgagatacacagaaacttaatttcaagaactattttagaatatttggtagatccaatcaagacatgtttgagtatatctaattcaaggatagtcctctcttttggatttgataatttgatttattctggatatatgttaggagtcttatttgaatatcaagtaacactcaaggaactatcagcattatcatttttgatacctatagatttcttttgccaacttaaacttaatagaattcaagttcttaaagtttcattatttaaagataagaatttagaacctaaagaccttattcaattatgctcttggattgaaagatatggaaaaaatctcaattatatacatattagagtaacaggatcaagctctaaatgggtaccgaaagaagcagaaattacaaggcttattaatttatggaaaaaaatgtgtccaagaacacttgagggtaaatctcaagaaaaaatcaaatttgaatgttgttttacagatcatatattctcaaagatggaaaaattacccaaagactttgaatacgacacagaatctgattaa

SEQ ID NO: 397 - DNA, 333 bp, Cryptosporidium hominis
atgcttgaaattatatcagagattaaagatttaaccaaagatatatctgttcttaaagtaaaacatcatgagttgattacaaaaattacaaataatcagattcttataacaatttcaggagtccatcctagaaaatattctgcaaaacttgaaatgcttttcagaaagaattttatcaggaacttgcatgaggttgaagaaatttttcataagacttctcacaatggttgtgattctgagatttctaatgattatttaagtgggcttaaacccgatgaagaactccgatcaattaaagaacagcttttaaggagattcaaagatcgggagtga

SEQ ID NO: 398 - DNA, 1767 bp, Cryptosporidium hominis
atggctccaatattaaaacatgcattatttactttaaaagcaccattgtactttcagttattaccagcaaggttacttataacatatattctattttggtactctattccattcttggtatttgctaataattataacttagggaaatcacaaaataaccaatgtaatgatattttgaatattaattgtacaaaaattaccaatcatacggttaaaaaaaataccaatattaatccaacaattcaacaaaacaatttaatgaattttggatcatatcattatgaaaataaccaccaacttggaaaatttgaaactgatttgaatgtcaataatgataattcaacttataaagtaattgatggtgctccttctgaaacattatttaatttgaaaccaaaattctctgaaaaatttgaagattcttctccatccaaatgttacatattaacagttagtggaggaggagcaaaaggttcattttctgctggccttttaaatggacttgcttttatatatagatatcatggaatcaaattaagatgggatgttacatcaggagtttcaattggtactttaaatactatttggagtcaattctatcatgttggtcaatcgactcatttttctacagaaggggcttcaatatggagtaattttacacataaaaatgtacatgattgtaaaaaaactttatctaaaaatgcaccattatttatttttagagccattactgaaggcaaaaaattacccaattatttatgctcaacttaccctatgcttatatttatgagacatcttttacaaaatagaaagagatttaaaggtcccaaatggaatgcacttgcatatcattttaaatcagctttaagttattattttaatgaagaagtaccaagatcaataattccttcaataattagatctagctcagcatttccattagtacttgaaccagctgaaatttcaggtattggaatatttggtgatggagctatttctaaaacgattgatcttagaggagctgttcatagatgtttacaatcaggaaaagccaaaactgataaagatattgttattgatttgattactacatcatatacaaacaatgaatttcattctattattgatccaacatattcaaaaaccatgcttgaatctttatattggtttttcaatttttattcatttacagaaacttatcaacaatatgaaattgttcaaacaattagaagatacccaaatgttcaatttagacatattctttcatgtttggatgataaagattctattgttaataaaatgggtcttttagacttcgtagaaagtgatgtattcgaatctctgaatgatggcatgaaaagtggtttttataattctaccatgtttaaagatttttggtctccagtcaaaagagatattacaccacatactgattggaaaccatatggggataacaatataattattccaaatcaggattttaaagtttcaaatcctgatactgatgcttttgtagaatttccaaaacttgaaaataagccatactcattaccaactatttttgaatttatgtcttcaacgactaaagttttggataataataataataataataataataataataataatttacttgaccataaaattcaaaaattcattttagagcttcatcaaaatattctttcaatcaggtttttagagaatgttagagagttcattcgtcaaagagatgatgaattactttattatgaacgaagaatttaa

SEQ ID NO: 399 - DNA, 1107 bp, Cryptosporidium hominis
atggggatttcaaaaggagagaggcaattacaatttgttccacagagatacttaagaagaggaatattttcctctgtagatttatcgagttcaatatattcagctcttccagaatcagtatgtgtggttaagataccagatgctatttcaaaggaagttaatagcttgttaagtagaggagaaaaatttccatttggaattcagccaacaccgtttgaagactttcgtatttttgacatttatttacttggacaagattatgtaggaattttggtagatcttccatgtaatatagaggtttataagagtttagattgtgagagtatgtttaaatcaaataacttaaaccaaatgctttacatttacgatgcaaattgtttgccaaaatggtttattacttcacaaggggtgaatatttcttcaatatacaagggacctatgaaatctaatatgatgtattcagatcaaactttcgtctctttcattaaatatttaagagaatcacttcattgggaatggccagctggtttacttccagcaagtagaggagtgagatctagaaagtacagaaacactgaattatttgacattggagaagttattgaggctgaacaggaactattagatagagtttcaatgccaagccaagatatggtaactattgatgttatttctgcaaaagaaatggatgaacaaattcatttattcaagcatgaacaaaagaattctccttttcctattgcatctgtttttgacaagaaaaagaaagcaacatgtatggggatcataggaagagatgatgatttgagaagtatgatttctagatttaaaagggaagattctcaaaagaaaggaacaaagcaaaatactttagaatttgaagatattcaaagcgatatcagtgacgtaattttccgtgaaagttcagatgatgagaataatccagacaatagtttggaaatggaacctaataatatcagaatatctgaagaaaatctatccaagacaactatcagagaaaattcatccaacaacaaactagttatatcaaacgaattaagtctcaacgaagattgggattcacatgattcttccagcgatgattaa

SEQ ID NO: 400 - DNA, 2256 bp, Cryptosporidium hominis
atgaggaagcaaaacagcactttaccattgcctagagggtcaagaggggattcattgtcaatgccccattcggcttcctctacattctcaaagtttggttcaaaatatattggaactggaacgggaaagcaggaaggacagggattatggcaggatattttgcgtagctttatgaatggtttacaaggtaaaaatgcagagaatttgcatggcacattatttgtattaggaagggctaatggcggtaaatctgagctcatttcagagctcaaaaagatttccgagaaaggaaaggagaaagatataaagagtgtgttagtgtcatctgaagtggatagtagtccatatattggtttagatttttgtagtatgaaaattaaccaaggattcttccaattagaacaggatgattctatcgaggattctgatcaggatgagttgaataaggatctaaatactacaccaaaaaatgtaacattggatgtatggagtgtagatcattgtggtatgtcggatgagctagtgaagaggcttgtggacgtatttaacagtcaaaatagtcgtttaacaggaaataatacttcagagaattcgagtttgaatgtatcatcaacagacgttggattagcagtaactaatggaataggaggaggtagtttagatgatgattgcagagatggcttgacttccatgcagtctccaaacattatgtttttaatagttttggactcctctttaccatggactttaaatgatgatttggttatatggattcaacagattcaggaatgctgggcaaagtctttagagctctcaaatctttctccagatttgcagaggattatgattcaagaagtgaatcattattttgagactagaatggaggagattgtggcagaagcagagcaaagttctgtatctagacctgaacctggagaaaaggctctacaagacacaatagattctcaaggagaagatactgaacaacgtactcaaaaacttagtgaaattgaagcttcatcatccaatgctagttcctccacctcttcttcatctaatctatatccaaaagtaaatttgggaattccaattggggttgtcttatcaaaatctgacattggacagagattctctgttccaacagatggtgctactggtcaaccatttattccttttgctttaagctttctaatgaatgttggggattcatatggaatcagttttttcactacaagcattcaaacatctggagatattcatcaaacctctggagtagaccttctcttaagttatattcttcacagacttttcgatacaccttttacagacgaggatgggaaaattttaaagacagttaatgatatagttaacaaaaacaactcaattttgtgtgtcttaccgagaacacctattgatcgcctttgtctaagtcctattcctaatgttaagtctgatatctacgaggagatggttcaaaaatcaaaattcagctcagaaatatccaattcaagtgatgctttagaattagttcatggactttctacagccttcgataagaagatcccatcactgaatgagtttctggaacaaattagaccccaaattccactcattgaggctgcttcaccaggagctgctcctgttcttctgtcgctaacagctgcttcaaactctgaggaatccaaatcaattagtagtgattctgtttcaatcaaaggtacagcaggaggtgcttcatcctcagctatctcttcttccgcagcatctgtatctggctcttcccaaaggcttaaaccctctaaatcaaacttaaatgccaatagccctggcgcctctggagatccctctcttaagggtttcttccaaagccttatacaaagaggtgaaaaaaaaggctctctttcccatcgatccaaccttaaaccagctccttcaatgaatttacgcaaagaatttggctctagaatggaatcaaaactctcttctgaagtaaaacttgatgaaaagacccaggaaagtgaagtagccaatacaaactccttagagatcgaaaaggtgggaagcctgcctaatgttgaagaaaatactgtgaatcctatagaagaagaaaatgagactgtggctgtgactgaaactgcaactgcaactgcaactgtaactgaaactgcaactgaaactgtaactgcaactgaaactgcaactgcagccgcaactgctggcaatgaggaaaataataacgataaacaaacagaatag

SEQ ID NO: 401 - DNA, 1575 bp, Cryptosporidium hominis
atgaaaaccagagatatttccaggtttgcaatcttactactttttggagtatttctcactatttccgaggcttctgaaggtcctatagaacctttgggaaaagatgacttgaacggggaagaatctattagatacaatgaaaatgataataattcaattcctaattttcaagctgccgtattatctgatggggatattgaggaaggttccagtcaaacttccacatctacagatcaagaaggacattctgaaaagggagataaacgtaaaattgtaattaattcattattaccaaatacggaatattgtacagaagaattaagtaagctgttagattttcactcaattatatcttcttcttgtggagtagatgctttaaagaaagttggaggatggttacacaaacataggaattctcttccatattggccatcaataaatatatcgcctccaaaaaatcgaataacattttatggttgtgattggacaatttgtgaaagagaagttgagaatcagattgatcaaaagcttaagaagctgcatttaccagttaaacaaataggaaatacagttcaatcagatgctcgtaattatgatagtgcaaaaagagctatagatattcagattcgaaatgggaatatgtcaaagtgcgaattaattaattctattggtatttggtggtgccaaaaagctcttcctcagttaattactgataaagaaacagcataccattcgattttcaaagaattcaatattcattttgatcagcaatctacagtaagcggaagcacttctatgagcgatatatcaaatacggaagaccaacaaactaatgtaactgttgaagaggaccaagaattaaataaggaggtatcagatatatttacaatggcttcaagtaacaatggtaaagtcaataaagatttctacaaatatccaaataggctagtttttctcaaaacagctttagaagaccctatggaatgttatgtaatacagccagaaaaagactatgaggctactacaaatgagcttagggaaattttggataatgaaagaaatagactggagtcaaatcttgctttcgttttacaaattggaacatcaatatggggctcgaataaagcattttcaccattagggaaaattactaattctgtacaaagaattatcagcacaatgagaatatatactgaagaaatacgtagagacttatttaagttatttccaccaacagactcaaattccgaaactgttcctcttccaccacacgaagatctcgtgatacttatatcagagatttgccgtattcaatcaattacagatgcgatttctctggttataattaaacttctccgtagaaataagatttcaaagaaagcttcagaagatgcggaacacttattaatgaactggatgtttgcagacatgaatataaacaaatccctaattcctgttacaagacctgtcgttactaaaaaaagcagcccattatttgtagaaagagctaaaagaatgaaaattaacgcatcgaggatcaccaaatttatgaataatattgctgacaaagattaa

SEQ ID NO: 402 - DNA, 1056 bp, Cryptosporidium hominis
atgaaggttagattaattctggctttcaaattatttcttggaattctatcctttgccttggtatctgccttggacctagatcttaataagccagataccgtaaatctcagaatttccagccgacaattagaacaaacttacaactttttcactaaaaagctttcaaactcagaaaaagaaaatttaataaagcttaattcatcatcagaatatgcaagaagtactattcctaaaggggccggatatgattttactgtgcaaatggcaatttacactctttctgaaagcttatatataaaccgtgaatatttcaaagtcaatcttattagtgattctaataaaaataaagacatctttgaaattgcaaattgcttatattcaacttcaagttcaactctcaaagccttgaagctggttaggcagagatgttttcatcattctgaaagctctcaattaaatatattcccaaaaaaagttgtaaaaaagcttgaattatattgcaatcagttcaagaaaattgaagtgagatatgcgagattatcagattttatttatttgttgaaaatgattctaaagaaatctaaaattcataactctaatttactcgaactttcaaagctaatttggggcattattaaaagtccatcatttaagaagattaaattttctaaagatttatcagctccaatttcctcgaaaaacccagctattaaacctagtaagaaggaagctgcaactatttctaagatttcgtccctattgagacatattgataacactttattagagaaaattaagattcttccattttggatctttaaagtatctgatgaattttcaatcattttaattgaatctcaatctattgctaacagaatctggtttccacttgaggagcaaattgaattaaacttaaagaaacttagaaaatgtacttcttcaaagaggcagccctgctgttcacacaaatctaagaaatacaagatgtccagggatgaaaagtttatccaaaatgttagagatgtcgctaatcagatccgctctgatattgaatga

SEQ ID NO: 403 - DNA, 618 bp, Cryptosporidium hominis
atgccaggagagcatgggggtacagggtgtagttgccagcatgaagctgtaataacaagtggaaaagatttactttctgaaattgagttggataaagtaatggctttaaatgaacttaatgtaggttcatgcagaggtatttttaggccatacgaagataggttatctgaagataaagtatgtaaatcccaggatgatgacccagagttgatcatttttgtgagattttcttctccttgtacaattcattctataaatattataggaggagagaatggcaagtctccaaatagagtgaatctctatataaatgatgaaaatttagacttttcaaccatttctgaccaagaacctgttcaaagcttagatttagttgaggattactgtggaactgttgactacaccttgaaagtatctagatttaagaatgtgaaccttttggccatgcattttccaagctcattcacgaatgatcagagttggatttattatattaggattgtaggtgaaagttcaggatatcaaagaaaagcagtacaagcggtgtatgaatcgaaaccaaatgtctctgatcataaatctaatattgaatcattaaatcactttagtctaatgtga

SEQ ID NO: 404 - DNA, 6078 bp, Cryptosporidium hominis
atggatttggacgttgaattttcagattcctccacggagggtgagtttgatactttggggaaatgtatatctactgaagatattagcccagaaattataagccgaaatcaaaaccaagcacaaactagtagctgctcaagaagtgggagagttcgtaagatgcgatattcaaatttttccaatattgacaatgaaagtgaattatctgatgaatctctttctgaattcggccaaacatctaagatgcaaaaaacacgggaacgatctaataggaataaaggaggtaaatcaaggagtcagtctcaaaagagtgaagaccttgactatgtgaatgaggaagatctatacgatggcgatgatgaagagtttatgagcgaggacttgaataataatgttgatgctaaaagaactaccgactctgatgatggtgatgaagatttttatgaggagccaactcagaagaaacggggcaggaagccttccaaaactaaggtatcgcaaacaagtggtgttaagagaactgtaagaagtagcagaaaagcagtaaattatttaagttttgatgactcagtttcatctgactcattatcacaagattctgacgaggtagaagtagatgcagaggtagagacagaggctggtatgtctgtttctgcccaacaaaatgtaagaactatagatagagtcatttcaagtagacagaatcctgaagatcctaatattacggaatataaaattaaatggatgggttattctcatctacataatacgtgggaatcagcagaatctttgataaatgaaggtgtttctggcttaagaaggttagaaaacttccaaaagaagatggctgaaatgcttcaaagacgtaaatttatgacggaagatgaaattgaacaggaagatattacatttgagatacaaagacagcttgattttgatgctttaattcctgagagaattgttgatgtttatagggaaaatgataattcaggagtagaccagaatagtgctgaagatcggacacaattatattactttgttaagtggcttagttgtccttatgatcaatgcacttgggaatcatatgaaacattagaagagcataaatttctttcattcattgactcattctatgctcaaatggaactcgtttccaaatttgacaagaactgtgattatgaaatgagatctcttgctttaacttctttcgagccttatctttcaactccattttatatgggaataaaagtgaaggatatgttaaatcagagcaaagatttggaaaagatggaaattgatgatccaatatctagtaatattcaagaaatgaagattgagtaccattctaacaatgaaaatgagcatggaaattcaattacagaagatgtgaaaatggaaattaaggattcccaaaagcttggaaagattaaagaagaagttgaaaatatagaggaatccaatgatgagcccttccaaccaagaactctcagagattatcagatttatggcttaaattggatgatttctaggttcaaaaagaatgttaacattcttttggccgatgaaatgggacttggaaaaacagttcagaccatatctgtagttgggcattgtctctatatggaaaagattgttgctcctttccttgttgttgtaccccaaagtaccagtgataattggctacgagaattcaaaaagtggttaccggatgcaaatgttgttttatatcacgggaatgcatacgctagagagctaataagatcttatgaactttccaaaattgaaatgaaggatgaagttgatgaaaatggaaactataacgagaatttagagtcaaaagatgaagttcacaattataatcagaaaggcatgcaaagctgcgcacgcgcgggaactggcggaaatggattttttaggcgttgtaggtcaagatcatccaaacaaacaaggaagagatatagatttgatatagtaataactaccccttcaatattgaacagtcaggttgattgtgattttcttcggcaaattgattggtatatgatgatagtggatgaggctcatcagttgaagaacagggacagtaagcgttttaaggagttgcatgaatttggaactatgtatagattattattaagtgggactccattgcacaataatttggaggagctttggagtcttttacattttttgaatccattaaggttccagaattatcaggaatttagactaagataccctgatatagagaatccaaatgtaattggaccagataaacaaagacaattggaagatctccagagtgaactacaagagtacgttttaaggagagtaaagaaggatgttgaaaagagtttgccaaataaagtggagaggattttaagagtagagctttcacctcaacaaacagatatgtataaatcaattctaactcgtaactatgatgaactgagtaagactacaggaggtacaaaaacttccctacagaatatatgtatggagcttaaaaaggtttgtaaccacccttttttgattcatagaccagagttggatccttctcaaggtatcactattgcgagtattcagcatcaactagtttatggatgcggcaaattatgcctacttgataaattactttcaaggctaagagagaaaggaagtagggtattgattttctcccagatggtaagaatgttgaacatcatatctgaatttctagttttaaggggatttaggcatcaacgtttagacggtacaatgggaaaagagctaagaaagaaggcaatggatcattttaactctccaaatagcgatgatttctgctttttgctttccacaaaagctggaggacttggaatcaatttaactactgctgacactgtaattatttatgattccgactggaacccacagaacgatttacaagcagaagcaagagctcatcgtataggccaaaaaaagcaagttcaaatttataggctagttacaaaagactcaattgaggagaacattcttgagagggcaaaaactaagatggttcttgacactttagtcgttcaaggacttaacaatattagtacaagcagttctcaaactcaagctagttcttctgctgccgcatccgttttagctatggcctcccaagctctttatcctaatggaaagaaacccgggtctggtggagcatctttcagccgtgatgaactcgccaaaattttaaaatttggtgcccagaaactatggagtaagggcacaaacaatgttcccgctcaaagccagtcaggctctgactcttcatgtggtcaatgtgctgatggacagtgtggggaaacatgcatgcaccgtgcagttaatgtggacggcactcagggcgtagaaaataaattaaaagaagatgaaagttcagcggatttatttgaagatgataagaggtttgcatctcaaatagatttagaccaagttttggctgatgctgaggagcatgtgcatgacactcaaggtcttgctgatgggcttttgcgttcgtttgcaaatattgcagattttaggtatgaggcgccaccattgataattgattccaatactggagctttggttccactaaatgagaagaagaaagaagataatgaggtagatttcgacagtaaggaattttgggaaaagacaataccagaggaggagagacttaagttgatagaaaaaaaccagcagaatacgataattacaggtcctcgtaagagtgctatgagagatggttctttaaagtatagggatgatggatatacatatgttggaggtgataattcaggatctgaggatggaaggacaggaagaataggtgatcaggggcttgaggctgatgagaattttggaacaaagggcaaaaagcaatcaaagaagaagactaaggaaaagagtgttaagaaatcaagcggaagtgggagttcaggaaagagcagggcttctagctcaagtggaggtagtaaaaagatggaggtgggtctgtctgagcaaattgaagatgttgaaatgaatttgggttctcaaaaagacttggataaaactccagaaagtttgggagaattagtacctaatagagaggagtacccacttcctgaacattcattgcaaagtagggaagactttgaagcattgatgttagaaataaccagttttccgcataaatataatcaagatgacgagcttttcccaagtgaaattaatataatctatagagatatttcaaatggtgtgaaatgtgttaaaaatggaaagagagcaaggagagattctcgagtactacatccaaagcgtagatttaagttatttaggtcgattttaaaatttggtgacccatatagaagattggatgatattattatagattctagattaaaaggtaaagtggagaaaggtactatattaaatgagtctcagataattgttgctttgtgttatgaaaaagctcaaaaggaactgtcatctgaaaatgttgtggctacatcaaaggaggagggtgagattaaggatgaagatgatgttcagaataataaatcaaataatgaagcaacgagtattttagagggtcagtcaactacagatagtacaataatgggaggaggtgtgcctttagaagttggctcaatggaggattttgctgaagaaaatgacattgaaaataataatcaagtttctaaaactgctttaaagaagaatttacttttgattggtagtcacagagcaaatgctttagagcttgttgaaagaattaagatgttatcttctcttgataaacttatgagagaatgcaatcctggtgtagaaaagccttggaagcttccaactggtcctttagctaggccagatagagaatcagttaaaagggatgaggataatgaaaatgaagatgatgttgatgatgaggatgaagatttggatgacgaggaggaaaaagaaaagtcgtttgaactttctaatgaaaacaacttggaagaaaaaaagatcgagccaacaaatactgagaatgaaaatgaaaatgaaaagcaatcatcacctaatggaaatgaatttgatggtaactatctgaagtttgaacttcctccagtattggttaaatcactcaggaccccttcctgggggattccttggacacttcaaacagatatagacatacttaaaggtatttatatttatggattttcaaactggacaatgatgtcaatggatgaaaatctgtctttatcttgtattaaaagaatcaagtttgataaattaaagcaaagaactttgagagtgatgaagcatttacattctgtaatggttattggcaagactgctcgtaagaagagaaagtttattccttcttctgatcaagaatataatgattttaataagaatgaaaattctagctctaagcgtggaaagaaggttgcaaaaaagtgtgaggatcagaacaaggatggaaccgatttatctggacaccttgttaatgataatagtaatggtgataataataaaggttctacaaaaagttcaaaaccattggttgttgggggtaagaaaggactaccggaatttgtgcttgaatgttccaatatggatgagaaagagttaagaaggcaagcaaggacttgttttaataatagtaatgtgaagccccaacttttggagatcaaaaagcttttccatcctagtaacaatatgacagactccgatgtcgttgcaagcctaaaagtcctgcttcctgttgttggggatgaaatcaatgagatccttaaacttgcaacaaatgagatatccagaaataaggtccacaattgtctttggtcttatgttgcaaaatgcactgtatttcaaccccatgatattgaaaagatttatcttagctggaaaggcattaatcctccagagactaatactgagactgtcacagaagttaatcctgatcctgttattgagcctgagcctgagcctaaacctgagaatgaacctaaacttgagcctgagcccaaacctgggaatgagccgggatctgaatcaaaatctgaacccgaacctagttgcagtgccccctactaa

SEQ ID NO: 405 - DNA, 300 bp, Cryptosporidium hominis
atgttactcccaaataaaaataactccgaagaaataaataataaccatatttctactactccaaatgataatttaattattaaagtttctaaccaacttagaaatttgcaaaacttaccatttgaatcaatttgtgctggagatcaaacaatcaattgtggggaaaatggcaaatgcatttctttaccaaatgttaataatcaaaagcaattcttatgtgtatgcagcgatggatttactggtccatcttgtgaaactggtaagtttattgataaattatttattctttcttttaattaa

SEQ ID NO: 406 - DNA, 2385 bp, Cryptosporidium hominis
atgaatatgatgaaaatacttattgctaccctgggaggagcaattctatttggatgtagcttctcaagggttgaagcaagaattcaaatgaaggcttatggtagtattgtttcaacagcctattattattccgatatttttattggacttccagaacctcagagacagagtgttattttggatacaggaagtaaccttcttgctttcagtagtactcaatgtcaacagtgtgggacacaccttgatgcatattatgacccttttaaaagtataacaaaaagggaagtcccatgccattcttattgcaaagtttgtgtgaataataaaaagcaatgcgcttatactattcattatttagaaggaagcagtttatcaggaagttactttgaggattttgttgcaatcagaaatgaaaaaggaattaattctgagccttcaccatatgttgttggattatcaaccatttttggtggaattactcatgaaactaatctattctttactcaagcagcttctggaattcttggattagcttatactgcaagttctcaagaaagggcaccattattccaaacatggacaaaaagatctaaatatgctaaagatgctattttatctttatgctttagttcagaaggtggtatgatttcttttggtggttataattctgaatattgggttttaggatccaatgataaatcatttaggtctacttctgaagctaatttgtttgaaagagcacttggatattcatttttatcaagttctagtaatagtcaatcacgttcgaattcaagaggaaataatttggattcaaaaattggttggactcctttatctattttgaatggaaattattatgttcaattaactaaagtaagtgtttatcaaactaaattaactttgcataaagattcatcatctggtaatacaaaacctattccacttgttattgatagtggtacaacattatcatatttccctgaacatatttttattcaaatattgaacgttattaatcaaagaattgcagaaactgaaaataagtcaacttttagaagtcttattgaagccggctctaaatttttggaatatactggtcttaaatcatcatcgtctcaaaatgaattggagttaggaattaaacaaatttcaattttccctggtgaagttcctggtgctgcattacttagaaaaagagtatatagaaggcttaataatattgaagatattgttaatacttttaattcaactgtacatcctgagaattttagtgatgaggatattgaatcaagtaacaatcagttaaataatagtaatgaagtttcaaatcattttaatcaaacaacaactagtactactacttctactattaacacattattctcttcacaagaatttgatattgattcttcagtatcaaggataatgcttgaaacatcaaaaggtgaaagatgttggaaattaagagatccaaatgaaatgtcacgtttcccaactattactttaggattcccaggtttaaaggttgaatgggaaccagctcaatatctttacaaaaaatacagaaatacttattgtttaggatttgattctgataaatcattcttagtacttggtgcatcattcttcattaataaggatgttattattgatgtaaaaaattcaagagcttcatttgtcaagtcgaattgtccccaaattgcacatgcaagaagaacttctacatctgagatgtctcaattattaaaagatgcatcatcatcatcgccagaatcaattatgaaatctgaagttgtagtatttgattcaaatacaaaacatataaatattgaaaatggtaatagtaataataataataataataataatagtcaaagtcttaatttaagttctggtacatctagtaaaaatccaccaaattatagacatagtgcagataatgatacaatttcagaatcgcattgggagccaaaaaacttgacttcgccatcctcactctcctcgtatttatctcaatcagctgtacaatatattggtgttacaaatcattcagttgattactataatcaaagtattaattatgaaaatttaggaaacaatgatatgctgatattatatttaaagcaacaattacatgatattgacgatattgctgataatactggtaatcctcaaattcaaaagaatcttcaggatgctaataattctccatcagattctaaaaatgagaatcaagatgctaattcggataataaagattcttcatcaagatatagtaattctcaaccaacaataatacattggttgattattttacttactgctttattttcatgttatttatttaatggtgtagatcagaaggatgccaagactgagtaa

SEQ ID NO: 407 - DNA, 1362 bp, Cryptosporidium hominis
atgaattctttaagcctttctcactcattaggaaagagttatttatttgagagatactccagatttgggatgagtgactctattattcaaagaaatttccaaaacccagtttctgtttataatgagcttttggctacagaattactaccaacaacagaaagtgacttttctgcaatggtcaaattgagagtaggatctcaatctatgggagtccaagaaagaagaaaattaggaagtaaaaagttgtatggcgatgaaaatgaatattctcgattaaattcatgtgaagtatttgatccatttgcaactgttcccttgagatcagtttctatggatccagcatggctatcatcaacaaatatgggaatgggtccaatctctagaaaaattccgaaaggaccattcaaaattttagatgctcctaacttacaagatgatttctatttgaatttggttgactggagctccacaaatttactagctgttggattaagttcgtcagtttatttatggagtgcatccacatgtaaagttaccaatttattaaatctccaagatcaagacactgttactagtgtatcatggacacaacaaggtaatcatctcgctgttggaactagacagggttctgttcaaatttgggatgtcgtagaacagaaaaaagtacgtactttaaatggacacagagcaagaatcggtgcaatggactggtgtgggccaatcttggcaacgggaggaagggatcatactgtattattaagggatgtaagagaacaggagcattggtgtagcagatggttggggcataaacaggaagtatgtggagttaaatggagcccaaatgaaatgcaattagctactgggggtaatgataataagttgcttatatggtcacaaggatatgatactcctgtgtgtcagttccaagaacacaatgctgctgttaaagcattatcttggaatccccatcagtctggactcttagcatcaggtggaggaactgctgacagacatattcgtatatggaatactgtaactaactcatgtgtaatggcagtagacactggttcacaagtatgtaatattgcttggagtgggaatgttaatgaattagtatctactcatgggtatagtttaaatcaggttatattatggaaatggccatctatgcagaaaattgcaactttaactggtcatacatacagagtcttatatttagcagtttctcctgatggccaaactattgtaactggagcgggagatgaaactttgagattttggcaaatatttccaacagggaggccaaaaggaccgaaaaatctagcggctttatcggtacctaatgcaccagctatgagataa

SEQ ID NO: 408 - DNA, 1875 bp, Cryptosporidium hominis
gatcctgagagtttttggagccaaatggctagaaaagaacttcgatggctaagagattttactaaagtaaggagttctggtacttgtcttcaagatagacttgcttggtttttgaatggaaagttaaatgtatgcgataattgcgtagatagatgggctgaaatacaaccaaatactactgcattaatttgggaaggagatgatccatcatctattagacatattagctatattgaactgtttaggaacgtttgtaaaatggccaatgttttgaaacgatttggtatcaaaaaaggtgattctgttggtatttatatgccgatgatacctgaaactatatatactatgttagcttgtgctagaataggagctgtgcatatggtagtttttgctggatttgcagctcagaatcttcttgagagacttgttaatgctagatgtaaaatagtagtaactgcagatcaaggatccagaggtaagaagattattaacttgaaagatgttgttgataaagctcttgaaaagattcctgagattaaaacatgcattgtttttagacatttgaatggacctattgaatttgtcaagggaagagattttgatggagaaactttaatgagatctgaaaaaccttattgtcctttagaagacatggatagtgaggatccactattttatttatatacctcaggtagtactggcactccaaaaggcgttcaacactctacagcaggatacttactttatgctgccgttacacaaaagtacttgttcaacattcatcctggcgatatttttggatgtgctggagatattggatggattactggccactcttacttggtatatgctcctctttgtaatggtataaccactttaatttttgagggagtaccgacttatcctgatgctgggagatactgggaaatggtggagagacacagaattactcatttttacgctgctccaactgcaatcagaactcttaaacgccttggagatgattttgttaaaaagcacgatagatcatcattgagagttctaggatcagttggagagcctattaatccctctgcatggagatggtaccattcagttgttggtgaagagagatgttctatagttgatacttattggcaaactgagacaggaggaattgttattgctccaattcctggctgttttgatactaaacctggttcagcaacatttcctttctttggtattgagcctgcgatacttgatcctgatacaggaaaagaaattgatggaccagggtctggagttctttgtataaaaaactcatggccaggtatgtttagaggaatttttggagctcattatcttcatgaagatctttatacaaaaccattccctggatactattttactggggatggtgttttaagagatcaggatggatatctttggattactggtagaattgacgatacaattaatgtttctggtcatagactaagctccaaggaaattgaagatgctcttaccaaccattttggaattgcagaagctgcagctattgcaattgatcatgatgtcaaaggtaatgctcttgtttgctttgtagttttaaaggattctggcaatagaacttttgacttgaataattcaagtcctcatccttttgagtatgaacttaggatgtgtgtcaggacccaaatcggccctgttgcaacacctgatcatattattattgttgagaatatccctaaaacaagatcaggaaaagttgtaagacgtcttcttagaaagattgctagtggttgcaatgactatggagatatttcaacggttgcaaatcctgagtgtattaaatccattgagtcatcctgggcacaataccttaagagatga

SEQ ID NO: 409 - DNA, 1032 bp, Cryptosporidium hominis
atggaaattctttctaaactactattttgtgctgtgaatatactttcaggtaaaatcctcgaatggctacttatcttgttggatgtagacaacgaaacgaagattaaaggaagtgttactttgagaagatttctcatttccacatggttacttaatccatttcctgttgtaattgcagctagaggaagtgctgatattattccatccattcttgtccttatcacaatatacttcttaatgaaggccaaatatgacagctttaataacaaaatcaatattattatttcagcattcttctttggtctttctgttcacttcaaactttatcctgttatatatggttttccctttatcttctttatcaatccaaactatctcaaaaaagacaggccactattctggtatatactcaaccttccaatcaagatatttactaatttgaatatagaccaactcatttttggattagtcagtttttctacaattgtttcattgatctcattcttctattatctatatggttgggaattcctttatgaaacttatttatatcatgcaatcagaaaagatcacaggcataatttttcagtctttttttatcttttttacctcacaatgtactcagtgaaagaagtcctcgcatccaattttgtatacaaggctcttccatatattgcttccatcccccaaatgtttttggttgcattatcaggaatttctcttgtgagagaaggtgaatgtattatggctattttttgtcagactgtcttatttgtggctttcaacaaagtttgcacatctcaatacttcttatggtggtttatactattccctcttgctctcagagtatatttgactaataatattgctcaactagacgaatctaaagggattattcactcagcaagtgcatcatttacccctattcttatttcactaggagtctggctaattactaaactttcatggttatattttgcatataacatcgaaatgcttggacaaccatactttttaagcgtaagtttttaa

SEQ ID NO: 410 - DNA, 1794 bp, Cryptosporidium hominis
atgcagggaatagaaatacttcaaaatagagggtatgattcatgtggaatgagtacaatagatgatcaaggagaattaataaccaccaaatactcatctaaagaatctggggattcaattgaaagacttaaaaacgattctgagctattacatggaaaccaccatattgggattgcacatacaagatgggctacgcatggagggaagaccgactttaatgctcatccacatcaagactataaaaaaagaattagtattgtacataatggtacaatagacaattattgttctttaaagtccgaattaatggaaaaaggaatcaaatttcaatcagaaacagatacagaggtaattgcaaacttgattggtagttatctagatgatggagaggattttcaaaatgctgttcaaaaggctctttctcgtttgcaaggaacttggggaattgctgttcttcacaaagactataaagatttaatgatacttgctagacatggatctcctttacttgttggagtacaatctggacatatttatattgcttcagaaacatcagctttagcaaattatacaaatcagtatgttgctttgcaagatggtgaaattgctttattatctcatgaaggtattaacaaattgattactccttcaagattattatctattgaccatgaaaaagttgagtcttctccttccccatatctccattggacactaaaagaaatttacgaccaaccacatgctttagcaaggtcattaaactttggaggtcggatttcaccctataataatatggtgaaacttggaggattggatcagagattagatgaattgaaaaatgttcaaaatatgattctgttaggatgtggtacaagttttcatgcagctctatttgctcagcttttgatggagcatatcagcggatttaatacagtaagtgctaaagatgcttctgagatttttgttactgggtttccacgcgaacatgctggagctatagctatttcacaaagtggggaaactgctgatactgttaaagccatcaatattgcagataaacttgggatccccaaaatatctgttgtaaatgttgtaggttctatgcttgctagaacaactggctgtggggtttatttgaacgctggaagggaagttgctgttgcttctaccaaggctttctccactcaagttcttgtattatcacttattgctgcttggtttgcccaaaatagggatagtgttatttcccaaagatgtcaggaattacttgaagcaattcacagagttccaatcagtgttggagtttcattacaagccaaagatcaatgcgaacaaattgctgaaatgattaaagataataactctatctttgttttaggtaaaggttatggctatcctgtagcacttgaaggtgctctcaaaattaaggaaatatcttatatacattctgaaggttactcagctggagctctaaaacatggaccttttgcattaattgataaggattctcaaacacctgttattttagtcattctttctgacgaaaatcaatctttaatgatgaatgttgcacaacaagttaaggctagaggagctagagttatttgtataacagatgatgaaaatttatgcaaagatattgattgtgaaaaagttttaattccttcaaatggtcctcttactgctttaaatgctgtgattccattacagcttatagcatattacttggctattaaaagaggtattaatccagataagcctagaggattggcaaaagctgtaactgtattttag

SEQ ID NO: 411 - DNA, 1916 bp, Cryptosporidium hominis
tgagacaaaacttatctagaacagaaaacgtagaaaaagattcttcaagcaattgtttgagctcttacaatgaatctcctagtataaaaggacaaaattcctctaattttgaagaaaaccaaactttcaacactaatggtttaataaaaaacagcaaatattcaagtaatgaaagaataatatcaccaaaaataaataatctaaaaaaccctgggaaaattgtcaccaaatatggccttggatctacaattacctctattttaattggacacggaattatggcagccaaaagaaatcagattttagaccttgtattttcttgtcctcttagagaaatagatccaattttgaaaaattttcaaagaaatgttctaggaataacactattgattctagttatttggattctaatcacttcatttgtgatcattttctcttccagaagtagattggacatatttggttttattccaaagtattcaagctcggaacctgacagacaagcttttacaatggcagaatggaaattttacaaacttgcaagtgtcctacgtttcatatcttttctatattgtatcgttattttcatttcaattggaagagttagacacttattatttacattgtttttcctttttctaggcttatttttaaaactcaaccaattcctactactcaaagaaaatgatattgtagatatcacatcagctttcatcagagaggaaatgagtgataatgataatacagcactaaacaaagatttagaggataatgatgatgttaatgaccagtctctagggatgggaaatccaatgcctgcaggaggaaacgaggaaactagacaagagggaatacatcttggaactattggagaagaaatctcagcaagtcattcaagtgcaacattcactgattcaagaaacacttttcaaagtgatattgtcaaaagagaacatattacagctgaacaatatgccttaactactttatttataggaatttgttcctttgtcattgcaatttcctcaaacttacaacgatttctcttctggaatttcagagagttttatcgctttcatgaatcctattactttacagttaatcatacttatattgcaatttcaacagaaattattctaatcttaaatacttggtcactaacattcaatattcttaaagctccgggactaatgatttttatcctaactcaacgaatacaagttcttcgttactttttacttgcatatcctgatattaatcagaatatattcaactctttaaaacgaaacaatattggattcataaataaggagggttcccctaattcttctccagctatgaatatgcacttaccagtttcaaaaggagcagtttttgtccctccaggaaggtttgatgttgtactttgtcaatgggtacgtgttaggtatgcaatcatgaagagaatgcacagaagatttactgttgcatccaaaccttataatgcactttattttggtattggattcattatatttgtttttctttttaataaaaataatattggacataattttcatcttggaatattgaattacctcttattcgatgagtttggcttcacccttctaactgtatttgcttcctactccattactcttattgtaattgtctggcttgcatgcacatctaatcagatttccgagtttcagcattggaggcttttttgggatgcattttcattcatgcctccttgctctgctcagcaggtcgttttacaacatataaagcttacacaagatcttgatgatgaggataaaagagttgatctttggagtattcctatcacaaattttgttagaaatgtactacttttatgtatagtagtagtttgggtacatatatcaatcattgggatctttcatattttaatatga

SEQ ID NO: 412 - DNA, 735 bp, Cryptosporidium hominis
atgatccaggaaggagatggaaataatggacaagggttttactatgagccaaaagactatgattctgtcttaatttggctacatggaaagggtgataatgcaaatagctatttggattttatccacactgctcaaaactatcctgagctgaagaaaactaaaattattcttccaactgctgatattattacttttaaacgattcggcttttctgacaatgcatggtttgatatggaagatttaagaccgtatgcactcgaagatttggacgatataaataacagtgtttctagaataactcgattaatttctcttgaaatagaaaaaggaattgatcctaaaaagatttcactcggaggattttcacaaggatcagctatagtatttctaatttctatggcatctagaaagtatacattaggttcctgtatagtcgtaggaggttggcttccacttaccgagagaggatttaaagaaggtaaagaaagtaaaatagcaactgaagagctcacttttgatgtcagagaatctgtaaaagagcatgtggattttattgttttacatggagaagctgatcctgtggtgctttatcaatggtctttgatgaataaagactttgtacttgaatttattaaacctaaaaagtttatttataaatcttatcctggagttgttcatactataactagtcaaatgatggttgatatttttaatttcttgtctaaaagaaactaa

SEQ ID NO: 413 - DNA, 1866 bp, Cryptosporidium hominis
caaatgaagaatcaagctgagaaactggcaacacatcactttaagataatggacccagaaaccaaagatctggatcatgatagtctaaaatactggtgtaaactctttaaagtcaatttacttttccctccttgcaaatctgataatataagaagagtaggtaataatgacaccattaattcaaacattcttttggaaaagaatccagaaatagtagaaataatgaaagatcggaaaaacaatcaatacgtaaataatcaaaaaataagtcccttaagctattttgagaacattactggaactaaaagaaactctctacctttggacgtggaatttataagtgagtcagatggggagggtatggaggaaattgaacaaggatatgaccatgccccagaagtagaagaaaaaaaaggggaagaaaaggaggaagagggagaagaggaagaggaagaggaagatgaagaagaagaagaagaagaagaagaagaagaagaagaagaagaggaaaatgatgaaaaagatattaaaggagccgatgatatagatcaagttaatggaaaccattacaatgagcgagagaacaaaatggttgatgttaatgaatatcattcagctgaagaaattttcgatcaagaaatggatgaaaagacagaatctgataaagagggaaatataaaggagagggaagccaatgaaagctcagaggaagaaaccaacttgaaaatgagaatagaggcacacaaaaggcttaaagcaataagaaagaaaagaatgaagctcaagagaaaaatgatggagagatacggacacttatttgaaaatgaagcagaggaaagcgatgatgatgggatcaaaatattaaggagagggattgggggagattatagtgatgacgatgatgatgatgatgacatagactgggatgagctaagcggtttttctgattttattgatgataacaattacgaaaatggggagctcgatggagatgcaattcaggctcacttgaaacatatgaaggaaatagaagaaaaacaatatagacaattgttcaccttggagggtattaaggaaagaaaaaataaagtatatgggtttgctgctggtcaggatgatgggattgaaggtgaaactagattggagaagaagaagaacgaattactctttaattctgccttttttgatgatgatgttattagtgagttttggacagatgaagaggagttggacgattatgaggaagaaattgatgagagaaatttgacggaaatgcttggattgaactatgaagaatggcaaaatagcttaccaaaaaaaacgaattcttctgatgaatcgttgaatgaacaaagaaaactcaaatataacattttaaaagaatctctaattaaagaagcttctggaagtatcaatattctcaaacaaagactcaaatccattcaaactaagcttagtatagaagaaaatattagttcaaaagaaaagaatcaactacaaacaaaatatattgaatgtatggaaaaactaaaaaagcttttacattcaattcattctgcctgcaacaaatgtatctacgaaaatccacagttcttcgaccatattgatatatatgagtacattcagaaacgtgaagaatccagaaataaaaaaaaattcaaggctaaaaacactgttgaagacaaaatcaaacaaaaatgcagatatcaaaacaagtatctcagagaaaatgtaaatccgttaaataagatcggaaagacaggatctgactcagaagatgatataattaatcgaaaaagggtgcaaaagaacggaaagaatatagtaaatgttaaaggagggaggtttaaaatctcaaagaagtaa

SEQ ID NO: 414 - DNA, 2439 bp, Cryptosporidium hominis
atgatctcgggaaagcttcaagtatttattttggggtttttcctcattttcttgggtgttcattcagagagttcattattgtctgagggtacggcatcattaagcaaatatgatttgagtgaacattccaaggataatagtgcggattctagtatttctcctttatttcctgaacgaactatgatcgatggttctttgaatgatgcacctattgaaaaggcatctgattcttcaatattggagtcatccaaaagtgcaagttctaaaaatgtaccttctttcgttgatgcctcaaaaagtgatcagtctgtcttggaggagaaatctggtctttttactgagaatttggatgaaaagcaggagggaagcgcaagccccactttcccagcaccttctgagtattcagtgtccaaagtatcagagggttcaatctcaccattagttgagaaatcaaaatctagtgctgattacgaaaaattattggatgagcatgatgaaaaattacagtcagagtacagtccaaagaaccaggaagaatcaataatgcttttggaggatccgaattacacagtagaagatgcgttagctcttttgagaaagcaaagaaagatacatgaaagtgctaaaggaaaaaacagaaaatcttctgagagctttgccagcgattatgaatcagaaagaattgaatctcctacattgaaatacgatgaaacttctagaagtggggaaaaagaacagtcaatatcttctgccccggaagaccaacaatatgatgagttgacattcatcccaaaagagttaagtctgccaagagagaatgagagagaaagatcagctaccataccaattacatcaaattttgaaccttcaaagaaagacactactgtagaagaatctagaagtagcttggataaatcgctcaaagaaccagaacccctcactgaggaagaatcagaaggaattgctttggaaaaatccgaagaagttgaagattcagagctatataaagctccattttcagagaaatcgagatctagcaagtctgttgaagatgaaatgagtaatctttctgagaattctgtatctgagaaagaaaaaactgccctagttccatctgaaaatacaatttctgcaggtaatcaggttagtcaagaagagcaatcatctgatgaagaagtgaaagatcaagttgaacctcagattgttaccattccttcatctgttagcagtattgacaatgaaggagtaaaagaatctcaacattctgaaaataatgaagcttcaacatctcctaagttagaaagtcctattattggtaccgaatctgaatcagaaattgaaaatgaaactgatgactcacaacagcctttaaatgaagctgataaaagttctgatccaagagactcaggttctgaaattgttcctgagcaagaagaagaaaacttatttaatagatctcttcttgaagaaaaggaaccatctggaggagctgatgagttttctcatgaagaatttatggaaagaacacaaagcagtccgcaattagataactctccattattacacgccgagacattcagaaatgaggattctgctaatcaacttagaggtatacttcttcctcttgttgatatgttccaagtctctattggatgtgctgccccatgtccatatcaaagatacttcatccagacagatagaatactcaagcgtatcgccaagatcgaagctaaaactattgaaatgtcaaatattatgaagaaagcaagggaagttacaataaaggaagtttctgatatatttaaattccacaatacagctgccaagagaagagctcttttattcgttcaaaaataccttaaatctattaagcttttgcacttcaaggttgattcagcaaagaagattgtgttccttgcattaaaggtcagaattattttgcaacttcttccaagcaaatatagtagagattacagcagtgaggagcttgagagaattagctcccaaattgatcttgcagttaatgaatacaataaccttaggagtgctcttggaagcaaaactatcaaatatggccttcttaaatacctctctttgaatgattatgattcaaggattaaatctattagaagcattttagaaagtgaactatcaggttatctttcaaagttacctacattccaaaagtttgtatccagacacaggaagctcgcatttacattacatgatatgatgaataaggcaggataccccgtaaaaaagaggttctttatggtagacagaaaaggtctttcgaaggaacatctaaaattatataagaagaaggttaacgaggatagcaaacaagcaaaaaacagactaggaaaggaataccaaaaattcaaaagttctcaagaaaataaatggaagaattttactaaaaaagtcaattcaggttaa

SEQ ID NO: 415 - DNA, 999 bp, Cryptosporidium hominis
atgtatgccaatatgaagactccagataacaatgagcctcatcccctttcagaggtggatttagaggatcaaagaatcccagacgaatataaagatccagagtttatagaaaaatctcttgaaaaactagcaatgaatataacagatatatataagaaagtatctgatgacttcaaaatacctgctagtgatatagatacaataaaagattcttatcacgaatttctggaaacagtggagatttggtctgctattgcaggagaagcactaatatttacaggtaaccagattaaaggtttttctctatcaaaaaaaaacaagctatcttatttctactcaagagaagagttttatgtttatcaggcaatcttcaactattcaattagcttaatagcaagtttggattcatttttaaatttaagaaggaatttagaggagattagagagctgttaagaaagagttttagtataattttgccctataagcccattaaggacttgtcagaacgatttgacaataatctgagagaatttaagaataattataaccataatgtaagatttttctgcagaaacattacaataaatgaatgtcttggaaccatgaaggatgacttttataggagaaatgagaaattcacaaactttattgctagaaatggcagtttgaaaagggcagttagtcaaatcctagagttgttcgattttaaggtttctgctaaagaccacctttcaacaaatggaggaactagagatgatgttaatagataccatgctataaagggctatctctctaaccaagtacctatatttagcaaaaaatttaataagaaactcttaaaagagcaattgaatatagacagagtgcatgcaaccagtgctattaaagcgttgcttgacaaacgagggttatcttcaaacacttcaagctgtgggaatgtaaggtgggaatcaaaaaacaaaaaacaaaaacttataaccaaaaaactcaaaatttaa

SEQ ID NO: 416 - DNA, 573 bp, Cryptosporidium hominis
atgttttcgtgctttaggtcatgcagtgaatcaccattctgtcttctttttgggtttaaggaggagaaatcaaacaactatgggacagatagatcacagagagcactgagctctaagatgtcagaagcctccgatgtgaaggaaaagaagaagaaacaaaaacaactattcaataggagaacagctgatgaaattctcactatttgcagatcttgggaaaactacatacatcctagagcaaaggatttctggaagtcatcggaacaagtatatgaaattttatctaatatagcgagtaacattgaccgtagtgacgatccaatcacaagcggagaggaacaatgtgtaagatggcatggagaattagaagcagaggatggggcaccagttatcaggatactcaagcctggggaaactgatgaatgccaaacctatgtaaatagaatattggcatttctatacgcggacgatgagagttttctggaactacagaaaaagccgcctgttgcattcaagaatgtctgcgaggatcctatttgtattaatttgacacatatctctttagaagaataa

SEQ ID NO: 417 - DNA, 2730 bp, Cryptosporidium hominis
atgaagttttctaagtactctaaggtttctcttggtttgttagccggtgcatttgcatcagctatttccgtatttagtcatccagtatacatttcagaatgggctactgaaattagaaacattgcagctaataaaaatctcaaaatcgaagcccctgaacaactcgaacaagtactcctcagtggaattaactttgatagctttgatgcctcttgctctgcattgttacagaaagttatcaaagagataggttttgattcaacacccttaaatttggaatccgctttggacatctgtgctgtaatcaacccatggaattccatggaatgtagtggtattactggagttacagcttcatatgctagatctcttcaagagtttgttcgcattagagatagctcaaaaggtgatttaagagctgcttgtttggttgcatccgcaattgcaccgggaagaccattcgctcctttaattaaaggctctattaaatcaaagtgccaagaagtttgctcaggacctctttcaaagtcaatctccgcaattgacccatcattctgtagtttgtccattgacttgtgcaattcagttgacttctccctatataccgctttcagttccttcaatgagagagaacttggtattgcagtcgcagtgtcagtactgttatctgagggaagtgccggacttagaacatctttccgtgagggatgcggattcgtccacttccttaagagtaagggagcattaccaactgcatcatcggaggtctcagagtcagacttattctcaaatatttcagagttctatagatctaagctcattgaatctggtttgttgccttcaaccgactctaatttaagatcaggcgatacagtcttcttaaaagttttgaactctcaggttgctaaagcaataatatctatccttgaggcacaaatcccaaagaagcaggctgatgttagaccaaagagacctacaatcgccagcacccatatcacctcttctgaggtttcaccattatctgaagcttcagattcattatccactgaagtcaagatgcagtctttcactgaggctggacagacttccacctcatcagttttagaatcatggtttgaaaccattaagcaatcaatcaagaagggtacaaaggacatcgatagagagttcgacaatgcccttaataaagcaattgcgcgtttcgactcctcttcagtgtatttctcatgtgtctctgaattgaagagattcagtttgggttctcatagaagaataactgaagcatgccgcaaaattgatccattctcccacgttaagtgccagaagcttagccactttgaacttatggccatggttaaactgagagaggaactcgagaagaacggaaaagatattgttgttgatctaagggacttgtgcgctgttgcttccaagatgtctatggaatcttttcttagaacaagagatgaggagctttctagcatgtgcattagaacacttaagaagagtagtttcaagaacaagtatcccatttctgaaagaggaattaagaaggcatgtatcaagtttgattacttcagaacctcttcttgtggcaatttagtgtctaactacccagaaaaagtcaacttcgtcttatctcttgcaaataacatgtttgacaagagaactgacaaggagcgtctacagattattagagaatctgaattcagcactccttcttatgctgatatttgtaattcaattgaaagaattccggttgaaactgttgaagagtgcatattcgagctcagagactcactatctaagttcaaatcaattgcatctttactcaacattgaaggcgcatgcattgcttcattagaagaaattccatttggtcgttacccaccttacccaccttacccaggtagtcagtttgaccgctatccaccttcaatttacccggatcgcttacaccgtcctgtgttcccaaagaagtctgttagaagattctataaagatatcgagttccaaccacaattcccctctcaacactggttcagaacagaactcccagacattttagaacgacgtgcacctttcttagaacaggaatattctgaatccagaaagggttactacaaggatcaagaaggcaagcccgtatatcatgatggttacagatacagacttaatggcaattggtacgtcaagcttggcgaaatgtggtatatcgacaattcttcctctttggattttgtcagaatttcaccaggtgacccaagatacagtaattacccactttctttctatgagaaatctccatctgatcctaagggcccattaaggagaaaatcttttgcaacatacctttctccacattcatcttattactatcccagaactagtagttatctctatacactctatggtaagcatccaggccaaggatattatcctacagatgcttatcaaccgttctacagtaaatgcgataagtgccacaattggatcccatatggacacacacatgttcatggcccagaaacaaagaaaacgtctctttctcgcttcgaagagaagctcccatcaacgagagataaatcttcgcctagcggtggttaccttacggttaccaatgaatatgatgaagatggaagacttcttgttaagacagtggagaaaactgcgttacctgaggcaaatccacctcaaggcaagcgcgaggtcggtgtacaagttggataa

SEQ ID NO: 418 - DNA, 2991 bp, Cryptosporidium hominis
atgatggaaacaaagatgaacaacttagaaatagaaaattgtaaatcaaatgaaagcaaaagtttagaatgtgaaacgagtaaagagaatccgccagctccgatgaaaattgtaatcccaaagtctatgatcatttttgtttcagcagcaacagcaatttccatgtttgtattagcatttcatgtaattccaactttagttgtgaacaaatacttactttttgaacaaaaagggcttccactaaggactgatcatagaattttttcattcatgaagcaatctataaatactaagccaaataactttcgaggaaataatgactcaccttcaaatgcattagaattagaatttctaaaatatggaagctcagaaagcattcaatcgttcagtaagaatagaaaattatcggaggcgattctaaacaatacaaactctagtttatatactcatgaaaataatactacatatatttcaggtagcactaccctaaattttaattctgatattaattctgtgcctaatttaggagcaacagaaacaaactctaaatttaattcaaattatgtgtgccataaattcgtttctatcagtaaaagtgactcttctactattgaaaatgaatttactcataacactaaatgcaagactcactacattctagcaagatctcttccaagggaattgaataaattagatttggcaactataaatgcttttaaccatttaagtgaggcatctcagtcggttaaaatgatcgctgaaatccttgataataaaaagaaagatgagggactattgatcttaatggcatcaaaaatgaattacgaaccagattggaaatcatctttggaacgtattcatacaaattgggaatttaatacatatgtttcacaaattattctaacttcctggacgatctctaagtcatttttccctggacgtcattatactcctgcattggattttggtttcatgattttaaatattccacaagatagtgacgatgaattaacttctatgaagataagagcttcactggatgttgtaaagtcatttatttctaatttaaatcttataattgatggaactctatcaaagttattttcaggcccaaactatagtattttaacagagaatagtttgactcaggatttatttacaaattggacctatttcgatcattcatttagcttcttaagtaactattttaataaaaatcagtcaatgttactggaggattatctgacatcagcagcattagatgtttctaggttaattgaacaattaccattgacaattgtagattcggtcattttagcaagggataacttggataatttatataagagaaacccaacagagctacgctatactaatccgaatgagactcaagttgtaattataccaccagtagaacgaaagaaaatcgcaaaatataattatgaagaaaagtttagaagaatatgcatctatcaggcacatactgaacagaggtctattcttagatcgacgccatccagagcttcaatggctgagtatgcaagatatcatgggtattcttacttcttatttgatggatcattttatgactctatcccaaaaccagtgattacagattggtctaaacaaggtttttatatgaaaatattttcaggtcttaagttactcttttggaatttagataaaattggggatatttttggaaaaattataaatgatccagaaactaatctcatgtcagaaaagttctactcagagtttttggaaagtgtaatgcctaactacttaaatgttgattgggatgcacgccataatgcaaggattggaagtactggcaaaattaactcaaaaggatcatctggaaaggagggaattcaaataactccttcaaatattaaggctaatgtatgtgactatatagtttggtttgatttagatatcgtaattacaaataagttcttttctattgaaagaatattagattcaaatactccagaatacaataacaagccacctgaaatatttaggaatatatacaaggatgtgggagaagtcgttttctttgctgcaagagattctgaatggagaaatagaaattcttttgtcaacagtggcttcttcattttgtctaggtcaagagcttctttacaaactttattccatacccttgcattggaccctgttaagtctcaagaaatcgtgctaaatggacgattttggcctgaacaatctactatggctcatgcaacacttagtatattcaaccattcattctcatctccaaatcagacttacccattcctagacactaaaattgacactgttaatgatattaagaaaaaatttgttggttccacccccgttatgcttaccgcctacttggaagaaatagatagatatgcacattctgtattagcaagccaaaggtttgctaatggttttattcatatgtccccagatgcttatggagatggtccatggcatcctggcgacttattcgttcatgctgccggacagtatagtccattcagagacaatgtattatctggactgctttactctatcaacactgttggttttacttatgatgaaattaactactttaaaaactactgctataactctttagattttgtttacagaggtttggatagacttattgaagaactgacttatgaatttatcgagtttgagaaagcaaggctaagtgatccaactaaacaattagaaaacattaacaatgttgatttgacttttcactttgtgaaaaaacttatggctgtaaaaactaggcctagttcgaaagatgttctcactcacccaaaccaaacgagctatgagaaaattcactttttaagatgtaactattcattatctatggctgctaaatggtctattgctgaagcatttgtgttgggtggtatttctgtatttggtattgctattattgcttttatttttaaatttgcaaggttttattctattaagtga

SEQ ID NO: 419 - DNA, 312 bp, Cryptosporidium hominis
atgaaaattttttatttaactaaaattttatttttgattcttataacaagcgtatttgtaaagtctgaaaactttagatcggcacaagaactagaggaaaacacttctaattctgaagaagaaaaccaaaattcttcaaaaaacttcgtttcaaatactataaatgattattataatcacgtttcaagtgcagctacaaatgaattcaacgaggagacccaaaaactcaaaaacagattcaaaggtatgattcagtctgcaggggaaagtattaaaaactttatcacagataaagtaaatttaattcaataa

SEQ ID NO: 420 - DNA, 1590 bp, Cryptosporidium hominis
atggccgatattatatttaagagcaatgaatcgattagaagtttaaattcgaagaattcaaatagagaagattttattgaaaatgataacatgatagatgaaagtgccttgcttgttgatttgaaacagaaagaagaatcttttactgaattcgaatgtaagaggttcagttttatttccaaagaagagaaatccggaaaattattattaaaaacttgtcaaccatgtcagaacttggaagtgagtaacactaccgataagactgcactagaattaccctcagtttatcttagggactatatgtatttgaaacttaataatggaattaaagttatcttaattagtgatgcgatagatatggaaatgggaataggaattcaatatccagtaagcttaattgaaggatgtaatgatcttggcggagtaagacttatttcaaatgttctgattagaggccttaaggattatttcagagaggtagcacttattaaatcatattttttacacaactcaagggtttcaataaatttttcgacaaatgagaatatattacaaatattgaaatatttttcagaagtttttgttaattttgaaatatccattgaaaaatttgtagaagcgtataaattaacaattgatcaatttaaatcaagacaagatgctcaatatactcgaatagttggcaaattgtttgaaattgctcatccaaatagttattttaagaactcatgccatacttttaatgaccaagtactagaaaatgaatatgctggatatgagcttgttcaacttaggaagaagattataaatgctattagaaataacttttcatcgaatctattatctgtaataattacaaccccaaatgctttaaattgttcgcaattattagtttcaaagggtttaagttctatgagaaatttgaatctgagtatcccaaacacatttgataatgaaaaatatgcaattcctttttctacagataatttgattggtaaaaggcttacattcccaagtttttttcctataaagcaatttttcttttgtttctttattgaagaaagtttagaggcaaatataaaagaaattgaaggagctttagcagaaatgttcattcatggtggaaactcattattatctaatttaaaaaatagaggcttggttagaaatatggacattaaaatactcttggcagaaagttccccaatattatcttttcgtgtagaagttgaagatacagaaaagaataatccagcagagattttaagtataattcgtcaggtagtctatacttttacagaatcgcccttattggagagttatgttatgaattattttaaaattcacgatgtaaagttttcaaagatatttacaacatcatcaacaaatgatgtcatttttaaattgtttaatattattaatacatctccattagaagaaattaataacatgattaatccaaaactacttttggaatcagtagaaacagttctgagctatacaacttttgaccacttcttcttaattaaaagttgtgattttgcttcggaggagcgaacgaccaaaacagtcgagaatgaacagatttaa

SEQ ID NO: 421 - DNA, 2772 bp, Cryptosporidium hominis
atgaaaagcacaaggattaagacatttatttttgctatttatttttttgctttgttctttaataatatttttcaaatcaaagcagcagaagcacctgatggcaattcttcagatgatttaagtgaagaacatgtaactcatatagcagaaacaagcaatcctatttatgctctagtcgattctttggttgtaaactattatgaaagaaacctttttgcggagtttattcttgtagagttatcaatttacatatcattattacttaaattgcttgctttagttaatccagaagatgtagaagatgggtatttgcctttgaaacacttttttgttagctttcttttgaattcaacgtttgagagaaggaaaaatatggtttctaaagaaaaaattgaaaaattagagcaatcatcaagaggtaagtatgtcgagttacgagataaattatcgcagcaaatgcatgggaattcggtcaaactttttgatacagcattaaccaataaagatgaaatacaagaaaatattgactttctgttgaatatgcttcttgttttatttgaatatggaatagaacgttttttaggaagcgcagctatcacacttttttctttttttgacagctttagtcttgtgttaactgatttttctaacattttttcaagttcaccaaggaaagaaatttcatccagatttatttccaataaagactttgtcagttatgttgatttcgatttttgctacaatagggttgagtcaggttcattgcaagaaaacgtagttaattcagctcaagagcaatttactaatcaaattattgatagttctagtcctaacattgaggaattatgcaaaattaaagagatattgttgacagctttagatctcttaaaaacaggtttatttatagtatttatttttgaaaggagtactttctatggatttctttcacaaattcatgataaagaattaaaaataaagaaagagttggaaaagataaattgtgatggattatcagaacaaaaatatttagaacttaaagtagacgcaagaaatttatttgacattggtggagttcactctaataatttggttattgaatgctatgatgaatgtttgccaaaagaaacattaacgagcagtatggcgagcgtttacaaatctttacttagtgctatgttagtattaaggaattatgagactactacttttggtgtagattttttaaaacttttatttgaaattgtattaacattatttgaggaatacacaaaaaaatgtgcacaacaaatcaaaaaaattagatctttggcagaagtagaagtacaaaatttgcaaataagtacagtgaaagaaaaatttaagatgaggaaagaactttataaacaatcattaatggttcaagctgaaattgaaagaaaagagaataaagaaagaaaacttagagaaaagaaggtaaaagaagaaaaggaaaggctagaaagagaacgtttaagtgaagcgaataaaaacaaagagaagaaaccgcggaaaaagaaaactaaacccaaaaaagtatttcctattgtagaagatagcacaaccgatacttcaaaggaggatgtaggagaagcacaaacaagtgctagttcatatgcatctcaagaagtttcatccaaagctaaagagcaagtatgcaggccaaaacttaatagaaaggaagaaaaactcagaaaacttttaaaagaagagcagaagtctttacaaagggaagaagtaaagaaaactattctagaacaaaaatgtagtaatatttcgacaagaaagaggaaacaaggcgaaagaaagattaagaatgagaatagaagagaaaaagaagagagagaaagacttgaagagaaagaaagagaaatggagagagagagagaaaaacgggaaaggatgaagcatagcaattacatgtatacactattaaattcaataagtgcgattgagggattatttgctgaagctgaaaaaagtagagctagcatatcgggcttaatttcattcgtttttcaaataatttctgaagaaaaagttgaaaccgaagaagcaagcagtgaaaaaggtatttcagacatgtttgcttcactttcagtgtcagaaaccgttactccacaacaacaagctagtggtttatctagaactgggatggagttaggagcaagaccaaaaactagtgttggaggccccaaacctcgttctagttctagttctagttctagttcaaagtcaagcgcaaggcgaaggtcaaaatcaagaagtaggagcagaagaagtagtagaagcagggcaaggagcagtagaagcagggcgaggagcagtagaagcagaggaaggagtagaagcagagataaatcttcagaagtcagagcattaacatttgatggatttgaagtacctgattctatattttcaagtactgtacatgaagacccaaataaaagctcaaaattcttaaaatatttccaagttgtaaatgggttggacagtcaagattcaagtgttttcgaacaaaaatatttggaatatgaacaacaattaattgatttatctgtaattactcaagattcacttgaagatgaaatactcaattcattagaattgtgtggcaatttaattcaaactttgcatacagttgttattccacttgtacgtggtaaagaattaatgtatcttcaattattggaaagagcatttgttaaattttttataaagtttttaatatttcttcaacaaaaaaaagatgaatag

SEQ ID NO: 422 - DNA, 252 bp, Cryptosporidium hominis
atgaaacctcttgctggtcaatcagagaaacctttaaaatctcgaactcctctcaactcttttgtattcccgcaagcaagtaatgttcaggtatttaacattatgtcaagtgattcacagactttattagttaacgtccttccatcaaagtcacttacagaacgtgttgatattgctaaatctgttattattacgagtgttccagaaaacgaaaacaaaaataatacaagtttgaatgttactaaaacttga

SEQ ID NO: 423 - DNA, 561 bp, Cryptosporidium hominis
atgcgttttcttattttaccactaactattattgctcaacagctttatagcaaccacactatacattataaaggggactcggggttagatttattcattatcgaagatcagattattaaagcaggagaaactggttttgttaggactggtattaagattgctgcttatgatgattatgatgaaccttctagttatactattgtcggaagatcttctatttccaaaagtccacttagattggctgttcctggcgggatatttgatgctggttttagaggcgaattaaagattcctttcgacaatattaaggattatgattatgaattaaaagtcgggcaaagatacgtctctcttactggttatgatggtaaacctgtctcatttagcttagttgatcaacttgatgaaactgatagaggtgagcgtggactagggtctacgggattaggtccagtcgtattaggtaacactggagaagaaactagatcaaaatctccaaatcaagctcttgtaaatggaaccagaacctcattgaggtcgaattgttcccttatctactaa

SEQ ID NO: 424 - DNA, 474 bp, Cryptosporidium hominis
tttaatttattatcaattttcaaagatgataatgctaatataaaaaataatgaacaattagatggacaaaaggattgggaaaaggatttaaagaaagatcaggagaagaaagctgatgagaagcaaaaagaccagaaggaaggggagaaggaggttgaaaagaatgctaaaaagaaccaaaaaaaagagtctgaaaataaggatcaagataatgacaataaaaagagggagaaggaggaggctgataaagctaaaactaaggaggacgtaaaaaaagaggtcaaaaagaaggatcagaaggaaggccagaaaaaagaagccaacataaaggatcaagaaaaagattcgaagaaagaaactaaaataaaggatcaagaaaaggatccaaagaaagatcaaaaaaaggatccgaagaaagaaaccaaaataaaggatcaagaaaaggatcaaaagaaagatcaagaaaaggatccg

SEQ ID NO: 425 - DNA, 1251 bp, Cryptosporidium hominis
atgcttaggattttatatattcgtatttctagaactagcgattctaaaaataactcaaaaattcaatcaaaaggttcagcaagcaaaaagaagctctttgaagaagtatttgtcaacttattcagctggaaatttttaacctttatcagaatttggtcattatctatttctaatatatcacagctttacccactacaatatccacttgttactattattacttccgttaccaaacttaaattaaattctattccatttctcccattcacacttcaaaatttagagatacttactgaaatctcaatttctaacaaagtatttatcccactttcagaaatgttatttgatgctcattcaactattgaaagaggagtcaagctaacattcaataaatcatctcaaaataacttaaaaacacaaaccatgatcacaacttcaagtaaacctttcatgccagaatttgaaataaaaattggaaactcaatttcaaagtcacatcaggtttatgattctttatttgaattctgggcccatattgtcacattatatatctccagcttatttaaacatccatcttttccggaattcttatttggaattataccaaaccttaagaaacttcaaaaacataatagtagacactggaatgataatattaacagaataattaaggaaatcattaaaaaggctgaaactcattctgaatatattaaaaacatcagaaccactattttaactaatcaagaattcctttcgtcagtttacaaccaaaatactaccaataataataagaacaataatctcatttctccttactccagtaaattgtattgtgattatgtttataattctctcaattctaaaatcaactctgaagaatttcttcaactagaaaactatattatttatatcaaaaatcaaagaactgaattaattaagggaaagatcaaattatcgtctatgaaagcttttgataattctgataactcaaactcaaacaactatcatgactttactttagaagatgaacaagaagatttagaatttaagatacttctccaacaattacaaaaagctggaaaatccatcaatgatatcaagaatctaggaccaagacagctcaagaagctaaaaaaatcaatcagaagtcaaatgaatgacataaaggagtcaacacctcttattagtaatcaaactaaacccaataaaagatcctcaatcatcagagaaaaccaagaaagtaaaaataac

SEQ ID NO: 426 - DNA, 303 bp, Cryptosporidium hominis
atgtcaaatattttagagaattcaaatggaagtattgagtcccaaatttccatgctaaaagaaaggttagtagcttatgcttgtaagcttgcaccagttccaaagattggcaagatagatacttcaaagaacggaaaatgtactttaaaagctggttctgattcattgaaaaaggtaagttttttctttgagaatttaatttggggtatttattttaattgtttgaattcaagaaatgtgatgtatgtgattccaaatgcagttctttgttttattgggaaaattttgaatattatccagaaa

SEQ ID NO: 427 - DNA, 68 bp, Cryptosporidium hominis
ttaatatttctccacccccaaaacagttacagaaatacacacgtattaagccaatgcctttttgctaa

SEQ ID NO: 428 - DNA, 113 bp, Cryptosporidium hominis
caaatcttatttgtgatttagccaaatatctaaatctggatgatgaggacgacaataatgatgacaccaatgacgataactctaatgatgataacttcaatgattataacttc

SEQ ID NO: 429 - DNA, 133 bp, Cryptosporidium hominis
agggaggaaaggaaaagggaggaaaggaaaaggagaaggaaaaaggagggaaggagaaggaaaaggaaaaggagaaggaaaagggaggaaaggaaaactaaggagaaagaaaagaagctattattgtgactga

SEQ ID NO: 430 - DNA, 2034 bp, Cryptosporidium hominis
atgacatcatctgaaggtccagctattggtattgatttaggtaccacatactcatgtgttggtgtatggagaaacgatactgtagatattgttccaaacgatcaaggtaaccgtacaacaccatcatatgtagcatttactgaaactgagcgtcttattggtgatgcagcaaagaatcaagttgctagaaatccagaaaacacagtttttgatgctaaacgtcttattggtagaaagtttgatgatcaggcagtacaaagtgatatgactcactggccatttaaagtagttagaggtccaaaggataagccaatcatcagtgtaaactacttaggtgaaaagaaggaattccatgctgaagaaatttctgctatggttttacaaaagatgaaggaaatctctgaagcatacttgggtcgccaaattaagaatgctgtagttactgttccagcttatttcaatgactcacaacgtcaagcaacaaaggatgcaggtgcaattgctggtttgaatgtaatgagaatcattaacgagccaactgcagctgctattgcttatggtcttgataagaaaggaactggcgagagaaatgtattgatcttcgatttaggtggtggtacttttgatgtatcattattaactattgaagatggtatttttgaagttaaagctaccgctggtgatactcacttgggtggtgaagattttgataacagactcgtggaattctgtgtacaagatttcaagagaaagaatagaggtatggatttaacttcaaatgctagagctttaagaagactcagaactcaatgtgagcgtgcaaagagaactttgtcatcttctactcaagctacaattgagttagattcactctatgagggtattgattattcagttgccatcagtagagccagattcgaagaactctgcgctgattacttccgtgcaactttagctccagttgagaaagtactcaaggatgctggtatggacaagagatctgtacatgatgttgtattggttggtggttctacacgtattccaaaggttcaggccttgattcaggaattctttaacggtaaagagccatgcaaagcaatcaatccagatgaagctgttgcttatggtgctgctgtacaagctgctatcttaaatggtgagcaatcctctgccgtacaggatctcttattattggatgttgctccattatcactcggtttagaaactgctggtggtgttatgaccaagcttattgaacgtaatacaactatcccagcaaagaagacacaagtcttcactacttatgctgataaccagagcggtgtcttgatccaagtttatgagggtgagagagccatgactaaggataaccatctccttggaaagttccatcttgatggtattccaccagcaccaagaggtgtaccacaaattgaagtcacttttgatattgatgctaatggtatcttgaatgtatctgctgttgataaaagcactggtaagagcagcaagatcactattactaacgataagggtagattatcaaaggacgatattgaacgtatggttaatgatgctgagaaatacaagggtgaggatgagcaaaacagactcaagattgaggctaagaactctttggagaactacctctataacatgagaaacaccatccaagaaccaaaggttaaggaaaagctttctcaatctgaaattgatgaggctgagaagaagatcaaggatgctcttgactggctcgagcacaaccaaactgctgaaaaggacgagtttgaacatcaacaaaaggaaattgaaactcatatgaatccactcatgatgaagatctactctgctgagggtggtatgccaggtggaatgccaggtggtatgccaggcggtatgccaggcggtatgccaggtggaatgccaggtggaatgccaggtggaatgccaggtggaatgccaggcggtatgccaggtggtatgccaggtggtatgccaggatctaatggtccaactgttgaagaggtcgactaa

SEQ ID NO: 431 - DNA, 1512 bp, Cryptosporidium hominis
atgagaattttgtttattttactactgtttctttctatcaagacaaacttaatccatttttgtttagcaggtaatttcttagatgtgaataacgcagccaatggcggtgaacatgaaattctttattccaattttttgaaagaatttggaaatgattataataaacaagtggaagaaatatcacgagtggaattaaatagatttaaaggacagacatatttggattatacaggctctgggttgtaccaaaaatcgcaattggaagagatttatacagatttcattaacaatgcatatggaaatgctcatagtagaaatccttcagctgaacttactaatagaaaattatcagaagctagagaacttttgtttagcttctttaatataagtaaagatacccatacaatcatatttactggaggagcaactggtgggttaaaacttataggtgaagattttccatggacaaaacaaagtaaattttactatactagagtaaatcataattcagtattaggaataagagaatatgctgtttcaaaaggagctgaatttcgtgcattatcttttaatgatattgaaaaaatattagctcaaagagaaaaggattataaagaaaaaaaggatggaaaaagtgaaaatttatgtttatttgcatttccaggtaaagataacttttctggagaaaagtacccactaaaatggataaaacaggttcaaaaatatggattatcagatgattgtgattggaaggttattttagatgctgcagcaatggtacctactgaaaaattagatatttcagaaaattctgctgattttgttgttgtttctttttataaaatgtttggataccctactggacttggtgcattaatttcaaaaactgatcaagttaataaatttaataaactctattttggaggtggaactgttgttatggcttcttgtgattctagatggtgtaaaatgcatgaaaatcctagtgcaaaatttgaagacggtaccgtttcttttttaagtattgtatcacttaaatatggtttaaataagcttcaatctattggtatggataaaattaataaacatgtttcatctttgacattatttacttttaatcttttatctcaattaagacacttttctggtggtagtgttgtacatttttatggaagatttgcttctcctccaactggaggtattattaatttcaatctacttaaacctgatggaacttttgttcattattttaaagttgaacagatggcatcagatagtaatattcatttaagaactggatgtttttgtaatcctggagcatgtcaagattatttaggccttactcttgaagaaattcaaattactagtgaagttaagaatagttgtagtgatccggcagcaggattagctggtaaacctcttgggtcaattaggatcagttttggatatttgtcaacgtttaatgatgttttggctatttatgactttattaaaacaaattttgtacactaa

SEQ ID NO: 432 - DNA, 1497 bp, Cryptosporidium hominis
atgagggaattgtcaataatttctttcaatgtaaatggtttaatatcattcacaaaaagaagaggttacacagaatcaattttttctaaattacttgataacatatgcgtaaacgatgaagttaccaatgctaatctaaatgtggagagcccagacataatatgccttcaagaatgtaaaatgagctttggagatgatttaaacaactcaataggatgtcctggaaattatgaatcatatttttcacttgctgaaaataataaaagatatagcggagttgctacttattcttcaaaaaaaactatggtaattgaggcggcaaaggggttttcttggctagaatcaaatccatgtcaatttgacataaaccaaatgattcaaacagaaaaattgcaagaaattgaatccaatatttctaaaattaaagataaatatgggatatctatatctgaaatagatggagaaggtagatgtgtaattactgatcataaacaattcgtattgctaaatttatatgttcctttactaagaagcaaagctgaagaaaaggaagaaaaggaaaaagaagaagttgtgttaaaagaaattcaaaatcaaaatgaaacacaaattgaactatcagaaactgttgatcctgaaagatttaaatatagacttgcattccaggaatatcttaatttattattacatgtacttaaaaatgcatgcaaaagaaatgtcattttggcgggcgactttaacattatattggaaaaaattgattgttatgatgattgtggaatacttgacaattgcaaattggcgccatgtgtgttaaaaaacactaaggaaatccttgaaacttcttcctttgctaaagcatatatgcatatgagaaggatgaatattgagatgattaaaggatattgtttggttgatgcatatagacattattatccaagaactaataacaaatacacatgttggagccaaatgaatcagtctagaattagaaatcaaggaactagaatagatttatttctcgtttcaaaaggattaatatcagaatctataaaatgtgagatacttgatcacatatatggttctgatcactgtcctatattactaattttaaagactggggaatttgaatctttgtataataatgaaaaaaggaagccccctagcatatgttctaagtacttgcctcaatgtaagcaaagacaaagtacaattagtcagtttctgactttaagtaaaattgaaggtcaaattaataaaaccattaaaaaccatgattttaagatgaataataaaatttctttaaatcatccccaatgtaaacatggaatcccctgtgtaaagaagaaggtaacaaagtcaggtgtaaataaaggaagactatattggagttgtccaaaatctgaccaacaaaaatgtaatacattctcttggattgaagagacaaattctgattgcaaaactaatcacgatttaaaaaattttgtaattagataa

SEQ ID NO: 433 - DNA, 1500 bp, Cryptosporidium hominis
atgtctggagataagaagctttatgtcctgtttgaaagtgcagcaggttatttattatgtattatagataattgggaagaaattggtcaagtaactgagtcagttattgaagtatgtgcagatcctatgagatttggccaagttgctcaattctttgcattctttccctttcaaacagcagaaatggcattagaaaatatgaaagaaattcaaaatggcaatacaactgaagaacttaagacttttttaatacaaaatttaccaaaaaaggtaaagaaatataatttaggtgttggagatgcatcccttggtaaaacattatctgatcagggataccctgttgtcattgataagaatattaatgaattattaagaggtattagaattcattttacaagaattgttaaatcttttgattcatctattggagatttacataaattccaagttggtctaggtcacagttttagtagaaataagttacaatttgatcctaataaacaagataaatcaattgtacagtctattgctttaattgataggcttgataaagacattaatttattttcaatgagatgtagagaatggtattcatggcattttccagaattagctaaaattattacagatactgagaaattcttaaaagttgccgttttaattggtgataaagacaaatttgaggataatgaagaaactagaaagaaaatctcaaaaattgttgatgatcctagtttagaagaagacattttttcatctattcttattagtatgggtcaggatattacagataatgatatgaatatgattaagaatcttgcaaaacaattaatagcattatataagcaaagatcgcatttaatcgattatcttaataatagattatataatgttgctccaaatctacagagtttattgggggatacattagctgcaagattaattgctcattctggtagtttagttaatttagcaaaaagtccagcatccacaattcaagtattaggtgctgaaaaggcattatttagagctttaaaaagtaagggtaatactcctaagtatggcttacttttccaatctacttatattggtaaagcatcacaaaagaataaaggtagaatatccagatacctagcaaataaatgttcaatagcagctagaatagataatttctcaacagttaataataatatatttggcgagaaacttaaacaacaggttgaagatcgtcttaaatatttatccgagggtatatctccaccaaaaaatattgatattatgagagaagctatatctgagaatcaggatattttaaagaatacaatttcaaaccaattagattcagataagaagaagaagaagaagagaaagagtcatgaaagcattcaaaatgaacaggatgaaggtgatcaacaagaacaaatgagggacaatgatgaatcatctgaaaagaagaagaagaagaaaagaaagagttctggtaaaggtgatgatgaataa

SEQ ID NO: 434 - DNA, 4608 bp, Cryptosporidium hominis
atgtcaagctttttccagttgttatggctttcacaatggagtagatatatcactaatggaaattcaaatcctggatatcctttgctttttcatggagactcacctttaatttggatatatagattaagagaatcattttcaaaaaacagaaaccatttctggcttccattattgcaagtatatggaagatcaattgtaaatgttctatttttgaagcttattttcttattttcttgtagtctatgctcgatagttttcactcaaacagtctcaaataaccaaagtattggagccttgaattcctgtatatttcttgtctcagcttatttaataaggtcagtaattgatgcacatgcaaggctttaccttgcaagagtgacaatgaggcttgaatcaggcctgacggggatcatcttttatagacttttatctggacgtggatccgaaaagtcaagagagcaaaagcaaaatgaaaacgctgtaagtgttgatttgcatgagatttctagtaagattcggcttgaaattgagggagatgaagattcatcatcgaatcgtaatggattcaaagcttttaaaaaatttttagactcttcaagaggaagaaatgagcttgagaaaataacctatagtaaatcaattagataccttcttgcagatccagatgtattcagtatgttagttggcgatatatcagcagtacagctatttttgaattccttgatagactgtattcttcttccagtgaatatttggataacctggaagttactttccaagcaggttggactcatagcagctttgcccggtattataacatttttgttcttctttatttcaagctttggattccaagtacttggaactatatataaggcaccatttatggagtatagagatcaaagactatcggtctgccatgatattcttgggattcttcgagttattagaataatgggagctgaagatctggcttttgataaaattatgaaaagtagaaatattgaaacagcattaaaccgtaagcgccttgttaggactcagtttggaagctttcttgaataccatactcaaagagccactcaattgattgtattcattattttctacctttttattggaacatctttgaacctaccagcagctcttgcttcaatacatatactccattcccttgcatcaccacttaggggaattcctgtaacttttattgaaggcctcatttcacttttgagaattcgtacttttatttcttctcatcccgataattattttgaatatttttcagaagatgatgatactagtactgattgtgaatttactggagcaattgacttttcaaatttaaagaattcagttcaagaggaagtaagcaaatattccaataaagttatgtgttttaagcagttttgcaagtcttctgatggtatttctatagatgaccagtacttaaataattcaaataattccttcatttatgaatgccaccgaattattaagtcacacctgtgcaatccagagaattctctcaatactctaggaaaatgtgttattttcactggatcgtcaggatgtggcaaaacctccgtcattaactcaattcttgaatgcaaagataatgacctttgttacgcttactcaagccaaacatcttggattcctcaaggcactgtcagatctgcaatattatttggaaaaccctggaatgaagaactctacatgctggttacaggcatttgtcaattgcaacatgattttcaatcttggaaggatggtgatctcagggtaattgatgaaggaggcacatcccttagtggaggacaaaaaacaagagtagccctagcgaggtgcctctaccatcagagtgaagctgccattttcctatttgatgatatttttctcaaccttgacccaaatgtaggctccaaaatattttccaggctctttgggcataaaggtttccttaatagcccatactctagaaccattctctcaattgaccttactactctcttatatttcattaacaatcaaccagagaatagcttaaccaacatccaaattgtgcaccttaacaatcatgatatattcttttcaggctctcttatagaataccaaacacttattaataataattctagaccaaacatcaacaattcattagaagttaataacttcgtatgcaataatgatgtggaaaaccaaaatatttcgccggtatgcgcacagggcaaagattgcatgcaagaaaatttgcatgaatccacatgcaactcggatttggcgccaaacaatttaaataaaatgaatttagagtttcacaataaattagaatcaaagttaacagacaattctaatgatattaatgaggagctagatgtaatacaccgcattagctaccagatatcagctcttcagagtaaaaatataagtatagaaagctttcattcaattaccggaacaacacccacgtcatctggaacatgtaccagtccatcaactttgaataataaggtttcattaacactaacttcttctaaaatattttataaacctgtaagcctgccagcggacttggtcttggaaactgagataagcccagggaaaagaaatactcttgaaatttattggtggtatttttctctagttggaagaacatggtgcatagtgttactcatttcttgtatattaaaatcagtgtttgaccgttactctgacacatttatcagttataatgattccagtaataatccaaattttatttggatttacacatttattgtacttttccaaggatttctttgcgctctactttttattggagaagctattggaggtgtgaaggcttccaatattgcccataacagcttaattcgtcagattctcttttctccattttggctttctgattcaaccccaacttcatatctaatgaacagactcagcacagatatgttggtcatggacgagagtcctttgaagaaaattgcctcagtaattgttccatcaattgatttcttgattcaaatctcaatattaagctatgcagtaccgtattcattaccaataatattaatggttacctttatgacgtataaaattgtttgtcaacgatatatttctacttatattagggcacagaaagttgctctttccgttctttctccaatgtatggcctcttttctcagttaattaatggcattgtggttattcatgcctttaatgctcagagacatctccttaaccagttcttaattcagattgaacatcttcaacgaataaagctacttcaacatattgcaagccaatgggctgctattaggcttcagttatatactcttcctttaatcatttttattctatttataccggttgaaagtaattggaggtatcttgctttactttactctttattgatatcagatactacgggcgtaattacatacaaatttgcgtccatggaaagagatatgtgtagtagtgaaaggattttttctttaatatcaaatggatcaaaaccaggtaccgaagtcaatagtgataacaagagcttcaatggaagctcaaaaaccaccattgaaaactctaccaaatcatccactaataacaatagagaagatgattttaacaatcgaactttttatactaataatacactaattcagaatccaaatctaaatcaggctaccactggtaatagtaattatacttataggagatttgattcagtagagattgaggaaattaatgatgatttattctttgtcatagattatagatttaatagctttggcaaaaagaaaatcgttttggaaaatgaaaatatgagtcataagcttttgagtgggatctttaagcccgattcaaagcgtacaggagtcaagattatggatctagaagttggatatagtgatattatgggtacatcttatagtgtagttttggatggtataaatattaacgttcaaccttttgagaagattggtattgtaggaagaacaggatctggaaagtctaccttaatcctggccctccttggtctggttaagtataccaaaggccaaattcttctagacgaaacaccaatttccatgctctctatcaaagaaagaaggaggattattggagttcttccccaaatacctctgcttctaaaaggttggactatcagagactttctggatccgtacgaggaacttactgatggtgaaattttgctaggattggataaatgtttacttgaccctatttttattaatgaagtgaaaaataatctttattctaatgcaggatctttatcaggatcacaactcaggtacctttctatagctaagctggtaatacactcaagacaatatagaatggttctaattgatgagcctcctccgaacacaaatggagatcagggactacaacaaagcataagtagaattctagttactcactttaaacattgtaacatttttatcgttgctcatcatgcagagtctattaaagattgtgacaatatatggattctagctcagcaaaacattgtcaagtcaatccaccctaaaagtatccccacacaaaacgaacttgctcagattttaacaagctatgaataa

SEQ ID NO: 435 - DNA, 4758 bp, Cryptosporidium hominis
atgagtttcaggtcatatttgacaaaattgtggaattcttctgcttttggtttcattaatccatatcttcttcatattaataaaccaagaattaattctattaatgatctcccagaattatttgaaaatgataaacttgattattgggttagtaaattatcttcagctatagaagatgaagaaaagagatcaatatatagaaatgaaagattttgtatttatagacctcttattaaaacactctggagaccaacacttgaagctcttttactcagattatgtttcgatatattggtcattctatcatctatttttttatcatatttttcaacctcttcttcaactattaatgcaatcatctcttcattatatatgtttttaactgtattattcaaatcattctttgactgtcattcaagaataattgtgtctagactttgtgttcgaattgaaggttcacttatatggattgcacttgatcgagttattagacataaagaaatgtatccagaattacctttatctactacttttatgatagaatcttcaaaaaaaccttcatcttgtagaaaatctcttctattaagacaaaatgaagtaaaattttctaatagtaatgctgcaaatgaatcatcaaatatatttaatttaataattggtgatgctgctgctattgaaatattttttggtgtatttgtggatttattatcattaccaatcaaattaattatgtcatggtatgtattatcaaaagtacttggaagttcttcagctttaccaactttattatctttttgtattatgtttggattaagtttcttatttgaaattattggtgcatttaataaagaaccttttatggttaatagagataaaagaattgatagatgtcatgaaattcttagtgatatgagatttgttagacttactggtttagaagatgttgctatctctagagttactaaatctagagaagaagaactttattggaataaaagaagatttatatatagtcgaattgctgcttttattgattatcatttaaaagtttattcacaatatatactctttattttatcaactttttatttaatatattattctgatgataaaagtaattttgcatatacaggtgcttcttcacttcaaatactcatgcaactttcatccaaaattagaagtcttccaacgaatattattgaaggtattgtttctattcaaagatatgaaaatttcattgcaaaacatccaattgaaagaagaaagtactccagtgataataataggtcaaaattcaataagaataataatattaataataatagtagtattaatcactttagacttaatgattccattaaaatgaattataattatgataataataatattaataataaccataataataatagtaatgataataataataataataataataatggaaataataaattctccaatttaaataatggaatttcatcttcaaatatatcttcatcaatatctgaatttgccatagtttcagtatcatcttctgtttcaaaacacataaacatatcagaaacaacttctcttattggaagagaatcttatggtagaatagatgatgaagatgaagaagacgatgatgaagaatcatcacatttaccaggtatatataatacaaatatgaattctgatttttcaaataataattttcctttaaatttaatggttttaattgaaaatggtgtatttacttggaataataaaccatataatgattcttacacaaaatcaactttaagaaatataaatatatcattaaaattaagagaatgtattttccttgtaggagaaccaggctgtggaaaatcttctcttattaaagcaatacttaatgaaattagaccatcagcatcaaatatttatgttagaccaagagaaacaaattccattatatcttattcaccacaacttccatggattcctagtggtagtattagatcagcaattttacttggaagagaatggaatcgtgaaaaatatgaactaattgttgattgctgccaacttaaagaagacttttcatcttggcaacgtggtgatcttagagttgtagatgaaggtggatgttcattaagtggtggacaaagagctagaatttctttagctagagctttatattctcttccaataagatattcagccttttctatgaacaagttttatatagattctgaaaatcctcaacaatttgagtctttactttatttatttgatgatgtatttgtcagtgttgatccaaaagttggattccaaatatttaatcgattatttggaccaaatggacttttattaacagtttcttctattgttacaataagtattgatagccttcatcattatatggcaaatattcagcatttatataataatgaaaagaatttgattgataatatgaatagtaattccctttcttgttcaaatgagcagaatttatcaacaacacccaagtcatgctcaaattcatcaccaatcgataataactcatcattttatgaatctttgaattacagtggattcaaatttaatgtttgtgtattaaacgatggtaaagtagaatggagtggatcttattctgattatcttaaagaatcgagaaatatattactagatcaagaattggttggagatgatcttgttccaaatacaccatattttaaaggtattgaattagtatctttaaatttaaatgatgattcaaataatactgataaccaatttactgagcttttaagttccagagaaggtgaagaatttaagggtcagaataataatataaggagcagattttcattttcatcttattattggtactttaaattgattggaccaaaatggatgattgtttttactttaggatgtgtaataaaagttattattgataaaattcttgagctgttatatgtaagcagatcaagtcagattcaaatttcagaatcatatctttatagattctgttttaatgctactttggcagtattaattgaaagtattataagtttaattatatatattggtgaagctattggtggtattgaagctgcaaaaaaatctcatgaaatctttcttaataagattgtatatgcaccattttggtttttttatatcaattcagttggtaagattttaagtagattcagttctgatatgcttgcaattgataactgtacaataagaagagttacagcagtaattttaccattaatttcactattattcaatatttcatatgtttcatttatagttccacttactttaccgtttgaggttattttaataattttcatactgagatatattggggataggcttttattgacatatagagatgcacaaagatgcgcattattagctctttcaccattatgtagtatattttcagaatgcttaagtggaggagcaatcatcagagcatttgatgctgaaagagtttatttggataaatgtgcaagttttgttgaaaagcttcaaagagcaagatttcttcaacattgtgcatgccaatgggcgggcttgcgcatgcagcttttaacagctcctttaacattaatagtatcaataattggtataatatccccatcatataaagcaattttggctttgcctttaacttatacaataagctttgctgaaaatattaatgagataatttttagattaataagtttagagaaggatatgtgttcagttggacgtatttatgaatacgtacatttacttgatgaagataataaagctcatccacaaacaatattagaagactcagcaatacctgatacaagacaaggtatcttaatatcagatttggaagtgagatatcgtcgtccagattataaagtaaatgaattaagagcttcatcatcgaaaattcaagatgaagttcaatcttgttcagatttaaataagatttattatccaccaactttaaaaaatattaatgaatttgcaggcccaaatgatcatatcggaatagtgggtagatcaggaagtggaaaatcgacttttattatggcactttttggatttataccaacaacaaaaggaaatatatacttggatggagtacctataaaccaaatgccatcttcgaccaaaagaaagattgttggagttcttcctcaagttcctttgattttaaaaggttggacagttcgtgattttctagatccagagggtcagagatcttcagaagatttatgggaagctttacgtatttgttgcttatctggtacaatacggtcattaccaggtggaaaaatgttggatactgttttagttccagatacaaatataacaacttcaacaactgtagaaaataataaaaggaaaaaaaatgatttaaatagtgatgattgccatgattctataacgagtctggttgcaagatatttatcagattctcaacttagatatttgtcattggcaagacttgtagtaaatgcaagagattatagattaattcttgttgatgagccacctccagatacttttgaggatcaaacaagtgcgagatcttatgtgccagtacatgaattattaagaacatactttccacattgtactgtttttgttgttgcacatcatgcagcttcgctacagaattgcaattcaatttgggtacttggtaatggtactattgaaacggtaatacatccaaaaggtatagttagccagaaatatctcgctgggttattaaagaataactga

SEQ ID NO: 436 - DNA, 717 bp, Cryptosporidium hominis
aataaaacattcattcatgaagatgtatatgaaattcacaacgatgtttcttctttatatcatgataatcatcagctctcctcaagaacagtattaaaacaaatcaaccaatcaaaacaggtccgatttaatagctctcctcctgaagtttttgagtatgaggcattagatcccgaaaacttcttatatgacaacaattatcatgaaataaactttaatgttaaaggccaaggaatttcaggtaatgattcttatgatttctttgaaatagaagatcgatctggagtttatgagaatgaaacatctacgaatggaaaaaatttattaactttaccaattcctaatagaagagaactattcgaactcgaaaattatccaagtgacttgaatcaaaataacttacaaacattaggatcacttagagttgaagatattctttcaattgacggaaaatttatccaaaaaacaacattatccgatacaaattatgatacgaatagttcaaatgcagatcctgtgttttcagaacatgttgataaatggatcaatcttaaggatattaagcttgaaattgacaaaatttccattaataaagaacccagtaatagttttaacgatattattgcttccaagaatcatccgacaaataatgaccaattgaataatcctgacttcgttgatttgcaatctacaacagaatctttgagttttctataa

SEQ ID NO: 437 - DNA, 208 bp, Cryptosporidium hominis
atgcatcaattaagcacaatacaaccagatgttgtaatttcaactccaggaagactttgtgaacattataatcaattagtaatatcacaagatcaacaggaaatacctgaattatttagaaatattcactttatcattgtagatgaagttgatagattattatctcaaccttataatgactggctatctattgtgaataatatttcaa

SEQ ID NO: 438 - DNA, 339 bp, Cryptosporidium hominis
atgggtatgaaatacgttgcagcttacttactttgcgtttcatctggaaaggaacaaccaacagcttctgatatcaagaaggttttggaatctgtaggtatcgaatatgaccaatctatcattgatgtcttgatctccaatatgagtggaaaactcagccatgaggtcatagcctctggtctatccaagctccaatctgttccaactggtggtgttgcagtttctggtggtgcagcagcaacatctggtggtgcagcacaagattctgccccagctgaaaagaagaaggaagaagaggaggaagaagaaggtgacctaggtttctcattgtttgactaa

SEQ ID NO: 439 - DNA, 369 bp, Cryptosporidium hominis
atgatgaaagtttacaatatcaaggatgaaaatgttgataatagtttttgttttctttcctctgaatttgaatcatatctaaattcttgtcaaagctccaattcaataataatcaaaggttgtaataaactacttcgaaaaattatccactgtttatgtgaccattactgtataattagtaggtcaatatcgacaattggtaataataataataataataataaaagaaatcatgaaaagactatgattttatctcttccaaaatcatctaatattattactcttccaaaagccaaaataaccactttattgaaaataaatcagcattattcaaagaagcaatttaactccatatcaaattggtattag

SEQ ID NO: 440 - DNA, 513 bp, Cryptosporidium hominis
atgagtaacaaggaaaaaaaacaaatatctaataaaaacactgcaaataaaaaaaatgcaagtaaatcatcaaaaaatgcaaaagataaagttgataaggaaacggaattagctaataaagaaattgatttgaagaatattaagaataaaatcaaaagagcagaacttgccaatcaacttaaacgagagaaaaagttggaaaaaagtaaacgaaggagagaaaatagagaaagagagaaaagaggggaggaagtagttaaaggaatacctagaacaatagaaaatacacgtgaaattgatgaaacttttgttcatgatccattaaatgataaagaattgcataaagaaatggaaaatgatgaattttcggattatttttccagaaaaagatcacccaaattacttatcacaactaataatagagctagtaagcatatgtacaactttcttaaggaaattgtttcaatcattcctaattgcgatttctacaaaagaaatggatttaatattaaa

SEQ ID NO: 441 - DNA, 396 bp, Cryptosporidium hominis
atgaataactttacagtcagagtacgtcaatttttaaacaatcctctcttagccagaaagcagtttgttgttgatgttattcatccatcattagggggagtcagcaaatctgacttgaaagctaaattggctaagttatacaaggtccaagatgcaaactgtattgtattatttggtttcaagactgcctttggtggtggaagatcctccggattctgtgtaatatataataacatcagtgccttgaagaagtttgaacacagatatcgtcaagtcagaatgggtattgctgagaaggtcacagcaactggtcgtaagggtagaaaagaaacaaagaatagaagaaagaaggttagaggtaccgagaaggctaagatatctggtggaaaaaagtaa

SEQ ID NO: 442 - DNA, 159 bp, Cryptosporidium hominis
atgaagcagatttcttttaatagaaagaagagacaactagaattccaagagaaccagttgaatcccttactagaagagttaaagataattcggagagagaataatagcctgataaagtctttaattaagaagattaaaaaagacaagggaataaactga

SEQ ID NO: 443 - DNA, 366 bp, Cryptosporidium hominis
  misc_feature (284)..(284): n is a, c, g, or t
atgatggatgataatagaaaaatagggcttggatgctgtggccttggaatgattttgatcattttaggagttttattgttcttcgataaagcactgttaactattggaaattttacttttgttgcagggttaacattagttttaggcctaagcaaagttacaagattcttcttaaagcctgacaaacttaaaggaacattattttattttgggggtttatttgtgattatgtggaaaagtacaattattggatttattttacaaatgtttgggtttgttttatntttttcaacagtttctaccaaacattggtttctatataaagctttctccactaagttttattctagagcttccaggaattaa

SEQ ID NO: 444 - DNA, 954 bp, Cryptosporidium hominis
atgttttgcggattaatcattaagccaggtcaaaaagttaagttggattcaacacaaggagaaattttgcatttaagtcaagcatgtttatctgagccaaaggataatggaagagtttatgttcaggcaatagataatggtaatgcatataccatttgttcattacaaaaaggtactattgaacacgcaaatttagatttattcctttctacatcagcagaaattgaactttctgttattggaaagaatgaagtacatatttctggtttctatgaaccagaaatggaggaagactttgatgatgatgatgctttaatgggtatgtctgatgaagaagaagatgaagaagaagaagaagaagaagaagagcccgaattagagaactctaagattgataacaagaagagtctcaagagaaaattaccatctaaatctgacgaatccactgaagaggagattgatgatgaagaaattgacagtgatgaagctgatgatttagacttagacgaacttattcaggataatgatgaagatgatgatgaagatggcgatgaagatagtgatgaagatgatgaagatgatgaagatgatgaagatgacttagatgatttagatgatgatgaagaggaggaggaagaagaagaagaaccagttaaagcaccatctacaaagaataagaacaagcaatcatcaacctctcaaaagactaaatcttcagattctcaaccaccttcaaaaaagagtcgtttagaatcaaagtcacaaagcaagccagatcaactttatgaagagtcaattatcgatttcttaaagaagaatggcagaacgaacatggctatgattggaaataagattaagagaccagagggtgtttctaaaaagttaggatctttcattgctgaaagaacagacctctttaaggtagagaataatatgatttctcttgttaagtga

SEQ ID NO: 445 - DNA, 1251 bp, Cryptosporidium hominis
atgtgcttaagacaacatcttcgttgtagttcattaaaagtgaccatttttggcgcaggaagctttggatcagcaattagctgtgttgtagggtataatactgaaaggactttaatatttaacagtgaagtaaaactttggctatatgatgaacaacttgaatcaggagagtacctagctgatgttattaatagagatcatgttaatgtcaaatatttaccagattttaagctacctaataatgtcagagctgttactgatttaaaagaagcatgtgaagattgcaatctaatgatatttgtcattccaagccaatttatacgctctgtggcatcccaaattagaaagctagatattgacttttctagagctgttagagctgtatcattaacaaaaggttttcttgttgagaatggacatccatttctaattagtaaaattattgaagaagaattgggaatcgattgttgtgttctttcaggagcaaatgtagcttcaggattagcagctaaggagtttggtgaggcaactttagcttgctctgattatgatgatgcttatatttggcaatacttatttgatactccttggtttaaaatagattgtgttcctgatgttatttgtactgagctttttggaggattaaaaaatattattgcattacttgtaggtatgatacaaggtttaggatgtggtacaaatactgttgcagctgttatgagattaggagtacttgaaatgattctatatggaagtattttctttaatattagaagttctattatgactagagttttcttcgaatcatgtggtattgctgacctagtcaccacttgtttaggtggaagaaatgttaggggaggcaaagcttttacattatcaaatggtcagaaaccctgggaagaaattgaagctgaagtaacaggaggtcagcatcttgctgggcttgtaactcttaaggaaattaatgaaactcttgaagttttattgattgagaagtctattgatgtagataagcatttcccgctttttagaagctgctttaagatcgcatatactggtactcctcccagatcattgattgatattctaggaaggaatgaactgagagagcttaggttcgttccatctggactcctttccctaattgacgatagtccaaaccatggagaagtcatgcaaagatcttcctccagacaagttggctctcttattttatctaaaacacaaagctgtatgcaatatgaataa

SEQ ID NO: 446 - DNA, 1437 bp, Cryptosporidium hominis
atggcggatactagttctagggttaaaacatcatcatcaagtgttacagcaatgtccagtatagaaaatagaaggaggaagaatgtgacaattagaaagccaataattcttggtacctatgcatttatgctttcaattgcagaacaaaagaaaagaggagataatgcaactcattcttggacttgttttctaagatctcctgataatgaggatatttcttattacgttaaaaaagttgttttctctctccatccaagttttttaaatccaaacagagttgttgaaaaatgtccttttgaagtaacagaatgtggatggggtgaattcgacattatggcaaaagtttattttgtagattcaacagaaaagcctgttgaaattaaacatttcttaaggctttatccaccaggtacaactgatgtaagaagcgtaaagttcccttcggataacactccttctgattgtgttgcttcggaaacttatgatgaatttattttctatgagcctacggagagattctatgagaaattaatttctggtccaattcaacccatggctcagcatagacttcagccatattttcacaaaactgataaatctgcttttgaaaagaccttggcagctgcacatgtttctattcaaaatgaaatggcatctttaagggctgagattgctcagattactttagatatccaaaatattcgtgaaaattactattctcttagaccttcagaagttgcaagtatgtttcctcaacaacatattgctgatcaaagccctgttagcgaatctaaaagttcccatatgatgcatcagcagtcagaattaagccttcctcctggagggcctattatacaaaaatctgagccttatggaagatcttcacctaaccaaaggactcaaaattcaaagtttcaaggtcttccaaattcaagacatgattgtaccgttgattcacaattccaacctcaaaatattgatcatattaatcattatgattcaggaaatataaatcaggcctctggtcaacaattccaccaaaactttcaacaacaacaacagtatcatcaacaacatcatcaacaacaccaccaggttcatcataatatgacagatattcctcctcaccaaatccaccatggtcactcctctcatcatcaaaatatctacgataaccccaaaatggtatcacatcttgctcataatcataattctaattcaaactttaaaccaaataactctctagatggagtcagtattgatattaataggcagacacaatttcaaatgacaaatcaaattcaaactaataggaatccagaaaacccacactctgttataaataataatcaaggtcaatattcaactcatgatccaaatcttcctccaaaaatggaacctcatagttcaaatccaaacaacgctaatattcaataa

SEQ ID NO: 447 - DNA, 4788 bp, Cryptosporidium hominis
atgggttgttccaagactaaatggaaatgtattcataatggagaatgctcaaaagagttttactatagaatccacacttttgttggaggattagaaatttctgttgaagatgtggacacaaatctatcatcttccaaggtatctttatatgatgaagaaacaatatctttcccacgtttggtaataataaggccaaaaggattaaataatttaaaagatattaactctatgaagcatgtttctgaatatagaaaaaatatgtctttagattactttattgaaatttataaggatttatattcagaacctttgaatgttgaaactagtcacctttatgattttacaagtaattgtatctttgaaatattatcagaaaaggacataccccttctaactgagcttagaagtttgtatggaccgccagaattcttgaattcagaaaataatattgaaggaaatattttgggaaacgtacttgaaaaagatgaaagcggtatacttgtaattaatccatgggaatcatcttctattggccaaactggaagaaatagttcatctcatggaacttttgcgaaagatgataccgatccatcttctcatgactttgatatatcccatggaaactctaaacaagatttaaataaaaatctggaaaattctatggggagccaaggtctagatttctctgggttttctattgcttctatcaaagcattcgcaatttttggtatactattcgtttttgaggagccttatttattagtttcaactagtagagatatttcaagtgtgatttaccaaaatggaacctacaaaacaattaatagggtaactaaatctcttgcaattccattattttcaaattctattgaaaaccaatatttcaatttagatgatccaattccctttcaaaataaacaggatgatcttaaaccaagtaatgaatccttttttaaacagcctgaacaaatgaattgtgagttcaaggttgtccaaaatgatccaaatgataaatccaaaaatgataaatccaagaaatctatggagaaaatggaatggattaatagagtttcttcaacattacagaaactctctccaattaaaggaaataaagaatcattttcacttctaagtgattcaggagctaattggctaagtaattctcttattaatgtttcttcaggtatattaagtactgtttcatcagctatctcaaattcaattaatattcaacaaaataatcctttattaagcactaatagctcaccaacaaatcgtcaatttaaagactcttctttaaattatattgataatcaatctaaaacaaaagatccaaattcacctatttctctggaagagcttcttgtcgaaagaagaaatcatttagagagacttattgaaggagttacaaaaatgatttcctcaggaggatttttctatagttttgatatggatattactcatactctccaacgaaaattcgagaattgttggaaggatcatactgaaagagtgggatctttaggtgaaaatggagagacttcttcagaaatcaagaataaagcttatatcatttcaggagattctagatttatttggaatagaaatatctctcttcctgtcctcatctctggagtagatccacgctggattactcctttaatacaaggatacttttgtaatcaagcaatcatcatttcccctgaaggtcctggatataataaaatcggtccagatgttctttcactcaaaatgaatctaatcaattcttttactgaccttgatgagttgattccccaagccaacaatactaatagttcagttacatgtgaacaaaaatgtgcatgtactgacaatggtattgttccatgcagacataagtttgcatgtaaaatgtgttatcgtgattatattgactcattaacgagatatgatattgttttgatgtctagaagatcatgggaaagaggtggaacacgtttcaacgcaagaggtattgatgaaaatgcaaatgttgctaactttgtagaatctgaattacaaatatgtattaataattcagatcactggtttgcattcactcaaattagaggctcaattcctttattttgggaacaaactggtgtcaactcttgtgcaattacatgttttgatcacgactattccagttttatgtttgataagcatcacactaaacttgtaaatctatatggagaagtattttatgtgaatttacttggttcttcagctcatgaacaggctttaagcttgggattaaagaaggaaattaactattataatttgaatattgagagtaaatacagtgatgttagatattcggaagattcagaaactggattagtatgtaactgtgtgaaaaatcatattggatctaccaaagatgaattttgtttttgtagttgtagagcaattcctatagtttatacaaattatgattaccatcaaaaggtaaaaaatcaaggatttgaaagtgcattaaatgaatatgtttctatattagctaaagaatttggagataggattggctattttcatggtgttttttcagattctaattctaagtcttgttctgaatcgaattcaaataataaccaagaacctgttactttcgtaaacttttttgatcttgatgactttgaaactaaagaagagactcaaaagaataatgtcaatgacgttgaatcattgaaaaatgatcgagatagagaatttattattaagatgagacaaaaaggagtaatcaggactaattgtttagattgtttggatagaacaaatgctcttcaatggtatatagcttggacttggtttgtagatttaattttatcaatttctacatgttcttttgagaatagtaatttacaagataaacaagataatggtagaaatatatctcaggaaggttttgtaaaatctttattaaatagtcaactatctcattttggatggtttaaattaatcttaaatagtggagaaaagacacaattagaagaaaacaatattttagagataattaatagtaagaatttgaatcagatattaattccaagatctataaattcttgtatttctagtattccaaggattcaaactcaaagtaaagtaatgaactctcctctgactttgtcaaatccgataataccttccagaattagtaagacagattttgagataagaaactctcctattcaaacagcatacagagaaattgtacaaagacattcatttgtaatgaaaagatctacaggtaataataatagttcaggtttacttaatggattagatataaatagaaataactcaacaattgacttggatgactttagatcaaaaaacttatcacaatcaagtaagaataatttatctatatttgaaatattcagagaatgtttgttaaatggtatgggagtggttactttgaaagactcttttagtttattatgggcagaaaatggggatgtaataagtgagcactatactggagcagggagtgtatttagtggagttattaagaatagaaagatttctctctctacaaactttgaccatgctgtaaaatctttaagaaggttatatcacaatgcatttgaggattcttctagacaacaatatattgattgtcttttatataaacatccatcaaattcaaatttactaggacgaacaaatgatttatttaaagataacttattagataaagattcaaaagtccagaattttccccaggtattaaataaaaattctaaagaactaaatagtgagaagcttaccatttggattggttcttggaatcttggaggccaaccattaaatatagacttggactactggattaagaaagatttgccaaagaataccagtattgtttgtttttgtatgcaagaaattgttgaattaagtagtgttcgtattgtgtttaatcagaatgataagaataaagaagccacgtttgaaatgttagctttaagatcattgggagctgataaatacataaagcttcatagtattagcttagttggtcttttttgcgtaatatttgtcagaagatcttttcatcacttcgttaaatctgttgaatcaaattcaataaaacttggccttatgggtagtacaggaaataaaggagctgtaatgattaggatgaatatagagagatatggaagcattgtattaaccaatgttcatcttgtttcaggagaacagtacaaagaagaacgtaattctcagctcaagctaattcttcagtcaccaatttttaatgaaatccctaattttaaagggtttcttaaaagtggatcatctttacaagatcatgatttagttattcttgctggagattttaatttcagaattcaacttcctaaacaagaggtgattgacttgattaaagacaaaaactttattgaattacttaagttcgaccagtttcttttggagaagaaatcagataacgagattttatcgaaattagttgaaaaggaaatttctttttttccaacttataagtacattcgaggtgaatatatatatgacctcactagaactccttcttggtgtgacagagtattagtattatcaaataattctaaattgccattgattactacaacagacgcggatacaaaaaatagcgagcaagataatttccatgaaaacgattcttttaatgattataatgtaactataactggatataaaagtgatgaaagatatttggttagtgatcatcatccagtatttgcagttatttctgttcaatttaattga

SEQ ID NO: 448 - DNA, 321 bp, Cryptosporidium hominis
atgtcagattctgttagaaatgatccaaagaaagcaatatataaaattcagagaagcgtaaaagattcaatagaaaagtcatgcaaagcatataattccaaattctccccttttaaattaaattatcatattgactccgataaaaatgaagacaaggaagaagcaaaacaagaatttcattacaatatagatgacgatctttctgcagatattgtagagtatattaaagaatgtgtacagaactcatcaaacattaatgaacaaaaggaatcgcttaatgaatggattctaaatattgttgataaaaacaaattaaaataa

SEQ ID NO: 449 - DNA, 393 bp, Cryptosporidium hominis
atgtcagcaacaggaaagaatggtacaggctcatcagccttaattcaaaagttaatggatgctgaggtggatgccgaagaaattgtttgtcgtgcaaaggaaaacagaattttaaagctcaaggaggctcaaatttctgctgaagaagagttaaaggcatttagagagaaggaagaggcacaatttgagtcagagtttaaaaacttttcagtggaagattctgtagatcaaactttagaaaaatccacagaggaagcaattgagattgtcaagaatgattttaaaaacaatgggggagcagttgcagatttaattttaaagaaggtcttatctgttgatctttctttacctcctactgtcactcacttggcaaaaattggaaagattcattag

SEQ ID NO: 450 - DNA, 657 bp, Cryptosporidium hominis
atgaaggagtcagaaaaagaaaaaactgtatctagtaatagagagttcttagaaatcaatgaagaaaataattcaaatagattagaagatttagttttagttgttgatcacaataaaactgataaaaacaatattattaacttcaaggaaaaagatgatgatagtcaaaataaattacctccatggaaaagaaaaccgatttctcttgataatgatattttgaagagagcaaaaaatttcctttctttgtgtgaaactattggaaatgagaaggtaactcaaagctacaatgaagataaacatgtagtaatgaatgtacatatgggagtgtttgacgttaatggaaagctcccagaagatagttctctttcaaacaatgacattgtggatgtatcaaatttagattttaaaactttacaggataatgaactttgccaaattgaacgagatgaagatgatagtgacgataatgatgaaagtgataactatgaggaagatgttactggatcctcatttagatatgatccagattccaaaagttcattggaagagcaaatggccatccacaaaatgttaactcaaagcaaatcgggaaatggaagttctaaaaagaataaaaatttagtgcaagttatatcatcaaaggataatgaataa

SEQ ID NO: 451 - DNA, 1638 bp, Cryptosporidium hominis
atgagtaagttcaactatatattaaatttttctcctgatacttggactccaacaatagagtctaaagcaggagaaaactgtttgggcggaataaaaaacttcccatttgctccatctatgaagattgatagacttggagctgtttgcgacttttcatacacaagttattcgagaggaagagacgcaaaatcatctcaagctgacaaccaagacttccacttggttgactctcgtccatttccaaaaaccaaagtacgatatgtacaaagaaaattccaaaaagaaactgctcaggcataccatcaaaagcaacagcaacaagaaaaggcagaaatgctattaagacaaggaaagagaagtgcaaagatgcgtcaagctggtactcaacaatatcagtattctagacatagatttgtatctcgtatgagaactttaacggaatggtcaatagaaccattatcatcatggatatctgttgcagagattccgctttcatctttaccaaaacaatttttagatgttagtaagtcaacaattgaagatattggatggtttggtacactaaagagttataataaatcaatggaccgaatttctccaaaattgccaatggttcttaaagactttggaaacatggaatttctccaacctacaacatctgatgatgagatccttagagatgctttattacagccagaaaggaatattgatgttgcaattactgatcaaattctggcatgtttggttgcagctgctcaatcgaaatactcatggcatatcttagtaacaaatgttgacggaaagttaatttttgataaacaggatggatcaattattgatttgatcacagtcaatgaaacatcagctgaacctcctctaccagacaatgtaaacaagaataatagacctcatttacttggtttagaggctttgaaatccaatcagaactatactcaaaatattcaaatattcggagatgaaggtattattaggcaatttgagccaattccattctctgaggaaaaccaggatacaaatattgaatctaaatgttatagatatcgcatattctctttacctccaagagctggagcatcatctagcgaaaatgcacaaaaaaccgttagagttgcaataagaacagaaatagatgctcaaattccaaatgctgaatcggaaaacagtggattcatttttgctagagctttaaatgagtatgatccaaagactgttaaaacttggaatacacaattagaaactcaaaaaggtgctcttcttgcaacggaaattagaaataatgcctgtcagttaactaaatgggcaacacaggctttactttctagttgtgatattctcaagcttggttatattgttagaagaactcctaatgatagagagagccaccaaattattagtgtccaatcctataaaactaaggaattgagcgctcaaatgggactaaaggaagaaaatgcatggggtattgttcgtgctttggttgatcttttatctgagcagccagaaggtcagtatgtcattctaagaacccctgtaaagcatgtactcagagtatatagaatacctgatgaagaaagtagtgaacttcctcaggatgaacaaaatcacaataaagaatag

SEQ ID NO: 452 - DNA, 618 bp, Cryptosporidium hominis
atgggagcttacaagtaccttgaggaattatataagcgcaaacagtctgacatcttgcgtttccttatgagagttagatcatgggaataccgtcagttgccagcagttatgagatgcagtcacccaacacgtccagataaggccagaaggcttggatacaaggctaaacaaggatatgttgtatatcgtgttagagtcagacgtggtgaccgtaagaaacgtgttgccaagggtattgtctatggtaaaccaaagaaccagggtatttgcaaaatgaagagtactcgtaatttgagagctgttgctgaggagagagtaggaaagtcaatctgtggtggtctccgcgtcttgaactcatactttgtatgccaagatgccacttacaagttctatgaggtcatcttagttgacccagctcacccagctatccgtaacgatgcaagaatcaactacatctgcaacccagtacacaaacatcgtcaacaaagaggtcttactgctgcaggcagaaagtcacgtggcttacaagttagaggaggtagagccgctcgtcttagaccatctagaagagcagtctatcgtcgcagacaacttatccagttacgtagatatcgttaa

SEQ ID NO: 453 - DNA, 552 bp, Cryptosporidium hominis
atgattgattttgattctgaagatgagttaataaatgaagagacgtattttgaagaaatttattatggagtttctgatagagttatcggagaatgtcgggcagaaaatacaaatagtccaatagaaacttcaataaattttgttaaagtaaaggagaagaatattgaaaatagggtaggcattcaacctaatattatgaatgaaacaatcaatgagacgattaatgaaactgcttcaaaatggtcaactagactcagagctaattcaaattcgaatacttctccaacttttgacacgaacagcagttctaaaagttcctctccaagaaaactttccaaagccacgcgttcaagattgctccttaaagaaaggatcttcagtatgaatccatttggagtaaatattaatggacgaattgaaacaaataatagacacacagatagatataataatcaaatatcaagtaccgagaatcatcctatcactaatgtaatagttacacaaaacacacatgtatcaaaacaacccttttcttctctattcaatatgtaa

SEQ ID NO: 454 - DNA, 753 bp, Cryptosporidium hominis
atgattactcaatcttcagagtcaactaattccaccatttctccattttggaaatctgaaaggtattcaatagactactcactatctacctatcttagctggctctacttgaacaagactcaaaaaatcttttgccaaggaagacttctatctcatgatgacaagtctgaatctttaagtttgtacgattttctaactcaaaatctaaatcagcctgtggagttatctagaatctacaaaaacggttctaatgatggagcttttgctttaattgggaagctttgctccagttctaaaaatgatgaacagagcacggcaatgacaactgaatctgaaatcagagaaaacaatgtagaacgtccaaatgatatctcatcagctagctctaagatctccaaatctgagaaaatctttgaagcaggcattctgctgtactataatggccgtctcattcgaagattagaacacactttcccatgtacaaaacctaaagaattgaatgaattccaattaactgctctaatcaacgtcccacactggcttaaacctgctagcaacaaacaagaatttttgttagaaagaaccggaatttttgaggaattccaagaccatattagagaattaatttcggtatatattaacattcatcatgatcaaaacaagcttaaggcttgggaagctgaattcaataattctagctccgaagattcaagcctgatccgcccaaataagatccccaaattagaaggataa

SEQ ID NO: 455 - DNA, 1350 bp, Cryptosporidium hominis
atgaaatctgaaagactagaaaattcaagtacggctagcattccttactttacatcattatttcaatctggaaggcttatccctaaacgtgaaagactgtatgctcgtttcgtatttattacatttggtatcgcttccttatttatgtggaatacatatttaagttgttatgggatcttaaataaacagttatttccaggaatgggatttattcaatatgttcaaaccagttatatgacatctgtattcataggtaacttaactatggtttttggtttgactcatatttttgatcctcatcattgtaccgtgatatttaattgcgttggtgcattgcagtcttcaattatctgtttatctgtgtggcttcttcacggtacccatttgggttgttcattaaatattttaattgcaggctttgtagcttttagttgtgcaattttgataccagaaacattcacattagcagctattatgccagaaagcttttgttcagatgtctctttgggacaaagttttagtggtgctatcacatttaccctaacaattattttggatatatttattccacatgatattcaaggaagaaaattattagtggcagtaatgtttgccttaagtacagtaatttccctttttgctgcatttttggctcaatcattaactaaatctccttggtgttattcagctattgcagaaattcgtagaaaatccaattcaagcacactaatgtccgtaaatcaatacagaaatgattcccaattatcatacgaagattctttagtttcagttcctatttctcttgaaactgaaaatagcttcgaatgcagaagtacccatttggaagtaacaaggcagatttggccacagctctataatatattcatgtcattcatggttactttagctgtattcccaacaatttgtgcagaatgggacacatttttacctgaaaaatactccaatatattaatggtcattttagttggaatgtttcatctcggtgatatgcttggaagacatgtaccaaagttcggattcaccattcctccttctcttctctggattctaaccacatccagactcgcttttataccgctttatgcagccattaaaaatgccagttatgattcatttcttgcttctatttggactaaaattattgttcaatttttcttggcattcactaacggactttctgcataccttgccttcatttatgggcctgaaactgtatactttaggcataataaagagaaagcgtcttttctccttgctatttataatgtagcaggtatgacagcaggaagctggcttatgaaccttcttgtctgggttaaatacttttga

SEQ ID NO: 456 - DNA, 1608 bp, Cryptosporidium hominis
atgacaataaataatgctgaagaaatggaacttatgaagaggagaagagtaggagcagaatatcaagagagtagcccagtagaaggtactgaacagaaacaggaacgccatgttaatgttcaatttatagatccagatggcaataaggtaggcgatgaattcgatataaacttagatgaaaccaatttaagggacctgaatgctttggttaaccaacttttggagaatgaagaagatactccctatagtttttgcttaaatgactcaaatttggaggtatcattctcactttccgaaacatttgataaaataggaggaatttctacagaagatgttctcaaaattgtttattatccaatgactccttttaaaatcttaccagccacaaggtgtactagttctttacaaggtcataaagatgcagttttatgttgttcctttagtcctgatagtaatttacttgcgacaggatctggtgatacaacagttagactctgggatcttcttacagaaactcctgaaatgtgtctaaaaggccatttaaattgggttttaaccttagcatggtctccagattctaccttattagcatcagcaggtatggataatgccatttgtatttggaatccatccaagggtgataaggtatttagaaagctcaaaggacattcaaaggctgtagtttcattagcatggcaacctctgcatctaatggactactctgctgaaactaaagttaatgatggtgaggaaagtgctacagaatcagggtcgaacaacttgtattttcctaaattaataagtgcatccaaggattttaccctaaagatttggaacataacaactggaacaataattaatactttgtcatcccatactgaaatgattacacatgtcaaatggactggaataaaccaggaatacgttgttagttcttctagagatacgctgattaaggtttggaacccagaaactggtcaacttttgagagatttgaaaggccacgctcactgggttaatactcttgccctaaatactgattatatcaccagatcagcttgttactaccctactgggaaaaacctaaagcttaacttcaaatccttgcaagacaagatcgctgcagccaaacaatctgttgataactttaaaaaaaggtgcaagtttgaaaggcttctctcaggttctgacgataatactatgttcctatgggatccgcttggagaaaatggtagaaagccaattcatagactaacaggacatttaaaagttgttaaccatgttgccttttctccagacggaagatatattgcatctgcatcatttgataaaactattaggctctgggatggacattctggaaagtttattgcggttcttaggggccatgttggtccagtatatatggtttcatggtcagtggatagcagattgattgcatctgcttctagtgatagtacggtaaaagtttggcacgtaagctctaaaaaactcaaggaagatctcccaggtcatgctgacgaagtttacaccattgactggtcgatagatggttcaagactttcatcaggatctaaagattgtattgtgaaaatctggaggcattaa

SEQ ID NO: 457 - DNA, 1974 bp, Cryptosporidium hominis
atgattgaagaagatatccagttgtgtaataattttttcgaaaacaatgctattaaattggatgatcattctcaatctaggaaaaatccttatagttatgaatacagctatttgccaaaaaatgaatataatataaagatgaataagatatttgaaaagtataaagagtatggaaaaaataaagtagatcttgagaagttgatttatggttcctccagaaatttacgagttggtaataaagatttcatgtgtgacattaatagctcagttttgatgaatgagttatccaaagaaattatgagcagaataatttccagtgaaattcaaaaaagggtatatttaagacagaaagaatgtaatttctgttcttacaatgactgtcaaaaatgttacgaaaattctattaaactcaaaaacctggaaaataatattaaggctcagaataaactttacaaggttattttggcttatttagaattgtgtggctttgaacaagttatgattaattctgagtttaaaggtcagggaaaaaagagtaaagcagaatttgaatactttggaaaggatggtagattatggtctgttgagaaatacttatcagaaccttttattgatagagtattgaaattaaatggtcagctatcaccttttcttagagcaaaaattctagagagaattaagctaacattacaagctttcattaaagtttttgagctttcatattttaacattgacagactagaatgtaattcatgtgaatatggactctgtaatgattgtttttataagtttagagaaataaatgataaaaaaaagcaaatttcgaaatacaaccatttattgaaagtagtaaacttagaattagaaaaatattatatacaaataagaaaatcaaaaaccaactcaagaattaaaggtaatacaaaggaatggattttaattgcagataacagccttagaaaatgggtgccaaataaaccagaacttgttttaaaatgtgataaagcaagttattcagaggcattcacttattataatgaaatttcattaaagagaaaacatttaaaaaatatattaaatcatatttataactctataatgcatagcaacctaaaattctcagagtatcatttttcaaaacaagccaaagaatgggagtcaatatggagagagagagtttattatgatgaggtatttagttatattaatagatacttatcatcatgtgttaataaaaatgaggaacttagtaattcctttcatgattacttatataaaaaatctgaaataagaagtctatataagagtttccaagaacacagtgagaatattaattgcttgatggaaaagatcaaggaaattcataatggtggttacattgtatgttcaaaactttcatcagcaaattgttgtaatgatttagttaatccagatgacatttataaactactaaattcagaattcaatgcatttaaattaattaggaaaaggttaaaccattctatatataatgagcatttgaattattttgatcgcaataaagagtattctgaaaattatcatgaaggagagattaataatcgtttttcaagagatctaaatatgaaaaatgaaaaattaagaaataagaaaagagtcagagaagaggaattagataaaataacagttgaatatcaagacattattaggtcgccaatatcaggaatgagtaagtacttgcatgaaaatgaaattaagactcgaagtgaaaatcagagtatagttcaattaagtccaaagtctgaatttcaatgtagtaagacagaaattttagttttacaaagaataacttcactactaacacaaaataaaaacaggttgaggcttttaaggagtctgaatagtgtaagatgtaaaatagaggattgttataattgtaagataaggaataaatttcatgataaattaggaaaagagttgaaaatttttgagtaa

SEQ ID NO: 458 - DNA, 2175 bp, Cryptosporidium hominis
atgtttaaagttactcgtgaagaattaggtgaagatattgatcttttggaatatttaagtgactccacatatgatggggaggaaactgaagaatatatttccaagagatgtaatacaatagaagaaccactgactttatcagactcattttctaaaagctttgttattttcggacttccatgtattggctcagataaatatgagagatttcttaaagctcttagaacaattattaatcaaacccttaaaatgatgagagtggagtatgacgaaaattttttacttgatgtacctcaggatgaagatggaggcacaaaaggagttgctatattgacattttcgaattcattccaagcagaaactgtttgccaagcactttcaaaggcaccatttgataaacagacaaaatttaatacagtaatgtttgatgatgtaaaaagaattattgaacaagatgaatcagctccaggacactttgaaactctatacccaccaccgactttattcagtcgagatgatgtaagaaattggttaatggggccaagatgtagagaacaatttgttattagataccaaagcgcaactgagatctattcatttgattcgattcaaagaattcctgaattaatttatgacggtgaaagagctaaaggagggaaaagagtttggacagatttttctgtacaatggagtccaatgggttcttacttagtgacattccatcgtcagggtgttgcactttggggaggtgatgattgggataagaagattagatttgaacacaaagatgttaaattcattgatttcagcccaaatgaagagtacttactaacatgggatggttcttctccagattcaaggtttgataaggcagtaaaggtatggcatgtactttctggacgacttttaagatgcttttccacaccaactatgacacttaacaataatggaactgatagtggtttacatttcctttggagcccaactggaaattatcttgcacattgctctgataaaggagaacttttcgtctatgaatcttccacaatgactcttgtagaagatcctgctacaggtaataagaacccattaaagtatccacttcagttctttgattggtcccctgaagaagacaacctttcaatttggtgtccagaaagaggagatacaccaggtagactcactttgctttctattaagaatagaaaggagttggcaataaagaatgtctttaatgttagagaggcatctgtccactggcaaccaaaaggtcagtatatgtgtcttaaggctctagtttctagaaaagctggtaaaaaggcaaaaaaagaatatactcagcttgagatctttagagtaaaagagaaaaatgttcctgttgatactgtacatattgaaggtgttactgtcaagtgcttatcctgggaatcatctaatagatttgccattgttgttgtagatgatgttacaagatcccaaacactgagattttaccaagtgaatgcaacacaaactgactttgtatgctcatattatttaacatctcctgttgacacaattaaatggagtccacttggtagctattttgttttaggtggatctggaggaaatttaacattctgtcaactcacaaatgaaaacaaatttgatatcttgcaaaaagatgagcattttatgtgtaactggattcaatgggatcctaccggtagatatgttacaacagctttccaatcaaaattagctgaaggtgcatataaatacagcacagaaacaggtttcatagtttggtctttccaaggtagacaactttacaactcaccattggaaacattttaccaatttatttggaggcctcatcccccttcacttctttcacaagaaaagtttgatgaaattcccagaaaacttaaagattacagcaaaaagtttgatgctgaagatgaggctgtcagatctgaaaagagaaatattgttctccaaaagagaaaagtcaacgaggatgaattcaatgctattctccaaaagattcaagaatggaaggttcagcaaccactttacaaagaatggctcgcagcaaaagaagtcctacttaattccttacaatgggaagaacaagaagaagttatcgagattgagcttgaaactatacaggaagttatttccactgaggtttag

SEQ ID NO: 459 - DNA, 822 bp, Cryptosporidium hominis
atgggtagtactctttcgtcaggatgctgttctggaagagaaagtgaggaggcaaagaagttagcccaagaaaagatgaatagaagtgaagctttaggagatgacatttccaggtttgatttagcatatgataaaaatgatatacaagaatttattaaccttttatcttcaactcaaccaattgataaattagatgaaccaatgcatccttgggcagctgatcctaaaactgttggagcattagctgcaactcaattggcaattctcgccgcaagagacagtcagccagaactcaaagatgaaattagaaagaaaggtggaattcaaggtttattagagttacttaaaagcaaagaagaagatagaattgatggtgcaattgtagcgctttcatttctaagtgttaacaacgttgaatgttgtaacgtcatgtttgattgcggggtgcttccatacttagtaaaatgtatgtcaagcgaaatagatggacttagagcagcttccgcacaaacagctagaaatatcttcatattaggacttaatcagagaaaagaatttatgagacttggcggaattacagtattagtaagtcttctcaatccccctacaaaaaatattgataagccagaaagttggtatactcccttggaagcagtgtatcatattgaagatctaattattgaccaaaatgaagaattattggaatatacacgcgctattcgaaaatgtggagtcgttgagaaactacaaattcttaccaaaagcaacaacagagatgtctcagaagcagcagagattttattagccagagttgctgagtga

SEQ ID NO: 460 - DNA, 357 bp, Cryptosporidium hominis
atgattacacatcccagaatttttgctgcaactttatatgagattttttatttcagggtttttgttttactaacaagatttcaaaatgttaaaactatccttgtatctcctctactttttgaaagcaaagttttcacatggatttgctcaccaatatatgtagtatcagcaaatagagaacagcagatcaaatatttaatggatagagattcttgtactcaaactttagcagaaaatatgattgactcacaaatgagtctgaaaacaaaatgcgagctggcagataaagttttatggaataatgacagtatacatgatctgaagattcaaattaagaaagaattttctattttataa

SEQ ID NO: 461 - DNA, 465 bp, Cryptosporidium hominis
atgtcaataaaaaagttcaggtcactcctaacaacattagttctaatactcttcttgttcaattacgagcataatgagcaagaaacgaccaatagagtagttcttgaccactcctttctaaatttaagaagatcctccttccgaaaattgctgagttgttttggatgttgcaaggggaagtgcaaaaagaaaaaatctaaaaaaaaaggtttgagcctaccacccccgccggctcgttcatgccttaaaaaaaccggacaagattcacagtctccagaaggtgatcagaacgtccgtaaaaaaagagtgacatttaaattagatgatcagtcatcttctagaattaaaaccactgcaggaggacttccttcttcaagctctctatcattaagagtaatgttaggattggaaagacctgataatacgaaagatgaagataatgaagaatttgaaactaaattttaa

SEQ ID NO: 462 - DNA, 570 bp, Cryptosporidium hominis
atgggttttataacaaattatttccatgccatttttcttattttaataatcaattccgcctttttcaccattaatgaagtacatccatccgaatataaattctcaattttgcaagtaaaagcgcctcgttgctcaaaacttagaagtcttctttgctgttgttcagcttcttccagaaatgaagaggatgaacttccaaatcaaaatgaaggtgatggatctggcatccctgtattgttagcttacaatcccatctccaatacagatgaaagtaattctggagacactaatagtaatgatgaggaagaccccaaatgttgctcatcatcatcatcatcatcgtcatctaagagaaagaaagctgatatttctaagggccacccaggccatcctggtctttacaccgtactattggattttgaaccagaggttgggacatattctggctttacaaatacaaaaacaactcatcctccttcaaaaccagatcctcctcaattcattcctaatgtacgtgctactactaccacgactactgaaaagactaaaactactagcaatgattcctaa

SEQ ID NO: 463 - DNA, 786 bp, Cryptosporidium hominis
atgcaattaagaaattgtttattaataatatttgtattttcactttcttttctatcatttgagcatagaaatgaaagagatatagttagtgaagacaaagtttcacttttgaaacttagaaatggaatctcatttggacaaaatcttcgcaaaatgctttgttgttgcaggggtaatagtaataatttatcaactcaagaagtaacagtatttgcagttgataatccaacgtttaataataacgatgaatcttctggaaattgctctaataatatggaatctgttccaaatccagatccaagtaatattcctgttcctagttctgatccagttgtatcttcaacatctcaacaatcggggtattcttcaagtagtaggcccattcccataccagcaagatcaggttctaataaagggccgtcatcgccttcttcttttccatcgccatgtagcccaagttcatctacttctaaattgggatttttaggaatgtgctcgccttctgtatcttcatgcgttcgccattcaagtagttcaagctcattatcatcatcatcatctacttcttcatcctcatattcatcatcgtcaagttcttctgaagatgaggatgaagaaactaataaaagtaaagaatcaaaaaaaaagagacatcgtgggcgtaaaacaggtaaaaaatcgaggtcaaggtcaaaatcaaggtcaaggtcaagattcaggtcgaggtcaaaatcaaggtcaagatctccttcactggtttttcaatttgacgaagaattgacataa

SEQ ID NO: 464 - DNA, 579 bp, Cryptosporidium hominis
atgaagtttttatatgtgtttctatgtttaatttgtttattgaattataccacattcaatcagcttggcagagttgatgaatattcaaaaatatcattgattaaagtgaaatcgttgaatttaagctctagtgattttccaaatggtgaagaaaaccatgaaagtacaggagatcgtcaagatgaaacagatggtaatggctcttctagttcatcctcatcctcaaatgaccctgaagaagacgaagcagatggctcgagttcatttggtggagcacccttaagttctccacgccctcagagaaggaagctatggggaagagggcataaaggaaattccccacaccctgactctgaaggagacgaggcagatggcttgggttcatttggtggagcacccttaagttctccacgccctagcagaaggaaactatggggaagaggaaatcgaggaggccactcacactctgaccctgaatctgatggagaaagtacaggtccatttggtgggttagccccgagaccaccgagccctttaaaaacgattccaaggaaaactaaattgagaaaaagattttaa

SEQ ID NO: 465 - DNA, 597 bp, Cryptosporidium hominis
atgatgaatgcctgtttttatctatatataataattccgcttttatatttaacctttaattatcaaagcactttctctcaagatttctcgaccgatagtttagcccaattttctttattaaagttaactgcttcattgggcaatactggctcggattctgatggtagtggtcccgatgatgatccaccaaatttcaaacctcctccgccaccaggaaagaagggtaatgtaggttcaaatccagatggaccacccgttcctcttccaagaacgaaatttccaggaaataaacctccaaaaggtccaggcaaaccacctgttccaactccaagactaagagatctggatgggtcagatggcggaaaaaacccagatcgtccacttggaagaagaggaggaatgagaggccgaaatggtggtaatagacaagataaaagttcaagctcaagttcaaattcaggttcaagttcgtctcctgatggacctgtaagttcaggtggaggcggtaaaggtggtgtaattaccgttagaaagtctcctggcggtcctccaaaaccacctgaacgtttatcatcgctatctggtttattagactaa

SEQ ID NO: 466 - DNA, 405 bp, Cryptosporidium hominis
atgaattgcccaaagttattaatgaatttatgcatcgttattggtttactttcatactttatggcatattctggccatgaaattgaatttacaaatgaaaaatatattgaattttctcttcttcaaatgaatatccctagtagacttccaaatttactcagaggttgtagaaaattgtttcgatccacgggtcaaaagcctacaacaattgatttttcttcctttgatggcactcttccaagatcacaaagtttcttacctcgcaacactcaaggtctaaataatcatttctctggttcacctcctccttttccaaagaaaccccctgttggagatccttataacccagaacgttctgctgccctactttcccgcagattcagagtttataactcaaaacaataa

SEQ ID NO: 467 - DNA, 561 bp, Cryptosporidium hominis
atgaatacagtaaagttaaattttattcctctagtattatgtttggcttttttgtcaaacttccttagaatcaatgatcaaattttgagtttaaatacccatgccgatctttctcttattaaattaagttctccaagaaaattattaagaagattatgttgttgttgttcttcttcttgttcttctgatgatagttgttgctcaagtagttctaatagtggatctctcaatattggagacccgactcagcctagacatgtttggtctgtaactagtaattatggaggatttagtcaagaaatgcaaacagtaccacctagaacacaagagggcaatgaacataatgagcaatcagaggaatcagaagaaaaacattcttgttgttctagtagcagttgcaaatccaaaaaattgagttcaaataatggtagtagtaatggtggtagcaatggtgatagcaatagtggtggtaatggtggtagcaatggtaatgaagatgaccctcagaatccatatgctggatatactggccgtttgaactctgcatttactacggattga

SEQ ID NO: 468 - DNA, 2769 bp, Cryptosporidium hominis
atgataagaatgaataataatataataataaataaaagaattggatatagttattatatggaatgtagatgtactagtaatgaattaataagaggatgtttattgttaaaagataataagttatggataatgaatatattatcaaaaatacaagaaataagaaataatacaatatatgatatgttattaagaatgagagaatatataagaataagaaagaattatgagaaaggtataaatgatttggagaagaatttaagaagaataatactatcaagagtttggatagagatgattaataatatagaaagaatatggattttaggaagattaataataataataagaaatagaagagaggagagaataaagagacaagtattaataagatgggtgaataaatataatgagaattataggaataaatgtataatagaatatatgagaagaatatatggtaatacaataaagattaaatgttatttaatttggtcaataaaatttgagataataaaaaagaagaagagattaagagaaagatatgagagatatttaagagtttatataatagaatatacaataagaagaatgaatgaatattatttatataataaatggttaatatggtgtaagaaagcttatgatagaatagaatgggtacatgactttagattaaaatcgatattatttataaattggagaagatattcaaaaaagcagagaatattaagggatgaattatatatattatataataaagtaaagataagaaagaaaggatatatattaatagaatgggtgaataggataagaatattattaagaatgagaaatgatgctgagaattattatttgaataatataatatatagaagaagatttaaagattgttttaatatatggagaggattatcattaagattaagaaatcaaaagaagaagataatggattatttggagaataagaataagaatttgaagattacatgttttaaactttggagattttttatttattatagaaagacaaggaattcaagatttgagaagataacaaatataataagattgaatcatttaaatatgatggtttatagaatattttattcatggaaattaaagatgatagaattaagatctttaaagaattcaatattttcattttggaattctggtatgggtttggagatggatgagagtggattgggagtggaggatgatgagaggggaggaagaagagggaggggggttggaggaagaggaagaggaaggggagggatgggaggagaaatggtaaggggagaaatggtaaggggagaaatggtaaggggagaaatggtaaggggagaaatggtaagagaagaaatagaagaaggaagaggggaaataaaagaaagaagagagatgaacgagctcatttctccatcaacttttaattctccttctcaatactctttggagttttcagtggattcactttcattgaagttaaaagaggaggaggatggtggaggggaagaagatttgaataatggagagaaaagaagaaaaggaagggtggagaataaagatgttgagagaaaggattatggattcatgagtatattttcatcaagtggaaattcttcattagagttagtatcacaaaggttggaatcaaaacgtcaagatgatttgagaggtgtagttaaagaaagggaaattcaaggacaaccaaagaataattatgggaattcatctccatcatctactcgtgaatatgttaataggttactttcctcttcttcttcttctttgtctgttttatccaatatttcggaaaaagtttcaataaaagagtctccatatactaattccaacacaagaagatctcctaattcttattcaaaagctagaagatcattttcacctttccttcagtattctgtgtcttcttcttcttcctcctctttacagtcactatcatattcggatggtgacttggagattgatgaactacattctgcaacaaagttaaaaataaatagaactcgtaagaatcaaaattcgttagactggaattcaccttcattatctccacaaccactaccatcttcattatctcctccaccagtaacttcatcatctctacacccttcattatcttcttcaccgcctccaatatctcgacaatctctatctttaccacgacagcaatctaatccatcttcaccttcacttccacctccatctttacctcctcctcctcctcagtactcgagttataaatcttcaaattcaagtaataatgattcaatgataagaaatcgatcaaatttatcttcaaggttacctcttccatttccaattcctattcaacaacagccacaattacagatggtaaatcaggatatgaaacaattgtatgattcaaatttcacttcttcttcttcttcttcctctttatcttacttttcctctgctttctcacccttttcttactcaaagaaaattactgaagatccaaattcattattagtaaaacttgatactgatacaaatcaaacaattaaagatcttcctcaagatccttatcatatctcaagttctagtccaatctttaaaacaatcaagactgatttaaacaatattcctaatcaaaaccttaaagatggccaacaaattgagtccaatctaaacataaaacccactcattctcaaaacaataatatatttacttcctctatttcttcctcttcatcctcatctttttcttctcagtctccataa

SEQ ID NO: 469 - DNA, 870 bp, Cryptosporidium hominis
  misc_feature (802)..(802): n is a, c, g, or t
  misc_feature (832)..(832): n is a, c, g, or t
  misc_feature (852)..(852): n is a, c, g, or t
atggaaacaaaaatggatatgaatgggatttctataatggaagtaaaaacaaaaccatattatggtgtaagtttaacatcaaaatatgaaagatttccaaaattaacaaattcattgggatcatataataatactaataatggatcaggttgtttagaaattggaggagatattcaaggtgaatatattcaatcaagatttagaatatctcctacaataaaaacattaggatgtttgaataaatctaataaagaaaataaagatagtattggtatgatgttaagtaatacaataactttaaaaccattttcttgtattaatagtttaagtcttggatcaatgatatcttcatcaaatataaatttaccctataataataataagaattcattaaaattaatgttgggattaatgcttaaaggtcctttatttatgagatcttgtaaagacacaattgatgaaagatctcaaggatatgaacaatttaattatcaaggtttaatacataagaaagaaaattttggatcacgttttaagaatagtatggtttgtaataataataatagtaattatgataataataatgatgatttatatgaaggaataggaggatcatcaacattaagtccaatttctattttaacaccaaattatgttttatcattacaaactaatacaaatcatcaaaataataagttatctggatttacaggaggattaatattaaacaatttagttagaaattatttaactttaggtttaatgatatcttataatactggaaataataatggaaataatnaatggaaatataatgaagataatattcacnaattgaaagatatggattangatcatcacgaaaaataa

SEQ ID NO: 470 - DNA, 684 bp, Cryptosporidium hominis
atggatgtaatgatacctatggaaaatatgacacctggatttattaatgatttacaagatggaatattatctaatggaaatcaaaataatgatttacagaattctaatgaacctttaatgcaaagaaatcaaacttcttcatcaggaaacaatcctgttaataatttattgaatagggaaagtgattatttacaaaggtttccaacattaacaggatttaatagagctgggttgagtggtaatgagagaattatagtacaagatagggatgatgaagaagaagaagatgatgatgaaaatgaagataataatcatgataaaaatattaagaataatccattatataatgaaacaagtataagtagtgatggtaaaaagtataatgatacagcatcaccaatcaaaacaccagaaattgtatattataataatacatccaatttgagagtattagcaaagaagggtttattagaaagagttgaagagaaggttaatgatgtttttgatggattaaaaaagaagtctaataataatgatgaagtaaaggatttagaaaaggaggatgatgctgatgaaaataataaaaaaaatgataataaaaagagtaatcaaaatggaggtaaaatgatcaagcaggtattcagtacaattgaagatattgtatcaaatacattatcaaagtaa

SEQ ID NO: 471 - DNA, 1428 bp, Cryptosporidium hominis
atgaattcagaaatatggaataataagagatttctactgagtggatttgaagaaaatgatgaaaataatctgataaggaaaaaatatattgagaataatgggggaacagttttggaattaaatagtgaaattatggatgatgatgttgattatttaatatgtaattattcaaaaggatatagatataggcatacaagtatagattatcagaaattaagaactccattttggatatggttatcagtgaatgacgaatggaattattcattagaatggcaccctttttttaggccaaatggcaattttaaatataatattttgaaagggtttcagatatatattataggttatagtaaaacaataggaggatttaataatagagaaaagagcccaaaatatatacgtaagaaggatgatattggtattttagtttcatttatagaaacgcaaatgggagcaagagtaatatttgatgatgaaaataaaaatgaaaatgaaagtaatgatgataataacttggtcaaagttccactaaaagcaagtgttacaaagttggcacttatttgtaataatgaagaatttgaaggagaaattattgataaagttaaagaaaaaaataatatccaaacaatagtaaatttagattggttatttgattgttatgaggaaggaagaatagtgagttataaaaaatatatatataatagcaaaagagagaaagaaaaaagggaagaagaaaaaatgagaataaatgcaggattggaaaaagagaataatagtattgcaaatgctaaatataagatgataatatcccatcaagtatatttgaaacatgttgagatatataatataatgataaagataaataatattgaatatatggaagtaggccgtccaagcagggaaatcatgaaaattattcaaaatattgacggaaagaatggattaaatttcgatgaaaatacagtaatggtattggtttttaatgatctgatggaagagcaagatttttggtatgacttagtcaatatattagaggaaagtgtagtatttaatataaagttagcatcaaaagaaaaaaaagataagattttacatcattttcagatgatgagaataatcaatgatcctgaggattttataaataaattaataggttgtgaggaaaacattataccattaataagcaaattgggttcaaaagttggatattcaataccttcttttataaatgaattacttaaatcagagagtgaatttttagatactgttttaaagtttacagattttgaaaatattactggtttgagtggatttgttgaatattcaaatgataatccaatggatattgtaaatttgaatagatcaaaagctataaaaagatttgatagctttgagaaagagttttctactattaaatttagttaa

SEQ ID NO: 472 - DNA, 192 bp, Cryptosporidium hominis
atgttatctttaattatttttatttgcattttaaagaataaatcacttaaagaggagatttcaagaaaggaaaaaatgttagatgacgattgtgagattattccagttaatgaattaaaagagttaaagaatagcttgttaaaaaagcaggtaagttatttttttaatattaattttaaaatttattattaa

SEQ ID NO: 473 - DNA, 906 bp, Cryptosporidium hominis
  misc_feature (364)..(364): n is a, c, g, or t
atggtaaaaagaagcaaagaagaaggtaataatatggaagaagaaggaataggattggatgaaacacaacagagtaaaatggaagatgataatatggaaagtaaatctcaagttagaccatcaagaaattctagaaaagttgtaaaatatacagattttgatgatgaagatgatgaattggatgattttgagagtgattttgatgaggaaatggattttatagatgaaggagatgaagatagtggtgatgaagatgatgaaaatgacttggatttagaagaagaagaatttgaaaagggtaaaaagggcaaaaaaagtccaccaaagaaaaaagggggggagtctattaactcaaaacctgcanaatcaaaaaaacaatcatctaaagaaagttcagtggaagatgaattagaatctgatgatgaagataaaggtacaaagccggcaaagaaaaagaaattgtctgctccaaagaatttgacaaagaggaatgttgcaaattcaggaggatcagcagcaggagatgcaggagaggcaatatttaactatatgaaagagcagaatcgtccatattcagtacaaaatgtggttgataatttgcataatatatactcaaagaagcaagtaactgatgaaatggaacgtcttgctgtcgaggggaagtttatatgcaaggagtatggaaaacaaaaagtatatttaatagaccaaagtgactgtaaagaattaaacaaggatgaaatggaggctttggataaaagtatttctgtttgcgagtcagaattgaatgatttggaagtaaggcttaaacaacttaagcaagaaacaagaaatataagtgttccattaactattgacgaattagaagagaaaataatgcaagaaaatcttaaggtaagtttataa

SEQ ID NO: 474 - DNA, 927 bp, Cryptosporidium hominis
atgaaagaaaagaaaagaaatgtaaactattacttaaactgtgcattaggtggagcattaagttgtggtctaacccacacagcaattgttccaatagatgtagctaaatgcagaatacaagtttacccagataaatttaggagcttagttccaactttgtctaaaataataagatatgaaggagtgaaagcactgagattaggatgggcaccaactttaattggttattcagcacaaggtgcgttaaaatatagcttgtatgaatactttaaagatttatattctagcaaaattcaaacaacaaataaagaatctcataaaggattgatttggcttggagcatcagcaacagcagaattttttgcagacatagcattatgtccaatggaaatgataaaaataaaaatgcaaacttgttcaaggccagatttattaccaaactcttttctaaaatcagttaataatatgtataaatatagatcagaaacaaaatttccttttggaagtattaagcctttatggtatcgtcaaattccttatacaatggcaaaattctatttttttgagagaattaatcagatgttttatgacaaagtctttactaaacctaaagaatcatatagtaagaaatcaaggcttggtataacatttttatcaggctatttatctggaattatatgcgctattgtatcacacccagctgatactataatttctcagcttggaaaagctgcatatagtggctccaaaagaattaatgtattatctatgactagagaaatcggtataaagaacttgtgtacagcaggtttgggcacaagaattattatgattggtacattaacagggatgcaatggtgggtttatgattctttcaagactattattggattaaatgcttctggtaaaaacaaagttaaatcttaa

SEQ ID NO: 475 - DNA, 609 bp, Cryptosporidium hominis
atgacttataatggtggtgccattttggcaatgaagggaaaagagtgcgttgcatttgcaacagatatgagacttggatctaatggatacagaactataggtactgattttgataaagttattagaccaagctcaaaaacattgatgggattttcaggtttagctactgatattcacactctaacaaacttaatcaaatttaaaacaaacttgtatcatttaagggaagaaagagaaattggtgttaaagcacttagccatatgacagcttcaatattatatagtaaacgtttcagcccatattttgtggaaccaattgtagcaggtcttgataataataatgtgccttttattgctgggtatgatcttattggatgcttatcagtatgtagcgaatttgcaatttcaggaaccgctgataatcagctttttggtatctgtgaatcatactatagacccgatttagaacctgatgagctcatggaaatcgtctcacaatgtatgctttccggtatagatagagatgcattttctggatggggttgcaaagtttatctacttactcctgaaaagctcgtcaccaaaactttaaaatcaagaatggactaa

SEQ ID NO: 476 - DNA, 1653 bp, Cryptosporidium hominis
atggttagagaggctcccaataagagtgacgcacctcaaactctcaccgctccaaacacgagcacaaataaggctgctcctgctcctgctcctgctcctgctcctgcgcctactcctgctcctgcacccattcctgctcctgcgcctactcctgctcctgcacctacgctaggaccagctttatccaaggatagtgcaccaattaatattccaatagtttcagttagtgtaaacgaacgatctggaactccaaattcgaaagaagttatacaagttccttcagtgccgagagaaggagggaacactcaaagccagacacccagtcctccatcaatgccttcttctcagcagtccccacctaagcagtcttcaccccaaccagctcctccacctcagcagtcctcttcgcagcagtcctcttcgcagcagtcctcttcgcagcagtctcccccaaagcagtcccctccaaagcagtcttcattccagccagctcctccacctcagaattcttcatctcagccatcttcatcaacaccttcttcaaaaccatcccaaacccaaatggattcacaaaaacctaatagtcaaaaaatatctccacaaaaagttcaagttggtaaagttggacaagtatcaaaccaagtggaattaaatggaataggatctaacttagattcaagaagatcagtagaaaatacaaagttttctctaatagaatcagagttggactctaaatttccggatattaaaacagcatttaataaagatggacttcaagaagttaaagttgcactgatttttattactattagcttaattatggttattggattttctattcgaaaatatcgcaagcttagaaaaggtggagagcaggtcagaaatattacaaatactgtatttcctgtaaaaattgtgagtctatatttatatatatttttgagtttcccaattactgtacttatgcaattcctctcgtgtattgctccaattggatatggaatgtttaatgtaatacaatcgacttatcaaagtatatgctatatatggctttgggatctttttgttgaatactttggaggatcagaacaaattgttacagctataaggagaacaggcccttatcaggtttggaaggtccctccatttatgattccaaccagtacagaaacttattttcaaccaaaaattgtcattgtaagctatatattaatgatacaatttcttccaatcaatatttttgtttcaatactaaatgttattcatccatctaaggcctttctttataatttaattctaataatttctttaactatttcaatttatggaattatgcttatttattggcctagtaaagaagctcttcaaccttatcaaggagggtggaaatttgggattcttgttattcaatcattcttgattatagttattgattctattattaaactcgcaaagtatgaaaatagagaatataattctattgtttataaactttactggaaattaatgcttacttgtggggtagctacaatctgtactcttgctgctgtggcaattattgattccagagaaatttatcagatttataatctctcaataccaaccaaagattctgaaaatattcccgaaaataaagcaatgcttgctacttaa

SEQ ID NO: 477 - DNA, 702 bp, Cryptosporidium hominis
atgaatgcattggagttaatatccattgatttattttttcagctaatcagttatttaatcattgcaggctcttgtatagtaaaaataccgcaaattattaaaatattaaactcaagaagcacacagggaattagtagctttagcatatatgttgagatcctctcatcttgtatatactcattttcaaattggagattcaatgttccatggttactttgggctgatagtgcatttataggtattcaaaatgcatttattctcatactatgtgtggtatattcacagaataagaagaagtttccaattaaccaaatcttttatatcacatccatctctttattaattgcggccctttatcaagatattattcctattcaagttttaagatacctttccatttcgcctcttatatttgttgttctctcaagagttcctcaaatagttaagtgttatattgaaagcagtactggtcagctttcatttatttcattcttcctccttactggaggctcctggtcaagagttgccactgttttatttagtgaatctaaatcgaacacgatcttgctactgactaatgtaatttctgccctccttaacaccgttcctttaatgcagattgttatttttaagtattgttcaagtatctcagagaaaaatggaatcgaacaaaaaagacatagtaagagaaaggtagaatga

SEQ ID NO: 478 - DNA, 1275 bp, Cryptosporidium hominis
atggaaattcttcagttattaaatattaatcaaattcattcaatcattcaaatgattataattttaccatatatttttgaaaagttattattaattatagaattagatcaagaaagaatatatggaatttggatggtagcaaaagaagctatattagttattatacatgattggatatcatttataaggttcttaaagatcgaatttgaaaaaattgataaaaattattcgaattctattaaaaatgatttgaatcaaattattttggacaatacttggccattatttattgatattattgcaaatatgatcaaggaagaacatggatttggacttaaagttgtttcaagtaatatattcaacaaaaattcacaaagaattaataattatattgaaaactattatttatattttgatatactattagttaatattgttatggattttatttttacattaaatgaatttaatagaaaagatgatataattgaagatctggagattcttgaattaccttatcaatattacaaaactattataagttattttgacgattttattaatgataataataaatttaaagatggatttgaattaagaaataaatgttatttagaagaatataagagttttcatactgcagaaaatactaattttggagtattaaatagaaatggtagtaataataatacaacacaaaataatcatcaaactttaaatattaattatcaaacattgaagatatatataatcgaaaaattatttgttttgtatgatcagttaaatattaaattaagtacaataagtagaatgataatgaaattaacaatagaacaagatgaaaatcaattgaatctagtgagtttaaaagtcaaggatttgattatttgtattgaagaattgggtgacatattaaatagaatgacaagtaatatgtttaaaagtttttctatggaagatttacaaagtggattaaggccaatgccacatttaaaaattgaagaaatgcaatctttattagttttgattgagaaacattataaagcattgagaagatttgaagaagagaatatggatgaaactaatgagatacaaattgagattttgaagatgagaaagagatgttttgggagttatatagaaaatgtattaccagaattaatagaatgtgtaacatgtaaagatcaaagtattcgtcaaagattgaagattattttatctattttatcaaaggatatatcaaaagattataaatcattattagtcccatattaa

SEQ ID NO: 479 - DNA, 642 bp, Cryptosporidium hominis
atggatgatattaaaagaaataaagatcctaaggatctcccagaattttatctagttttatccaatatttctaaaagacaaaactttggaacattacttagaagtgcatgcggatttggagtctctgaagtactcgtagtaggagaaaagaaattgatgacttttggaaataaaggaactcttccacatttgagtttaacacagtatgaaaatattgatcaagttgttgatattattaaagaaaaagaaatggatcttgttggaattgaaataagtgatgaatcaaggcctatatatcctcatccttttaaaagatcgacagcttttctacttggtaatgaaggtactggacttagtcaaaaatatattaaactttgtgattatttaattcatattcctctttatggaaatggaacagcatcattaaatgttgctattgctggatcaatagtatttcatcattttgctatttgggccaaatttactgaatcctcaaagaaaggagccaagtatattattcaagataataataataataataataataataatgatcatcataatattgatatatccaatgttaaagggaaaataagacattatttatttccttccgagttgggtacgtttttttccttttaa

SEQ ID NO: 480 - DNA, 5691 bp, Cryptosporidium hominis
atggaaggatttcatccagattggcaaggctactttaagccgttaattgctttaatagctccaaaaaatctacaggagcatatttcaaaaagtattgattcatttagaccaaaatcatgttttccttgtgacaaatacctggagttaaaatgcatgacttattcagagcttattaatccaactccaacaccaagtgcaacatctccatcaaaaactttattaaaatctccatattcaatttcaaattcaaattgtgtaatattagggaatcgaactggtaattatcttggaggaatcgatattttgaatgtaaattggatgaataaagttagatatgaaacaccagctctatatattctttgttttgactggcagaaatacccaataaataccaataattcaaattcggaagaaacagaaaagaataaagatcaagaaattattaatgaacttgaaaatgatgctcttaatataattaaaaatattacacccatattaaaaaagagacaatccccaccatcagtattaatttttgtaatcttaccatcaggcactccagatcctcaatcatgtgtaacttgtttcagaagaaatcactttcctgagctacaggcaatatttgtaaaatgtggattaaaacatcaaaaacaattaaatatcagaattgagagattagctgaaatggcttatgaaacggctcaagcatattatagtgaaaatgagcgtagatggagaaagtctgcaattaaggcacagacagctggtataacggcttcaagtgattcatttattggaagtttatcaatgaaaagttcatccaccggattaagatattctgtatcgaatagtatacaatctagtttatctccaagatttggtagaaattcattcttttcagcagttaattcaagctcaaatagtgtgaataatcttctcaagaatgtaagcttgacaaatgcaaatactttatctagatccaataagaataattcttttgcctcaagtacttctgggaatggttgtcaaacaatgactcaactccaatcaaaagtattattaataagatattgtataaagagtgctgtaatgaatgagttttgtgggaatttcgcattagctgtaaaacaatatattgcagcttgggataatataatgaacgagacaagtataccttcttatcaatttgtaattctttgcaatataataagtctaagactttaccatattcatgtgataaatggcgaaatccaaaaagcaatgattcatttaaagattcattgtagaacacttcgagaatttggaacaaatcatccaaaatttaaatttttgtcatcattatggctttctcagacattgcaaaaacttgcttcagtacttttttttcaccttgttaataagagctttattcaagatcaaagtataaaagaagatacaaagctatgccagaataatcatcataaatatccagatggacttgaattctcgttaatcccattatctataggtaataaaaacgaaaaaatcatttccagaatttcagaatcttgtagagagaattgtgcattcaagtttgaaaatgaaaatcttggtgatattctctcttcaattgctagatcaattcaaaatattgtgattaatattaataataatacccaatgcgataatgtaatttcagatgaattgaatggaaaagatgacagtaataaaattgaagatcgctctggtattactatattaaacaataacaataatcagaataatatggtacttgatacattaataaacatttccaaactttataaaacttcagcagaatactctcatctttcaaaaagtcaattaattgaattttgtaatgaatttgatacagaattattcagtaatgaccaagaaattggaggagagattcttcctcctctttcacttggttgttttgaagaactttcatctcctgaaacttttcttgagtatgaaagaaaagggctctccagtactagccaacataaaacaacttttgatcaactcagcaaactttgctcactttatattggctcagattcttttgacattgatcagattgaagacagaagcattgcttcagaggttcttgcatcttgtgaaattgttagaagaaacattaaatcactcattaattccaaatctttattctatagatccatctcacttttttacacttcagcagtcatttacagacatttttatccaattaatttatttaacaccatctcccaccataatattaacctcaacacaaacactgaatcagaaataccccaaaaaaatgttgcgattaataataataataataatttgtccacattaaatagtacccctgacaataaatgcaatcagcccgcaccggcaatgcatgtggacaatgcatgtcagagtggatgcatgcaggcgggtgcaagtatggcagatagtactgccggtactaatggtcagaatgcgggtgaacttgtgaatgttggttctggaaattttattacaacacctacaattccctccaaaattggggcaggacaagttttcggacaactgacggatcgtttctttcagatgatttccctttcctttgctgagtatttgtttgaggaaaattatatcaactgttctctaagtatttttgaggcaatctttcagtcaatcgttccaaaacatgtttttgctgaaatcagtaggctgactacaattgatgagcaacaaaacaagttttttggaaaaagaaaggcaagaatatgggaaattgtgaatccacaaatgactaatacatgttttcaaataacaaatagttactttgattcaaacttttggttatttttaaaacgagtttgcactcggatacttgaatgcctttctattcaaaatttaaatttggaagaaagaaaaaatattcccaaaattactatttctaatacaagctctgaaagtaaactatttggtaatagcaatatcgacaactccaatctatacaataatagcaatattaagcaggatggtcaatatatttattcagttgtctcaagtttcttagcagtattaaaaccaaaaagaacatggacacaaggccaaaatcaatgtaaacacaaaaatactattccaaatcattgttcaattctcattctatcttatttaattatttcaaattctcttgaaagggactcagaaactgcatgtaaaatagaaattgaagccttttacaaatggattcaagtactatattacaaagtattgaataataatattactagtaataatgaagatgatcactcaaataatattagtaattctaatattatccaacaacaactcactccagttcttacaggtagtaaagcccaagtaaagaatatcttatttactcattttcttcataacaattattccacaatattacaagatcaatcaattcccgatagaattatcataatgattcatcatttcccgacttttcttaacgtatttattaattccagaatggaaactacccttgtgaccaatattggaatattgggagtaattattgagaaatttgaagttgttgaatttgaagaagttgggagattgaactctcaattatcattgcactgcaggatcagacgtgtgaactatattccacagaattatgaagaccatcattccagaaaattattctatcaagtttatcgtccatcaatccttatttttggcatattcctatatctatgtgtatcaaattcaaaccaagctaatgattatatcaagtttggaatcaatactttaaaatactttaattatcaaaaatcgatttcaaatttgacaggaagtaatatatataacttttcttatgttcaattctgtctcagaaacccatcactatcatattttacatgtattggaagttggttacgtcattcaaggacacttatatataatactcctaatttgcaaattgttccaggtggatttttagatttatctacaaattccatagcaaatccagttccaatttataaagttcctgttgatgatttgcaaattttgtcaaagttttctcaaccatttaactctctaccaatatttcacaagcttgttactaataatataaagtttaatgatcagttatcttcgaaagctaataatgatgaaattggtttcaatattgagagtattaagaaactatgtaaagtctggctactttcaccatttaatgctttggatgtgcttttaactgactctaaacaaagaattgatactattgagtctattgcatataatgcaatttccaatgaaattagaccattacaacttgttttaaggataccaaaggacttttcagaaaaatttattttggatatttctgttaaagttggaaaattgataactcaagacccgtattttggagtttcagaatcagaatttgaaaataagaatgactctattatccaaagagaggaagatattgtttcaaagcttggaattctccaaattccaaccaataataaatgggaaattgtatttagtcaaaatactatatcttcagttggaaataatgataataataataatgctattcactataatagttatcaaaacaatagcttaactccttattctagcacaattgggagatttactattgatgggaaattgcttagaagaagcattgtttgtgaggtaaaaactagttttgaaacaggaatcgtgaatacagaaaatgtcaataaagaagtaggaagtcttgaagaatttacaagaatgcattcactaataaacaaaggagaggaaaaaactataacatatgaatgtaaatcagtgaaatctttgagtgatgataatatacaatttgttggttttgatcccaatttagcaaatgaaacagtagtttggactttgagagagaatacttcaaattatagagattatccatctactgaatctaaatttggttcagagtcaaaattagtagaatctgaaaccgaattaggattcatctcagaatcagggccattaacagggcaaaaaccaaaaacaacaatctcctctgggtcatcaacttggtcactttcatattcggaagagaagacagttagttttattgatgaaaatatcactccatattttaaaatcttaaagaatggtgctaaaattgatgaatatactacaaatttgttccaaggagtaggagaagagaaagataaggaagaagaaagaagagtagaaaaagaaaaagagattgaagaaaaagaaattggaattaatcaacaaggagagttcgagaacgactccatattttctacacttgacaattcttcgggagtccttttatttattcccatgttcttaagtattaacaaaggtgggaattacaaagtttctgtgaatgttaagattttgaatcaatttcaaatgtctaataataaagatttggaagctgaatcagaagaaaaattgattgaattttccggtaatcttatattacatgacttggagcatagcagaccatggtatgtaggagagtgtatcacagtgaatagtataattccaaaaatggactcattacatggttgtgttaactatttagacaaacatggggaacaactggaacacagagtggtaccattatatgatagttcaaatgaaattagtcaattctttttgtcatttgaagttcaaaccaacgattaa

SEQ ID NO: 481 - DNA, 1281 bp, Cryptosporidium hominis
atgaaatatgtagctttgttctgtttaatcattcaaacagtggcagtaatcttctttatgagaatttctcgtattaaaaagtcagaaaatgacgaattatattttaattcttgtgctgtggtaatgtcagaaatcctcaagcttttaagttcattattgatagtattatattctaataattttaatatggttgaattttacaatacattgagatttgaagtatttaactcatttaaaactaatattcttgtaggtgttcctgggctgctctatgttgtccagaataacttactatttattgcattgtcaaatctatcaggagcagtataccatgttacttatcaacttaagatccttgcaacggcaatattatcagttattatattgaataaacaactttcaaaaataagatggttgtctttacttttacttacaattggagcagtactagtacaaacaggaaaatcatcagagtcaaaaactctaaataactcaggtttagttgctgaaaatactgataattttttgggtctttgttcagttttattagcatgctttaccagtggtttggcaggagtttttgttgagaaacttttaaaagatagtaaaaccagtatttggggtagaaatgtacagcttgctttgtatggtataatttttggattaattgggtgccttacaggaaaagaaggattagaaatttctcaaaaaggtttcttttttggattcaacactcttgtttggtttgttattatattacaagctattggaggaatcattgttgctgctgtgcttaaatatgccgataacatcctaaaatgctttggtaattcgtttagtattattatgagttgtattctatcctggtatcttggtgattatagcattacgctaaatttctttgctggttcagttcttgtaatttggtcaatatttatttatggacttgaaagtgcttttccttgctctgaatatcttcttaaacttaaactaattttaaaaagaaattccagaaacaaaattattgctaaatacaagaatcttagagaatctagctcagaagcttcttttgactttaatgaccaaaactctggaaccaggaataatcatctaaacagcttgaataatcaaaataaaagtagcaatatactgagcaatagcaaattcaagaatatcaataactttatcaataagcaaaaccaaaatagagataattatggcgaaattgatgatgttataccaaaaggtcttcaaatggcaatcatttcttctggtgtttaa

SEQ ID NO: 482 - DNA, 1704 bp, Cryptosporidium hominis
atgctagcaaaaccatctcaggatcaatcaattcacggagagcgacaacatgggagtgatgtgaggtcgaataatttgacagcagtaatgtcgatagcaaatatattaaagtcgtcattggggccccaagggttggataagatgcttgttgatgaggtgggcgaagtaatagtaacgaatgatggtgctacaattttaagccaattggaagtaaagcacccagctgggcgagtactagtagatttaagtgagctacaggacaaggaagtgggggatggcacaacatctgtagttttattagctgctgagttactaaggagaggtacatctttagttagcaatgggtctcatccttcaaatgtaatttctggttataagttggctctaaaggagtgtgtgagatatatttctgggtctttatctattaatgagacaattagtgaggaatgttgccttaatgttgctaagactgtgctatcatcaaagctagcgggagcagattcagagttttttgggaagttggtagtagattcaataatgacagtaaaggctacagaccccttaacaggagctgtcaaatatccagtaaaatctttgaacatattaaaaactcatggtaaaggtttatcagagtcatttttggttgagggttatgctctctcccatacaggtagagcttgccagggaatgccaacgtctgtaaaaaatgttaaaattgcatgtatagactttcctttaaaacaatacagaatgcaaatgggaattcgtgttgaattggaagatccaaaagaacttgcaaggattagactggaagagaaggaagtaattcacaaacgtattgaaaagattttggctacaggttgtaatgtagttttgacttcagggggtattgatgatcaatgcatgaaatattttgtctcagctggttgtattgcagttagaagggtggagaaggttgatttaagaagaattgccaaggcaacaggggcaacaatctgccttacaatggcacaattagaggattcagaggaatcatttgacccggcttatcttggagaatgccaagaagtaagagaagaacgtattggagacactgattatatgatgttccttggttgcaagactcatcgagcagcctcaattgtattaagaggagcaaatgaggttctattagatgagcttgagcgctctctaaatgatgctttgtgttcagtatctaagcttttagagtcaaatggatatgttgcaggaggaggagcagtggaggctgctttgagtatttacttagaagactttgctcgcactcttgggtctagagaacagcttgcaattgcggaatttgctgaggcacttttggttattcctaaaactctggcaattaattccgctaaagatgcaacagacttggttgctagacttagagcataccatgcgagcgcccaacaaggacaactcaataactatgctactaaaccaacttcttcggagttaacagtaaaacctcaagatcaagataaatacaaattctttgggcttgatttaattaatggaacagtaagagataatgtccaagcaggagttttggaaccaactatcagcaaacttaagtctttaagatttgcaacagaagctgcaatcacacttctccgtattgatgactacattaaagtaaaaccagtagagaaccaacaaggaaacgagtaa

SEQ ID NO: 483 - DNA, 834 bp, Cryptosporidium hominis
atgagtggttgctcaacagattcaaagaagtctatctgcaaaactgcttccaagagctgtaattcaaagtctagtaagatttcagtaaagaaggaaaccccgaaatcaacttctttatcatcttcaaagtctcgcaaaagctccttgtcaaaatcatcaatagcaacgactaaggcttcaaattcacatcctattaaaaaagagcagggaactgtaaaacctgtagttaagaagacaattagcaagacaagcaaaaagggaggagaaattctgaatcacaagataattaagtcaaagggatcagaagccaaagctatcagtgaaatagttaagaaaggtgcctcatcaagtactaagaaggtcacaaaaagtgaagttgcaaaaaacaagattttggacaatattgttaaggaaatatcaaccggaaataaaaaaaggaaaccagagagtaatttaaaggaaaaaaagatatcgaaggctaatagtaaagaaaagaagtcagcttccactgaaaaggcaacaaagcccaagtcaaagacttcatcatcatcttctaaactaaaaaaactaccagcttcagtaacttctttaacagcaagaaagaattcaatgaaagttgatgcaaagaatggaggtgattcaagcttaagaactcctacaagaacttcaagactttcttactcatcaacaccaatttcatcattgatggctgcaaatgatgctgaatcagatcatggagccactaacggaggagcgattggcgatttaattaggactccagtgcatttggtttcttcagctcttaggaggatgacaaagatcttcaagaattaa

SEQ ID NO: 484 - DNA, 1182 bp, Cryptosporidium hominis
atgaacatcgaactttccaagcctttattaaaaacatacactcagaatcaaataataagtgatactactagtaatcaaagctatgagagccctgatttaagtgaccgaaatgaaacaaaagtatctgacttcatttcatatagtaacagaaatcccccaaatatactaatggaaaatggaaccttaaatataatgcatcactgggatagactcagccaattctttgaattttgtttacacgacagattccatgttatgctttcaatgggttggggaagtcttattttatttatatttctcatatatattctacttgcaattattctagcaataatacattttattattacatttggtgatgctgctaattgtattgggagcgataaatttgggaatatagaatattttttctttgctgttgaaactatgtttagcattggctacggttccccaagatcaccatgttgcttaattaccaactactttactccaattacggttattagtggttgcatcttgaattcagttactgttggaatattctttacaaaattttcagaatcaacttctagaaaatggtcaatttgtttctccaaagaactttgtggaattggatttaaaagtataactcctgaagaagtacttgaagtacctaatcaatcaaacttaccacctgtcacttcatatgcctttactaaggcagctgaaactacctgtgagaattgtccattcattatttcattcagactttttaatatctctcaagaaccatttttttcgcctgatcttaaaattttcattcttatccacggtgacaacgggccatatatcacagaaatttcatcatacaaacttgatgttcctctagaatttatggaaactcctatcactgtttcgatatactcaaaccagcctgactcccctcttaaaaactttactattaatcatcttagaaatcaaggccatctcattgaactcatgatattactacgtttctctgataacagaacatcaaagaatttggaggtcaggaagacctggaggcttaataatgtcttctggggatataaattttcttctattattaagaaacaagtttatcatggcggaactatgtacaaagtcggaatttcagatctcgataacattgagccggttatctccggtactccatttctctaa

SEQ ID NO: 485 - DNA, 921 bp, Cryptosporidium hominis
atggatgctctggaaaccaaaaagatagcttctgttttaaaagcccaagcagagaagactccattctcattattggttagtcctggagataactttcctggtggaattgatttcaaacattgttttgagaatatttactcagaaaaatctctccagattccattatttgcagcaatgggtcaagctgattgggataatgggaatgctaacttactattgaagagaaataatgtaacttatgatagcaataatgatattttcccaagatttagtttcccaaattacttttatcattatgtttcacactatactgatacttcaaatgtgttatctagaagagatggcactgttttatttgtattcattgatacttttattctttccagttctttcccagaccacaaagtttctgaacaagccttccaaaatttgaatgcaactttacactatggtcataaacatcatgatttcactgttgtagttggaaacaaatacttggcttcttcatattcaatcgattcttcgttaaagaaggttcaacaactcattttggatactcatgttgagcttgtaattagtggtcaaaataggggtacatacaattcaactattgaaggtactactttcttgaactgtgattcttattgctcatttaaggttgatggtagcaagatggttccatatatcattcaaaatggtaatcaggttgaattatcaccaattaatactcaattaccatctccatctttatcattccaaggtattgctggcgatgaattgcctgctttagagatgattgaattaacattcaagaagggagctaaacatttatcacgcgaagctttccttaagatcgttggaactgtgggattaatgatcttagcaacttgtataggttcattgattattaacagaaagtaa

SEQ ID NO: 486 - DNA, 255 bp, Cryptosporidium hominis
atgaagaataaaaataataaaaaaagaatcctggttgagaaggaaaaaaattatcatgagaaggcaaactttgagatttggaaaacagatggaatttatagaaacgaaaacgatagaagttttatatttggaaataggaaaatgtcaaatatgaaaaaaatgcaaatcgattattacccctataatgagaagtcaaaaattgagaatgaaatgagaggaaatgctgtaattaaaactagaaaagaacggaattaa

SEQ ID NO: 487 - DNA, 1029 bp, Cryptosporidium hominis
atgaatagaagtaatttagaacgtgattttcgtgaattaataaataacaagacattcaaccttgaaaatgaaatcattgaattaaatacaaatcttttaaaagaaattaaatctgttaaaaacgaaagttcaacaatattcaaaaattttaatcgttcactgaatgatattttaacgaaagagaagaatcaaattatttataataataatcatccagagattgaaagccaaatacaattaattattaaaaatctaacagagcacgagagattttatttgaaattaagaaatgatttggaaaatatttcggaagaagttaagttaattgacgaggcacaagatgttttaaggagtttgatttggtcaatgaataaaagaaatgaagaattatcaacttttaattcagaaaatacaatagaaaattctcagcttgaagctttacaaggtcaaaggccagaaattgaagtttatcttaaaaaattacttgggacaaaattggaaatgcaaggttataatcaaattgactgggcacaatctagtatgggaggaaaagtattaaatccgaaaagtaataaattctgtaagacaaacaaagataataataatagtaattcaataatcattaagagtttgagatactttcaagatcagctttttaagtttttgattcgaaaaaaccatagaagaacaacattaaaagttcccatctataattctgagtgttttgagcccaatcaacttatcaaatcaaatcaagaaaaaactattggaaattgtttacttgctgaagttggtactaatattgatatacaattatccgttttaattaatgtaacatcagtgggaatagatcatattttatttcccttgcaatatgataatggagaaactgtcccaagaaaattttctgttaaatgtataaaagggagctcaattgaggaatacgaatatggtcattttatgtatcactatcctcaaaataatcaaggtcttgaaatttttcaggttaattcaaattcatttatgtaa

SEQ ID NO: 488 - DNA, 1329 bp, Cryptosporidium hominis
atggttaaatatgaaaagagtattttaacaattatttttaatataataatctttttatatttactttcaagctttaatataataagatgtaatggtgaaaaaatggctcattttgagctgaattcagtggaaacgatttcaagaagcctaaaaaataccatttttgtggataatcttgaaaaagttaattttccattagcaaatgatggattttcaccaggtccaaaagtttacatattaaaagaattacttcaaaatcgtagagaagttaagaaattgtataaaattctgagaaaaatgcttataaagttttatattgaagaatttggaattattcttacttatcatatgtctcaaattgaagaaataaagttaatgggaattgatacaaatggttactttagattgataaaccatcaacaaaaaccaataaagaagaaacttccaaaattaagtaaaaaaatgatcaagaagagtcaatttgcaaaaacaaatactctggaagactttggattaatgaccaaagattcggatgcaaaaaataaacaagatgaacattccacttttattgaaaatgaagcatctcagattgaattcttgagcgctagacctatttcatttctcaaaatgaagaactcaaatacaaatattgattctttcggaaataaaagaagtcttaagaaattgcatatgattaactccaaagttaataaacaagttgctttttgtaaatgtaaatctgatcataaattgcacttaaaacttattatgattgctcaatcccttttatttgttattaataatgcaattgatacaaatagtactccttggtactcaatgccggactttattgcattgcttctagaggatattctaaaaattaccagtataatgaaatttataggaccaaattttaaacaatttaaaagcattaaagaatattataaatattccaaaaagcatattaaaaagagccaaaaaaaacatttcttgaaattctttagtgatagaaggaataactatcaaacaaattttttacttcaaatacttggaattactatcagtttctttggaaatatatttaattcttttattgaagactttagaaatagtcactctgtttcggatttagcaacccagattgaaatctcgaatgcaaatgatcttaaaaagaaaaattccatgattaaaatctcaaaacaagatattatttttattagtgaatatattgaaagactcccaaataaaaataactgtattatttacccaatgattgaaaatatttcagttagtgcaccaaatcaaaaatccatattttcattatgttag

SEQ ID NO: 489 - DNA, 762 bp, Cryptosporidium hominis
atgatgcaaagtatgagaagatatatagtcctaggcctattttatttttgtatgggagaaagtttgagcgaaattcctactcaatattccaaaaattccaatattttttttcaagtaattccaatctctgctcttttatcacgttctatgggaacttactctttttgtaaatcaattatatatgactcaaaaaatacacgtaatcttgtgcatgtttttggcgccataactgcatgtattttgacattttttgtatatatattaggaatatatataagccatgaatcattaattgatggagtgaggatgatattaagtcagagtttggttggtggggggttggaaaaggactttttgagaatatgtatttacttggaattatttgttcagagtatattattatcagaatgtgtaatacgtaggggaaaaagtgtatatgcttcctttgcttcaagaatatctcctatattgggttctcttttaatgattatttctttagtattgagatgtttacatttggagactaaaatggtcccttattatattccatatttggaaatatgtccatatgtttggggtttgtttatatttattcattgtatagctttttatattcgatatgatgatcaaggcgataatagtagagatgaagaaaatattgtttatatgaataataaagttggcgaacagattaattctaagcaaaattataataatagagttagttctgaatctgtaactatacagaaaaagaatcaataa

SEQ ID NO: 490 - DNA, 690 bp, Cryptosporidium hominis
atggaccaaggaggtgaattagaaacacaggaaaagggaggaatttcttcagcaaaggagttgttggtagagaacaaggatgatggaacaattaatttagatacttccaacttattagaagagaataagaagttgaaagatagaataaaagaattagaacagaaacattatgtggataatatacaagatgaaggacaggaagagaggagaaatcaggtatcaatattaacagaacaattagttcatgagagaaatgaaaatgagagattacatgagaatttgaatggattacaggagttattagtaaagagtaaacaagagttattggaatttcagcaaagagtttatgattcagagattatttcatctagaagtcaacatgaaagtaagattttagaacaagaaaagaatactttacaagaatctttgaagaagtatcaagaggaagctgggattatggagtctaggatgaaagaacttcatgcttctaagaataacattatattagaatcaacaaagaagattagtagtttagaggtctcatgtagagattttgaacataagattactttaatacaaaaaagtagggatgaattagaaatggaatattccaagacttgtgacgaacttagaagagtaaaatctgaattagatttttgcaaaggtcatgatgttgggaaggttatatga

SEQ ID NO: 491 - DNA, 2910 bp, Cryptosporidium hominis
atggaatctaaacttaaagatttacagaatgaaaaagagaatcttgagaaacttttagctcagatgcaaaaggatgaagaaatacaagaaaaaaagagtagaaagagtatatcagcttcaccaataggagaattaattaatttatcattatcttcttcagaatatccagaaagaagaatttctacaagaaatagtattcattcatctagtgataataaaatagatttgaatgattcagatgaaggatttaaagatcattcaggtatcgataatgatgaggtatctaaattacgtgtacaattagaagaaagtaggaaattacaaaattactggaaagaattggtacaatcagtagagaaacaattagagacaaagacaagagatttggatgaattgaagataatagaggagaatttgaaaggggagttagaatcaagaagagaggaagcaaaacaaatggaagaggagagtcaaaaagagctgactagattgaatgagagtatatcagcaatgactttaaggatatcatcaatagatgaagagatagcaaagagggaagcagttttaagagataatttatcacaagtaacagaggagaatataatacttaagaaagagacggatgaattaaggcgtatggaacaagatttaaggggtcagtaccaaaatatagtaaggatgcatagtttggatatagagagacttcaaaatatgaataagcaatgtatggaattaaaggaggaattaagtaatttacaagataaatcaaagaaatcaaatgatgagagtacaaatttggtaatggagatgcagaatgatatagttaatttgagacgtcaattagaatcttatattaaaaagtatgagatagcaaagacagattatcagaatttgagggatatgatgaataagattaagactgagaatcaacttccaagtaatttggagaatatgttggatatggcaatggtttcatcttcattaatagatggtgttgatattattgaaggtaacgataaagtatctgatgagagaaggttatcaatacaatcatcagtgaatggagtacttggaagttcaggaggaggttcaacatcttcatcctcatcctcatcatcatcatcatcatcagtaacagcttctttattattgatgagaaaagtacaaacattgacaagttctgtggaagagttggatgcaaaattggatgagtcaaagatagagattcagcgtttaaaatttgaaaggaaatctttgcgtgaagagaatgaggttttacagaaaagattaagtgaggaattagagagagcatctgaatttgcatcaaaagctgaagcaaatgagagtactttgattcgtcttggggagttggtaacattaagagaatcaaatgatagattgagacgagaattaatacaagcaacagagagacatagtaatttggagaagcaattagagcaagaatcaagacaaagtgatcctttgagatgtgagatttctaagcttggagcccaagtagagagtttaaaatctctttgtgaggagaaatcagcattgagcaaatcttgggaggagcagtataatcgagttttgttgaattatgaaaatatgaatccaaatgagattactcagatgaaggaagagataagtaagcttaagactcagaatgaggagttgcgtgattctttaggaataaaggcccaggagatagagaaattacagacagagaaacaacaagaacatgtaagtaatgaagaacttcagttaactaaacagcagatggaacagttgaggaaggtttatatgagtactaatcagaaactgaaagaggaaaggaataagtgcactcgtttggagaatgacttgaagagactcagttcccaagttcaggctcaaaatcagaatcagagtcagactcagagtcagcctcaaactcagactcaaccacaaatccatatgggcggtatgggtttgaattccagttcaagtaattcacaggatggtagcaatagtaacaataatggcaatagcacaagtagtggtaatagcagtagttctttgaattgtaagcctactgctcaggagattaagagcatttcacaagcaacagaaaatttggttgacacagttttgaagttagcaaaactctccatcttgaggatcgagtctgaaggaggaggaggagggggaacgggagcgggaggagggggaacgggagcgggaggaggaacaggaacaggaatgggaacgggaggaggaggtggctcgtcatctttggttgctacatcctcagtgaactctataaatccttccgaaagtgttggtactgaaggcaattcgggtggagttactggagataatgctgcatttggtatttttacaacttctaataatactattgctacatttacaactacgtcttcctctttagttgattcttctactactactactaataataataataacaataacacagtagcttcaagtaacaacttgccaagcattgtaggcttttcaggagtatcagggcaaagctcaagtgaaataatgacaacttcagcaatgaccttgcaacctcttcatccgccacctccaccacctccaccaccaccaccaccacctccaccacatacactacctcatttgagtcaatcccaaaattctatctcaagtcaaaattcaatggagatacaatcttgcacttcaggaagtggttctattctatgcgaaaattcctctgattcattaaaacaacaaagagttcaagatgacttggctggcatttcttccattcccgcacaaaaaaaaagaccattaataggggaaaatactgaagtaaacgaaacaagtaaaaacattcaagaaaattctcaaaataacagtaacacgaatatacaaatcatataa

SEQ ID NO: 492 - DNA, 3441 bp, Cryptosporidium hominis
atgacgaataaaccaaacgtaagaatttccgagtctggcttggagattgtaaaattctctaaaggaatacaagtccaagcaagaaataatagaggtactagatatttgaattacaaactattaattcgaaaaatacgttgggtttctgagcaagagtctcaagagaattggactgaagctcaaagatatgatttaatatttaaggatatactactgcgagatatgaacagaatggacgcaatgtataatcgagatatcaattatattagggacttattatgcatcttgtctagagacatttggagcctattattatcttgtcatcaaaattttggtcaaatgaatgtttttcatggagatcattttaatgagagtattggaaatgttaatcataataataataataataataattgtaatggtaatacatcattcatgttcttttcatctctttcaaatatagtaaatcctggtatagaaatatcagtacatgataagcgagtcatagaatggctatacaacttattagaatgttgtggcaaactcgcaaaattaagatcttatattatttggaatagtattgccgtaataaaagtactaaaaaaaagaagaaaaaaagtttcaatcaatagacatataaaaaatccattggatgcttattctttgttaaactctcacgaattttacaaaagtattactttggattacttgaataagaatttaagaaatctaatgcttaaagtgtttagaaaagatatgttttctgattattgtcagaaatgtaaaaaaaaaaccagtgaacctattaaaagtatatgtaatcatatactatgttggaaatgcattattaatgtggatgagatattttatttggattcaaatacatcaaaaaacgattttaatttgaaccctagtaataatagtaatagtaatgcattacaatctccttcaataatttcgaaacaatatgattatgaaacaggtggattattaaatgtttcagatcaaacaaccgtatcaaattccgtgaattgttgttccccatattcttttaagaagataaagaatcgtccatttaagaattgtccaatttgccatacaaagtggagtagaaatccagaatctcttcaagtagaaaataaatttgttaaattatgtattcaacattatttaaatacaaaatcattaacagggattttagatatagatactgtaattcagtcatcagtgagtaatgttggttttatttcttctgatgatgaaaccgaggatgaattcaatatggaggaagaatcaggaatccaagattttgatttgaattctatttccgaacataacgtgaacaatggcagtgacaataataatgatggctttttagattctatatatgattttaatatcagtacctcagataccgatattaatatgggatttattaataataataataataacaaaagtattaacaataatatttttggtatgttatcatgtcgtccatattcttcatcaatttccactataacttcgtctaaccaaagtttagatgatggtttaagtagttccggggggaatttgtctgcttcaacatcaaattccaatatgaattcaaacccatctttttcatcgttttcagcgtcaaacaactcggtggtggagatgggtggctttgagagcagtggtggtggcgatgttggttgtggtggtgatgttggtggtggtagtagtggtgttagtagtggtgttaatgttggtgttggtgttggtggtgttggtattggtggtggagttggtagtagtagtaataatagcattagtggtagtagtggtataccaagtccgcctccacttccagtaagctgtaataatagctactcaagatctttgaattccaataatttagttcagaaaatgtcacatagttttttacaaggacaagaagcggagtttagtcgacttggatttggttttgatattggtcttggtcttggtcctggtcctggtcctggtcctgatcatgatcatgatcatgatcctgatcatggttccagttttaatgggacaatagaggaaggagagagaagagcaggagtaggagtaggagaggaagaagaagaagaagaagaagtaataatgggaggaataagaggagaattcagagctagtaatatgaatactagagtcatgaaatcttcttcatcaggtatggatgtttcttctttttcaggtttaggacaaaaatctttcaagaacttagataagagtgttatggatatatcttcacaacaacgtaaacataattctatgcagaatcgtcttttaggaggaggatgcatccaaacaagagaaaatgaattttattctggaagattaggaggtactttttcaaatggtagattaaatggtaataataatattaatcatacaaaaaacttaattggatataataacaaagaaggtaactttttaaattttgatggaataagaagatcaggaatgggaatgatagatgttggtagattccaaaattatcaatcttcatcaaaaaaaactcaccaaaataacaatcactttaatggctttgttagtaataataattattataataatagttattttaatagtaacggtaacggtaatggcaatggcaatggtattggtaataatggataccatggatggtctcataaccaatatggacaaggccaaaatgctaatcgtaatgtaaataataatcatcaatatttacattttgctcaacaaagtttaatatctaatcaaagttgttttactggtaataatacttcaccatttcaaacatcttggagttcaaatatgaataatcgtcgtaataataataataatactaattatatgaatggtattcaaaatatgtcatctttatatacagatcattctaatagtattaataattttgatatgataaattcaaactacgattattctgggcttcattatagtggtagtgttagtcaacataatggtaataataataataaatcattgttatcatcttcatcatcttcaataaaaagtatgtattctcaaaataatggtgaaatccatacatttccgtcaaatttacacaataataacattatttggtcaaatagtggtggtaattatcgtcgaaaatcaatgaataataataataataataataatgatagtagtaataataaaaataataacaatagtaataatagcaataacaacaatactaatactaatgataataatgatttacaaaagatatcatcttgtaattggaatccttttacaagtgatcatttaattggaaatggtgaatttttacaagaatatttttccaataaaaataacaaaaatcataatttcagtgaagaaattgtttcttctgattcaaaattacttgatttattcagaggccttggtgtttaa

SEQ ID NO: 493 - DNA, 1092 bp, Cryptosporidium hominis
atggatgagaacaaggataagagcaagaccaaggacaagaacaaggaaaaggacatggataaaggtaaagttgttttgaatcaggtagttcctaggaatttaacaaagattcgactaaagaattgtattccagtagaatcaataatggagttgaggtataacaaggcagaacaagaaggaatatggaataatagaaaaggagtttgtatacattttggtggaagatttaataaaaaaaaagtgaatagagatgaaaagaagtttcttcctaatgaagatataactcaaattattcataaaaatgaaagtggagtttctgagttaaaaaataccgaaaatgatcaaaatagtaatcgttgttttaactttaagaagcatctctttaatcaattacaagttataggacaatttaacaaaggatttatcttgacaaaactttctattaaagaagaacaaaattatataaatcataagaataatgaaagaaatgggaaaaatatgatagaatcattacatatatttataatagatcaacatgcatctgatgaaaaggctcgatttgagaagttaaatagtgatttaagtaatatccaaactcaaaaacttatttctccactttctatatctttaactccgtctcaagaacaattagtaattagttataaagatatctttgagcaaaatggattcagatttatatttaatagtaatagtgaaattggatccagaattcaacttactcaattaccagtaattcttggtattccattgaaacaaattgatttcttggatttactttcccaaattaataaatataaagtgagagtatctattattgatgattccaagtcaaaagttttagatcttccaacacagatttcctctaacattagtgtagaatgtaggcaaaataaacgactaatggagaagagaaccaacgaagaattagatgaaaaagaagaagaagaagagaaagaagactcaatttcagtctcaactggagaccaagaaaatactaatgtcacattatggtgtccatcaggtattgttccaagaccaagaaggatttggtcaatacttgcttccaagtaa

SEQ ID NO: 494 - DNA, 810 bp, Cryptosporidium hominis
atgaatggagaattgaataaaacccaatataatacaaatataaaaacaaagaatgcagattattttgaccaaatggagaatatttcaggatcaaatgtaagaggacgcttgacttactctgatttacatgtaaaggatagcttttcgcatgtatatagtaataataatattaccagatgttcatcaaattatagagaagaaaactttgacagagattctggtagcaacatggtaattcttaatgtatatgatttagatgcaattagtggaagtattaatagatttacaagagtattcgaattgggagcttttcatgcaggaattgaaatttatggagtagaatactgttttggatcaactagtgatggaagtagtggcatcacagtaaatcttccaagaaggcatccaatacatatctatagagaaagtgttaaaatgggtagaactaactattctaggggagaaattaagagaattattaacgaaatgaaacctttatggcttggttcagattataatatattcaggagaaattgtttaacttttgctgacgaactttgtatggtcctaaatgttggacaaattccaaattatgtcaaacttctccctgaacttctttgtcaagctggagatggactcgacaaagtcaccaaacatatttcaacaatttttgaccgtattgcctctaactgttctaatcttgcaatcgttgaaagcgaacaagaagaaaaaaatgatcaatcaacgactaattcctcaggaatgtcacccaaaaaatttccttttggaattaaaaatccccttttataa

SEQ ID NO: 495 - DNA, 936 bp, Cryptosporidium hominis
atgcaaatagctgtagataaaagcattacaagtgttacaaatctatgttattcaagagaattaattctaaatggaattgggaatttgtttcctcaagaagctatagaatatggaagcttaatgaattctatggaatgtatgggtggtttaacaacagctagagaacattttaacgtagattgcgatcaggtaaagatcttgatccaggaaatggttttgagtgtaaatagcatccaaaagcgtctggtaaagaggagaatcgcatactctgagagaattcactatgaaaagaaattaaagaagcgacaacaaagaatgaattctggaaaaagtatttccttaaacgataacgtcaaattggacagaacccaaagaaaatgcggagatgctttggatgagttcactagaattgatgatgacgtacaacaagaactccaacaatttttaacaagaagtcatgaaatatcactaaacattatctccaaatataactacgcagtcgggagcttcttctcttttgtttactctcattatgataatatggtcaatggagaaattccaactaataatctaatgatacctgaccagccacaagtatcaatcaccaattctaattccacgccaaatgcagatttagtggtttctccaggtaaggtctctggaacagccatgaactcagcgacatccgtatcaacttcttcttcaaaccaagtacaatcaacaccaaatctccgtcaaactggaaatacctcaatgggtactattaactctcaaaaaatggacagctcagaaacattaactagaccagcatccacatctacacttaaaaaatcagactcagggtgcttctctggagtggagtttgcttcaaggagaaatacaaagagtatgcatcaaaatagctcctctatggaaattaacttaaataaagcctaa

SEQ ID NO: 496 - DNA, 1224 bp, Cryptosporidium hominis
atgattgaaataccaataaagtcaatagtatgtgttgagattcctggtagagtggagaacttggacaatgcaatatttgctttaggaggtatggaaggtattgaggagtcaataaactcaaaagcaccaatgaaactattgttttgtagagaagacccgtataaccgtcctatttactcagatttcatgaaaagaacaggagtccttctacgaaagttgaagtatgcaaatgggaggatagagtggagagtaataggtgatgtttctcttgttcaccaatttatccaaatggctgacttttattttattcctccgccaggatttagagataagaagacaattcacgaggagattaacgaagaaattgttggaacaccatttatccctccagcggtattttcaaaagtgactcatcctgtaaatatcaagtggataagtactaatgacaattttgataaatcaacaaatatcaataatattgcatctagtatagcaggagacacggcagggactccctcagcattggatgttcaggtagaatctggaggaaacgaagtagaaatgatggatataacagaagaacaggaagaacaaatgaaaagcgaggggcaacagtattggaatgtagtatttaaatattcagacagcatagttccaagcatgccgttaaaaatatcttctagtataaatctggacaaacaagcactaggcacattaaaagaattatttgaggagcagccattgtggctaaggccagtgatagaatctaaaatctctccagaaatctcaacttggaagagaaaattattgtttacacaggtctgctataatattagtgacgggccatggagagcatgtctttgtagattaggttacgatccaagaaaagatccagagtcaaggatataccaaactttggattttagggacccatatctcagaaaggttctgaaagaaaaaaggatcgggatcaatgttaaagttgaagaagatttgggagaaaccatcttagactggcagttcaaagtacctccaaaaagggggtcccaactatatcagctttccaatatagaagataatcacattaaaaaaatattaaaagaggccgttcctttggaatcatgtacaagggaatcaggttggcttaaaaagtcggtaattgaccaaatcagagagttactttcacttaaatgcgaacagatgagacaattggagaataactaa

SEQ ID NO: 497 - DNA, 345 bp, Cryptosporidium hominis
  misc_feature (266)..(266): n is a, c, g, or t
  misc_feature (268)..(269): n is a, c, g, or t
  misc_feature (274)..(275): n is a, c, g, or t
  misc_feature (277)..(277): n is a, c, g, or t
atgattgaaataccaataaagtcaatagtatgtgttgagattcctggtagagtggagaacttggacaatgcaatatttgctttaggaggtatggaaggtattgaggagtcaataaactcaaaagcaccaatgaaactattgttttgtagagaagacccgtataaccgtcctatttactcagatttcatgaaaagaacaggagtccttctacgaaagttgaagtatgcaaatgggaggatagagtggagagtaataggtgatgtttntnnttttnntntttttgttttttgtttgtttgtgtttgttttggttgtgttggtgtttttttttttttgttggttttga

SEQ ID NO: 498 - DNA, 270 bp, Cryptosporidium hominis
atgagtgagaagaaagcagtaataaaaaatgcagatatgtccgatgaaatgcaacaagatgctatttcatgtgcagctgcagctattgaacgacacaatgtggaaaaagatatagcagcatatataaagaaggagtttgacagaaagtataatccaacatggcactgcgttgttggtcgtaattttggatcttatgtgacacacgaaacaagacattttatttacttttatatgggtcaaattgctgtgctattattcaaatcaggataa

SEQ ID NO: 499 - DNA, 1269 bp, Cryptosporidium hominis
atgcagagctattttctttcagagtgtcctgaggaaccaattggttcaatagatgttataacaagccacaataggcaagaaatacttggtcagaatgagggttgccttttggcactgacttgctggaacaagagtgtgaagttttacgaccctcagataccttatggggcgagcttaaatgataattttaagtataacccttccaacgagccaatagaacgctctgatgaattgcaaaatacttcaacctcagtacaaaatacaaagtatatatctacgggaaagtgtttacaaagtcttcagtgcgagtatatttatcttgcatgcaaatttaaaaatgattcaaccatattttttggagggtttaacgaagctgtagatattattaatttgcaagattctctctacagtccgagaaagttagtaggacacttggctcccgtaagatgtctttctttattggaaaacagttcaatactggctagtggggattggaatggagaggttttattaacctgtgttaatgaaggcagttttggctctcgaatatctaaaatctcccttcctggtaaggtattttgtatggattattcatacaatgaagaatggctcttggtaggagattctttaaaaaatatgaacttaattaatctgaaaaaactctcatctggtatagagacaacaaccccaactgaagttgtccccaatttcatgaaatatcaactacgcaatatctgtgcaaacaaacacaaagatgtgtttgccacaagctctatagaaggaagagtacaaatcacaagtgtagaaagggctttaaggggagaggtcaatagtaaagaaagtcctaaagataattatgcatttaagtgccacagaaccaaagataactctattatgactgaaactatctatcccgtcaatagcgtgtgttttcatcctcaatttgcaaatgttttagctacaggaggaagcgatgcaagtgtttttctttgggatacaaatgcaaagaaacgactttggaggaactcaaacttccagttagttgactctgataaaaatcttatcagagtatgcaacgaaagtatatcatccttgaaatttcatccaactcttccttatttaatttcctcgtgctgtgatactttcgaccagtcctgcagaatcagctccgaaactagagaccaggccaatgatgggtctaactccattccagttcagaggtcttccatcatattccactctgttcatggagtcaaacccttagaatag

SEQ ID NO: 500 - DNA, 1011 bp, Cryptosporidium hominis
atggaagaagctcaggaattatttagaaaggcggagaaggcagggaaaggctccacaggattcttttcttcattattatcagtgggcccagactacgatgaagcaatacagttatattctgaagcaggaaataagttcaagattttaaaggcatggatggatggttgtgaatgctttagtagggcagcagagctttctctgaaacagaatgatctggtaactgcttctaattattacacagagtgcggaaatataatgaagaggtctgatttgcaaaaggctatcccatactttttgaaagcagtagaactttacaacaagaatgggaggtttagccagagtggaaagctctataagaatatcgcagagtcacttgaaagtgattttcaatatgtagagtgttgtgaattctataagaaggctgctgacatgtttgacatggatgaatacagcaagacagcttactcatcttgcattctaaagtatgcagataacttttccctctctattaatgatgaatattctaaccattcaatttccaagactgagaaagcagctctaggaaataacagccttttagaggctgttgagatatatgagaaagaggcaaaaaaagctctaagtaactccttgattaagtataatgcaaaggagtatttgtttaaggcttttttgattattctttctttggaagataatgtggacgctcaaattaaatgggaaaagtactcatcaatcgaccagagtttttgtacatctcctcaaggaaagctttgtcgctctattctggatataatggaaagaaggcaaaactcggttggtgaagagaatgacgatttaaataagaatagatttgttgaggagtttacgagtctgattgaagaatataataacatatatccagtagacgattggaaggtccatttcctttctattattaaaaagaacttatcgagaatagctatgaatctcatagaaaaggcagaaaataatgaatttgacttaacttag

SEQ ID NO: 501 - DNA, 1353 bp, Cryptosporidium hominis
atgaaagccaaaaacgtgcaagaagagctttcttcattagatgctttctcatcagtttcacataatgtgactccaaatcctggtaatcctttagatattgacgtggtattcaaacttagggagaacaagaaaagatttacattgggaagtacaattaacaaacgaggaaaaataggtttcgaagcttcagcatttttcccaaacttatttggaacattaagtacgagcaaatttagtattgcgacttttggaaccagttctagagagctaagtataagccattttaccccaaatatattttctacaaatattgatatggtatataatctttcaaagtcaatagtagattacaataaaagttcatcgtatacagaaaactcttttggaggtttagttaggttttctggcccgaataatcatcacaaccttacagtcgaatctagaatcagagaatttcccagattggtgcatgaacaaattggggaaagactacaagattgcgatactgacagttcaaatcgattttttggtcaaagtattcaaactcttaaaaacagtatatgttattcatggaacaaaattaaaagcaatcattataatgaaaaggatgaggattcatctgaagctggaactgagaaacgttctaatgctttctacaaaattaatagcaaccatactattaaacagcttagcgttgagctcgcaggatttaacggagatgtaagttttattaagacacaaggcttctatacatggagctccaagctctccaggaatagatatggcttcaatttcttgaaaaatccaagtctagatttttgccttgggtttggcgctctgctaccaaatttcatcaataactctatatttaaagcttccatgcatgacaaattctttttgggcggcaactgtggggctcactattgcttgccaggtttcgcgccaagatcagtcggaccatgcacatatattacaagagcacagggaaaagaggaagattccaagatagttgagaatagagagaatgtgtacttaggaggggactcatttattgtgtcagaggcgaggatctctcatcctctagacctaagtggaatggggacagatgtaaagccggatgtacaggcttttgtaggtagtgcaatagttcttgacagaaatgacaatagggaaaagcgatcagtattggaaaaatttagacaaaatattagggtgacaactggaattggactttctgttccgttaggtcctgccgacttaagtttgctgttctcagccccaataaagtatcggagtacagatacgcttgagggattccaactaggtatgagaatgacttatgctccgctatag

SEQ ID NO: 502 - DNA, 1101 bp, Cryptosporidium hominis
atgtcagttacaacagcatccaagccacagtatgacgcttttagagatgaatattctttttctgaaggactttcatttgactcttttatattagtaaacgacccaagatgcaaaaagccaccacaaagaatagttaaagaggaggctctctctcctattcagctttttttacgaccttttatgcaatgttgcgctccaagatctagaagtggaaaaaaaattaaaatcaatatctcatcatattctacaactacaaggactagcattgcaagtattgaaatagcaaataaatttggaattaatgaaaacgaaacggaaaatgtggaaactctctcaaaacaaagtaaaagcattatgtggtatattttggtcccctatgaatatggaataccaattatcactgaaacacaaagacaatttgcctgcttattatggggtattaagaacgaatatggattagttactacagaaaaaagtattcaaaaaatattcgaagcggcaaaagaaagaagagagacttctgatataattaaagagtataagtcaaatcctgatttacaaatcatgaagttacatagggatggactttctgttacagttgatgaagcatttaatgaaattctaagttattattcaccaaaatattccattcttgcaatcatttcaagaggaaggtgctttgcattttactctcaagcaagcgaagataaaaccaatgttacatatttattatttgatgcatcttcaaagtacgaaacaggtccaagagtttttggattcaaagatattaaaagccttagggagcatgtaattagtgaatttagtcatgatcatgaaacaagattaaaggtttcagaaggatttagagtcacagtatttcagggtagagtaatgtggaataccgaatttgatatgcctaatacaattgtaaagaaagatttcaaggagaagaatgaagctatgatcaggttaggaaggcttaatgatcccaaatttgatgctaaagtcgtttatggagaacttcaaaaagctactacaagacctactgatcaagattacttctttacgtaccaaaataatatgatgaagattacgaaatag

SEQ ID NO: 503 - DNA, 3744 bp, Cryptosporidium hominis
atgagtgctactcagggaaaagcagaatatggaaaaaagagagtgagtactattattaaggctttggcatggattgcaatagtgtgtctagttaaaaatgcaagctcagagggattatctggagagaaaaggcatgtttctaaggactactgtagagcagttccattagatggatttgcagattttgctgaatgcgcacctccaagcaatgaagcagaatacactattgaagtggtcccagtagtcgcatctggaatcgatttaagaagtgaggtagatatagttttatatggaggtgatgatacacagacatccccaattccaatttcatcgtcaataacaggtactgttagatctttaagcacaaaacaattggatattggagctccacagcaagtcggaatattcttaaagagtaatacaaggtggaagtgtttaaagattactgttgttaaagattatagatattgggtattctcatgtaatggagaacttactcctcaacaccgttcattgacttttggagttactggaaataaattatatactgcaagcattatgacaggaaaaagtggtgaagcaggaacaaaaggtggagtagaaattagcatttcaggagaagctggtcaaagtgataagattttactcaaacaaggattttactcttcaactttgaggaggatgcttttcagagctgcagatgttggaaagattaaggaaattagtttaacaaatacagctttagatgacccgtggtactgcgagtatgttagaattcagtccgaagatggtgaaagtatcgactttaccgttagaagatggattggaaagccattctctcagatggtaacactaacaaacagtatatctgggtcagaaaactctcctgctcaagatattgactgcaataccagagcaattgatattgtcccaagagctccagttactacaattacttttaaagtcaaatgtccagtaaattgtggttcagaaaagtttgcaaccatttatggtacaggaattcatgcagcttcatcttcaatctgtaaatctgcagtattcgacaatattctaactccttcaggaggagagttagtactaacaatagtcccaagtttaccaaaatattttggtggaaagggtgcattctctatagaatcttcagatttcttcccaaagcctggaagtgaaatttttagcttctatacatatttgagtgactctattgactttatacagtctgaagtcagagtcgttgattctacaggtaacttggcatcttctggtaggcttgaagtcagaagaaatggtatttggggaagcgtttcattaaagggagaatctactgtaactaatgaacttgctgctacgcttgcatgcaaacaattaggttactcatttggatccatccttccttcttgcacatatgttaatggaggtaatgtttgtactccaaaaggatacccaatctctgttgctggattacaatgtaatggaaatgaaatcgatattgctcagtgtatgttcgaggaaccaaagactactaatagcatgacaactgttgctatacagtgtagttcaattgctccaaaagatacgatgcatggggctctcagaattgttgattccactggtgtaccttcaagaacaggagcaggaagattacaagtttatatggatggatggggatcagtatgtagtgatggttttaatagtgtttctgaaagagttgcatgtacacaaatgggatactctggagttaaaaatggaggagcttcaactaaaagttgtaaagactttggaggcgaagatgtatgcggaagtgaacaagaacaaattcttatggtagatgttgcatgtaagggtgacgaagaaaagcttgtcaactgtcagcactactcatcaaataatatttactgtgtacatgaggaagatgttgttgtaagctgctcaggatcaggtgacccaacaggtaatggtgcctatttatctgaaaagtctccctcaatcttgccatctattccatataataagtaccaatttgactgtaatgacagtcctgtaagtattaaaggtgctgtaggtacaggtgcaatcattgcatgtccatcaaaatgttctaaagcatcttctcacattaagggaagctatatctactctgacgatactcctgtatgtaaggctgccattcatgcaggtattatcactgatgaagttggaggagaagttgttattacctttgtatcgggtcagaaacagtactttggaagctttaataatggaattcaaagtagaagtattgaaacaagtgcctctaaatcaaagattagaggctcagatttagcttctataaggtccttcactatttcgaagctttcagcaacaattaacagaaaagaaaatgatttcagtcaacaaattgttaatgaagagcttccagctatttctcccccagtattatcatgggtctgcccaacagactatcctggattcagaggtggaaagaatgactttattgatgccactaacttaccaggaggtgatagaatcagctctctagatgattttactatctctgctagagttctcattactggtggacaaggtacctggagaactattatggcacatactgaatgcttgggtatatcattatatattgatagagacaacactattcattttgatcaattatgtaattctgatactgtctcaacttcatatgcaccagctattaatgaatggttattcttaactgttgcatacaactttaatgaaaagagagttgtaatgtatataaatggtaacgaagttgctaataaggtaacaggttttgttttcaatctcaagactaagctaataattggaagaagttcagattctgacagtgaatacttcttgggccaaatttccaatgttaatatatgggataaattcttcactccaagtgaggtcaaatctgctatggagaaatcttggcatcaaaaaggaatatctggtggtggagagcttaaaggtaaaagacatacaattgatggaagacaatgtatcacttcctgtcaatcagaattcccagttgcctataaaatgggaggaattaactatgcaactaatccatctattcaaatcaaatgcgatactaatttagacaatgcaagattctcatcaaaagccaataaattcagagttgaatgcccagctggatgttcaaaaagtcgatatcctgttaaaggtcataaagtatattcaccaaagagttcaatctgtcaagccgctatgcatatgggcataataagtgatacaggtggtgaatttgttgttgctctttatccaggacttaagcaatatactggggctgctggaaaaaacaatattgttagtaccgatgaaaatactccacaaacaagatcatttgttgttggagctgctccaaaaccaagacaacttacttgctctgatactgcaagctttattttccagttaccagttggtgagagagaactagtttcttgcccaagcaactgtggattagaatctgatgctaaagtctacggaatggatatctattctcctataagttctatttgcagagctgcaattcatgcttccaagctttcttctggcactgctggtgaaattcaaattgaagtcggacctgagcaattccactttgaacaatctaatagaaatggtattcagtctcaatctacagggtattatataagaagcttcaaaatagtctaa

SEQ ID NO: 504 - DNA, 1815 bp, Cryptosporidium hominis
atgagtgttggaacagtttcaacagcatcaaccccatcaaaatcccatagatctaggtctgaatcttatcaaaagttaaaagaagaaaaagattttgcaacaacatcttttgaaagcgatacaaatgatggtttgtatagaaaattgataccaagtctttacgcttactcctctctacatggatgtattgaccagctaatccctacaaactataaattcttagaaagttcgataggactctcaccaaaatctttgggaatgctaacttttgctcagaaattcacgcaaggactattcacaattattagtgggataatatgtgaccgacaaataagtgctactaataaacaacttgagaataaccacaagaatttaatttccctagaggaaggtgatagagactcagaatttgctcaagtcagttatagaaatgtagaggatgaaaatcaaagtggaaacaggatagaaagggagagtgaatatggagaggaggaatacgaggctagaagcctttcctccagatcagaggcttctgaaaaaagccaacttttacagtactcggaagatattaatttcttaagaatttggcctgcctattttatgatggtaaccacaattggatggggaatggtaatgatttcaatgatatttgcctcaagttttctccaaatgcttaccttactttgcttcatgggagcttttttgtcactcatgggaccactcacacaatcagtcattggaactttcaacaatattggtagaagtgagcattttggaaatctctttctctcacaaaatattggaagactattctgtatctctgctactgccaatattatggggcattactttgacttcacatgggccctacttacattttctttcctctccttcttgttttctattttcctatacaagtcatgcattgaacatgcattccaacaaaaaggcggcaaaaccctccataggaaaattttgtcatataccggcgaacatgcatatattgtccacataagtatgcaaataagagaaatttttagtaagttatcatatggaaagttgaaggattttatacatgattattcatatgtgatatcaaataaaagtgcgtggttgatgttggtgatgggtattgtgaatggaattccaagacactctttaaattttacaatgatgtggttacaatattgtgggttaagccctttattggcaacgacagtatattcctccagttggatctctgcaattttgatctctccatttgtagggaaggcttctgattatattgagtccatttatccttggattggaagacaagcattggctcaaactgctatattattaagaattatatttatgatcatcctattgagatatattccttggggaagtcattatttcttctactacttagtggtcagtattttaattggttttatggcaggatggccaggagttggagcgagcagacctattctttgccaaattgttttgcctcaccatagagcaacattgtttgcaatgttttcattatttgagaccatcggatccgcaatctttggagctcctattgttggtcttttagctcaaaattattttggttatgattcatccctaaagaaggaaattggagaaatcatatcatccgacaatctgcatgctttacaaactcttcaacttaatgcaaatgctctcgctaattctatgcttattatgactgttattccctggatcctaactattgctttatttggacttttgagattaacctataagcaagatcaaaatggtaataaccaggcaattcttagctaa

SEQ ID NO: 505 - DNA, 450 bp, Cryptosporidium hominis
atggcagaacaattaactgaagaacagattgcagaattcaaggaagctttctcactctttgataaggatggtgatggtagcattactacaaaggagttaggaactgtaatgagatctcttggacagaatccaactgaagctgagttgcttgatatgattaatgaagttgatgctgatggtaatggtacaatcgatttcccagaatttttaagccttatggctagaaaaatgaaggatactgatactgaagatgaacttattgaagcattcaaggtatttgatagggatggcaatggctttatttctgcagctgaattgagacacgtaatgacgaatttgggtgagaagttatctgacgaagaagtcgatgaaatgattagagaagctgacgttgatggtgacggtcagattatgtatgaggagttcactaagatgatgctttccaagtaa

SEQ ID NO: 506 - DNA, 339 bp, Cryptosporidium hominis
atggcctcatcttcagatacggttggaattcccacaccgtttgtcgtagacgcactatcagaagttggaaagagctcctctggctacgttcacataagaaaccaacaacgtaatggcaagaagagtttaacaactgtacagggactcagcgctgagtttgacttaaaaaggttattaaaagctttcaagaaaaacttcagctgtaatggaacaataattgatgacccagagcatggaccaatccttcaaattcagggagatcatcgacacaacgtagctaggttcctagttggagagaatattgttaattctgacgaaataaagatacacggagcttga

SEQ ID NO: 507 - DNA, 681 bp, Cryptosporidium hominis
atgaagatggagttggagtttgtggggcaaagtagcctgtctaatccagctggaatgaatcagctaaacaacgttaatcataagaatgcaatgatgaatgaagatgtagcaggagcaccaattatagcaagcatactaaattccgcaactcatcctacgatttgtcttttccaagttctatttaaggttctagcatttttatcttttatttttgggccattttttttcagatttttttcgaataatagctttattttgacatttttccttacatctatattactttctttagatttctggactgtaaagaatgtgacaggaagaattttggttggaatgagatggtggtatgagattactaaggacggtgagaccgtttggatgtttgaaaattgtaatgaatctaaaaatacaaataccaatgtttcatcaagcactgacaaatcagtcttttgggttacaacatatggatgggctttactttgggttgttattatagtatttcaatttctctcactgaaatttcagtggatttcactttcagtaatagctattacactttcattctcaaacttaattggatatacaaagtgtattcgttcgtccagaaatattcaaaaggattggattactaatattgcagttaagacaattatgagtaatgctcaaaatatggtttag

SEQ ID NO: 508 - DNA, 621 bp, Cryptosporidium hominis
atgttggattcagaaacactaactcaaaaaactaaatatttcaattctattaactgctgttttaatttagttgtatatttatgttggatgtttatacctgatgagtacttaaatcaaatcaatataacatattacccagataggatgtggggaattactgttccaatatatatgttatttttacccttcatgacaataataacatataattgtatatcaattcttaatgtcaagccaactaattcatttgacctgattatagatgaatcaacaagatacatagatctatcgtttctttataaattcgaggatttagaacaaattaaatcaatttgcaaatcaaccttgaaaatttatacaatggtaaataaaaattctggtgaaaaaattactgaaggaggtagaagtgaccacgagaaaaagtatgaactctatgatgatccaaaaagtgctataattagacaagcttttaaaagtgaagatgtaactttagatctagtccatttaaataatgaaatagattcgatacataacaacaaaaacattgttccagtagcagacttgccacttcctttagtttgtgaaatgatatactcggataagtttgcagggaaacagtaa

SEQ ID NO: 509 - DNA, 939 bp, Cryptosporidium hominis
atgagaaaaactaatagatgggaaggtataatactttttttaattttacacgtattaataaaatttaaacacgtaataggtgaaataacgaatgtattaaatttccaggcggatattattgtaccattggcaacaggaggcgatcttcctccagataacaactacgacatatataggcgtatttggagagcttcacagagtgaaattgaagatttggaaagaaaatcgttagatttcttcaaggaaatgactgatgttgatattgcaggacttccagcatgttcaattggtaatacatttaatggttttgggggaggaatattatcaatcattccagcattcaaatctcaatttaaggtagtcgagacaccagagagaccacaattatcaggcctatgcttattgagatcaatggatggtgttgcatatatatatgatcagggaacccagttaagagttgcatccatttaccacgtaagaaatatggatattattggttataagttagttcaatcattaatacctcaacatgaggcaacagaaagtcctctcccactttttgatacagcatttttattaaatgttttagaagatggttatctaccctgctccaagttccagggatcctgtattaaaggagatcgattgttatatggctggtatacaattagggacatttataataaaggagaatggggagtcattcattatgaaagtagtggaccacagaatattctaaaggaatttacacctttatcatttaacttaaactcacctgtttggggtaagggatattctaacgggttcgtaagtcgaagatttgtcaataacgattatgttcagccatgccacgaaaatgcatgcccatacagaatgtcaaaaatgtttgatacagtatctgtttcattcagaaacatactaactttcgttactgcttaa

SEQ ID NO: 510 - DNA, 633 bp, Cryptosporidium hominis
atggaactggattttttgaatggagaaattgaaacaggaaccacaattgtggcattgaaatacaagcacgggttggttctagcagcagatggaagaacctccactggaccaattattgcttttagagcagcaaggaagataactcaaattactgataaagtatttatgtgccgttctggatctgcagcagacacccaaattatttctagatatgtacgccgaattgttcaggatcacgagcttgagactggcgaagatacaaaagtgaagtctgtcgcttctgttgccagattgatatcatatcaaaataaagaacacttattagcagatatgatcattgcaggaatggatccaaatggtgaatttaaagttttcaggattccattggggggaactttgattgaaggttcatatgcaatatcaggatcaggatcaggctatatttactctatgttagactctaagtaccattcagaaatggaccttgatgaatgtaaatcttttgctagggatttagtttcccacgctatgttcagggactcttcttctggtggtattatcagaattatagtcattgacaagagtggagtggaggaatttgtagttcctggagaagacgttcctaacctataa

SEQ ID NO: 511 - DNA, 378 bp, Cryptosporidium hominis
atgtttgcaatgcagtcttcttcaggtatttctcgcaacaaaagtgaagaatcaggatacgacgatttacttgtggagaatcccaataggatcgagaaagaacttaggattgaaacaaagtctaagaatattgaatatatttctgcatcaacacttgatgaagctcttttggctcttggagttgatgataagcagagtgcagatatgcatccagagaagagacaaaaagctgcatggctagcttacgtagataacaaccttccaattctaaagaatgagaatcccacattaaaaaggtctcaacttcttcagatgttacaaaagaattggaagaagtctcctgagaatcccatgaatgaaaatcctaaacttacttga

SEQ ID NO: 512 - DNA, 1893 bp, Cryptosporidium hominis
atgattagtaaaaggaagagagaggaaaatgaatcaaaaagaccttctactttttcaaaggctgaaaatttgccattagaatcacaggaattgactaattaccatgtagttcagttgcaagaatctagtaaacagtacaagcgtagaattaatgagctggaggctaagatatctgaaatgattccaatctttgacaaaattcaagatgaaggcaaatccgaggaagaaaatctgtcaagaaagtttgaacatataatacaacaaaaagatgatgaaatattgtctttaaggaacgaaaatcaacgtttgagtatgcagaatgtcttcaaaagattttattcacccggaaattcaagctccaatacgaactcaattggtatttctggtaaaactaatcaatcaaatagacaaggaaccactttaagcgagctaataaacgattgttcatctgaggttgatagaattgatatcacttcaagcgatattaagtcgaaattgattgaaaaagaaaaacaaatttctgaattgaccaataagtacgaagcgatctctcaggagaatttcgagttaagaaaaaatttgaataagtgcgctccatatgagagctttgaagggaaaattagcagtaaaaaggaagatgatgacaaattttgcatttgtgtgcaaagcattataggagaaatttttgaattaagaactcaacttaattctgaaaagctcaaattcgttactttgattgaaaacaagttgcttagaggtataaaggactttctagcaaaccaaaaaagttgtgaggaacataacaaggtaataatacaagaattagaggatattaaatacaggtataattctttaaaacaagatctattttctttagagagttctaagaggactttggatgctagagataaagagcaaaaaaagaaaatcagagaacttgagcttgcaaatagcaaaattgaatcagagaagatgagagtgggagagttcattaaaaccgtcaacttaaagctggaaaaaggagaaaaagaagaggtaatcgaaaatttaatgaatgaatacgaggaattaagtaatgcttttgaagaaaagagtttggaatgcgacgatttacggcagaaacttaaagaaaaggagaaggagtatgatgatttcaaaatagggattgaagacattaagcaaactctcaaagaaatggaaactattaagattttatatgaggagaagttatctttggttcgaagaaccaacaaaaatgagtcaggaagagaagtacctaactccgatagaatacaaccaaaccaagagacaaggatatctgaattcttaagtaagcatttatcctttattagcaaactcagcgaagataaacaagtgagtaactaccaaacacaggacggaaatgattttaatgatgtatacaaatctttaatcgagcaaaagactataactgagaaacacaaactagatcttgaattctacaaatctgagtattgcaagcttaaggaaaaattggaatccattgaaaataaagaattaaattataatacaacaatttcaatccttaagaacagagtacaatatattctaaatagggtacataagctcaccaacttggagattaattttgatgatactgaagaaaatataaatctacagattgatgattatgataaagaaattaattcactcaaatcagagaatcaagaacttttaactttaatgaaatgttcagtatgctgtgacaaagttaaagatactgtaattaataggtgtggacatctgttttgcagagactgtattgatagaaatttatcatcaagaaataggaagtgtcctttgtgccacataaattttgataagaatgatactggaaggataatcctttactag

SEQ ID NO: 513 - DNA, 1017 bp, Cryptosporidium hominis
atgtcgatatgtatttggttaagtttgctggtattcgagggatcttacttatttactgaagtaattggaactcaaactgttctctttgtcgccattataatagtattgggtctattattgatatcttttggtatattttgtggtgtgcttggttatattggatgcacaatttcaaattctcgatgcgtatatttcttttttatacaattaaactttcaactaatagccaatgtttacgctctaattgcttccgttatccgtggatatattacatactcttgtgcttatttactatgtattatattgatttgtttctttctttacccttcctggtcattatatgtgcacattaagattaatggtattcctccaaatgctcataagcattatggattattgaatgacgttctttcaaaggttgaacaaaaaaatgaaagaaagtccaatctagaggagtcagaatctttagtcgaaaatggttgttcaagcatttctaatggaccgggcatgactacttctatacaaattaatagccaaatctttcagaagaaagagcaaaatcgtataacaatgctaaaaaaacaaagtactaaaaatagcggcgaaattattcataaaaacaattctgaagataatattgaaaaattatcgcatattgcagtaaaattttctgatgaaaatgatagttcaggtacttgttctgaaaagccaacaggccaagtattgaatattcaaacattggactcattagactcttcacaacaatcttcaagcaagaacagccttacccaacctttaatttcctctgatgtttcatataaacttcgaaatgaagcaaagattttccttaattggtccaaacctaccatatctgtaaataggaatattgcaacatctccaaatacagattgctcaaatggaaattctggtacaccccctcgatatagtaagttacaagtatcaaaccggaacaacaaacccaaatttactcgttcggatgtatataatgggtgttga

SEQ ID NO: 514 - DNA, 1584 bp, Cryptosporidium hominis
atgactcaaacatcatatggtccaaatagcatgaataagttaattgtaaatcatcttggaaaacagttcatcactagtgacttatcaacaattatagaagaacttgatatccagcatccagcagcaaatatggtagtaatggcatgtaagaggcaggctgaagagtacggtgatgcgagcaatacagttttgatatttgcaggagaattattaagaaatgctgcaaagctacttaatgataatggtttacatccttcagatattgtagcaggatatgaaatagccctagagagatcattatctttactaaatggaatggtagcacatagagttgctaattttaagaatgttagtgacttatctggaattgtaaggcctttggtttcaacaaagaatataggatattctgatttaattacgagattgacatgtgaagccattacgagcataatgccagatgaagataaattaaaagaattcaatatagacaatgtgagaattgttaagcttttgggaggatccccaatgcaatcatttacaataaatggtatgatggttaatagagaacctggaggtacaataagaaatttggaaaaggtctcaaatgttatggttttaggatgtggattagagatgactggaacagaggcgaaaggtacagttgttttaaataatgctcaagagcttttggattttactagaggtgaggaatctctggttgaaaacttgattaaagatattaaacaaaccggtaagatcgatgctattatcgcaggcggtccaatttctgatattgcacaacacttttgcaacaagtacgatatattaactctaagaattacatctaaatgggaactgaggcgcatttgccgaagtattggagctgttgcaatggttagattgggagttcctcttccagaagaaataggaaaagctagttctatcagggttgaggaaattggatcgaagaaggtcactgtgattaatgctcttaataccaaagttagctcagttattcttagaggtgctactcagggaattttggatgaaatggaaagggctattgcgaattctgtctctgttattaaatcatctacaaaagataatcgatttgttgctggcgctggagctacatttgttgagctttctaaatgcttgagagcatatgataagtctgaaaacaaatgccaacagaattctgcagatgtacctgttcctggaatggaggagtacgcagtaaatatgtttgctgaagctttagacgttttcccaagactattggctgagaattctggactaaactccaccgatcttctggcatcactacatgcagtacatcaacaaggttcccaaccacataaaggaataaatgttttctgtggttctggaacttctccaattattgactgtatctcaaataatgagcaaggagtaggattgattgtcgatcatttaggcactctttgttctgctttaaaattagcgacagactcagctgttactattcttaaaatagatgaaatcattatggcaaagcctgcaggaggtccaaaaccccgttctcaaaacgatgacatggactaa

SEQ ID NO: 515 - DNA, 1131 bp, Cryptosporidium hominis
atgaaattcccaaatacattagaaattaaggaaaagatttcaaaaagagtatttaatgcaaaatacaaaagccaggacgttgtgcttaaattatttacacctgacgatttggatggctgtgccgcccaaataaaacatgtttttgacgagtatgaaggcacagattgtgattacttggaaacatcattggatgacagagttttatattgtataaagatacattatttaatccaaagaaacctagggatatgcatgacatcagaatattactgcaaagagatgcaggaatgggtttttgaaacgattgtagatggtcaaagagattatttagaatcatctctgtctggagaaaacaaatctagaactagcaaagatatgaaaaattctttcatacagctaattcatgtttttggtgtgagatttgatcagaaatctcaagtttttacttcccaggatcaatttattggcctcatttttcctaagttggggcagcctctgatgaattttacacaaaaccaaagatgggttccaaatcccatttatctatcttccgtctttagtgatgaattgtccattgctcatatcttcaaggatgttgtaaaatctgctttatttcttttaagagagttgaatattgtccataaagatattaagattgaaaatatatgcactgtattagacaacccagaatcaaataaaatacatcctataataattgattttggagaatctcagattttaagtaataatggaatgctcagagacgcatatgggactcatacaatgctacctccagaagcatttacatattcattttgttctcacaatgatgaaaattatatgggttattctgctgaaaaaagagaagtttggactctcggctgtttattgcatactctagtttttggttatcccccttattttgatatattctcaaaaaaatctcctatagaatttcaattgaaactgtgtgatgaaagcattactattgatattcctacctactcaagtgtgctaaatgcagatatctcacacaatttgagaaaccttcttagtagtatactagtcaaagcccctaataacagactttgtcttgaaaatattttattacatccatggctccaaccctag

SEQ ID NO: 516 - DNA, 3081 bp, Cryptosporidium hominis
atgattaataattcacaggaactggttcaaaaagtggatgacatagtacttccagaatgtgaagatagaaagtacagagctttagagcttaagaacggtctaacagcctttttagtatcagataaagaaactaaaacaagtggatgctgccttacagtctacattggagctatgtactctcctaaaaatttaaatggattggcacactttttagaacatatgttattctgtggaacaaaaaaatatccgaacgtggatgaatatcaaaaatttattgcaagccatggaggaaagaggcagggatctactacaagatcaactacaacatattactttgaaataaaaaataatgcttttaatgaagcattggatagattttcttcattctttacagaaccattgttttgcaaggatatgacagaaaaagaggtttctgccattgaaaatgagttccatcttaaatatcacagtgatgaaagagttagatttcatttacttggtcaattgtcaaacaaatcacatcctttgaattgttttactaccgggaataaagaaactttggaagtcaaacctaaaaaattgggaatcaatctccattctgaacttttaaagttctactcttcctattacagcagtaatattatgtcagttgttctttatggaaaagaagatctagacatattggaaaagtatactattgaatatttttcaaaaattccaaatcaccaagttaattgttttgattatacaaagattttcatggaaattcctccttatacaagagaaacttcaaatagaaaaattattaagttaataccttatgaaactgacaaaagattaaaaatctacttcccacttcctcctttagacaaatattacgatagctgtgctcctgcttatattgcaaacattattggacataaaggtgagggaggaatatcatcaatattaagagctaaaaagcttgctactggtgcttcttttgctattactaatgaagatccatgtgcactagctcagtttggggttgtcctaactgatgagggatataataatattggacaagtattggaaatcattttcaactttttagtattatttaaggcaacacctgttattccagaactagttggtgagtttattgggattactagagcaggttttacttatcaacccaaattctcaattcgtgatttattctcattaccagcaaagtatctcaaatacaaatgtaaatttgaagaaatcctctcttctggttttcttgtgaaaaaattctcacaagatgatgtattttctattttggaatacttaaataatgacaatttttttgtcttactatcttcgcaagcaattgaggaagagtataagaaaaatcaagaaaactttattgttgaacattattatggaacaaaatatagtatttcagaactagatgaagatttgctttcaataattaactcctcctcaccagaaaaggctttaaaacttgggttaattttgccaaaaccgaatcaatttgtgtcaacagatttctcaatagtaaacccacaaaaggtttgtgttaatgattactcgagaattcctgaacttctaaattttgatgaattgaaagctcaaggtaataccgattcttacaatattcattctcatcctttaaatatttggtttaaaccagattcaacctttaattctcctcattcattaatcaatatgagattaattgctgagagaattctggaatttaaagaaaactcatcttttgagaaattgtcaaatttttcaaataagttagttttccaagtatttggtgaaattttaaatgaagttatgtatagaagtatgcatgagctctcttcagatatattagcagcaagtttatcttatacaattaatttcaattctagaacaaatgtatttgttttacaaggatttggactttctcacaaattaaattatttgatttcaataatgttcgagaaattatatcatggaacagaggttagaaaatattatgatgaagccatattaattataagcaaagattggaagaataagataataaaaccaaatttgacttcattttcactagaatgtatctcagaatctttgtctccttttttcttcaatcgtcaagaaaaattaaatgttttggaatcatttacttttgaattgttttgttctataagacaacactttttatcaaactgtagacttgaagggttaattatggggaatttttcagagccaaatgcaaagtgtatttcaatacaacattggaaaaatttgataaatttccagaattctgttaaaaatgaagtaaaatcttctggaataagagtagaacaattttcaattgttaatttagaaaaggacatttatactttaaattatattccaaatagttctgacaaaaatggatgctggatgttgagtttcttccttggagagtataatttaaggaaacaagtcctatgtgatttgattttaccctttgtctcaagtgaagcttttgctgatctcagaactaatcaacaattagcttacgttgttagagctacacagatattttcttctcctgcaattattattggatactatttacaatcatctgagtataccaatgctctaactcttgagaggcttttagagtttcatataaacaaaacaaaagtggaactaaaaagtaaattgaataaggaaatgtttataaaattgaaggattccacaattcaaaccctttcatcaaatccaaaaagtatctttgatgagtataagacttatcttcatgagattaatgaaagatcatatttatttgatataagacaaaggaaaatagatatattaaataatgtacaatacaatgaatttattgatttttatgatagtatatggacttcaaactccgtattaacagaaataagatctcaaatagatgatactaagaattctggtatgggttctgagtataaagatccgtctattccagaaggatatttaaaattggagtcaattactcagatttcaaggaacaaaaatacacccacgatttcgctggaagataaactaaagaatttgtaa

SEQ ID NO: 517 - DNA, 3042 bp, Cryptosporidium hominis
atgacagaaataaagacgaatttaaaagaaattcagaatgaaataacgaagccaatttatgatgagaacaaatatagagctctggtattgaaaaataatttgagagtattattggttcaggatgagaatacggatatttcaggagcaagtatgtcggtatttgttggttgtcagcaagatcctgaagaactgaatggccttgctcattttttggagcacatgttatttttaggttcagccagacatccaaaccctagtgattttgatgactatatgaaattgaatggagggagttcaaatgcattcacagataatttgtcaacatcttactttttcgaaataaaaaatgagtcatttgagcatgcattagacttattttctgctttttttatatgtcctttatttgatacaaagtatgtagatagggaagttaatgcagtaaacagtgagcataacaaaaatttgttatcagatttatggataagatatcatgtaatttcttcaatagctaggaatggacatccattaagaaagtttggtactgggagtatagaaacattaaaatatgagccagaaaagaaaggaattgatttgattgcagaactaaagaattttcataataaatattatagttcaaataatatgtttcttactttggtttcaaattgcgatcttgatgagcttgagaattatgcaataaagtatttttcagaaatagttgataagaatattgctcgtattgattattttggtgaatttcaaaaagaaagaccatatttaagtattatggaatctccagaagatggtgctcttgaatcaatggtatatgtcatacctaacaaagatgaaaaaaaagtatcttttaattttcagattcctgatctacgtaaatttagaaaaggacttcctgaaatgcattttacaaatattttaggacatgaagggccaggaagtttgacttcagctttgagaagaaatggttggtgtcttgctctaagcagtggattaaatgaaatgtattccgctaatttgtttgaaattataataactctaacagagaaaggtgcaagagaagttttgagtgttattgaatacacattaaattttgtaaatttggttataaagaatgaaatagatatggaagtagtttcagatcttgaaaaactttctcagcttgtctttgattatagaaatagaccaagtctagatgaaactataagcaataatgcatttgctcttgcaaatttacctcctctaaaggaacttcttacttttggaaatagagttgaaaaaatggatgtagatgcagtaaaatatcttaaacaatattttgatcccaagaatatgtttattttactttcaattccggaaaataaagctcttattgaagatgaaagacttaaagataaattaatttatgacagacattataacataaactatttgaagttagagtttggaccagaaattaaggaaattatctctaaaataagtctttctaatgctagcaaatttggactcaaaatgccaacaaaaaataattatattccagagaattttgatttaatgaacacgtatggcggcaacatgcaggcattccccacaattttggagattcctggaaattcatttagtgacagagtggttgcatattataagccagatacaaattttcgaactccacacggtttttctcaattctttttcttctcttcaagtaaggtgacatgtgaattacttgttcttgatactttgacatctttaacattaagtaaatttgttgcagaagaggcttataatgcaactattgccaatttagactataagatttcaggtgggtacaatttaagaaattcaatgaattgtttatctataacaatttctggttttaatgataaaatgcacacattattaaagtttttgatcaaatctctagttgaactcaaaaatgatggtgaaaagcaactatataagtcattctttgaagatgctctagaggaaagtagactatcagtcagaaactcgctttttaatccagatatactttcccatttgacttcgtataatttcagggagttttattctgtttatactccttcaaaagaggagattttatctatattaagtacaactacatacgaaaggttgtgtgatcatatatcaacatttttctcacaatgtttgataaaatcgatcacagttggtaacttaaataaggaacaagcacgagaacttgttgaaactgtgactatcaaggaattgttatcgtttgaacaactaaattctaaaatggaaaagactatcattagaaactgcatagatttgaaaaaggcaatagaatcagatcctgaaataaaatccaataggatcattctatctaagtctgtgataaatccaatggataagaatggttcagttatatattcaattgatatgggagaatacaatttaagaaactacgttcttttggagctgttgtccaaatatttggattcaaattgctacttagaacttcgtacaaatcaacaattagggtatattgtgcatgcatgcagttataatttgaagccagctattggtatttatatttgtgttcagtcttcagacttcagtaattctcatgttataaaccgtattcataatttacttgatgatcttttggtcgtaaaattatcggaaaagcttgatgaggatcagtttaacattttagtggattctgaaattaagatttactcaaacaaaccaaaaaatattaaagaggaagttgctcaatacttgacaacaatcactaatggagagagtaattttgattggaaagataagtccattaaaattcttgaaaatttaacttatcaagaattttgttcttttgtgacagatctaatcagtagaccaagggctattatacaatctatatcagccttggacgccagcaaaaaatgtgaagatgtggctaatgattctgttccaaacggatttatagttatcaaagatttcagacactttagaaatactgacgcactatttaacataactatataa

SEQ ID NO: 518 - DNA, 3189 bp, Cryptosporidium hominis
atgaataagtatctacttatttaccattttttcctacaggtggtaattttattatcaattaatggaagttcattaggaaaagaacctgatttggtagataacgaggaatgtgaaaatccggagtatttgtttccctgggggaatgattatcttaattcatgtttgagttttcaatgccatagggtccgagaacataaaagttggtatcgcttttgggaaaaaaaaccaaaatatgttcataaaaatatttatggaagtgaacgggtgatacaatgttcagactgtgaaggttttttaaagaagggagctctatttggtggaatgtcaatttgcactccaattgagtttggtggtagttttgatataccaaaaggttgggtatctatagctactgcaagcttacaattaaataaggaaattaagaataaaagttcaattaagttagttccagataactggagaattgatggacagactaaaaagacaaccttggacttatccgcttgttccacttctgatgattctgaagtagctttatctatattagtaactttatcaaatatagccgaaccttctagaaagtcctcaaaatatagacgtattttgggtcttcacgatgattcaattaatgtgaggattaaaactcttggagttgatatgggaaactcagcagatggttttgatgatgatgatttggatgatgactttgatgatgagttcgatagtgaagatgttcaacaaagcatgcatcaggataatgggtataatgagtactttttgtatgatatgaataaattagcctcaacacagcatagggtacctagagataacccatccaagggcaaaaaaaataagcaaaaagtaagaaaggaaaaaccatttactggtgcagaaaaactaccaagaaaatggaaacttagcaaaggccatgcttcgatatattcatcatccgatgttttaaggcttgatcttgcttcagatattcaccccaatgaacttgtccaagttattcttacatgtaataacaaatatatgaattgcaatatccaagactttgtttcgtgcttcaatattctctgtagatctgtaaccaaagaagagcttattcgtagagcagctttaatgaaagctaaacggttcatttcaaattctattatttcaggtcaagtagtgcctaaaatggcttataacggcatgccatttcaacccggtttcccgcctgctattccagggcctttcaatggtcaattccagtatccacatgcaaataatatagtaaatgggaatttcatacaaagaaattcaactttgcctattcaaggagtttcgaatgtaggagcaaattatattcaaaataggggaaaaaatggggttgttttggttaacaatggagtaggaaagcctgttgaggtaagtaaccaagctaacgtttttgttggaaatgatggcgtacaaaatgtaaatataaataccaatactaagactgctggaatttctaatatttcccttaagcagcttcctgcaaatgtgaaaacttctcagagtaccgcagcatcaaagggtattcaaataattgttgtaccagtgcagagtcaaacgaatgcccactgccaaagccaaactaatatgggtaatgtaaataaagctgcgactaaatcatcgttaaaacagaaaaagcaaaaaaccttaataagtcaaaacatcatttcaaaggaaaaaactaaaattccaaatcaaattaataattctcaaataccaactacaccaaaacaatctaagtctcgaataaaccagatcggagtttatggccctgctaatcacaccgttgttacctcgtataactcaaatgtattaaacactgatatttatcaaacttctgctgagcaaaacttggagagtcaaccaacaacagtttgtatactagctatggaacctaaaagtgaatctaaagtgaatgttgtgagttcaaacacaattcagcctgtggaaaaaactcaattcagcaatgtaaaacaagatgttacagtagttttgaatcctataaatacagtgacaaaaaactcaaaaactagcaaacgcaatactgtgaaacaaacaactaaaactcaagcaccaactttaaatattttattagttcctaataagactgttaaaacaaagaataatttcaagaaagtttctaaagtctctaaaaacgaggtaaaacatgcaaataaaacagtagacattattttgttcaatggtaatttaaatcataaacctaaaaagactgttgataaaagtaattcagattatatggttttgaatacaaataatgttctaaaacctccaaaaataataacgggcaagataacctacaaatcgcctaaattaatcaagaaaagtagtaaatcaacagagccagagtttaatattatagataccatagttttggaaaaggttaatcatgaggaacccagaaacaaaattgacaagttagtccctgtggatacctcctctttaagtgatgagaatattttattatcagatcctggcattagtagccaatacatttctagtagccagaagaaacattctaaacagtcgcatagcccccatttgaagaataaagctcatagaaagaagtccataaaagttaaatctcgaaaagagggaacaactgaaaacgttctgctagatgccgacaaacatatttctaattccgataataaggcttctttggtcaaagtagaaaaatatattctacgtccagttaacacttcagaaagttctgaggactcagaaagttttagcgaatatgaatttggatcagaagaaattggatatttgagtgatgaagatttcagtaccctaattctgaaaaaagttaaagatgattctgcaaagtcagacaaatcagtgaaaacggagtccaattcgaaagtctctactcattcacagaaaataaaaaacgaagatgatgataaagttaatgaggagataaagatcaaaaatatagaaaaaagtgaatctaaagttgaaatagaaaatagtcctttaagtgattcttctgattatgaaatttttagcaaacaaaaacattataattacgaaacaagaagcacaatgaagtctattttgggatattcaatattgatcagtgtttttctgttcatagtgttcattattatgaaactgcttctactttaa

SEQ ID NO: 519 - DNA, 1317 bp, Cryptosporidium hominis
atgatagtagatttagaattatatcctaaacaatcactcagattattattgtttattaatgagcaagagaaacaaagtaagaaaagtacaaaatttctggaatactgtaatgaagaggaagtgaaagaattccaatatttgggtgaagaagatagaataattatatctgagagcttcaggaaagtggtgagagctgaaattagagagtatattgatttatacatggagcagtaccaagaaccattaaatgataaagaagaagctttggatattaatgaaaagcaatatacagtttatgggaattttcaactcttcaatgaacaaaaagacactattttatgggacctactaacattattgatatacctagatagcatgaatccacaaatatgggatagaagggcagtcttaataggagaattattacaaagaataggattggaatctgaatatatgagattcttaagcagtgagctaaatcttacaaagcttgcattatgtcatacctttaagtatggggaaatctggagttatttggagtatatattaactgaatactatgaaagaattaaagaaaacgagtttaaaagtttgaataatgatgaaattatcaattatgttttaaaagataattttgagtttatttgtctacagatagactcctatgaacacaactaccatgcttggagtttagttaattggttaatttatgaattaatccctacaataatttcaacagatgactcaaataacccctataaatacaatgaaatcaggatgatcgaaagttgggtaatcaaattattacaaagacatccatctcattatggaggttaccatgcgcttgtgaatctgaatgaaagcaaaattaattcacaaagtaaatcaaataagctcgaagtatgcacagtaataggattagtatacccaaaagaaattattgatatgcttagaattattattgagtgttttgatcatcattttattaactgtttctcagtaattctaggcttcagatatgctaatttcatgcttttgattgattcagtagatgaaaggtctcatcttcaaatttttgaaaacgaaataatctggtttcaaaaacaagatttggttgaaaaaatgtccaagagtccaaaacatcttgaagaattgagagaacacttttactccattttatcagagatatcaagctataattacaataaaagcattatacaaaaattctacgacctattagattcagaaatacaaataataaggcaagaatcaacgttgttttacaatagtgattgttcctataaaggcctagtttga

SEQ ID NO: 520 - DNA, 1827 bp, Cryptosporidium hominis
atggcagatactcactatccaaatggaagctttgaagaatatgaaggagagagcgtatatgaaatggatagattaaatattaatgatgagtatattgatgaacaaggcgtagaacataatacttctgcatgcactactaatttgggactgtataactttgacagcgaggatgatgagatatcaagagaaatttataaaggatatggaataaaaaatgagacagatggctcagttaccgaaactaaaagaacaaccaatgaaaatgagaaagaaagtcaattgaaaactccaccaaaaagaccatttttaaggaagggagaaggtaagtccttggtaataagtaactcaagaaaagcaaatggagaatctatttctagaagaagttcccaaattaggtcaaacccagcagccaagattgttccgagctcagctccttccagaaggtttatacgttcaaacaagtcagttgtgccagaagcaggtagaaacagcaaactagactcgttattattgggaattgaaagttcaaatttgaccaccgagagtgggctggaaggatttgaaatcttcgatgctgaggaagagtttctagggattgactggcgcaaagagcagaatattgtcaatccaaaaagtaatagggatgagaaacttaaggggaatattatagagaaggaccaagaaaaagactatgacaaattgattcaacaaaaattggatttacttgatgagaagatggaatatatacatgagacacacgaggaaatgcttaagaaaaagactttgttggccagagaaagaaaacttcttgaaagccaaaaagtgacttttgaaaaagagttgagggcaaagtttgaaaagagtaggcaagaaatagaatcagaaaaacgacgtttggaaagagaaaataacaaactaaccaaggataagattgccttgagcgatcaggtgactcgtttaaagatgacaatcaaggcaaaagatgctgagatcaatcgactcactaaagaaattacaatgatggagaagaaagaaaaagagagagaaagtatgcaaaataaaatccctataggaaagaaagaaagctcatctgaaagtgtggaaaagaaacgagctgttaatctgagagctaataatcagaagaatggagaatttgatagagccagacttgcaggaaacaccggtattactacattgactaccaatttgcagacgactacatcaatttcttccaactcttcaggttcatttatagatcgggatttagttattgaagaacaattggcagcctttgactttgaaaaggaattggatttactatatggaatcttaagtacttgctttgagtttgtaagtgaaggggaagacttcacaactttaccaggtattcctgaagacgtagggagaccatggtgtgatattgaaaagccgtataaagttcagaaggacgacgatttgagaactattacctttaagttccctagtggacttgttgaaattgtattttatgatgaacaagaggattctgtttgtccaaaaaacacaagaaagttactttggactcatcttggttggtgtattctagtttatccaaatggagatattaaagcaatcaaacctgacaaaaatattacttaccattatgttgaaaaagatattgtaaaatgcgtagtaagtactatgaatctattgaactatgatggagaaacaactaagctacattttagcaagtttttctctcttggacagttgcaatgtgtcgatcctgagactagaaaaacatacataattcattccgatatgtctaagcaaatccttaatggttga

SEQ ID NO: 521 - DNA, 1800 bp, Cryptosporidium hominis
atgaattctagaatggtcttttatgttgaacaagaacaactaggagtagaaataggccccatacagagaggtttggtgtcatatataatattggatccaaatgaggaagatggaagttgcgagtttaatgtgtatatggtttgtaatccaactggattattaacaaaacttgaaaaccgggaatcttcttgcgacaaaattgcaatcaatgagattattccaagcaaagttactgattcttcttcccaaccttcagatcaaagcgcttattctgcagtctccagatttgacatttattctgaaactaataatagtgactactatgagaatagtaataaggaaaactatcctcttcttaatgatgaaaccattctatataacaaacttaatagactaaaatgcattaatacattctctggaacctgtttttcactctttgtaagatggaatttgggaattgacgatgtcttatacccaaatataccaaagctcaatccttcaagtatagatgaaggattgatttttttgaaaattgacatcaaccaaatcaaagatccgtctcttgtatcaattattgaaggaattaattttttggaactgttaattaactccagctccgatttcaaagataccactctacaaaatcattattcatctaacccaagtaccgattttgaaaagaaagagttgcaaattatctctttcaaatttattagaagtctttccaaaatatgggggtactccataatggaacattttgattcaaaacaagaagataatgaagctaatacatacgtggtagatgataaatttgagttgaaaggttcttccagttcaaggattgatgctgattatacggacttactttggagctttcttgtgagtatcagagacgaaaatctcatcttcaaaatagttttgcttttgcttgatgaactggagaaatcttcaactcaacaactttacgagaatagatttatcccgcaagtaagaaatgacaatacaacaattttttctcaacttataaggattgcaatcgaaatttacaaagaaactcagtacttaggacggagatacgaaaactctccagaaaatgaaaattctgatttaaaagaaaaatactctctatgggaatcaataaagaagaaatattttggagaaatcaaagcttttaagtttatactaatggaaataggctttgaaagtataatagcagatatgaaaatgcatgttagaaaaagtgaacccttaattgatgatactagttttgactggcacttgaatggcttgtattcaaaatctaagaagtttttggaagagtttaatttgatagaattacatcaaaataatagggagctacttggaagactgaagaaacttattcctgtatgttatatatcgaatatacttaaaacctataattgttcctgggacatttcaaagaagttaattagatctacaatcaaatactattcagaccagaacatccaagaagctcaacctaccatctttttgactcccattttcaataagacaatgattactcaaattgtctcatcaaatcaaccaaatcaaatagagatttcgtctcatgggacaaaaggagggtgtgaaagggaaattctcagtcttaatagagtaaattccattgaattacctaaacttaatagtgagctcagtgaatctatcatcaaatttaacaggcttccaatttgtatttggagaactatatcagactttgaggaatccagtcacttacaaaaccattatacaattcaattagagaaaagcttagtttag

SEQ ID NO: 522 - DNA, 618 bp, Cryptosporidium hominis
atggacagtagtgataaccgattttttcgagcaaggaggacgctttgtgagatgctagaggatagggggtacattgtttcaagccaagataaagaggaggacttttcaacatttaaggaaaggtttgagtctcatcaacgcttgaggtcgaggatgctgatggttgcttcccatagacaggaccaaactaagcgaattatttgttattttgcagatgaatcaaagaaaactggagtcaagccaattagagatattgtagaaaagatggatgagcatgcgatacaacgagcaatacttatttctcagaatgtattgacagctcatgctaaagtggccatactagatgctgctccgaaacattatattgagagctttttggaaaacgagcttttggttaatattactaagcatgagttagttcctaagcatattttattatcagacgacgaaaagcttcaacttttggatagatataaaataaaagaaactcaactaccaaggatccaatatgctgatccagttgctcgctattttggtttggctaaaggccaagtcgtcaaaatcattcgtccttcagaaactgctggtagatatgtcacttataggttggtagtatag

SEQ ID NO: 523 - DNA, 1899 bp, Cryptosporidium hominis
atgtcttttggggatttaaaaagttataaggaaaaacacctcaaagttgtcaaattagttgaatctaatacaatggttaattttagaattttaatgcataataataggggtgcaaggtacagactaggagtccttgagattcctgaatgttttctttcaaaatacggtgatatgataagacactcagaaattaagacggcctctaaaaacccagatctgattgagagtattcagataacagaaactggatcaaaatcgagtcttgtaaacctagagaatttcgggatagccagtattgcgaccccgtcattcactgttccaacttttggaggcctgccccattgtattttgcccaagattgaatcggatcaatcagagaattatgagttagcatctttgatgcctgaagtggactatctactaataggacatggactagatttggagagagtcaagagaagagagttggagtccataaaagagaaaaatgatgaacgaactggaaatcgttcatgtattaaatatgggaacaatgcaagtaaatttgacatgctggaacaacccccacctcaactagccaacaaggactatgtcaattacctgatgttccgccagccaatgattcctggagtgtcatgctggaatggctcggatggaattctggttcaaactgaaagtggaagggcaatggtcagcattgacgatttgtttgcgtccgtaagatactttcaaccaccatttttgatttctcctgcagaggaggctcaaacaggtcaatgtggtaaaaatgtatcttttaggtcgattcagagagctgatgagatgctattggctctgattgagcaactaaagagaaagagtgtatatactcaaaggaaaatagaagagaaaggcaaagtccaggtagatgaggagggttctataaaagatggtggaggagctttccgcactattaggtctgagagaccgaggacaaaggtgctggcaaatatacagggagctcagtttgtgaactacagagcagcggctgccctgggtgtgtgggacttgtgtagaggtacgggcaagggcttgaaaaatgttggattttcaagagataaaggcaatgctgatcttagggttgatagctcaagtggacccgaagcgatcagcgaactggatgaagtgattttgggtgtggccataggaggtctggggtactcagagaagtcgtcagtaagggctgagtgcattaaagctgttgtggatcacgttcctgatgataagttaaggctaatttcacttagtacgggtagccctatagagctattgcaagcggtgtaccttgggatggacattattgagtgcccttatgtttacagatgtagtctaagcggagttgcactatcatttgaacttgacgagtttttgaagcaaagagagatcatcaattatagtaacgaagagaagaagaatgttgaaagatttttgttagagtttgatttttcaagtaatgagtgcggaatagatttggagaaaagtgagggagcgcaagtggacgcaggagtatgttttttcggtggcgccaaatatttaaatctgaatgatagaaggtattcttgtgactcggataaactaacaaagaatagtccagtctctcattcgagagcatatatccaccacttaatcaactccggtgagattttaggggtttcattgttattcatgcacaattattggcaatatcaaggtttattattgtcgataaggaggtctatcattgatggaatactcgaggattttgtggcttggtttatgtatacgcaaactgatcttcaaattcatccaattaagttaccagaaccagcattggaaacttacacatttgatggaatgaagggaagattacagaaagattga

SEQ ID NO: 524 - DNA, 1908 bp, Cryptosporidium hominis
atgtataagagccatggcaataaaggactgtcgagctatttctcgccatctttcgaggaggagttagtttcacaataccaaactttgagtgaatcaactgcctcagatattggatggccagtccaggaatcatgtttaaaggctgatgaaattggatgggaagaccctgttaagggaggaggattagctctcaatgaatttggatcattcatgggtaatatgaacgaagagcctataaacaatagttcaaaggacttaaaatcccgatatgtaaacaattttatatttgatgataacccgatagcagtcgtaccatgtggtctactctatccgatagtatttattgggaacattcctccgaatgttccatatgagtacttaaaatcagttatcttatcttcttttgatacgcgaagcgaagaggataactgccaccgtatgattgctcttaactaccaaccaagttacaaggaatggagaactgcatatgcaacattcaagacatggagttgtgcccagaaagtcatccaacaccttcatctaagaaggcacttcaaaaatgcgccattccaccgccttgtggcttgcatatccccaattcctccaccatccgtactctcttcaagttttgactctgcctatgatccacaagaggcagaacaaattatcacagagttccaggaaaccaatcgaaggcttataatgtaccaacctcaggacactgagatttggttaccatcttataaccgaattgaaaagaacaagggattctttggcacatggaactgcttcagaagagatcacaagatgcatcaacctccggcaagatggatgcaatactatcgagaaaatggtttatgtgaatattgggattctttcaccggcaatatgcaaccgacattatctgttagccaagcaaaggatgataaacacttccttccgacctctattaccctgctaagagatggtccaggaggcgccaaccttttcatatacggcatacccaatgactggactgaggttactctaatgcagttgtgccagagatttggccatattgttggaattagactaccgacagctaacaataatgggaaactaaaccgttgctttggctttattagctatgacaacaaaccctctacatgggcagcaatccgatctatcgcggggattaagttctttggaaaacctcttaagatccagcttaaggcaggtgaggatgcacttcttccgcttaccctgagacctattgtcgagggatctactagaaaccgaaacttccatcaggagcagtttgaagccaagtctaagagtgctgctcaacagagtagttctctacagatcaatcatatgcccttcatgaacggctgtaatattcctcgtaataatggcagctgtgttaaccctccgattattccctcgccagcttcaaatacaattaactccttcccaaacactactcaactccactgcagttacgtgtctggaataaagcaggctcgctatagacctgagcctggtcatattaggatgaatcagaagtatgaaagctctatcttacttccacccaatgatggcagtatcaactctccatataatggaatcacagattttccaattaaccctatcaccgccactaatactattactactactactaccgccgttcctaatgcaaattctacctccaataaggactctcatattgaccataccaacaattcatccctatcattttccgatttctttagaattcaatcagctccacaaccatccatagactcgttagagaatagccatttgattgccgagagccaaaatcatcttcccgagaaatctgcaaatttgcaaatgctcctcaaaaatatactcatctatgacaattcaaactctcacagagtttag

SEQ ID NO: 525 - DNA, 570 bp, Cryptosporidium hominis
atgcataatggggacttgcaagactcgctaaataattctgtacactcaaatgcaagtaataactactgttgtactaaaccttattttgacgcctcaaataatgtatcttacaaaataagaaatcatgaaaagaattatagcggattcaaagaaggggcttcaaataatggtaaaggcttcagaaactttgtaggaaatggcctccaccaaaagaagttccaaaataatattttgttgaatcataagagtaatggttttggtacaaatacaggtttagctttggcttctgtctcatcttcaagctcgcgaggaattaggtccagcaagtttggcgataggttaggaaagttagattggggttctcagaaccttattccatttgaaaagaatttttatcacgagcacgaaagtgtttctagtttatcaaatgaacaagtggatcaaattaggaaagaacgcaagataactataatagcgggtgaaaatgttccaaaaccaatcactagttttgtcacttcgggttttccgaatttcctggtagatgctctttaccgaacaggatttacttga

SEQ ID NO: 526 - DNA, 207 bp, Cryptosporidium hominis
atgcaaaaggctgttggcgctcaatgtcggtatataattcacatccctcaaggggccacaatatgcgtccaagtgcaaaaactcagaacaaaaacaaatatcttaaataataaattaacacaacaaagccaatctctaatactcaaattatctacaaaaccatatataatcgtcggaaacgcaattcttccgggaactgaagcctga

SEQ ID NO: 527 - DNA, 1293 bp, Cryptosporidium hominis
atgatggaatctaggactccattggaacagctagaaatagagctcaataagagaggtgagcacaaggagcagattgaacagttaaagtcttatttgaaggaaaagttatattttcagtttttggaatcttctttggaatatatttctactgatggtctcaaggtttgcggaaacgaactatgcgaattcttggtaaatgtagttgaaccacttaaaagtaactttaatcctttgaggtatgcagtgtttgtcggggaggttttatcgaggagccccatcagtattcaagaaaaggtggagcttctcaaaaaaacaatgggagatgaggatttatatcaagtaaaagaaaattacaagaatgcaagcttgactcaagaacaaaatatcgcaccaaaacaagaaatcaagggtgatctatactttagatgcttgctagcattggagtattccaagtccaaggatctaagtgtcgattgtgaggaaatgctcgagtttttaaccaaaaagttggagttttataggggacttgaggctgaaatattagctttatatcatcgttcatatgcctcttatgagaaaacaatggggagaatgagtaggttctacagacaaactatacactatttatcttatactcctctcaacaaaataccttataaagaaaaaccatttttggtttacgagctaattatggctgcagtcatttctgaagaaatatataatatgggtgagcttgttcttcatccaattgttcaggaatttagttccatagttaaaggaaataactctaatcagatgatagatgaactgacaaaaaaagaatttgcagaaaacgcatggatactcgaaatattagtttcattacatgaaggtgatcttaactcttttatgaatgctattacaaagtatcaagataaggttagtaaaaccccactttccactccagatgccagagtgtgcattaccaaaaagactgcaactctagcacttatggacctagcctttagaaagaataagaacgagagagttctcacttttgacgaaattgcaaaacattgtaggattggagcaaatgaaattgaactattagtcatgaaggcaattaatatgaacttaataaaaggtattattgaccaggcttctcagactgtagaaattagttgggtacactctagagtattagacaaaacaagaatgaaattattaatggacaagattgataattgggtcggttccaccacggatattgtttcccaacttgagaatattgctcctgagcttgtgaattcctaa

SEQ ID NO: 528 - DNA, 945 bp, Cryptosporidium hominis
atggagaaagatattgaggactgggaaatctggaaaggagatattcctttttggaaacactccctagcgggtagtattgcaggggttatggagcattcctgcttttttcccctagatacaattaagacatgcctacaatctggaaaggttgatggtttaacaggaaatcgaggtatgattgcatttattagaagcaatggaacaagagctctttttagaggatttcctgctgtagtatttggaaatgtcccagctcacgcatctatgtttactacttacgagttttcgaagaggttgatgtcaaaaattactaagaaattagaaaaacgagctgaaagtaaatccagtcttttacatgatgccaatacgagtatattcaattcagtggtttcccctgctatatgtggtggattatcaaccatttctcatgatatcattgccactcctcttgatgttattaagcaaagattacaagttggttcttataaaggaatggctgattgtattataacaatgttcaaaagggagggaattcggtcattttacagatccctacctataactttgtttatgaatatcccccaaactggtttatttgtattattaaatgagaatctcaaatccttttttggaaaaaataaggatgatttgcttaaacaaaatacattcaattttgttattgctggaattagtggtggaactgcagcatttattactaatcctctcgatcttattaaaactaagcttcaaacgcaagcatgtcatgtttcccaaaaagaaacgttaagagttgtttatcctagcgttaaaaaagcttttattgatactttaagaaaacaaggtattagaggaatgtattccggagctttagccaggtcacttttaattgctccatcatatgctttatgttggggcacttacgaaaccgtcaaaaactttctttaa

SEQ ID NO: 529 - DNA, 576 bp, Cryptosporidium hominis
atgcttttgggtcaagtatgtcccagccaaatggctggaatgggtttgaagagatcaggcttattagtctgtaagtttgcagatagtgaagacttaaaccttacttggccaggaggtcagacaaagcaaaacttggtaaattatttggacaaatctattcgtattcatggtaaattttgcggagatgacttattagaaatagaggtatcatacttggaagaagacgataaagtttgttggagagccacaacattagacgaactggtcgaagattgtgcttttaatatcattcgagtagtaaaacaaggcaacccaaataaggcaatgataactgaaagtgcaactaaaattaaaggacttaaagaagggaaaaggtcatcgattaatcaagctaggtatatggggttaatgaaggatcaggaaggttttgctccaaaacaatgcagaccaattactaaagaggaactaaaaacccacaacagtgagaaagattgctggatatcttatcaaggaaaagtttacgatattacaaaatatctagagttccaccctggaggtaagtttgaccaaatttaa

SEQ ID NO: 530 - DNA, 1044 bp, Cryptosporidium hominis
atgcttgcatggataaaattgatgttcagtatttatataatattttatttaatttttttctatattcaagtagtctatagtttacattcaaatttgagtaaaggagcaaacggccacaaatactttattttaaatcctatacagtataatgactttgtgttaaacattataaaaaactcagaggaaattagctcagaaaacagttttcgaaaatctgataatctaaaccaaataatttcaagccaaattaaaaacattatttgcaaggaatcggatttagtattcagtaatactgagacgaatgtaagccatagtacaattttgaatttgactactagcgacagtaagactaatggaaatagtgattacttgcttctatttggtgccgatagatgtattttggattcatcttttatagatggtaaatttaccaagattaatattcgatttatcccaaacttggtgaatcctacaaaagaagtatatcaagacaaaatttgtgattgtgtcttcaaaaaaggaaatgctgatgaaggcagccctagcgaattccaggttaattgtaattctgattcatccaatgattcaaataaaaaggtactagaggaacatgattatctagaaataggaggggcaacagctttaaatattgctgatttagttaatctacctaccccaattatagataaaaattctcaggtaggtagggaagttaaggttgaagtttctaataaaactcctttaaaacctataattaaaccaaatcatatcaaggcttcaaagccaaaagtaaataagtttaacttttcaaaatacttttgggaaactaatagtggattttttggtgaaggagaagaagctattaaaaagtcaaatattgaatattgtgaatctcacggccaaagcaaatcgtgcgaggatgaagaaagatctagaatagagagagaatttagagaaggttgtaataacaaagaacatcaactaatattagaaacattattaattatagtcaataaactagtagagtatttagacaacaaatag

SEQ ID NO: 531 - DNA, 2157 bp, Cryptosporidium hominis
atgatgggacagggccaaaacgcaataaatggagcttgttcaagaagatatgaaaaggactccatagaaataaacaagaataaagagcttagaagaaaacaaaataataaaagaggaaatttccaagcacataacatgactcatggaaagccagaatatttaaaagaagcagtggaccgcttaattaaccatggtaatattgtaggaaattcgccagacaggtatttagcaaaggaaagaaaaagtcaggcatcatgttcaacctcagacccgacttctcctttggcttatagaaatggtaatgataattactttgaacaatatgagatttgtgatttaattgaattaacatctgaaatggcgttgtctaatgaaagccgtttcgaaagcttaagtgaatatgagtcaatccctaaactttcaccaagtacaacagtaatgggtataacggatatatcagtaacaaacacctcaaattcgaattctgcaactccaacagaatctgaaaaaggtagtggccctaaattatctttgacacaaggcaagtttaggcgtgaaggcttaattcctgcatgcaaagggtcaatacactcagattatattattgattctggaaggataggaaagggaacttatggttcggttaaaagtggtactaaccgattgacaggctgtatcagagcaattaagacgattccactgactagagtggaagcgttagataactttatgaaggaaattaacattttgaagaatttggatcatccaaatatagtaaagctctatgagacatatcaagataaagaaaatatatatttagtcatggagctttgtagtggaggggagctttttgatagaattattagtcaagggagttttgatgagatttatgcagccaacctaatgaagcaggttttatctacaatttgttactgtcatgatcatgggattgttcaccgtgatttgaagccagagaacttcctctttctcaataagaattacaatgctccacttaaaattattgactttgggttagcagcgagagttaacaatgaagatacctccttaaatactcgagcaggaaccccgtattatgttgctcctgaagtattgcaaggtaaatatgacaaacaatgtgatatgtggagcttaggagttatcctatacattctactttgtggatatccaccttttcatggtagtaatgatagtataatacttcataaagttcaaaagggagtatatgcctttaaagaggaagactggaagcatgtttcatttcttgctattgatttgatcagaaaattacttacttataatccagctgagaggattacagccagagatgcactaaaccatccctggattactagatttgcagatgacattctcttcctgtctcctagaaactatttctactccaatgatggctttatgaaaacaggcatagcgtctagcgactatattgattcaagtattaataacctaaaagccttggaatgccaacaaaagcccagaaattgcagtttaatgggttcgagaagaaatggctatattaagggaggacttaggtactgtaggtcaaagagaagatctatttcatcttcttcaggcctgaatctgctatctaatttcagagcattccacaaatacaatcgttttatgaaggttgctcttactgtaatagctcagcagatgacagagagccaaattagtaatttaaaggaagcctttattcttttggatgctaattgtgatggaactctaactccacaagaaatcattacaggactgaagaatagtgggattactgagcttccctcagacttgcttgcaattctaaatgatattgatagtgatggaagtggttcaattgattatacggagttcatcgcagctactttagatagtaaacaatactcaaaggaacaagtatgttgggcggcttttaaagtatttgaccaagatggtaatgggaagattacagcaaatgaattacttaatgtgttttcatataattctgaacaaggatctgcaggaatcaatgataaggctctttctgatgtgaagaatatgattaaagaggttgatgtagatggagatggtgagatagactttcaggaatttttggaaatgttcagaagatctaattcttaa

SEQ ID NO: 532 - DNA, 321 bp, Cryptosporidium hominis
atgccaccaaagggtgaaaaaaagactaaggagcaaattgcagcagctgctgctgcaggaggtagagcaaagcgcaagaagtggtcaaagggtaagcaaaaggataaggcaaaccactccgtcttgttcgacaagaagactgcagaccgtttccatagtgatgttttgaagtcaagacttttgactccagctgtcgttgttaaccaattaaaggttaatgccagcgctgctagagccatgttacgtgactgtgaatcaaagggaattatcaagccagttggagaacagactcacggacaaatgatatatacaaaggcataa

SEQ ID NO: 533 - DNA, 1755 bp, Cryptosporidium hominis
atgagttgtattcaaatactggattttcttagaaattatatcaataagtggccagattttaacgcaaaagcattcaactttgataacttttcattaaatgaaaactctgaaaaaatatatgaaaatttgaaaaagagagtatgtggatatttatatgactacctatgcgaagatgagatttctgaaatactttataactcgtttaagaggcttgcaaatacttttattacgagctttgaattagaatttacagctcaaccagagcttgacattactgatttatttgtgatgtttgagattatcgacagtgaatttatgatatctgataatactgccgaatattgcgttttatataggaatgctgtgagtggcaaatatgagccaaacttgattgagaatgaatcgattcgcaactttaactctattgcaagcttaattgaacatgctatttctaaatttaactctaataatatctatttactgcaggatattaattcagtttcgagagagactctcgaagaattagttcagaaccgttacattagaatgtacgaaatatataagagaaagtctgaaataatggtaaataaaattcatttaaatcaatttggagcagaaactgtaatgaatattgaaaggtcttgggaagtcatattattttctaaaatcattggaataataaagactcttttcttggtgaataataaaatgaacgactctgaaattaacaatggaacatatgaatattctagtgcatatgaaaagagcattctattaattgctatcaaatttactgaaacacttaaaattattcaaacatataataaagagaataatagatgtgggactattttatttttacaatttgaattatatgaaataatacgtaaccaatttccttataatttggtaggctgcatagatgatatagaatattggaattactttcaaacatatatggaaatgtttacagatattcaaaatttaatgactcttgagttgagttacttacctaaagatattgaacagatgattgatgatgcgtattttaataggatgcaaagtattatggattacatgttcaatcgaatttttattattataaatagcatagaattaaaatattattcaagcgaaaaacaagaaatgaattatttaagctctttttgtgctttaatcgccaactattttaatcccttattgttttctaaaaatgagtcaaatgagaaatattatttattaattaaagcatcaatagaaattaatataattaattgggctaaattgtcatttttgtgtactaatcatgaattcaatacatgtgacgactcaattaaaattgagacaggttctattgtaccgaaaaatatatccaaagttgacttttttgaagggaaattaattaatggatattatatgatattttgtggtcttaaaatactttatttattattaaatactacggatatttcgtttttcttgcctctagttagacatatattcagcaatttacaagtagtttattgcttactttcgaaacaagaatatcaagaatcattaacctttgactatattgatgattttaagagagcaaaaagactcctagacgaaataataatactattttcacaaagtcttaacatagagtttattcgcactctctctactagtgagagtaatatcgatcttcaacgcaataaaacttctatagacctactaaataatttaatagaaaatagctgtctcatagtttaa

SEQ ID NO: 534 - DNA, 1518 bp, Cryptosporidium hominis
atgaagaactcaggtgtagattataggggtcgtccgttatttgatattccccataaaatggcgagcacaacaattctaagtaagaactcagcagacctaaatctaaaaggattttttaatctgtttatattaattcttgtgttcacaaatatgggtgttgtactggaaaatgcaatgaagtatggctgtaaagtttcgtttcccaagggaattacagacttaattcaaaactggccaattctatggtgtatttgtcaactactggctttggtatttgtttcctatctgctcgagaagtatcttgcttctttaaaaatatttttactcaatatttatgactgcgagccaaatagtaactcaaatcaagctaattgtggttttgcaaattctagtttacctaaaataacgggggggttatctctggtgttaattatgattaacatgctaatgatgctttatattccatataaaaccgttaaattttactcaccaaatcctctctcttctttaattttactcagcttttcatttgtttggtttttcaaaactttatcatttcatcatgtttgccacgatgtcagaagatgcatattaaataatgaagacttccatgaagtttgcggaacctctccagaagctgaaattgcgagtaaatatccaacaagtctatcactaagatatcattattggtttctaatggcaccaactatgtgttttcaattctggtatccaagaactggtggaataaggtggttgcaggtaattaaacatacaattgaactaattacatgtattattctcatcaaaataataactgaacaatatgttatggtgactgcgcactacacttttacattaaaggagattcaaagtatgaatattttccaatttttaggtcatatggctactagaattatgaagctctcaattccatctctttatgtgtggttattgggatttgtttcactatttcaccattatcttaatatacttggagaaattacatgttttgcagacagagcattttatcttgactggtggaatgctggaaattttggagagtattggagaaaatggaatctccctgttcatttcttcctcacaagacatattttcaagccattaagaaagaagggattcagtagttctttttcaggcttacttgtattcacattttctgctttaattcatgaatatttggtagttgtaccattagatatcggatggacagggtgggtcgtgcttgcctttgttttccaagtcccactttcatcttggacccaatcaagctatattcaaaaaagagaaactcttggcaatgttttgttttggattacattttgtttctgtggacagcctattgcagttttattatattattatttgtgggctctttctaaaggacagattgatcaaatagacttaaataaaattgaaggaattccacagattccactggaaaatatatccgggtacattgccaacttaacaaatgtaactcataatatttatcattaa

SEQ ID NO: 535 - DNA, 2913 bp, Cryptosporidium hominis
atgagtagcaactatagagttcatgatgacgatgagtcgtcacagaattcacatgatggaaataattcttcaagcaatggcattgcaaacattttattaacacaagatcctagtgactacagtgaggcagaagaggtagcggttgatgaagtagtgtatgaggaagagattgcaaatgaatcagaggaggagcttggagaagatttgtatggagacaacttcatgaatgattataacaagaaccctgaattagataaatatgaccctgagatgttggatgatactcactatgaagatgatattgaggcaaaaagaagagcagatttggctcttgatagaatgaaatctgagaaatcccagggaaagcagacggaaattcaccacaaatatggaatttccacatttaatgcagatgatggcgatgaaggtgaaattgaaaagagaaggaaacgaagagaagcctttagagagatggcagacgaggcagccagaggaggcgccattgttgatattaatgaactaattcaagatttgccattggctgagcagtctgaatggagtgagcatgtagaaaatatcattcgacgtctatttaaggtatttctacaagacttcaaactctcctcaatgtacaaaaccatttcaaatagtgataacaaattagaaggcagaaatatctcttttgaagatctctattatattaaaaaaatcgaagaaatggtacaagaagaaaaaaccagcttgtatgtggatgttaagcacatttttactttttgttacaaactctgggactatttgaacctttatcctactccagtaattgaatgttttaaccaatgtgcatatgaggtcgtaacatctatgtaccatagtttatattctggtaagtccattatggtaagattgattggtctagactatattgatcaactcagagatttaagagtagaatggttaaaccagttaatcagggtttctggaattattactagaagaactgacattctgactaagtttaaatctctatatatggaatgtgtaaaatgtggctgcgatagtttagggccttatgaagacaatccattgtttgaaagtggatctttgagcgaaaacaattcaataatgaagaatattggaaaatgtaccgattgccagagcaagggaccctttgtaattaacagagaaaagacgatttacgaaaactatcaaaagcttactattcaagaatcccctggtagtgttccagctggaagagttccgaggtccagagaaatcattgttagtggagacttagtagattatgcctgtccaggtgaagaaattattgttactggaatttacagaacatttagggaccaaaagttaaacatcaaatctggattcccaattttgggaacccaaatactctgcaataatattgagaagaagcatgatgcacttagaaaagatgatctcactgatgaggactacaaaaaaattaaagagttgtccagagatcctgatataaaagagaaaattgtttcatcaattgcaccatcaatttatggccacaatcacattaagacagccattgcctgttcattattttctggggttagaaagcaagtggaaggtaaacaccaccatattagaggtgacattaatgtcttaattgttggtgatcctgggcttgcaaagagtcagttcctcaaatatgtagaaaagagttttgacagaacaatttacacatcagggaaaggagcatcggctgttgggttgacggcttcagttagaagagatcctatttctggtgagtggacactcgaaggcggtgcattagttcttgctgatgaaggtatctgtttgattgatgagtttgacaaaatgagcgataaagatagagtttctatccacgaagcaatggaacaacagagtatttcaatttcaaaggcaggaattgtgacaacactacgtgcaaggtgcagtattattgcagcagcaaacccaatttttggcaaatatgactccagtttgacatttaaggataatgtagatttgacagatcctattatttctcgttttgatgttttagcggttttaaaggacgaggttcatccaatgaaagacgaattattggcgaattttgtggttcagtctcacatgaatagtcaggaaatgtatggaagtagtggcttggatcaggatgatcaagagaagaagttttcttctggcctaagcgatacaagccaaaattgtgatcagagatttgcaccaatcgaccaaaagctactctgcaaatatattagatacgcaaggaaatactgtaaaccacagattagaagcgttgataaagaaaagattataacattctactcgagaattagacaagaggctcagcaaaccggaggcatttcaatgactgtaagacatatagagagtattattcgtcttgcagaggctcaagcaaaaatgagactcagtccagtcgtatcaaataaggatgttgatggagcaattggtatggtgctcgaatcattcattcagagtcaaaagtatgcggtagctcagagactttcaaagatcttctctagatataaggcgttgagcagtggatttgtggatgtgctggagaatctcctattacaattattctccgataagattcaaaagattaagctcagaaattgggatgaggagcagatgaatactattgtggaagaagttgacaacctgaccgtaaatctagatgagtttatagcaatagcagagaaaatcaaactttctcataatgtgacattatcgtatttaaaatcatcctcattcttaaagcactacttaatatcagaaaccactgactcaatgggaaataacatcaaaataatttgtaaaagaagttacacagatcaagactctcagagtcaactttctatgtag

SEQ ID NO: 536 - DNA, 1197 bp, Cryptosporidium hominis
atgacaagaaaagaaaatattaacccatttattaaggcactcaataaatatccaaactcagtagtaatttcactctgcaaaatcccaatagttaattattcaggtaatttacttggacgagctacatggaacgtgataaatattctttcaaaattcaagagagtatcgtttctaaaggaggtgcttggagtatatcacataaaaatatttatggcagatgacaacataattatcaccagtgcaaatttgaattctgaataccttttaaataaacaagatagatacataatgattacaggtgcaaaggaaatatgcgactatttcgaacaatcattggatttaatatcagaatactcgcacagagctttatcagagggagaaatacagaaacctaaaaaactccattttaacgaattaaaaaaagatttaatggagttaagtagtgatacagactttcatgataaaatagcatccacaattaagaaaaagttgaacaatgaagatacttctgatgattgtgtactggcatcttattttcaatgttctccaataaatatcaaatctgaagagcaaatcattacaaatatttcccaactttgcgataaaaaaaacacagatatttttctgatcgctccttacctaaatcttcccaaataccttatctcactgcttaaaaatagagagagatcagtaaatatagtatctggagttcccatcacgaaatgtgataaaatgattaagaaacacaataaaccgtccttggaaagaatcagaactcttgttcttccaaaactatacacttacataaattactcattaataaatcagcttaggacacaaggaaatggaatcattaattatttcgaatataaaaagcctaattggtcattccactttaaaggtatttatttttttagaaatattagcaaatctaacccttgtggctcgaatgtgcaaaatcaagggcaaatcatggctactacatttggaagttccaactacaactatagaagtactaataaggatttcgagtgttcatttgtcctaatacccaatcaaaataaaattcttgaaaaatctttaaataatgaattgacaaatataatgaacacatctgtgaaacaatgcgcgccaaaaatcacttggagacgtttattaattttgaaagtagtcaaaatatttcaagaatatttgtag

SEQ ID NO: 537 - DNA, 945 bp, Cryptosporidium hominis
atggaaattattgatcaaaactgggccacttttggattttactttttatcagttgtaatatgcaccctttcaactatagtatttttcctttggaaatctgatggtgaagtaaacacaaaaaaagacatttttgagacaattaactctccttctctatccgaagaaaatgttattagatattccagacaaattgcacttaaagaagttggagtatctggccaagtaaaattaaagaatgcaaaggtattagtaattggtgctggcggattaggtagcccaattttgctttatcttactggagccggaattggagttattggagttgttgatcatgatacagtttcaactagtaatttacatcgccaaattattcattccacagataaaaaccatatgagcaaatcaattagtgctaaacaatcatgtaattctcttaatccaaatacccgaattatcacatatcaagaggctctatctattgatctagttaaggaaatatttccactctacgatgtaattgtagatgctaccgataattgtagaagtagatatttaatcaatgatgcggcagtatattataaaaagcctgtagtttctggagctgcactgaaatggcagggccacgtcactgtatataactattctaacggtccatgttacagatgtattgcacctagagaagacaatggaaaggtcgatggtactcctggaggtgcagaaatttttggtgtattaggaatgatggtaggcgttattggctgtttacaatctactgaagtcattaaagtaatacttaatgactttggaaagggtgataatagtggaattgactctcctaatcaacttcctgttttatctgggaaaatgctcttttataactcattaagtaatgaacatatggggaccgacttgttagaattagagataaaaataaccaatgtataa

SEQ ID NO: 538 - DNA, 525 bp, Cryptosporidium hominis
atgttttttgaaaattttgataaactgcacacggcaaataatctgaccaagtttatttatctttttggtcaaattccaagcgaaataattaactcggaattatatcaagtatcgattaactctaatattgaactgccttttctaaatacattttctccaagaatagttaaaaactcaccaagatatattaattcaattagactcaccgaaatattttcaatagtaataaaaaatataagtaaatcgcaaaaaactaatattaagactgttttgctattcttaatagattttgttaaaaggttatataaccaacatattggtgaattaagaggtaaattagtaaatcaagatcacaatacaaatgatcaagccgacttttattattcatatatagttttattcaagtatctgaatcactgtcttgagaaatataataattatatagatgaacatataactatgtcactaaaaagcataggaaaacctgaatcaattattccaaaaaatgtgatatttgctttttag

SEQ ID NO: 539 - DNA, 969 bp, Cryptosporidium hominis
atgattgacctactctatgatcttaggaagtatgcagttgcaaaacacccagaattctctgctgcaattagtaatgctgaaaagggtgttgctcaagtaggtgtggaccaaggcgtaaatgagcaaaatggcaactcaaaaaacgatgaagaaatgtccagttattacagtgagattcgctcgattggagtttctcttggttatataaataagatgattgatggaattaggattaataaacaacgtgcattgctaactacgagttcaagcaaggacgaagaaatatctgaaaatttagctaagattctggatgagactcatgaaaagactctggaactaaagaataatatagaatatttgagaatccaaaatgaaaatctcaaaaagaaggcaagcaaaaaagaagctactgaaattatgattagagagaatttactccaaaccatttcaaaaagatttagggaaactatatatgagtttcagtccgtgcaatctgagtacaaaactgagatgagaaataaaatctttaggcaaatcaaaattgtttatccagatgcaacgcaaagtgctattgagtccattgcagaagaagaaggtaagataactacaacgcaactaataaaaatgaaattgagtggatcacatgaaactattggaaatgcaataactgaattacaagatagatatagagatattagaaagcttgagaaaagtgttgaagagcttcagcaactatttattgaattagcatcattgattaacgagcagggtgaaatgttggatcatattgaattttctgtttcaactgcaaaagattacactgaaaaggcagatattgaattaatttctgccagaaagtatcaaaagaaaactcagaaaaagatgctttggattattttgtgtatatttatactaattctcgtagtattactgcctatgattattggattcacaattaatagtagctag

SEQ ID NO: 540 - DNA, 1008 bp, Cryptosporidium hominis
atgtcttcagaagcagtagatgtgaaatctccaagactattcgcttgtggatatcctggttgtcatgcatcgtttaaaagaaggtctcatttggagcgtcatgctcaaactcataccggaataaagcttttcaaatgtcatgaatgttcaaaagcattcggaagaagtgaccacttacgccgtcatatgatgttggtacatagctcaattgaagaaaaagcgagttatccatgttcatcctgtaatagtgtatttatgagtccaacatcattaagaagacatattaaaaggtcacatgacacaccgtatatttgtgaggtttgtggtaatctctttccatctgccacttcccttcagaggcatactctcaggcaacatcttactgctgaaattccatttcctaatcgtacagaagatagcaattcaaagcaatgttggtatgtttgcagagctgatcctatgttatgctctgcggcttttctttcgtaccctggcttagtaagacacattaaatctaagcactggtcttcgtctaatgagccgcagccactcattcttaaccagaatcagtgtataataaataatgataattcgcaaaatcaatgcctatacgccttgcctaatgaggccaacgtaggtcataacgaaaatgaccctttattgaataatacaattggggaaaataaagatagtgatattgattgttcatataggtgtccataccctgattgtggaagattttatagctcaaagagcaatgtcagaaaacacatacaagtttcacattgtaacagcaaaccttacgaatgccacttatgccccaaaaagtacggctacagaactccttatattcgccatatgaaaaacagccaccctgaattccaagacgaaaacataataaatgaccattgtagtggaattaccacaatggacgaatctcacagcgatctaacgatacccggaactcctcactaccctccactatacgttgatgctattcctttttaa

SEQ ID NO: 541 - DNA, 2019 bp, Cryptosporidium hominis
atgtcctttcaaattgttccagatcagttggaggaggtagaagaagacgtaaatactgcaattgcagttgccgtgtcaactagcagaaatgcactcatggaaatcggcattaatgaagaggaggaagaaactccaatgtctcaaaacgctaatatagagagtcagcttcaaactcaacagagttacaattcagagacatcatttccagatgaagtgcaatctttcttaattaatctaaacgattctatttcacgtcgtgatgttgatagaattcgatactttaatgaaaatttacataataatctgacctttaagtattatatgaaatctcgatggccaaacccatcagtagtggaaaatttaattgatagcttcaacaattattcggaactgaccaaactcttgtatattgagcaatattatcgtcacatatttgctaaattccccaaccatgttaaatggatagatagagtctcatcatggaaaaactatattgcattgtttaatcatttattattcagggggcattcaagcactgaatcacaaagttcacagattccaaattctcttaaggagtattttgaaagcaacaatttaagtacaaattttgatcgagaagacgaaatatgtctacctccagaaatgactcatggtattattgatgagtttttgtatcaattccaggacacatgtagatacagaactagggtagcgcatgtaatttcaatgagcgaacaaggtcaaaatgacggaagagctgccaaggtggaccaagatgtttggagatgtgatattattttccaaatattccagtcatttgttgacttaagtgaagttagaatgctaatgagtgcagatagttcagcttctcagcaggaacatttacaagttctaaactctgttgaatcattccctattagatatcaacttggttacttctcaattctcgggttattaaggttacatgcattacttggaagctactatattgcaattgaggtttcaaatggaattgatcaccagatcttccgcccattattatggaaggtgcaaactgcttatgtatcttatttgtattacttaggattttcttacatgatgttacaaagatacatcgacgcaatccgtatattccaacagagtaccgtcagttttgcatcgaatgcaatgaattctaataattcttctcactcttctccataccaacatgatgccataggaaagtttatcgatagaatgtcatggctgatgctcttctgtcaacttctttcttatggaaacagctccaactttaataggatggaggaatctttatcacatcagaatgataggaagtcatcaccctcattttccccactgggatcagacatttcaaactggaaggaaatgctatctaaggtatctccaagatttatatccccaagtgtgcctttaataactccaagagatcatattgtaaaggctgatcagaatgaaccccaacaaaggcagatgcagacattctcacccctgatgcacctttatgaattgaattctatgattaggtctttcacaaagctttacaacaatttgaatgttgatactttggcaagtttaatgcatattgcaaagaaaaatggcaatctgaaatctcgcgaggtaattaagtctcgtaatagtggatctgactctcaagccaatgaaatatctagcacgcattcaactactactgatgattttgaggtacaggaaccatcaagtatcgcgagatctcaaataattgcaattaaaagtagatctggacgtcagaagatttggaaatcaggagatttacattctggtgagctggttcaattaaatggcgatgtagacttacttttagatctagacacaatacacattattgaagggaagcaggttgataaattctttggggatatttttgcaaagcaaattcttaaggctcgaaacttacttaggcatattgactcattgacaagcaaaaatttagactcatcttcaaagaaggagaaggcctaa

SEQ ID NO: 542 - DNA, 981 bp, Cryptosporidium hominis
atggctggaaattctgaatacagcagagatgatgacaccggtttaactattattcaatcactctgcatgaactgccataaagaaggtgaaacaaaactattacttacttccattccacaattcagagatgtaatattaatgtcatttgaatgtccacattgtggatttaaaaataacgagatccaatcgggaggtgttttgcaagataagggagagtgtatagagttggttgtaacaaatgtttctgatttagatagacaaattgtcaaatcagaatttgcaactatttctatattggagcaagagcttgatattcctccatctactcaaaaaggagtaatttcaacaattgaaggtataatcacaaagactatccaaggcctttcactcaaccaagaagcaagaattgctcaagatcaagaagtaggtgggaaaattgaaaaaattattaacaatttaaaaggatatctagaaggtaaggggcttccttttactattaaactagatgatccaagtggaaatagctttatccaaaatccaattgcaccccttgttgaccataatatgaaaagaaaactttatgatcgaacaaaggagcagctggaagaaatgggatactatggagttcagaatctaaaggatgatgaaagccagcgtatttctacataccaaccaaaaaaagataattcaaatgtaacattcagcaaaggagctgacatacctgagcacttaatcccccactatattgacttgaataagagtatagaggaccagggcgagttaggtagcaatgaagatcgtattaagtttgatgtaccatgtccaaattgtggcaataatggagagagtgacgtatgtgaaatagatatccctggttttagaagatgccttattatggcgtttgtttgcaatttttgtggaataaaaactaatgagttaaaaccttcaggagcatatggagagctcgcaaaaaaatggtaa

SEQ ID NO: 543 - DNA, 528 bp, Cryptosporidium hominis
atggagagctcgcaaaaaaatggtaagtttgtttatatttatcaaaatcaattcaattatcatttctattattttaggattttgactgttgaaagcgaacttgacttaaatagagacatcttaaaaagtgatactgcttcaattgagattcctgaaattgaacttgaaatgggtatgggatctttaggatcactgtttacgactgttgagggtatgattgtcaaaattacagactctttgaaggattgctttacattccaaggtgactctgcaacatctgaacaaaagaagggtttccagagagttattgaaaagctggaaaacttgctagaaaaaaaagaaaagttcactctaatcatagatgatgcagcagatcatagctttattggcaaacgtattgttaatggtcaatttgtccaggatgatcagcaattgaaaacagaaaagtaccaacgtactgattatcaaaatgaaacacttggaattaatgatatcaaagtagagaattactctgaatccgagaattaa

SEQ ID NO: 544 - DNA, 1863 bp, Cryptosporidium hominis
atggtagattcaactataatggatgttaatacaaaaaagaggaaaagaaagaagatttcacaagatagccaagcaaatgagttgacttttttcgagaatgaatgcaaaaaaaatgttgaatcaaatatgaaaagttcatttacaggaaatgaattggttataattaaaggggaaataagttcttggctgaatttagtttcaaattcatcactttttccttctggaattgagaatattatgaattctatgggtaataaagagctatttaggggaataattgttgcaagaaggataacaaatttgccaatcagatatacaaatgtgcccggatctatcattcccaatttatgtaaaaattcactatactctgtttctgagaggtttccttgtacaccacttaattcagaatttgaaaaagaaaactttgaaagaatttcattcgatattgaaaaatctaaggagaacgattgtgaattagaagaagctctttttggagtattagataatccaaaaaatattaaagagggaagtgaatttcttattaataaaaaaaggaagaaagaaacaaaggtaaacgttgattttttgaaaaaaaatctatctattttcccaggtaatattggaagagagtatcttgtatttcaaaagtatgatgatggaatcattttggatggagatgcagtaatggatgcaactcccgaaattctttctcagcacatagctagaagattaagaggctgcacagtattggatgcatgcggaggagttggtagtaacacaatagcattttctcagcattgtaaacgcgtaatttcagtagaaatttcaaactctagaactctgatttgtaaacataactcacaaatatataagttgtatggagatcaatcttggaataataccgaaagcaatattagagatacaaattctattgatgcaattagagattctggatctcccacactacattttaatatagcacattcaattgatgacagttataatttaagcatgtactttgaccctaaaagcaatatagtttttgttaatggcgatattttagatttttgtgattggtaccaaaacaatagccataataaatatgatttcaaatcatcttcaatcaccaaacaagcatttaacaattttgaaaattttgaatgggcttttgcctctcctccatggggcggatattcatacaatggttttaaacattttaatttagagaataattcatctttgaattataaagagatgattatccgcctttcttcagttgcaaacaatattgcattgtttttgcctagaaatacaaacataccggaattttcagcactactttcaattcttgggttttatgccatagaaatagaagcaattcgtgatacaaggtttaactatatattaggaatagttttatactctgtaagaaccagatccaagtttaaattacaatatttatttggacaaaatattgattcgattagtcatcctatttcaaaaagattaatatcctttactgaacatattcttagaaagtcaaaattagatggaggtgaaagcgttaatgaacaaaatatatcaaagctaggaataaagaaaatatcaaagtttggaaaaaagattgagaggctaataaagaaaaaaggattagagccaatgatggccattacatatttactcaactatatattacatagggatgactattgcacaaatctttacctatcaaattgttcaaataatatttttccagtagctggtaataatcaagatataactcaaactgaaggtttaaaaatgaaaagaaaatacaaaaaatatataagaaagattattaaggagctcgagcatggaaattaa

SEQ ID NO: 545 - DNA, 930 bp, Cryptosporidium hominis
atggatatggattcaacgatgggggaatcccagtctgactcaatcatacgaatatatgtaaaaaaacgtagtgggaaacatcttgcagtgttaaatatagataaggatgctactgttagtgatctaaagctacaattttacgaagagtttcactattatccagaaaggcaatggtttaatgttggaagctcaaatggagaggtgcttaaagaaggaaaattagaggactatggagttgaaaatggcaccactttgtatttcaaagatttaggcgtccaaatttcatggaggttagtattctttatagaatatcttggcccaattataatttttccaattttttattttttcccaacattaatttatggggaacctgctcctccaaagagtatttctcaaaagcttacttttgctctggctttatgccattatattaaaagagaaattgaaacatgttttgttcacaggttttcgaatgcaacaatgcccattattagacttccaataaattgtttccattactggtttatttttggagcttctgttggatactacacatttcatccaaagttctcacctccagaattttcccccttaaccctatactttattgccattttaacgtgtgtctttgaatctctgaactttaactctcatttggttttgagaaaattaagagatagaggtacaaaaaaaagaggcattccctatggttctggctttgatcttgtttcatgcgcaaattacttctgggaaacactttcatggatatgttttagctttattgcaaattgtgctacttgttggctttacactttaattgcttttattcaaatgtcacaatgggcattgaagaaacacagaaattatcataaagaattcgctaactatccaaaacataggaaggccattgtaccttttttcttgtga

SEQ ID NO: 546 - DNA, 765 bp, Cryptosporidium hominis
atgacgaaaacctcaaatgtgcttatttcaaagaagttaacttggctacttagacatggagatccagcaaagactggactaaatatgagaaatgatgggtatgtagaagttaacgagattttggagcaaaccggtatctctcttgaaaaattacattatattgtagaaaacgatcctaaaggtagatttagaatgattgatgaaaatggaaaaaatttgatccgtgctaaccaaggccattctctttcatttatagaagatgaaaaacttttggctagatttgaaattgataataattcggaatttattcaaagaataattatacatggcacatatttagataaatggaaaaatattaaaataaatgggctaagccgtatgagcagatctcatatccactttgtttctgctaccaattttaaattggaatctataaaacaaggttcaaaaatttcggaagatatgtgcattaaccaaattgttagggaaatgtgcaattataagtgtacagcaggtattaggccaaactgtgaagtattagtgtttattgatgttgtaaactgtgttactaatagcgctgaatataaattccatctatcagataatggtgtagttttaacaagaggcaattctcaaggaataattgattcaacaatgtttcttctttgtattgatataaaaaatggggaaatattactaaataacattaataatgaacataaaattactgaaatagttagatttattgttaattcagcccgataa

SEQ ID NO: 547 - DNA, 1161 bp, Cryptosporidium hominis
atgccttttagaagaagtttgtcatcattaatgattccaggaaactattttgactttaatactctagctgatgctaagctaaactatataatagggttaatcaacttggtaattaaatatatttcagttattagaaatgtattttgtaacactttttatttacccgtctttctttcaaccgactcaattcttttggatatagaaagatccatagaagaaagcattctgaatattactgaaataaccataaccgacattggtgaaaaatcaaatttagatataatagaatactcgacttttgggaatccagattgtctttatccaatacttaatatttgtaaaaataataggtacttaagtcctgaaatagcaatttcctattttattgaatgtttcttaaggaagaatagagaaaacagcgcaatgaaaattgagaaaatacaaaatatttatgattgctttgacccaaatattttgaaaaacgctttaaatgaaagaattctaaacaaatggcaacctttaattttttctggtgatataatatttcaagataaaaacaataatgtttataatgctctgaataatcaagataagattacagatttgattattcaaaaggaagtaaatttaattgtaaagattggaatgccatcaattgtcttctctcttggtttgctaatttcgaatatttttggaggtaaggacctttttgtttcatgtgacaatgatattttgcattctgttgattgtttatgcgaatggaattcctgcggtgattttgtcccatttattggaagagttaaagaaggcaatgtgatgaactctctttctggaagaagaaaccaatctgtagaagacattatgccagaacttaatcctaaaagtggatctcatcctcacactttgcagctgaacaacaaaatccaaaagctcttgtggggctgtcttaatttcactccatgccaaagattaacacttgctcaagtcgaatatgagcttagacgtataaacgatgatttagcatttatctatcaacaaagaataaataagtttgacactaaatcaactcggagcgtaaggtggtttaataaacttaaagctaatcttaaaaaaaatgataaatctagatcatctgagaataatattaatattaatttgtga

SEQ ID NO: 548 - DNA, 1125 bp, Cryptosporidium hominis
atgataccttttgtacaaaaaagatttgatactgatcatttaaataaaactattgtcatgttaatgcaaataatgccaaaatcaacaaaaatctcggctgaaaatactcaatcaataactacattagaattaaatagaacatgttttgccaaagtaacaatttcaaaacctgggcctgaagactctgatattaattcagatgagaaatatagtgatattaaatcaattgaaattgttactttgactgaacaaacaaaagctattgtcagctgtttaactggaataattttacaaagctttgaatttccattaaaaagtaatgaaaatgttaaactatcagggattcttgaaattgtttgtcctacatttgaattactattaaggaaatgcataattgaatgggaaaaacaaattgattacattattaataataaatttgcaaatgaacagatggtgttgattttatcagaaatgaatacattacttcatttaattgtaccaatttacttaaagtatctaagacataaaaatatcaacggtaatagtaaaaatatacacaaatcaacatttcaatttctgcaaaaaacccttagcaatatattatctgtattttctgactttttcttaagcttatctcaaatatttatcacagaatctaattctgaaaatttttccaaggatgatttaaaatcacctgctcgtaataaaataaaccaagaacgaaaagacattatttactctattggttctagcctaatttcttcactatcaataatctctgatgtttccacatacaactggacaaatgtatcacgaagaagatacttaccttcacctcattttaaaatatgcggctggatctcatctagtcaattcaaatttgtcgatttatggaaaagaatatttatttctgagcgttgtataattgttaaagaactttctcaaatagtaaccctaatttcagaaagaagctctgcattgaactcaaaagatattataacacgaagcctcaaatttagttcggaagataatgatgaatataatgcatttttagaggacattgacgatgagttatataatgattctttagagaatgtaagcctaagcttaaataacgttgattaa

SEQ ID NO: 549 - DNA, 1278 bp, Cryptosporidium hominis
atggatttatctattagaaacgaaaatagtttgggaaatttcacaagtgaagagttaacatgctacgaaacatggtataaaataattcagcatttcagcgacaaatatccttccagtttggaaccgattaatcaccatgatattccaaagtttgggatgattacggctaggtttttaaaaacctcgggtatacctaaggatgttcttcacgatatatggcaaattgttgatactgaaaataaaggaatactgggattttcagactttgggaatgcatgcagattagtttcattttttcaacatgaaaaaattttcccaaatcaacatatgttatcaaaaattcctctaaaacttgcatattttaacatttcaaagttttgggaagaggctgagaaagctgttaaggttgatgagcaagatataaatagtataattaactcatacttttccgatacttcgcatatttctgattgcctgaaaaggttcaaggatttagacgaaaagaaaagtggatttcttgatggtattgcgatctttaacaagtacataagctcaaatcttgttagaaaagagcttaaacagatctgggacttctctgatttagatgaggatggaaagctttcggctgcagaattcataatcttcaacactctagtcaaggtttccatagaaagaaatattagtattaattcaggtgtttctaaacaaagtatgttaattgtgatcaacaaaataatagaaatggagagtgaatataaaggaacagattatagaaatattccaaagctcagagaaaataatttaatacaatttactccggtggaggaaaaagaagtcgaaaaattaaagagtgaaattgagatgttgaacggcgaaattgatgattttaaacaggctaaaaatatattgacacgttataaagaaagcgacgaccagcagatccttaaattaagcgagaaaaaattgatgttgatgtccgaacataaagacctcattcagaatttgaacgaaaaacactcggaaatagtaaagaacagagatttaattaactatttataccaagatattaaattcctcaaagaaacaaataatttgttatctaatttcgatcttccaaaagctataaatgttagaaatgggaagttaggcccagatacgagtattaacaagaacattccgaaaattaatacaaatataggagatgttgtattagaaaaatgtcaaaataggaggtataaagattgggtagagttcccttcaaggggtcatcacgtttaa

SEQ ID NO: 550 - DNA, 2685 bp, Cryptosporidium hominis
atggaagatgaaaaaagtgttgcaaacagcgatgggattatgtttgatgcttctatgagtgcagcgaatgatgggtattcccaattggatggaagctcaataggccaaagtattagaacaattgggagtgcaggaaaactttcaagaacagacttaggcgatacggccagaattagaggcgaacgttatgcgtccagttgtaatgcatcttctttgaatgagtcggaaatagtaaaaaaacatttgaacagcgttgaaattggaggtgaagttgagtttaaggagttattttcaacttttttaaaaagctacattgcaaaagatggagattcaattgcagagtacagtacttcaaaagggaacaattcaatgattgatggtgggacatcaacatatatgactcttttaaagaaattattagaagcacaactcacaattgagggtggaaatgataacaaaaatggatctcactcatctggatatagctttgatatcagcttgagacacattgaagactttaacaagggtctttattacactattgtatccgctccaagcgatgcgatagtatttatggatgaagttattgaatctgaaattgagtcaattctaggtgatgattttctaaaagaatttgcacttccaaaagtacgtgtatttgataatattaatatttgtaatatgagggaagtaaacccatcagatattgagcaacttgttagcattcgtggaatagtaattcgctgttcagacattattccagagatgcaaaaggcggtattcagatgtactagttcttataatgcaaacggtttgcacacaaactgtgaccacagagagtatcgtttattgatagggggagagattgatgagcctactctgtgccctgtttgtaataacaactactcatttgagcttatgcacaatttatgccaattttctaacaaacaaatattaaagatccaagagcttcctgatactataccaccaggtgagaccccacacacaattttaggttatgtatatgatgaaatggttgattgttgccgtccaggtgataggatagagtttaatggaatagttaaggtatcaggagtcagacagatggctaaaagaaggcagctaatgtcagtatttagaacctatatcgacattttacatgtaaacaaaaacacgtgtaatatgctctattctgtagttggtaattctgctggagaaatgtcggagatagacaatggaatacagtccatagatggtcagaacgtcaattctgttgagaaaaacaatctttttacaaaagaaatgatcgagcagtttcacgcaatgtctaaggatccaatgctttatgataaactctctaggtcaatcgctccaagtatttgggagaatgatgatgtaaaaaaaggtttattatgccaactttttggaggaagtaggaaaaatctactgaaagcagcatcagaaatggtggctggtctagatggccagaattgctcattttctgactctttagaacataaacagccaaataactcctctcttaataggagtgaaataaatattctcttatgtggagatccaagtactgcaaaatctcagctacttcagtatatacacaaaattaccccaagaggttattacattagtggaaagggtagttctgctgttggtctgacagcttacattacaaaagacccagaaactaaggagattgtgctagaaagtggagcactagttttgagtgacagaggcatatgttgcattgatgaatttgacaaaatggatgattcttcaagaagtattttgcatgaggcaatggaacaacaaacagtaagcattgcaaaagcaggtattatctgttcactaaatgcaagagttgctattcttgcctctgcaaatccaatctcaagtcgttatgatcctaaaaagagtgttgttgaaaatatcaatcttccgccatcattgatgtctaggtttgacctaatttatctaattcttgacaagcagagcgaagagtctgataaaaggcttgcagagcacctatgtgcgctttatacatcctatagctcaaaagaaaaaccagcaaactcagccatttttgataaagtcactctttctaggtatataagttactgccgacaaaattgcaatccgaaactatcaactgatgcgtgcaacaagttggtgcagaattatatttcaatgagaagacagggttctactggtggcagtttgcagagaccgaaaacaatcactgctactccaagacaattggaaagcttaatccgtatttcggaatctctggccagaatggaactttccgaatgggttaagaaatcacacgtggatgaggcaactagactaatgatgtctgcaacctatagcgcattagttgacccaactacaggattgatcgacatggaacaattgactattggttttggaggaagagaaagaatgatacaagcgaagataaataaaattttgcttgagatcctcagcaatagtcctgatggaatctccaaggatggaatcttcaacaaaatcatggaacaactcaagacagggaattcaagtgaatttaaccaatttgactatagaaaggagtttgatgcttgcctggacactttagtgataagtggaagtattaaaaagatttcaggacagaaatacaaactatcataa

SEQ ID NO: 551 - DNA, 2436 bp, Cryptosporidium hominis
atgacaaaggagagaagctcttcaataattaaactggagaactttgaaagtgcagaggcattaatagaaaattatagaagggagtttgaaatacataggctgcatgaaactttgcagtctatgctaattgaagaggatgaatcaattactaatattttaaatgctgcttatagtgactattcgttgatttcaactgatttattaccacttgttgatagctatctgccaagtattaaacaattccaagaaaaaattgattctaatgtaaatgatgttacatctattgttggaagatattctgaggaaattaattcaaagatcaataaccataatctactttttactaaaaaactggaacagaatttatttaaaatgtgttatgatgaaattaaaagatatagagagatattgtctattacaaaaagtcaatttaataaagatgaaaccagtaattcatttctatcaataagaataattcattattgtatattaaggctattaaagattagaaaaagtattgatgctatatatcaaactattaaaaaaaaacacacaaaactcgactttgaatttgaaaacaataaacattataatgactgttttgaaatatgtaataatttctctgatgaattaaagacgttggttgtacaagcatctaataatatactacaaaccaattatagtaaatttttggaaacagaagactttaagcaaaacaataatatattgcttcaatgtatcttccttctcaacttaaaggatgagttcatatctaaagtgaagaactatattggaactgaaataattagtaattacaatttttatgacaataaagatgacaaacttttgttttcaaatgtaataaatgacttggaaaatattattcaaggtgaaaaattggccaatttcatcaataaaattgtattttcattatttaattatgatgattctgaatttttggtgtttttaatagatatttatatccagggagttttgttatttttattagagcacgttgaaagtacatattctgaacatatagtttctccaaccgctccaatggacttattcgttcatcagctaaactcgattatatctctaattgagaagaatgaaaaaattttaataaattttgaatccaaaaggattccagcaaataaattaaaggaattgaagctaaaaattcttatttgtttcagagaaaactactttatcaacaattactcaaaaaaatggaaatttggaacttattggaatctaatttatagaaatattctgaataggaggattagtattagaaacgaagtagtcgagttttcaaaggtttatgtatatgacaataagaagtattggttaaagtattcaatcgaaataatacgtcaaatacgttggatccttggaaattcttcaattcacagcaatacccctcttcctccttcaagatatttggttcctttatttatgcgttgcctttattcatcattattattattatatgactactcaagctatttgttgagctttacggaattaaataacttttctgaaaaaaacagccaaaacaattcaatttggtcttcaaaaactaaaccagaacatatttgttgtgtattaatggatgcaatttctttcgaagagtgggtaaatattcattttattaacgagatgttctttcatattgatcaggtgaaaagtgaatttgggttagttgagctatttgaattatctgaatatgaaaatgttttggatattgatcaacttaaatcgatagttaaagatgaattgattaatcaagattatttggctcatattaatgaaaatctcttcaaaccgttaactaatacgattagtatttatttgaaaaatcaaacgataagaatatttgaaacaggactcagagcggttccctgtttatataggcttactacaacatcaatttctagcaaagcttccgacaagattgataatagtgaaagagtaccaagtagctatattgagaatgcaacaaaacccattgaagtgtttttaatattttccttgaatgcaattaaatcagtaatcgcagatttaagtagcaatacgatacaaaagcttagagaaacttattacaatattttatttaatacttttgagggaatatttgaggaaatatttgatatttgcgaaaaacaaattctttcatccaagcaccagctggcttcactacaaaaactagcgcagaaaaatataggatcagcagctaatagaattgacccaaatataatagcatctcaatatatgacggacgttgatacatggttgacaaaaatgctcaagttaatctcaaacttctttgaaaatttagatcaaggatccgaaaaatatgttaaagaatatataaatgcaataaaagaagctcctaaatatcttaaactatatgaaatactaaaaaactag

SEQ ID NO: 552 - DNA, 2201 bp, Cryptosporidium hominis
atgaggattttcaaggatagatttaaacatgaatatgaagtcttattgaaaaaagtactttataacaaatttacattaataatttttggagtctttacaataacttcaattattatcaatgaggctcgatttttgtttagagaatctacaattgattggatttttttttcaataatattatttctaacaatcgttaggggaatcgaaatattggttttttttgcctttaaaaaaaactaccactcaatatttttttttgatttggtcgcatatatttttctcattttatcagcagttttgtttgactctagtgagcattcaacatgtgatgctgatatcctaaactttgatgattttcaagtgttttcgcaagtaaaaggctacggatataactttcaactaaacttaataaactcaacattacagtgtgcaagatttattttattatttgtttgtaatgacttttttactttattctcaaagttatacaataaaaaatcgattattcacacagaaaacatatatcaacaaaatcaaaaaaaggatttgtcaaagaataatttagattctgataagcatttgagtgagaataaaatagctctttcgcagatattgggccttagatttgcaatcgttttagtattaagtgcgttgctatatcctttattaagttcatcagtttggattcaaataaatagttcagcatttttaagcattaaaaaccttagtcaattatccatattaagaaaccagtatccaggtgataaatcatggccaattgcttatatgttggagttgtgtaattttgtttatacaaatagtattggagactctaccaaatggatgaagcttgtagctatacaatcaccatatactctaaataataacccaacatgtgaagggtgcccaaaatctaatttggaaattatgactgatgctatgtcgattatttcaaattctgagattccttcctggtttgttggaattttaacattacccactctaaaagaagggatctcgttaattccaattgaagattatagaaaaatccgcaagcaatcactaaggcagtatgtgagtcaagtatgtatgagatcaggtattgattcaatttctaacttttatagttcatgcccagaagagcttaaagccaagataaccatggtatttgatactactacaatgcttcaattgggggcaggattaagtattggaatatcatttgtaactctaattttattgacaacattaatgattttggtacattgtgtattagaaaaacatattttcagcagtataaagagaattaacgatactctcatctcaattgcaagtaatccattattggcgttgaaaatgtctaataatgcatacaacgaattaagtaacgaaaatgcaactatggggaaattttcaaataaaatgctagaggagaccttttcaaagctagggacattacttgcagtaggtctcggatctgcaggtgctaatataattattcataatttaaaagatgataaagttgtagtaaaactccctggtaaaaaagtaatgggtatttacgggttttgcgatattcgaaacttcacagatgcaaccgaaatattgggtgaagatgtaatggtatttgtaaatcaagttgccgaaatcactcatggagtagtttgcaaatatggtggatcagcaaataagaatgttggcgatgcatttttattcgtgtggaaacctgacgagaagtgggaagggatggagtctttattagctgatatgtcagttatgtcattcgtcataattattaagcaaatctccagctgtcctaaactaaaaagaatcgctatgaggagcgaaatccaagaaagaatgccaaactatagagtaaagcttggatttggattacattatgggtgggcaatagaaggcgcaataggttcagaatataaaatagatgcctcttatttatctccaaatgttaacctttcttcaagacttgaaagtgcaacaaagcattatggagtaaatattctgctttctcataatcttttcgaaaagctttctgttagtatgaagcagttttgcaggaaaatagattgcgttactttaaaaggtagtaatcaacctctggaattatatacaatagatattgatccagaggctcaagatgatgagacgaacagcattcttcaccaagttgacactggtaa

SEQ ID NO: 553 - DNA, 2055 bp, Cryptosporidium hominis
atgtccccacaactaaaaaacctacatgataagaaaatatccattgattttacttttcaagatttttttgagcctgatacattgattcaagctgatcgccattctagccgaagcaaagagaaattgattgaagaatttgacaatttgttttcggttattccaaaaaatgacaagacttccttcgttactggttgtagagacttttttataattgataaaaagcattcaactcagaaaagcacctctaaaaagaaaggacttaatactagtttttcggaaatagataatttaatttctaatgaagctaatggaaaacgagacgattataatttatcttcaaacagtaacgttgaatcgcaaaccagaagaaacaaaacgaatcgatttggggccgggaaaagaaagaaaaagaaaataaggttcaatagtggtactaaaaacagctttcaagaaaactctgatttattccaaaatgatagtcctggtcctaataatagaattttgaattatgaagattttagtcctccaaattcacacaaagaaacattggcaagcgagaattcttcatcagaacagttttcgccattatcagaaaagaagctacctataattgatggatatggcccattttctccaagaaaatcaaaacaaccgcctcatattatgctgattgttcacggaattggtagcaacgagtctgccattaataaaaatagggaggaatttgttcaccagctagaatctgtaaaggcacactggttttgggaggtagatattgatattacggtggatgcagtagattggaaaagtaaattggcatctgtacaagaccatatgtttgacagaattactcttcctcaacatagagaaaatagaatgcttctaaataagacgattggggatgtgatgtattttatggttccgagatacggagattatattattgcggaagttgcaaagcaattaaatcagaaaattaaacagtataagtcaaaaatttcggaaaaaccaaaaattgtcttaattggacactctttgggaagcgtaatagtatatgagcttgtttcaagacaacagaccaggattactaagtcagaaataccaaagctcgactttgtcgtagatcacctgtttctatggggttcgccattaccagcgatgcttgtaatgatgtttcctgagtatctgcgttcaggattgactcttccgaagggtcttgcaccaattcagcccaatgaaggttttagtggaggtaattttattctgaataaatgccctgaattaaagatctacaacgtctttcatccatatgaccctgttgcattcaggcttgagccattattatatccaaatttggtttctctgcctgatcctgttcttttaccgtattggcgcaatctttcaaagagaacttatcatcagtgggataaggagatggagaatgcaagaaaagctttgtatgagagtattagtgggataacctcttccatttctaatgctgtgcttggcggaatattaggatgggggggagtgaatgaatataaatctacgttagaagtcaatcttgttcctagagaccaaaagattaaacaattgcgagatgaatctgtgatttctaaatttaaaacaaagttttctgcaagtagaaagacgggtgcatttactggtatcaactttttaaattcatcagaaaggcagttaaaaacgcatagcaattctgatagaagagaaagcgaatctgtaaatttttctttgttaaaaaccaatgaggtgccaggaataccaattagagtggactatcaactccaagaagggactactgaacactacatttcgtcattagcatttcttcagtcgcactttaattattggaagagcagagatttaggattctttatattatggaaaataattgaagattttgagccagtaatttcctatgacgactatagagctgcattagaacatttaaaacaagatcaaactgggctagagaatctcgactcgtcatctgagatttcagatgactcgtcttatgagatagaatccgattaa

SEQ ID NO: 554 - DNA, 1266 bp, Cryptosporidium hominis
atgaagagtttgcctcttattaattattctacaatatttatgtttttatatagttgctttactgtatttaattatgcaacttgtgaattgtttattgtcaatagcaaagccacaaatcagacaaatgattcatggtttaatttggacttattgagagagtttctgatggatgaaaatgtaacatcaagctcagctgatgtttttgagggctttaaaaagatgattaaagtttctcctccaactcctaaaaccaagtctagttcatggataccacaaaacattaaagacgtaatatcaaggattaattcaaattcaaaaaaagaagtgaaacataaaccaatattaaaaagaaaatttgaagatttaaagcactacctcgagtatcatctatatcctgaaaatccgcaaaataatacaaagccagaagaaaagggtaggaacatgttttcatttggatttgcgggaaagaacttaaatgaacaaaataacaagaagtcgactatccagagttcagagagctcgagtagggagcaagctttaattgaacaaaagtcagaaggaactactcaaaacccaaacaacatgaaagaaacatctaatcaaaacactccatcaagtccaactcctgaattaccggcagatcaatgcgaaaagaatgtaattaacatgtttaaggactgtattgagcgatgtaagagcaatcttaaacaagcacaatacaaatccggaggtatttctccccttattgtttcagaactaaatacttgcattcatacatgcaggcattctgcaaattcttcaaattgtaagttatcagccaactctataaacttgatcaatcaagaaatcccagttccaaagcctacaataagaaggaatcaaaaaaatcaggagaaaagtcgtggtttgttaagcaaatatattattgatcctatcgttagtttcatcacaacatgtctattttgcttactaggtatcattgtggtcctttactatttcaaggaatataggttttatccaagaatggccgattatattacttacaagattgagtcatattacaccgaggatgaaaaaagaagggcaatatttgaaggtgatggtttccctcaacagccgaaggtaaactggaaacgaacaattgtctactttgttagattaaactaccttccacgagttttagctaacaactttacctggttaatacctatgagagaccattatcaacaagtaactgatcctagtaactatgttagagtgcattag

SEQ ID NO: 555 - DNA, 2034 bp, Cryptosporidium hominis
atgttaaatatagaacaaaatgcagatgaatgcgctaaacgtgaaggagctaatatggtacctgtattacataatgtaacggaagagtgcaatattaaagccgaagaaaaggaaattgtaccagaaattgaagaagctaaacctaaatccaataactgcttaggctctgatgaatatcttgagggacacatttatgcagctatgtgtacaaagtgtgcaggggagcttcagcaaaaactcaatccaacagaaccataccgtgatccaaaaaaggttagcgggaaagaacagatttctcgtggactaattattgaaagtaagtcatttgtggatgcaaataagaatatcaaattttcaaaaaaagccgaaaagaatgaatatgcaggcctctgctcaagtccggaagtaaccactccaaatggtgagcgtgaaacttctacggattcaaatatcaaaaatactgagagtacaaaagtttctcacgggatttttgatagaacatgcttaattcaagagcatgcgcttgttaacaggaatattaatgatttctacgaactgaacttgggaaatttggggagaggctcttatggatctgttgtaaaagctattgataaacaatcaggtgcacagagagcagtaaaaataatacttaaaccaaaactcgagaatattaaccgtttaaaaagagaaattttgataatgaaaaggctggaccatccaaatattattaaactttttgaagtatttgaggatacaaattatctctattttgtcatggagatttgcacgggaggagaattatttgatagaattattaagcgaggacacttttctgaaaggtatgcagcagtgattatgagacaagtttttagtgcaattgcatactgccattctaatgaatttatgcacagagacctaaaaccagaaaatcttttattttcggactcttctccaaactctctattgaaagtaattgattggggttttgctgcaaagtgcccaaaaacacacaagtttacttctgttgtgggaactccttattatgttgctccagaggtactatatggtagctatagtaaattatgtgatttatggagcgcaggagtaatcttgtatattttactatgcggatatccgccgtttcatggaaaagataatgttgagattttacgaaaggtaaaaattggtcaatattcattagaacacaacagttggaagtatgtttcggactctgcaaaagatcttattaagaggttattaatgaccgatccaaataagaggataagcgcccaagatgccttaaatcatccttggattaaatctcaaatttcttctccaaatactgcagatgctacttattttactaacgatgtttgtaattcattgcttgcaagattcagggacttccaaagacaaagtaaattaaagaaattagctcttacatgtgttgcataccaccttaatgacgctgatataggcgcattacaaaaattgttttctacattagatagaaacggagatggagttttaacaattaatgaaatcagaagtgcactacacaaaattcaaaatgtatctcagttgggagatgatatagataatttattaatggaattagatactgacggaaatggtagaatagattacacagagtttattgctgcatcaattgatcataagctatatgagcaagaatcactctgcaaggcagcattcaaagtatttgatcttgacatggatggtaggatatctcctcaagaacttagccgtgttctaaatatcacgtttcttcaagaagcatttgaacaatcgacaatagactcgctgttaaaggaagtagatattaatcaagatggctatattgactttaatgagtttatgaaaatgatgatgggagacaagcaagaacaaaaactagaaactaaagttcaaaaaattgaagatgaggggagcggcaataaaaagctttcaaaaggtggaataatttcagatatatttggtactaacagcatttttaagaagctgaataattaa

SEQ ID NO: 556 - DNA, 1449 bp, Cryptosporidium hominis
atggataatgaatcgcaaaatagaaatgagaactctcctttgttaagagaagataatcaaaaaactccatatggtattaaccgctacatactcttaataatttactgtgttttttgcggccttacaacttcggcaattcagcaaagtatctgcattagatttattatgaataagttaggcgcatatgaatgggtttgcaatggtattccaactgaaattttgccaactggagctaaatgcaaagctcaagataactatattacaacatgttggacagcaggcattatggcacctaatataattctttcagtattaggaggtggaaagctatttgataatttgggtccaaaattaactggatttatcgggcaagtaatgtttatgcttgggcttttaattttttgtattagcaatcaaaactttccattatatccgcttggatttatattaataggtttgcctcaaggcccaatttttaacagtgttgtatctgtaagtaatttatttccaaaccatggtaataaaataatatctattttaagtacaatgggcgatgtttcagcatttgtattttatttcatctaccatttccacgaattttctggaattcgtattagaaatattttgatattttattcaattgttgtatgtggtgcactggcaatggttgcactattgctcattcccaaaaattcttttgaaaaatttcaaggctcagattcaattgaggaagaagattctaactcagaactaacgtttaatacaacatgctctacagagatgatctctcttcataatcaatcattaattaatcaactcaaatcttcatttttcattcttttacttccttactttactcttacagttttcagatcggactcaattaaggcatgcctggattcattcttacaaagtgctaataatactgacatagatcttataagaagccagatgtctatattttctacccttcaatgcttttcgttcatattttctttaatgaatgggtttataatggacaaaattggagtttctaaagggatgatcttccaaaactcattgggaattattgtatcatttcttttcttattcaacgcatctcatatagtgagaatagtttcattctttatattcttttcttatgcaagctgcatttattcgactgcatactgttatttagtcgaatgttttggattctctaatattaatttcctaatggcattgacaactgcacctgttggatttatttacatagttattccaattatgtatagtaaattgaacccctcaaacttcttctacttccatctattttacgtaatttcatcattcattatgtatgtaaccccaattaatttgctaatgaataacccaaacgaaactcaaagagccaacttaagtgacggattgtcttctgtgcaggtggatgaagcaaaaacattcaattaa

SEQ ID NO: 557 - DNA, 303 bp, Cryptosporidium hominis
atgaaaggagtttgtttaaggtccttgaagtttaggcagattctttctagatccatattccaacagctaaacgtatcgtttaatggaagatgcttattttatggtgcccttttcaacttatcaaatagaatattttttaaaagtattacgtatagtagcgatccatataaagtcttaggagtttctagaaatgcatctgatgaagaaattaagcttaagtttaaggagttagcaaaaaagtaccatcctgatttaaacccatcggaagaagccaaaaataaaatggcaaaaatagtgaagtaa

SEQ ID NO: 558 - DNA, 552 bp, Cryptosporidium hominis
atgaagtgcagtggtactggatattcaaatttaatgctttgcataaagtgtaatggtagcggccatattattaaagaaaagaacgttttactaagaatcccaagaggaacgaaggatggaacgcaactaaagctgagctcagaaggtaactttgtttcaggaaattatggagatttattcattaaggtgaatattaagccaaatacgaaactcaaatggataaaggataatattcatgtagatattccaatttcaattaatacatgtatttttggcggagaaattgttgtgcctagtttaattaaaggtacaagcatgcgagttaaggtacctcctaaaactaatccgagggttccatatatattaaagggtaaagggccacctatttttggcaaagatacattcggcgactatatcattcacttttctactcgaaattctcatccagatttatttaaaaactacaaggagtctattggaattaaagataaactactcagtatattaagtgaattgaacaaaaaggtttcaaaaaaagctagcaaagaataa

SEQ ID NO: 559 - DNA, 2037 bp, Cryptosporidium hominis
atgaatcaaattaacaacttccctgttgctcaacaggtatatttttcaactcataatgctttgcgtgcaggtgaaaatgaaatccagaaatttgtcttatatattgacgagctggatgggacaaagcgcatacttttgtcaatatacccattctatgattgccaaatggttaaaagactagtaattaagtatctggatctcccagaaggcacaagcattcgtgacattcagctattttatagaggcgtagaaattccgaatagcaggtttatgcatacatttgaaaaacaaagacacccattgcactattctctcaggatgaacaagtcagattttggaattagaagtactggacttaaatggtcgagtaaaattcagaaacttgtagttgaagttaaacttgcaatgcagagaaatgtccatcccaaacttacattggatggaacgggcgctacctatagaatgtacaatgcaaaaggccaagttgttgcaatgtttaaaccactagatgaggaggcattctctccaaataatccaaggggttatcaaggtaaattaggccaacaaggttttaggtcaggagtattgtcaggtgaaggagctagcagagaggttgcaacagcaatttgggatgcatactaccataattttgccggcgttcctgatactacactacttgaggcatgccatcaggcttttaattatgatagctggaataagattactcttgaatggggcgatatttttcaaaaagataataataaggcaaatagtgaaataaccgttgattggaagttgggggcatttcaagagtttatttcaactacagaaacagttggtaatttcaacccctctgtattctgcattagagatgtacaccgcattggaattttggatatttgtctctttaatttagatagaaatgatagtaatattcttgttgtcgcgaaccagcccaattattcaatcaaattcaacattagtaattcaaataatccaagtccagctatttcaccatatgaacaccctctgagcactcctgacggcaaaaaaaccaagtataagttaattccaatcgaccatgggctttgtttaccagatgttctcgatgttgcacaatttgattgggtatggtttgattggccacattcgaagataccctttagcaggtctgaattgagagtaataaagtatatggatccagatgcggatgcagagaggttaaaaagaaagttattgattagaagcgagtgtttaagaagcatgagagtttcagtcagatggttgaggcttgcatcatcaatgcatctcaacttgtatcaaattgccagttttctttgtagagaagatctggaaattccatcttcaattgagctactaattcagcgtagccttcaacattgctatcgcgcatttgatgcaactgcattaatttcatcaaacaggttaggcaatattcatattgacttagcaacaacttcttccgcacctaacagagctagagtttttaataaatcacctaaaaagggtcagaatacaaatacggtagacaattttattgatgattgcgaattatcagataattcacaaatctcagattctgaatctgaattttcatcagataattcaactattaaaagtaagtggtgggaatcgcgtaagagaaagcaaaaatcttcgcaaagccagaaatcagatattcattcgtgtccaaatgaacaacttacaccttcaagcttccaaaagagctgtttaaatggagcgtctagaagtactgcctatcgaactcagcttttactcgggcttgctcctcaaaacgccacatggatgttgctagacagagaaaataacatcattccaattcaatggggcgacaaacacttcgaacatgtattttttgaagtattagagcaggagatgaaacatttaatcattgataaacatcccaaatgggaagagtacccatattttggagaagaggtatttgacgaaggcaagaataaggatatttcggctaaagaaaaagattattgctaa

SEQ ID NO: 560 - DNA, 1278 bp, Cryptosporidium hominis
atgtcatctgaggaaggcaccgataattggtctgcagaggaggctgtagagagcgtaaagactctgagtgttagtgagcttcagtctaggattcgccttttagatggtgaaattcgacttatgaaaagcgaaagtaatcgtcttaagcatgaattaaaccagatgaatgaaagaatcagaagtaatactgaaaaaataaaacttaacaaacagcttccttatctggttgccaacattgtcgaatcactggatttttcagatgaacaggaaaatgagggtgaagggatggaattcgatggagacaaaaacgataaatgcatggtaataaaaacatcatcaaggcagactgtctttctccctgtcattgggttggttccagagaatgaattaaagcctggagatcttgttggagtgaataaggatagttatttgattcttgataaattgccaccggagtatgactctagagttaaggctatggaagttgatgaaagaccaatggaagagtattcagatattggaggattagataagcagatccaggaattagtggaggcaatcgtccttccgatgacccataaagaaaggtttgaaaaaattggtataaaacccccaaagggtgtactaatgtatggacctccaggcacagggaaaactcttttggcaagggcatgtgcagcacaaactaaagccacatttttgaaattagcaggcccgcaactcgtacaaatgtttattggtgatggtgcaaagatggttagagatgcatttgaaattgcacgtgaaaaagctccttcaataatatttattgacgagcttgacgctataggtatgaaaaggtttgatagtgagcatagtggggatagagaggtacaaaggactatgcttgagttacttaatcaattagatggatttagctcagacgacagagttaaagttattgctgcaacgaataggccggatactctcgatccagcccttttaagatcaggtaggcttgaccgtaaggtcgagttaccgcatccaaacgaagaagcaaggtccagaatacttcaaatacatagcagaaaaatgaatgttgatttaaatgacgtgaatttccaagagctatcgagatcaacagatgattttaacggtgctcagcttaaggcagtttgtgtcgaagcggggatgacagcactcagaaggggagcaacgatactttgccatgaagattatgtcgaagggattgcagcagtactagcaaagaagaaatccccacttagctatttttcataa

SEQ ID NO: 561 - DNA, 1026 bp, Cryptosporidium hominis
atgtttatgattcgaggaaaattgttaagtcaatctcttccatgcttcaaattcacacgaagagaatttttaccactattttcggtatttttccagaaaaaagcgatccgcaacctagaatattataacttaaacaaaagatggaagtcttatagtaaaactagcaaaaatctctcagaaggctatatatcacaaatcatgggttcagttgtagatgtaaaatttgagggtaaactaccagaattgttaaacgctttggaagttaaagggcatcaaaacaaactagtacttgaagtggcgcaacacttaagtgataattcagttagggcaattgcaatggatgttacagaaggactctctagaggagagaaagttatagacactggaagcccaatatgcgttccagtaggcaaggccacacttggtagaatggtgaatgttatggggaatgcaattgacggatgtggagagatcgacgctaaagttaaaaaaccgattcatagaacggcccctgaatacatggaacaagtaatggagccttcattaattgttactgggattaaggcaatagatctacttacaccattcataaaaggtgggaaaataggactatttggtggagcgggggttggcaagactgttcttatcatggaactaataaacaatattgcaaaaaagtatggtggttactctgtctatacaggggttggagagcgcatcagggaagggtacgatttatataatgaaatgctagcaaatggcgtcaataaaaagtcgattgttggatcacgagttgacagcaagcataagagacaacccatatacgattttttaggttctaagacagcgctggtatatggtcaaatgaatgaaactccaggagcgcgagcgcgagttgcacttacaggtctaacaatggcagaatattttagagattcaatgatgcaagacgtattatttttcgtagataatatttaccgatttactcaggcagggagtgaagtttctgcacttttaggtaagtaa

SEQ ID NO: 562 - DNA, 408 bp, Cryptosporidium hominis
atgtccgaggttgggatattcccatccattgatccattggaaagtaggtctaaggttttagatcgaaatattataggcgaagagcactacaaagtttctattgaagttctttcgattttacaaaagtataagcagttacagagcaaaatttctactcaaggttctcatgcactttctgaagaggaaaggttgattgtctccagggcaagaaaagtccaaaagtttcttactcaaccgttttttatgtcggaagcttttaccggaaagccaggggtttttgtcaacttaattgatacaattaaaggttttaatgctattgtcagcggtgaaatggataacctcccagagacaatgttttatatgaaaggtagtcttgatagtctaggaaagccagattctacttattag

SEQ ID NO: 563 - DNA, 2694 bp, Cryptosporidium hominis
atggcgcaatttggtaaaaaaaaaatttactatttatttggttgcagattaataatcatcatggagttgattgaactaccgaaaaggcagtggtaccatgtttctggttcatctttagatattaagataccatcgtctcacaatgcttctacatctcaagcagcctctatactacaatgtaatagagaatatgttgtccatatgttttctgatgttccaagagttatcatgttagattctggtattaatagccaagaagaactaaacaatggatctaaatgcagcagtaaattatcagggcttggaatggaaagtttttcgctttcaaaggtgtcgaataatattgtttatattaaagggaaggaactttcaatagtaaatattcaatcagacactattaatactttggtaaggggaaatacccattggaaatctgttgtatttaaccatttagatgatcgttgttttgttgcttggaataaatgctcagtgtgtctatggaatcgttcttcatatgaataccacattctacaagaatgttctaactccaacaagtccaatgctccccagcattcagctgctaatttatcatgttgcgtactgattaactacccggatgatgttaaaatttctagttgccaatttattggagaactaataattctttttacttcaaatggctattatgatactttttcctcaaatttaagccctggagagtactatagatcgataatgtcaaggcaaattatcgattcaaattcattactacttgatactgcagtatatccgaatataagaatcagagatcctaccattaaccacatgaatgtaacagctacattattatcagtagaaaaagatatctatactgttcgcatatataacttaccgatagattcaaacaataactttggcgaaattacacttttacagagcataaatattcatattatggatgataataaaaataaccaatttaatgctcatattattggaccaaattggggtgagtatttcgcaatacagatttttaaccaattaatcgtttgctctgttggcgaagagctacccattaaagatttgtttttcttcccctctagactattagagacggctgctttcagacctccaaaaaatgttacctggcttgatgctggaaaaactaaatcaagtgaaaatttatcaaaacaacccatcgaagtttttgtttcaaatatttttggagggctcgaatcaatcattatcccacctgttttagatttgagtgcgaataaagcccattattcatccgaaaatatcagtatacctagtgacacatttactataaacttgtctaatcagaaaaaaactaatattgacacgaatgacgagattgctgatgattattatgctgttttgatggcaaatgcatcacataaaactgagaaaagcgattttcaatacaataatacacctcagaataaattaccatctgatagatcaaatttacttacatctatttttagtacattaaatatggaggaaaaacagtcaatgagcaatccacaatcgaaaaatacgaatacaagcaataccaaccacaaagattttggtttaaatgataaaatatttgaaatgattacagatgaattaaaaaaattgaccttcagcttgtccaaagagttaaatgattcggtttcctcagcaattagcaagtatttagaaccgatcgaacgtgatattcaatctattaagtcgcatttgtcaggaatcgagaagtctgttgataattatgtcaatatcaatgaaatttctaaaattgaaacaaatgttaaggaactttttacaagtacaaatgagaaattaacaagtattgacacttgcatttcgaggcttgttggcgaatctagaagcgttcgtgaaaaagtgactaaattaaataaacaatgcgataacattagctcgaatccaatagacaactttactcaagtagtagcagattcatttgggacattaactagtgcagttactcaattgcaaacaactgttaatcgtttggaattacagatcagtaatggaataccactaaaagctcttacaccagacaactcaattgcaaataagagcgcccaaaacatagctttgcaaattgatgatgccttaaaacaaaaacattacgatcgcgcatttgcgatagcaatttctgccgatcaatctactctatctcagtcagataagagggaaatcccaagtggagaatgttttgttttgagccttgcatataagtttgacccatgcgtttggttggatgatccacttcctattagccatccagtaatattaggaatttcaaaaattttgagtgatactcttcctcatttaattgagtctttaaagaccagcggtaatttttctcaaattaactgtatttcagatttaaaattgagaatattatggataaaagaaaccattcactgtttcgaaccatttactgatactcttacacctagtgacgtaatgcaaatactaaatgaaatttcagaaagcatgaacaaatgcattagcattataaattcggttagcgatgtaagtaaaagcatgaactatattgtacctgcatgcttcacggatgggtcgatcatcagtgatattactagcatattaaggcatattagaaggacaactagaaatattacatctggaatgaaataa

SEQ ID NO: 564 - DNA, 885 bp, Cryptosporidium hominis
atgaatgataaatttttacaaaaagctgatagaaacgatagtttggttgaatttgtaagatacattttaagttcgagatcttcatcttttcctaaattatctcttccagagttggatagagattctgagctgcctccatttttgaaagttgagaagttaatgtttgagaggcatgaaagagagaataaaaaaataaaatttcttaacaaatgccttcaaattgcaccaatatatcctgaaaagtgtaataagagggttgcatttagatatcataatagacaacccgaaaaatgttcatattttaatttatctaataaaaaaagtaatttaagcttgaaccaaaaggccaatctaaatggtaattttagttcaggcctaatatgtaaaagtattacgccattaagagaaaggatttgtttagcttgtagaaagaattctttgttaaggcataataatcaaaaaaagaataaatatacagaaaaaaatcaaaattcaattctggattattcaaaggtcgctatgcatgataataaaatgtttgcaatgaatgaattatttcaaaagttgttaaatacaaattctgcaatattaaatagtgtatttgaagaagataaaaaagtgttggaaccattcaaaagaacaaatgatagtttaaaaataaataactgtatttctaagaatgttattaatgataacttagcagatggccaaatcaaagaaatgttccagcagatgtcaatatctttgaataattcagaaataaatgaggaatcacattcacgacattctatgaaaaaatatttacaattattaaatactgatccaattagtttgaaaaataaaagtttagctacaatcttatctatagaaagactatctatttaa

SEQ ID NO: 565 - DNA, 591 bp, Cryptosporidium hominis
atgagtgattcagatagcgatacagcattgtcaaaaagaatctctaaaagatcttctaaatcgtgtgctaacattaagaatgaagagctagattcagacttttcggataatatacccttaaatagtagaatcaagaaaaaagctcaaagacctaagaaaacagtagcaaatacaaaaaataccaaaaaagcatctaagaaaccgactaagaaggctaagtctgcttccaagccaccaagcaagccgaggaaaaggcaatcgataaaaagtgaaaatgattcagaagacgacgatattaacaaagatattaagaagcagtttagagacggtcaaaaatacataacacctcctaatggcgatgcgactagagcattttatgaatctctttataacgaaaatccatatagtattattgcattgaagtattgcgttgaaaatggtatattaatgggggcaaaacacacaagcgcatataaaagactggagcaccttagagaaagtggcttattaaaaagatcattaggcggaattcaaaatgaagctattgaatgtttaaaacgttttgatagcaaaaatggtggttttccctaa

SEQ ID NO: 566 - DNA, 1842 bp, Cryptosporidium hominis
atgaaatccttgcttttcgtctgtgaggactccaattcaataaatcgcgattcaagtcagaggttgaaacctggcgacagatggttttttggtgaaactgaaataattgataaacaaaacagcgcattaaatatccctttagataatcacaactataggaagtttgagcttgatcaaatcattacatatgatgttgacgaactatctttaatagcaaataaccttgcagaacagtgttttctgaatagctcaaacaacttggtaatttcaacttcatattcatttggcaataattgcccgttattgcttgaaggttcttacaatggcaataatactctagttggaccaggattgtttttattgttatcaagaaatattttatctactatacaggaccaagatgaaagtaacagtattagtttgtattgttcttggactggtgtactgaacagtggagacttcaccgatttgtttgaagatttgaacaaagaaaatgattcatttgatatggaaaatttatctccgatcagtggagagtttggatacaccagtatttttaaagttgaaagtgtaaattctcttgcagcagaaatcaataataaacgaaaatcatctaattggaaagaaatatgccattatatatttacatttagaatatacaaagattttaatgaaattgaatctgggaaaaataatcaaatgggctctatatctctaatatcgctgggtgaaggtattaaaacaagaatttcaggacagattagtccctggaatgcgttagaaatggctatgaaggaatttaaagatcctattaaatctgacttttgtatgcttcaattttcacgttttataagtcattatttcgaattcccagatttaattacaatcatatatagatttccattttatattaacccaatgaagcttagccatggaaaagaaatcaagtttatcctcagtatgatgctctttcatcaaacgtttttaaattttatttcaattgaaaacaatgttgattctatccagaaagataactatattttggctcctaaatcaatactttcaaactcttcaaacatagataaccagaattcaaaatatttacaggattttggttatgattctccaattcaaatcgattcatataagtcttcattttttttcaataatgagttgaatgatgcaccgataccaccaccgaacccagtatcaaaaaatgaattcaatttaaaatttcaagaggattcatccaaatacaatattttcctagaaaatggatttatttcagaaacatccaagatagaagaaatttatttggaaggaaataatggagatctagagggtaacatctcaaatttaccaaccaaaaaaaacttaaaatgcgagtatgatacacttatacgggaaattaaaatgttggagaatactatattagataagaatgagattattattagattagagaaattaatagatgcaagggatcaaattattaaacaaaatcaagaaaccataatgctactcagacaagatttgaatactgaaactactaaggttaaggaattggagcataaaataaagatgaacaaaggagataacttctcaaatcatttacacaataaaaaattaccgttacatcttcaaagagcaaggccttctactgtaaacaataatctagtgagcaaaaatgtgggttgttgcaatgatacagaaattcacatggttaaaacacagaacaaagatgaaaataatgtacttcaatatacacaagatgaagctgtattaagccctgttttaactggtgtagcaaaaatggcacttgaaaaatttttgaggaactga

SEQ ID NO: 567 - DNA, 429 bp, Cryptosporidium hominis
atgagtaaagatgaacaaaaaaaaattgactcctcgtatgataaagttataaagaaaccaataaagttgttaaagtataagaactctaattcaaaacttggaataaaaaataacgaaaaaaacctcgtacaaacaaataaattggcgaataatctcgagtatgaaaagaactttccagaaagtctagtcaaccattcagcactgaatgacgatgctacacttttagtaccaaatccaattgttggaatagacgaaactacggggtatacaaaggcggaattatctcacaaagaagcacaaagaaaaagggtccataagcaaattgaatttcgcgcgtccttaacgcaccgtcaaagagtttcaaagttcaatgagaagttatccatgttgccggaacactttgatataccaaaggtcggtccaggataa

SEQ ID NO: 568 - DNA, 807 bp, Cryptosporidium hominis
atggataagggcgagccttatgggtgtagaagtaagtcggtaattaaaccagaatttaaaaattttctatacaaaccgagtgttcaaaaggtaaatgcaattggaaataatgtatatatttgtaactttcatggctggaaagggggaaggaattctcagaaatgtccagagtgtgtagaaattgagaaaaaaattatggaaagattgtctcatacaaagtttaaaaatgttgctggaatagattatattgaaggtacgaatactctcgaaggaatgagaatttggttaaggtgtaatatgggccataaacttatatatgctatgaaagatatatcaagagggtgtagagtatgctcttctgagaagtacttgtcacctaaatatagaaataatgcaataaaattagatataaaaaaagaggaagaatatcgtaggaaacaaggagagctaattgctgaagctaaacagatattcgagatgaaatccaatactaatagtgggaatcagaatattgacttggaagttcaggaatgtattgataaccacccaaatatctcttatgaaaccgcatatgcgttgacatatattctaaaatttggatacgaaccatacaaactatttcaagtaccaaatataataacatcagaaaataaagtatctattctaaaaagaattaatacttatttccgtacacaggcaagattgattcaccctgataaaagtgatcatccaagatctgctgatgcatttcatattctttctaatgcatataatcaaattaaaaattacttggaaaataaggtataa

SEQ ID NO: 569 - DNA, 795 bp, Cryptosporidium hominis
atgattctcaaaaaggtgagttattatttcataggaataatgattctccttttaatttctaactcagatgttaattgttggaagtttaaaagtgtttttaaacggaaaaataaaaaaagtaaacagatcagggtattagaagatcaagcaaagaagcaatttgataggcaaatacctaattgtgaagattacggtttccatggatgcgatccaactactccagacgcatgttcagaatgttatagccgatgtggtagacaatgcgaagattttttgtggctttcgcttgaagccgtaaactttaggatgttaccaagggcagagtctcaaaaagaatgtaaactgccaagcggaaaaaagagtagtagaattttatgttttacaacggcaggaagacggcatattgatccaaccgaacaaatgattgagacaatgtcaatatcaaatcctgaagatatagaagaaagtccagctcaagtaaatgaagtcgaaaacatggtcccagaaaacttgcctggtatcaatgccgtcccaatgactcagaaaatgcaggaagaaagtaaaacatcgttatatgatacatctgctgtaacatttagaacttccggtgaaaaaggaactttagtttcatctattgagctagaaaggagtggcgggaaacttcccacaaatttcgaaaatgagtcgaatgcaaagattattactgtatgtggagcaatattgttcgtttccattggtgcactatttgtagttattatatataaaaagcgtcagaaacgcgctgaagattattaa

SEQ ID NO: 570 - DNA, 1386 bp, Cryptosporidium hominis
atgcataattcaaatgtattttatttggtaaatggtgaaaatcatgatctaattaattgctattattgcgaatcatgcaataagttaatatctcaggaagatgtaaagattgaagtagatacgtatttttgtcctagttgtctggaaaatgttccttcaagcgaggcattttcgagaaatttcagatgtattaattgccatgattgcccaaaatgtatggcgacaatttctacaaataaattagacttagggtctgaaacagacgaaagcaacggaagaattatgcagcattcttacaactgtggattttgtcatttttcactaaatgtaaatcttgaaatggatgctgggaatgaaattgatgaaaaaacgttgaaggaatctaatgatggaaataacaaattgcatatacataaacaaaacgacagtctttttttacaagagtcaaattatttatctttaataattgataaagttaaaaattcagcttataaacattttgacactaatatctcaagcgaaacaaaacaattaaataatccaaatgatgaacagagtgaattaaatctttcattaagaattttagaagaaaaacaaaaaacctcagcaagtttaataagggaaaaaaatatatggctcaattctgataagatgaaatacctttcaaatatcagagagttgcttccgacttgtttaaagaaaaatgatttatcttatagacaatatctaaataatccagatattattaattcagtttatctatcattgagagcaaactcaaataacaaaacaaaactatgtccttatatgaaaaagttgtcagtacaaatatccaaaagatgtatggcatgtaaacgccttgtaataaagcctcaattgaatccactatctcagccaccatttagagtgaacttgagtgcaaacctgttctttccaaatttcagaatagtttcaattaaggataattcatctggcgatcgatcttttacaaaaattattaaaattaggactgaaaatttaatggatagacaggttaggattgattttctacctgaaagagaccagaatgagcaactatcaatagaaaattcaaaagtatattcaattttaaaaatagaaccgaaaagttttacaatagaacctaaatgggatccgttattggaacaacaatctcaacaatcgaacagttttgcccatgagagacgaagcagaaacagaaaatatttggacgtgttcatttgtgaatctgaaaacattcgggataagatagaattagaactgactgcttttacaaattttcaatctcccactgggaacgaatctacagttcaaattaaattaattggcaaagcaaacattcaagatgaaaactatacaactaattaa

SEQ ID NO: 571 - DNA, 735 bp, Cryptosporidium hominis
atgtcactttacgatagagcaataactgtattttctccggatggtcacctacttcaagtagaatatgcaatggaggcagttcgaaagggttatggtgcaataggagtacgtggggcagaatgcgtagtactcgcagttgagagaaaggctgttgcaaaacttcaagatcctaggagcgcaaaaaaattattgttagttgatgataatacttgccttgcatttgctggtctccatgctgacgcaagagttcttgtaaataaaataagactagaatgccaaaactttaggctgaatatagaagacgcaccaccagtagactatatagcaagatttactgcacaacaacaacagaaatatactcataggggtggcgttaggccttttggagtatctactttgattgcaggtgttcataatgatggaagcccaggtttgtatcaaacagacccatctggaattgcgcttgaatggaaggcacaagctgtgggacaaaattcaaagacagtgcaggagtttcttgaaaagaactataaacacgacatggcaaaagaggaaactattaatttagctatcagcgcactacttgaagttgttgaatcgggttcaagaaatatggaaattgtcgtagttgataaaaaaggatgtaatttcctctctgatgaagaaacagatatgcttgtttcggccatcgaatcaaaaattgctgctgaaaacgagaataaaactagacaatag

SEQ ID NO: 572 - DNA, 1725 bp, Cryptosporidium hominis
atggaagttgaggccaatagtaataattattatttatctgttatgagaagatcatccagaaggacttctttccctactttgcaggggttgtatgtatcactctttgaaggagaaataacaaatgatggtttggatttctcaatatctaataaaaacgcaggtaaagaattcaatccaaaattaataaagataacatttctattgagcatattgatttcaacaatcctttgtttagatcatggttttgttgcgtgtaatcttgaaaatatagagaaaagcttcggagtaggatatgcacaatctagctttattgggtcaatggtctatatgggttttttaattggttgtttattaactggattatttttgccggtgttgaaatctaaggtattacttattggttcgctagtatgtgtggcaatcagtggaatctattcatcaaaatcgctaaccttagcagaaatttatgcatccagattctttattggttttttccaggcattttcaattgtttaccttcccttatgggttgagagattttctcctcaatctaacacgactacatggcttgcatatcaacagttatttagtatgattggagtattttttggatatttactcggaggggtcttaacttgttttactgctgaagatattaatatttattacatgtcacttagcgaaaaaatcagttcattatttgtttcctggagagggccttttattattcaatctgcattaatcatcccaataataattgttttaatatttattccaggagaaattttggatgtaggagatcaggaacgccttagcgaagttgaatattcaaaaactacaggacttcttgtctcaggtgttgatctaagaagatcaactaatgataatctattaccagacgaaagtaattcaaacaagcgaaatagcaaactgaggagatccagtattctaattatcccatctcagtctattggtcctaactcttcaaaaagttttgaagttagagaaatctgcacaaatcccatttttatgttttcaacctttgcagtttgtggagtttactgtttcacaacatgcactttattttggttaaatcaatattttgtagaagtcattaaagtagatagaattacatctgtgttttcagttgcatgtatttatctttcaggtccaacacttggagtatatattggaggcattacaggtgacttaattaatgatcgccatccaaatggcttcggatttatattaacactatgcacactactttcctttattggatttattatatcaatggcggtggttcggacttgttcatacatcagttttttctggggtatgattatcattttgtttttccttactagcacactgccaatgtcgatcattgttataatgaaaagtgtatcaagcaaaacaagacaactcgcatcagccatcgcacaattttgttttaatttggtgggtttccttttgtcacccgttattattggaataattatggatgtaattgaatactttccttttggtgcgctaaaaagaaggtataatcctattgaagtcggggtaaaaataatgctatatatttctctgcccacattctttttttattcattagcaacattttgcagttatttcaactgtctaatatcgccaaagctaacacaaaaaaagattattattgcaaatcaaagcgatattccaaaacagctctttattaaatag

SEQ ID NO: 573 - DNA, 1914 bp, Cryptosporidium hominis
atgaatctttttgaaaatgttaaaaaagtactcggtgaagaattattcttcaagatacaactttctaaaatacttgttgttggagctggaggaattgggtgtgagcttgtgaaggacttgattcttagtggcttctgtaacattacaattattgatatggatggaatagacattagtaatttaaatagacaattcttctttcgaagaaaacatgtagggatgaacaagtcaactgttgttgcattagaggcaaaaaaattatttaacaaatgcaactccgataatcataaagtatcgaatatagttggtatcgtaggaaatataatggattacaacacggaattttttaatcaatttgacgttgttctaaatgcacttgataatatttctgcgagaagttacgtgaataaaatctgcatagcatcaaatatcgagttaattgattcaggaagtgcgggttacaatgggcaggttcatccaataattcccagagtctcaagatgttacgaatgttatcctcctccaactcaaaagacatttccagtttgcacaattagatcagtcccagacaagccccaacactctattgcttggtctaaatatctctttgatattgtttttggagttaggcatgatgaaaaagaggagtctgataacatactaagcgacatatcaaaaaaggttcaaatagatttagataatctaaagcagttagagaaaaatgaagcaagtgaatttattgaaaactatatagtaaatatgttcaatttcttgttttattctgaaataactttattggcgaataatcaggaaatgtacatcagcaacgacaagaaaatccctattccaatatcctgggatgacattcaaagaaaaaattacattgatcgggtaatcaattcagaagatgatttagaaaactctgagcaaaaggttttttccattaaggaaaatgctgagttatttttcaatagtgtacgtaaaattattataaatagaatgaatgaaattggtacagcttcactttgtttcgataaagataataaagatgctatggattttgtttcagctgcatccaatttgagatcttataatttccatatccctctacaatctcgctggtcatgccaatcaattgctggatctattgttcctgcagttgcatcaacaaatgctattgtctcaggagtacagattgcacaacttttactaatgttaaaatcaaaattatcaagcttaactaatcctgaagcggggaattctgattgctcatctaataataaattactatttgtaaataaattcgtatggataaggtctataccaatgggtagattcattatttgcccggaaagccttgaaaaatgcaacccaaaatgtttaatttgctctcaagtacttgttaaaataaagattgtaagctttgataagtggaatttaatggagtttgtaaaaggaattatttgccagcacttaaagctttctgagccctctgttgagttaaatggaaaatgtatttgggatccggatttattagaggatgatcatttcatcaaatatagttctcaaagaccacttattaattggaagttctctgatggatgcattgtttctattacggacttttcttgtggagaatttcaatgcgacgctataattaatatctgtgacaaaaacattatcaagtcagaaaaaaactttcaaacttatgagaaaaacggggagccatttaccataacaatagaatcttccaaaacctctttaaatgatagttgtagagactatttatcatcagaaagctctgacgatgaaatattatctgaattccaaggaaatctagataattcttcaataagaaagagaagctttaacgcaagtgaaaatgtggaaaatactcctaaaaaaagaagataa

SEQ ID NO: 574 - DNA, 567 bp, Cryptosporidium hominis
atgaagaaaaatccagaaaatatagaatattatacagatcatattaacaaaaagataacaaattcgataagcaatagtattagactacttttgaagaaatttgatgtggaattagatgatcccaacatattagatacagctacagaagcatacattaattatatcgaattattgggaaaaatttcatcaagtatagcaatcgcagcaggaagaactcaagtaaacattgtagatataaaaaaatcaattaaaagcctagatattaagagatatgaacaggtatttttggatagcgaattggaaagcactatcaataaaaagaataactttggaacaaacttcttaaagaggactatacctgacatttgcacaaatggcaattcactatggaaggatgtattgaatgacactaacaatgcaaataaaaaaagtctcgacccagagttatttgaatacgttgactcgataccaaagcatatacctgatttcttaccaattttcccacccaggttagactactgcgataaatttattagtagtcagtgctcgaacgggaaagatttttag

SEQ ID NO: 575 - DNA, 1317 bp, Cryptosporidium hominis
atgaacttgaagccgctttatgaattaaattttttattcatggataaattaaattatgaaaacaaattagagcttaaagaaactaaatggaagagcaatatagatgaatctgatccagcttttagaactgtagaatttggttcagatcctcatgtttttaattctgaaactgttgaaatttttttaaccggcgttattttgacaattttaggaaaggcatctaatgattctgaaaagctcaaattgatagaagaagtagtcgaatctgatttttcatctttatcatgttctaccggattaattgcaaacttggaaaattcgattaaaattgataatattttctgcgtaacttttacttcaagtttattttctcttatatgcttgaaattagatgggcatattattgactcacaaaatatcaagttattctgtagaagaccgaataaatattcgaatctaaataatgaaaaagttttggatacatttattatcccaagaatcagtcaatatgacaactttaaagaaaatgaaaagtgtatattaaaaaatttacctactgatataaatgaagagaaaattagacaacatctagagaatattggaaaacttaaatctctaacaataatatatgatccaattacgggaatcccaaaaggcgttggaagctttgaattcgaagaaagctcgctttgtaaaaaggcaattgccatacttcatggaaagcctatagaatcaaccaaaaatggaatttggaacatctatcttggaagtgggactataacaaattataaatcaaataaaggtcaatttaatcaatctaatttttctgctaactcgagtataatccaaaatagtgaatatttacatattacagagatccctacaagcatgacttacaatatttttagcaatccagtacttggattaatgatgaaatattcgaaacaagttggagaaacgcctagccaaataattcagttacttaatatttttcttccagaagaactagttgataacgagatatataattcgacattagactcggttaggtctgaagcagaagtatatggaacaattcttgaaatattctgtccgcgtccaaaagttattgaagaatttcatagctgtagtggagcaggtaaagtatttatatatttttcagatattactgctgcaaggcgtgcgcaataccaatttaacggaagagtatttgataatattaagacagtttctgcaacattttttccacttgaaaagtatttaaaacatgaatatagtgtaatttcatattacgatgaagaccaaaagttatattaa

SEQ ID NO: 576 - DNA, 1002 bp, Cryptosporidium hominis
atgatattattttatacgatagatttgattttatttattactcttgatatagtaatattacaacaagcattaaagatgaaatcgacatattattcagagatgagatttacaagcatgtcatctatatcacaccgtacaagggtgtgtttcattttactttgcttattagctaatataacgaggacaatttcaataatcattttggatctaacatggccaattgtcagcgaatacagattattattaaaaaatgaaacaaatatcgaagaatggtcacttgatttgttgagaacgctgccatctcttgtatatttatcgtcttactcagtggttgtacttttttgggctcatgtatattatacttctattttaataagcactcctcaaatggtttcgtttttcgttgcaataaatacaatcatatatgggctatatattactggaatggtagtttcactctttagtaatattttaagctttgcttcaatttcaatgtttttacttgcaatttcatatatttcaatctcaatatcaatgctctattatggaataaaagttgtttcacatttaactagacgcgctgcaagtggcactattttgaggtataacgtaattcaacgtgttctatttctaacaatattctgcccagtacttttatttataagagggattatttctggagtacagtgcatttatagcattattggcttcccgacttattttaagatatttgacaaaactcctattggagattcagtaatatttattctaacagagctattcccttcaatagttatagtagtatcgttctggcaaaaaatttctccttcgaccctgacagtatcaactaggggtctcggtttcacttctggagtttttagcaacatacaaaatacaaacgataattataatacgcaccactcattccatttaattcaaaatataaacgcactgaataatattgatgagctggtaaagaaaaaagatagagaaataagctaa

SEQ ID NO: 577 - DNA, 576 bp, Cryptosporidium hominis
atgaggctaaataaagagagtttggataggatggtaaacatcattacattgaatagagataaatataaagatctttttacagaacttattttcaatctactcgtaaacttcgattttgaagcttctcagaagatacttaatagctttagttcagtgactgagagtgatttctttttaaacccattacaaaaatatatagaggaaaacgcaaggctgctcatttttgaaatatattgtagaatacacaaatcaattgaccttaacgtaatatcaaatgaattatctatgactagcatcgaggctgagcgctggatagtaaatttgattagaaatgttcatcttgacggaaaactcgattacgagcataatcgagttgaaatgattgataggagtaataatccgtctcaattagtctcagataaaacaaggaacatactatttagaagcaatctactaatccaaaacttaagcaacaacccttcattcaattacaataattctcaaaaaaataaacaaaactggagagtacaatctaataaacaatccaatagatcagaaaaaaaagagcagatgtga

SEQ ID NO: 578 - DNA, 2418 bp, Cryptosporidium hominis
atgaaacaatcaatcaatagtgaatatggaatagatgaatttaatagatcactagatattagattgagaggaactataaagaagtattttgaggacttccatgtgcatgaaatacaaaaaaatggtgatgtctgctgtatttcttcattaagaaataaacatgagataattaaggaaattcaagaaagaaaaaagatactttctggagataatatgttaatcaacagtaacgcaactataatacctgaattaattaacaatctagagaacctaggaatatctcagtattgtattaacaatctattaacatttattagtattttaggtgagataaaaaaacttacaaataacagctcattaggcaatagaatgttcaaattggataataggggaaacttaaaaagtatttttgaattaaatatcaagttatatggtaccaacactaacaatattagtcctgggaataatttattacttaataatatgcatgagtttaaagacaacaaagattcagtaaatgcccaaaaagaaaagagaaaaaaaattcatacgctaataaaggaatttgtaccgtttattacatctcgaactgttgaaaacttgaaaaacaacaacattttgtatcaagataaatcatttcaatataaagatatttttatttcgaatgaaatatttagtgaaatttcaaagttctttaaagttgatgaaatagaatctgaatgccttaaaagttttaaccggcaaatattatgtaatgattgtaatgagagacaatttgatataattgttttgaggccatcaaatgactatatttactcattgcggaatgttagacaaaacacatttgcaagtatagaagaatgccaaggtaatttagaagcaaatgagataacatcggatactgaaccagcttgtaaaaaaaaaagaacagaatgtgctgaatcaaacctaattacagaaaaaaaagtggatttattattgggaagcaacgaaaggtgggatccaaacattccagattatattcatttcactatttacaaagaaaatagagacacagcagatgcaatcaatatgatttcaaagtgtttaaagaggaaccataaatcctttggaatagcaggcttaaaggataggagaggcattacagtgcaaagagcttctgcttacagagttttggaagatcaattaatttattctacggcttccaaaaattgggatcgcaatattaggatttcagattttaaatatgaaaatgagcaaataaatattggtgacctcaatggtaacctctttcatgtaataattagagatttagaaattttagatacaaatatacaaaaagaatctggaaatgaaaagttgacattgaagatggttgacaaattaattggcgatattaaatcgtcaggttttattaattactttggattacaaagatttggaaccagtgaaattcctacatataagattgggatttcattattaaagaatgaatggaaaaaagccttctatttaattcttggatttgacgaagaaaaaatgattagctattcggcagaaaaaagaaaattctatgaccaaataataaacgaagattttgaagaatatcaaaaaagcctatcaaatcattcatatctagagaaattattattaaatggatttattaaagaaaaaaagaaaattcaaagcaacactaaatgcaaagctaaggaagatatatatagagaaagtattaatttactaccaaaaaactcttattccctttatatacattcactacagtcgctttttttcaatatagttgcaagcgagagaataaaaaaatttggaagaaatccagtaattggcgatctagtaatagctccaaatttaaataaatattctaacaaaaatgaagattcagtatttagcgagaaaaatgtaattgtattagagagccaactagaattggcaaagttcacaatccaagatgtggtacttactttacccggagataatgttgcttacccaccaattatgaaggagaaatatgaagaactaatgatggaatttatgggaataagtattcaagagaactgcatgggaataaatggtacctataggaagatcttagtagtcccagactatatcaattatgtgggacttaatatttctgaaaaacgaaatgatacgaacaaatttccagattctaaggttattttaagtgaccttgatatattaactattcatcccgaactaaagcaagaattgggaacaaaagaacccatattatcgcctgaagtaatgagttacaaatgtgacgataaagacgagaattcgcaggtgaacacattagtattttcatgcatgctaccaaaatcatcttatgtaacaatggcgttgagagagtttttgggaaactctccttcagaaaagtaa

SEQ ID NO: 579 - DNA, 1779 bp, Cryptosporidium hominis
atgtcaaataatgtcaacgaaagtttcagggagattcaacaacctcctccctcataccttgtaagcaaggatttagattcaatagttgttgaagagagcatggaaatatttgatgatagaatttatgattcagaaacgcaaaaaaacgaggactcttcaaaagaaatgttagaaaatgttgactttttggatagagtagttgatcagttttatggaaatgaaagaacttccagcattcgaaaagtaaatgacgaaatggatgaggggaatccacttctattctcaaataatatgacaagaaacacagaaataatgaatattaataaaagacataaaataatggataataacgatcaaaaactaggtggaagcagagaatttcttgatgcaattcaagctaagactagaaaatatattacttttgaaattggtagaggatataaaagatgtttgcttttgcaaacgggtgagttactacggttggtacattcatacaacaaggaatgcttgttgcaggatactgtacctggtgctctaaaacttcgtgatttgagacaagttgtgagtatgggtagtagccaaaggccttcaattgaagtaagaagaaactgtattttagtgaatgtaccgcattttagagcaattattcttcatcaaaaagttttgctaattgcatcaggatattcaagatctccacttgactatccaagtagtggaatcaactataactattctagtagtaataataataaatctgaaaaaaaagaagatttcaaggaacaaaataattgtgttaataagaatgcattctcgcttaatgatgtacaactcgaagttccagctccctatttatcttcaattgatattccaaattctccaagcaattatcaatgtaaaaacgatgttataaatgaagtaaattttgataactctatgacagtgcagttcgattcaagtaaggttagcagttttccaaaaactggaatcgaatatactccaattgaaggtttatctgataaacagatatattcaaaaaactgtcagttcattcctcctgggattgaggaaggatttccattattaaggaagttagaacatatttctggcattgagagttcaactccatttgaatatttggtattagaaactattctagtagaatcatgcaatattattaatcgacaagtcaggccaataagagattctgtattgtttatacttgatagctttccaggaaggaatcgagaaacaagaagattgttagacgcagtttcagagcttagaaggagattaaacgctatagaagagcttgctcaaggacttttcaaggcaattaccgaaatgctcggtaatgaagaagatatgcaaagacttgagatttcattttattggaatagaccagaagcgtgggaatacccaaaaaacactccttatcatgaagaagtagaaaatgtccttgagtgttatgcacaagaagtagaaatgatgttgcaacaaatagagtcaataggggaatctttagaagatgctctagaagtattaacactagaactttcttcattaagaaattcaattatgaaggctgacttaggactgtcaattatcgcaacaattgttggcttttgcggtttttttgctgactgttttggaatgaaccttagaaatggacttgaagaagttgggccagcattattttggtttattacatggggactaattttgttatgtgctgcgggagcaattgttgtgttaacaacttttagaaaaatagatttatag

SEQ ID NO: 580 - DNA, 1212 bp, Cryptosporidium hominis
atgaatacacatttttcgttatggccaaaaatagaggctattattttctgtaaatttgacgaagagcttggcccaattgtactttgcagtagcccttcagatatttttggatctgaaaaatctcagctatattcaataataacaaaatacctactaccggacattcactttgccgggaaaacgatttcatttgtaataggaaatagatggaaagcaataggagtccctatatttattgaaggtagtcagtatttaaggaatagtttccagttcacagtatgcattatcgtagaaaaaaagccctacaatttttatcaagagatctattcaaggcatattgctcgaactcttggttcggcattcaaacttttggaagaagattgtggaatactttattactattgtacatatactgagaaccttcctgatttgttaaaaaaggtaaccaagaacagtaatgagatttcatcctttccgaagaacattctggaggttatcgagaatgtcaggtcacaacttaataagagacatcaagtttttgttgagtttggtgatgctagcatattaaattttagaattagaagacctccatccaatataataatatatccggaagatattcctttcccttccgaaaatacattgatttcagatattaaacatataggtttagatttttcactcattaaaattctaccatacataaatggaattaatactagctttgaaatatcaaggtattgttcattgcctattgaagatgtaattgtatgtctggaacatttagttttatatggtctcataagtatgattgatatgatttcttcagaaaacaaatatagatttattggcggcgaggacaagcatggcttatacagaaagttatgcaacgaatgtataaatgaagggaacgtgttgtcattcacaaaaaaataccacaaagagcttagaaaacataaaattaaaagtatttataagttcattgcagcaggcgttgtttccaaaaaaatcaccagacttcatgaaattccgattatttttgctgatactaaagaactttcaggaattgaaaaggaattactacaactttgtaatgggaacagcaaactagaccatatacaaattttattagggtttaatactaagtcagagatcatcaaatttatttctaatgtattcgacaaatcgtccatttattgggcgtatctttaa

SEQ ID NO: 581 - DNA, 456 bp, Cryptosporidium hominis
atggtctcgtttgtttgtggaaattgccaagatgtactaaaaaagaacaaagtagattctcattgcgttgggaaatgccgtgatgcctgggaattcacatgtattgattgcaattttacattcgagggcttcgactataaaagtcacaatagttgtataacagaaaaagaaaaatactgtggtaaattggcaaatattaagaaacctgttcattatccaggaaatagttttgtagatcgaaagaaggagtttcagcttattattgagaaaatactaaaaaaaaatggatcaatgaactggaaaaaactagtcaaagaatcaattaaagaatatatgaataacggaattagtgataatattgaagataaaattcttaaatgggagtgtcttgctgcaattcctatttcctatacaacgaatgaatcaaatatggtttcattcaaacagtcattttag

SEQ ID NO: 582 - DNA, 1098 bp, Cryptosporidium hominis
atgcataggaggctttttagtggccatcaaaagatttcaattttaaaagaaaagctatctggactttcaaaatgtggttacacaatagtattcgcattggataattgtgaacctattataatcggtgcttctaatatttcttactttaattcgaatacggctgggttttcttctaggcagtatgccttatatactttggtagatattatgcattcatccgaaattaacctagtgcttattttgagtacatcaatgtttgacttgccagatttcttcgaaaaaagagtaaaaagcagaatgtctcaaagaagaatcttgttagaggagttacaaaatacgaaaaaacataatagagtaaaaagtatcataaataaagctgcaaaagtactaaagatcgacaaaagattagtttctgaaatagaccagttaagtatagattcatacaacgattccatagacagtttattttcctatttagcggatgaaaataaggaatcaagagaagttataaggtcgtgggaatttttagtcgattttgaaatggaagacgaagttttatccaatctcctctataagtttctactagtttcacctcaatgtaatataaaagagtttatgaaaatattttcagctagcaacaaaaaaaaactttcaaaaaataggaatgaatttagactgcttaaccagggaataaaagtacaagaatgcttgaagttgaaaagatttgaatccctcagcataattcaacacacaattttggttgcattaattaaattaataacattaggagtcacaaatataacatttaaaaagataatcaatgaattacattcgctgaaaaattatatctccgtccaatctaatttatccggacttagactcgatcatgcagaagaatcatatcaattatcttttttaatgttggtgaaaatgggaataatagaacctgtatataatatcaaaactaatgctttatatagtacattaagtacaacgccagtaaaattcacgcaacataaattatatagtgactctatacagcaatttaacattccaactattcttcaatattggttaaaaaataacatcctaaaatga

SEQ ID NO: 583 - DNA, 765 bp, Cryptosporidium hominis
atgattattgaatcttctcaaatcagaacattgataatttattgggttttagtgatattttgcttgccaataatgtttaagctaatagtaaacttaagctcagattcaaaaaaaaaaaaaatatttacacggaaaatctttcatctatttttaatcgcactcttttttccccaaatattatcatttaatataatgcctactaaagagtctcaaggaacgattgaattcacagtaatttccatctatttagcctcgtgcattttcatttatttagaggttatgagaaaataccgttacagagaattaacgaaattaataaataaattattgttaccttttttggataataaagataacataaatgatttgattattacccatatttgcttgctggttgggatttctattccaatattcaaggagtttctactaagaaaagatattcaagattttgacatcgtttccgcaactttaggaattgcaacagtaggagtaggagatgcattttccgctatttttggaatattatttgggaaaatgtctttacctgggaacaaagacaaaacattgattggaatgattgcattttttatatcaacatactcgtatctgcaactaacttgctttttttcttcaagtaaatattcattatcaaaattatatataattagctttttttcatcattactagaagcatattctcactatattgacaacgcaacaatacctatgttctcacttactttgtatactaatattaggtaa

SEQ ID NO: 584 - DNA, 408 bp, Cryptosporidium hominis
atggaagttggtgtagaagggtgcttacatattgaacttgaatatgataaatctacttatcatttaaaagatgtagttattggtaaggtttatttctcaatagtacggctaaaaataaaatatatggagattgatattataagacttgaaacttgcggatctggaccaacagcaataactgaaactgaagtactttctaaatttgaaataatggatggtgcgcctgcgaagcaggagacaattcctctaagaatgtatttatgcggttgtgacctgacacctacatataagaatttgcaaaataaactttcggttagatacttcctgaatttaattattgttgacgaagaagacaggagatactttaaaaggcaagagattacactttggagaaaaaaactcggataa

SEQ ID NO: 585 - DNA, 366 bp, Cryptosporidium hominis
atgcctaataagtatgtatttcgctgtaagaaatgtggttcaacgctatttacaacagatcatattattaaacatggcaaattaaatgaaagaaacgaagaattcaaccttaaagatgaaaataacttatgtacatcatactttatttcaaatacttcatggatggaagactatactgagcagaatggtaggataatttgtccaaatcgttcttgtgattcaaagttgggatattattgctggtttggcggtaagtgctcttgcggatattggcaaaccccatcctttcagatccataagtctaaagttgattatcttccgaattctctgagacgaaacactatcgatattgcaataatagaataa

SEQ ID NO: 586 - DNA, 1845 bp, Cryptosporidium hominis
atgaatctatataataacccacttttggaggtgcgcattcctcgtgtagtaataattacttttgttttcataatttggattagaagaacaaatcaacaggtaattaatgcatgcacaataggaaataatccatgtacagaaaatgcagaatgctatgttgagactttattcattggcgctcccaaatgtagatgcccaaatggttttcagggcgatggattaataggaggcactggatgccaggatattgatgagtgcgcaatggggattcatacatgcgagcctaaaactcaaaggtgcattaatacgatagggagctatgaatgtgagtgtctgagtggttttagaaagcatgaacaacgtttaaacgtgtgtgttgatattgatgagtgtatggaattaagtgtttgtcctagttctacgttgtgtattaataccgaaggatcgtttaaatgtgaatgtcttgatagagagctaatatttgatcagggaaggtgccgtcccatcaataaatgcacagattttaatggaagattaaatgattgttctcaaaattgcgttttgggtagtgacggacgtggaaaatgtgaatgtaaccccggatttaagttgcatgaagatcgaaaaacatgtgtagatataaatgaatgcgaggaaaataacccatgtgaccttagcatttcgagctgtataaatatcccaggtagctatatttgtgactgctttaagtctgctgggtatatgacatccccaattaacaacaaaatatgcattaatataaatgaatgcgaggaagatccaatgatatgtggtgacctaaatatgtgttgcaaagatttagctcctccagacaagtacgaatgcgtgtttcctagtattaattcggaagtgataaatagaattgacgtaaataaccatttaaaggagggtatgaaaaatgtagaaggtgaacataaaaatttggaaaacaactcgaaatacatccaaaataataaaatttcaagaaaatggattgaaaccaataaagaatatggtaataatgctgattcgattgcaagtaataacaatagcggttgctacgactcagatattgaatatccaggctatactattcaaattttgcattcattaacaagcgcatttgattgccaattacaatgccaagtagacttgggatgcgacttcttcacctacgatatgatgaatagggtatgtctttttaaagcagcaaagtcagaaccaaaagaatctcctgggatgatttctggtccaaagtattgtaattataaaaagataagcaaaaataagttgtttccgctggattcagcttcaagccaatcatctcttcttcgtagaatgtcttcaaataataattcaaataagccaaatcaaatttctgacaacaagtgtcctcctggctttaactttgcatatgatatttggagaaaacaaaaaaacaaaagaacaatggaagtaatacaaaaacaatttggtacaaaacagatgaattcaattaatcctgtggatatatcagaagggttgcaaagtaatactaatttcatggcaaaccagataaatcaatggtatgatgtattttcaaacgttccaaccacattttcaaacacaacaaagcagacaaataagtccgttcccaaacttgaatcatccaacattaatcctggatttattgcaggaggtattcctccacctccaagaggtacaaattttccatacaatgaacattacaaatttaatcaatatcaagaccaaaacagtcaaattcctcacaagcatggccacaatactcccatatatggaatgaaatcagataattcaattacgtga

SEQ ID NO: 587 - DNA, 2589 bp, Cryptosporidium hominis
atgcttagtagtctttcagacagcgagctctctgagcaacttattcaagtatataaaagttttttgcaaggcaatgacgaatattcgtccaaaatcaagcaaatggcagttgaaaatatagaatctgggcgtattcttatagaattaggtgatttaaggaacataagtgatgaacttcctcagaaaattatcaatgaaccttacttgtatgtatccccatttgaagaggtaattaaagatttagtggatctagaaagagagatcgataaaaattcgccattgaaatcttcacaatttaatgcgagggttgggttcagtggttggtttggacgtaatcatctgacgccgcgtggccttactgcaagtaatattaacaaaatggtttgtgttgaaggtataatttcgcaatgctctattgttaaaccaaaattagttaaatctgtccatatttctaaaggccatttaattggtcaaaatgatatttcaggtggagcaaatcaggcttttgttgaagttagagggcatcgcgatatctcttgcttaataaaagatcgttatattcagagtggcgttccatcagaagatggacaaggtaacaaaatggaggtagaaataggcttatgcagatataaagatacccaaaaaatgacactacaggagttgcctgaaatgatacctactggacagctacctaggagcattgaaataatagcagaagatgatttggttgagacgattaagcctggggatagagttaagattgtgggggtctacaaaccaatttcaagacgagaaaacaatgcattaactggaatttttaaggttgtaattgttgcaaataatattcaattactaaataaaaatgttacttctcctgaattaactcctcaagaaataagaataatgaaagagatttcaaatagagatgatacttttgagattttgtcaagatcatttgcatcctccctttgtgggcatgaatacattaaaaaaggcttattgctggggatattagggggtgcagaacataatcttgaaaatggaacacatatcaggggcgatatacatacattgttaataggagagccttcttgcggcaaatctcaattgttaagatttgttatgtcaattgctccgttggcaattagtaccacaggaaggggctgttcaggagtaggtttaactgcggcagttactcatgatccagatacaaaggaaagaagactagaagctggagcgacagtattagcagatagaggaatagtgtgtattgacgaatttgataaaatgagtttttcagatagggtcgcaatccacgaagttatggaacaacagagagttacgattgctaaggcaggaatacaggcttctctgaatgcaagatgttctatttttgcagctgcaaacccagtatatggccattttgatgactttatggaacttagcaggcaaattgcttttcctgattctttattgtcaaggtttgatttaatatttattgtaaaagattctagaaactctcagcaagatcgaaaaatcgctgcacaagttcttgcacaagttagatataataagaattcatcaataaatgatacaaggacaaataaggcaaacaataattttgttatacagcctgagtacaaagatagtgatttaaatgagaaaaatgaggtgaacgatatttggcaacctccatctaataaaatagcagataagagatctcaaaataactcaaagggttcatctggagataaagtattaacaacgtcatttttaaggaaatatattcattattgtaaatatgttagaaataccccaaaattaaccgatgaagcagctgagctagtagcgagaatttttaccgaattaagggccaagtgcatgaatcaaagcaagggtggcaccacttgcacaactcgtacacttgaagggataattagattagcgacagcacactcaaaattaaagatgagagattctgtaatcccagaagacgtgttgattgcatttgaattgctcagctatgcaatgtttggagaggttattgaaaaagagagtctgcttaatgtagtatttgagaaagatatcgaaaatgaactgcaacaggaagataattcaaggaataaaaggagggaagaaaaaaagtaccaaagatcaaatcatccaagcaaaactcccgagttaaattttctggaagaaaatgaacacagcattattgctcctcctccaagttcaattgtcactcccagtagggaaaaaattaaccgcaaagagtctgctgctcgtggccaccaagttgctcttgctgcagcgaatattcttagagaggaaagcaatactgatcatggagattgtgagctagctgattttaagaaaaaattcattacttcatgtatcgcagaacagttttctgaatcaggccttgaagcgatgctcgaggaggaactattaaaaaatattatctcaaaatcaaaagagaaaggaaataattttatgatcactaacagggatataaaggaagttttacgaatcttagaagaagaaaataggcttatgattgctggagatactatatactcgattgtttag

SEQ ID NO: 588 - DNA, 1551 bp, Cryptosporidium hominis
atgtccaaatgcaatggttcggggaataactcatttgcactaaaagataacaaattcctgtatactaatgataacttcggaagtaacattaatgcttgccaggaatccaataaatatgtaacaagtgaggagaaaccacttttattgctactagatggtataaatcaaaagtttcatactgataaagctttttcacgaaaaaggtcaatcgaatcaaatgaatatgaatccataataaataagggactaaaaactaaacgtattcatgaacatgaaatttcctcaatcaaaagctctgataaaaaagattattccgatgttactcctgatactctccttggctgctatgctaacttaacaaaattgggtgtaagaatagacgattattttttaataatttcaaaaattaacagcaacaaaagatcgcaagataaatctgataacgttgtgagtgggaatggaaacccagaaagggagaataataatcgtccaaaactttattgggcaaagcatattgcaacaggattcccagttgttataaaagtagttaaaaaaactagaattatgtcatcatttcccggaagttattcaatttggaaaaaactatgtttgaaattattaaatttaccatatcatcctaatgtaatgaaaatttaccaagttcttgaagatgaggaaaatttttatctggtaatggaaggcttggaaggcggagagctttttcaattcttaattacagagcaagctattccggaagaaacgtgtaaatatattattagacaaatattagaaagtgtgaaccatttacattgcttaaagatgcttcatcgtgatgtaaaacctgaaaatattatgttcagatacaaaagaagggaggaaaaaccatattctccaatgtcagcatcatcattttctacttttgaagggaccgatgacaaattaggacaagaaataaaaagcaaagaggaaagtattgctcacctttcattaaagtcttctaaggagtactttgaggttgtgctggttgattttgacacttgcgagctaatggatagcaaaccacacgtacaaatgattagaatgaagaagaggctggttggcacattcggttatcttgcccccgaagtattaaatggaggtgaatattctgcagcttcagacctatggagtatagggataatactctatatactaatgacaggaattcctccacttaggattgacttaatgtgcgattaccctaaagctttggaagtgctaaaggtaataagtgatcaaggaggatttcaattcgacgcgccgcctttacctgattttcctttagcacaagacctatgtataaggctcttacaatgggatccaaagaaaagaattcaatcatgccaacaagcactaaagcatccgtggctggttgattcttttaaatataatccaataggaccaatatataagcaaattctatgtaacacagatgtaaaagagatgttcaaaagaaaagatataagcaaacatatgaaagagatagaagatatagaagaattggatacataa

SEQ ID NO: 589 - DNA, 759 bp, Cryptosporidium hominis
atgaatattaataaaaatgaaatgagtctttcacctttaaatagtttatcagcccagctagattctaatactaataaggaaaaccactttgatgtaaaaaatcagaagccacagtgcataagtgataatactgaagcaaacataaaacacgaagattttgagaagtctaatataaagaaaaaatataaaaaaaatcttatttgggatggcccaagatgggatctggcacattttgatccgacaatgagtgcaagagaaaggaaaaaacttgtttattatgaggctctgttcaacaaacttgagaatgatgtagtgttgagatgcaacgaacacaataataaaaatgtgaaaaatccaaatcagaagaggaaaatgcgtaataacactttagactcaagccccaagacagaattgagcgatttgaagggaatgaaagaacataaaagcgatattgattcaggagatagttctaaatcagataactatagcaaaactaatccagaaaagtttgtaaattctcacaattctaatcaaattggtattttgttaactcctgatagaaatttttcacgaagtgaaaacattatatcgccaattttagaggagcctagaaagtgtagtagatcgaattcaaatagtcaaacgccagcaaatgaaagggaaagtagtagcattcgaagatccaatgattggagagtaaaattattgaataaaagatgttcactccaagctacaccttatagaggagcgactccataa

SEQ ID NO: 590 - DNA, 297 bp, Cryptosporidium hominis
atgtgtattggatttatcgatcagataggtaagtttccatttaaagtaactcctttttttttttttaaaaaaaataatttaggaatacataacatattttatggatgtaaaaactatcgctttggtggttgcggatctgtattggactaccgttatttaaatagaagctctaaaatcatcctaacttccggaatctgtgaaaatgaatcaattaaaatactaaaagagttttatgaaattggaaacccaaaagctccagaaaataagagaaaaaggccactaaaaccattaaattga

SEQ ID NO: 591 - DNA, 2127 bp, Cryptosporidium hominis
atggaagtctcttcaatttatggtcctaatattctcaactctaaatttgcaaatactgattttcacgcaggcgctaagaatgctgaaagaatctcttccaaagttattcgtccagagcagtggcacccatggaaaagttttggcaagcttatggatgaagctatattggaaatgggctggcaagagagatattcaatactacgtgacattgtttctaaatacgggaaaagaaaaaacggctacttaacacagagcgagtttttgaatatattaaatgataacccaattacagacgagcaatatagaactgtattttataaccttatggaccgcaaccaagatggaattgttagtgaagttgaatttacatcaggaatgttaagtttaagtcctttagcgaaaaatgatcctaaaactagtattgggcagcttagattacaatttatcttcctttattatgacacagataggaatgggctccttaacttaaatgaattaaaaagaatgattattcatatttcttccataagatcattagctaaaaaaacaatatcaatgagtgagtctaaagcaagagaatatgctattcatttaattgctcattacgatggagtatttggttttaatgcattttataattctgtgaaaaataatatcttaaaaggaacaggctggcttttgcgaactcatctagatttggtggattttatcaacgacaatattaatgctgaatataattcaaataatgatattaataaacatgggtcatttatatcaaatttttcttcaaaaaattgcctcaaaagcacctttgatcaagattcggagcaagctcaacatatggagttagctgggttaaaattgacttctgcattcgcagaagaaacaaatatgaatagcagactcaataaactttcctttgaagctggcaaaatccaaaatgacataaaactaaattctaaaggtatattagatttattcccttacaatttccaaaatcaggcatttagttctttggaacagcgagtaatagaatactatatgaacatcttaacaaactctgaaaataaatctgattttgaagaaaaaatgtatataaacaacatattaaattgctcagaaataatggatttgtgtgatcgagctgtgcaaattatcagaggtgaggatagtctgattaaaataaagggaaataactctgttcgaatttttggaggcattcatgggcagctaattgacctattgtattttttcgaacaattctcatggcctcattttcatagaggggacatattatcgatgaagtatgttttcttgggagattatgttgatggaggaaagttttcgttagaggtcatttctatacttttttctctaaagataatgtttcctgataagatatttttattgcgtggcaaccatgaagatgcatcggttaatttgacttatggatttcattttgaatgtaagcagaaatttggaatgaatggtgagactatttgggaaaggattaatgatgcctttgaatttttttcgatttctgcgttgattgatgatcaagtgttgtgtctacattcaggaattggtaaaagtattaaaagtgttgcaaatttatcaggtatccccaagccaatccatgtaaaatcggaagaattaataaacaaaagtgattgtaataatagattagctgagagtgatagatacgtgtttgaatgtctttggtcagaaatgatagatcaaacaagttttgatgactctcataattttataaatgagacggacgtagaacacacaagagatgctgaaatttttgaaaaaaatatgtattgctatgattcttatgacgttgaagattttatgaatacaaattcaataaagctaatagtaaaaacaaacgactactgcaaaagaggatatggatataacgcaaatggcagagttgtttctttaaattctgcaaccaacttttgcaacaatttttgcaatgatgctgctgtattagttattacaagatgctttgacaaccaattgatccaatacaatcaaataattaagtatcaaactatagataattctttcgggtggtttgatcagattaattctggaattaaagcaaaacaactttag

SEQ ID NO: 592 - DNA, 1407 bp, Cryptosporidium hominis
atgctcaagctttttattctttttatctactcttttatatatttaatagaagcaggttctggtacacttggtgaagctcctaaacaaatatttaatgcagatctggccagcttggaattactcattttgacaaattccaacgaaaaaaacattaaacaaaagtactcaatattcatttcaaatctcgtctcagccggccatgaaatcacagtaaaaacttataatcgttattctcaggagcaagatctagagttatttctttatgatgagtttctctataacaacattattattctagatatagataattcagatgtgcacccttcctttccaatatcgtacgtaccaaaaatcttaaatttcatcgatagaggaggaaatttgatgatatttgttgatacaatcgatgatacaaatttaaatattggagaaaataaggcaataattcgattagcaaaggagtgcgcaggaatagaatttctacctcaaaatactcgcttatttgatgttactacagatggagttggtaaatcatcaaaaatattttcaaacaattttattgaatcagatgcaattttttctccagaaaattttacgaaaaaagggattttatatcatggggtaggcttttccaattctattcctagtaacgagcttgtaattccaatattgacagcttgccatacatgtatttcggttaataatgacataaaatcgaaatctattagtttgtttggaaactacattagttctagtactggggaagaaattgggttaataatggctcttcaaggtagaaacggcgcaagagcaacatttactagcgacggtaaattgtgtagtgacgaaacaataaaaagtaatagtgaaaattctaaattttgcaaagatatttttctatggtcatttcaacaaaaaggattaataaaaattggagaaatttcacacagaaagttgaatgacagctttgaaacgattgttgaaaattatgatgaaatattgaattatacagttgaagatatagttcgtttctccgctaaattttataaattttctaacgataaatgggaaaattacaattcagaggatattcaacttgaatttacgatgctagatccatatatacgaacttacttgaagcaaagcgaagaagagtctcgaagctcaacatttagcagcacatttaaaatccctgaagtttggggagtctataaatttgtaattaatcataaaagaattggttataatacaatatcatatgaatcaattacaactgttcgcaattttcgtcatgatcaaaatgagagattcaatatttctgcaatgccatattactcagcatttattttaactattatttctttctgttattttacattactatttattacaaaaaacagtatttga

SEQ ID NO: 593 - DNA, 510 bp, Cryptosporidium hominis
atgtcagttagaatcataacaaattacggagacctaaaatttgagctattctgttctcaatgcccaaaagcctgcaaaaatttccttgctctttcagcaagtggctactataaaaatacaatttttcacaagaatataaagggatttatcatacaaggtggtgatccaactggtacaggaaagggcggagagagtatctatgggagatattttgatgatgagatttacccagaattgaagtatgataggagaggtattctttcgatggcaagcaaaggcgctagtaaaaagccaaatacaaacggttcgcagttttttataacttattcaagtttaccgcaacttaatggagagtatgttatttttggtaggctaatagatggttttgaaactctaaatgcgttagaaaactgcccatctgacaaatcccacaaaccaattgacgaaataattattaaagatatagttattcattcaaaccctattgctgaccaagaaatacttgattaa

SEQ ID NO: 594 - DNA, 354 bp, Cryptosporidium hominis
atggaccaaaaagaattagacgaagtagctgtcaaccaaaaagaaaatgagttcgatgagcttttgccatattccaagatagctaaaattttaaaacttgtaactgataaaaaatttacaaaaacatcagttaagctaatacaatcttctactacaaagttcattaaggagatctcagaactttcggagaaacaatcaagaattcgctctaaaaaattggataaggatcaaaccgttattattcaaaaggaagatgtaatttcagcaatccaaaaaggtgggaaaaaatttagttttgtcaatttttctacagaatttcttgaagaccgtttctggaacatggaaataagttaa

SEQ ID NO: 595 - DNA, 1011 bp, Cryptosporidium hominis
atgtctgagtcgcacgaaatatttatggaggatatttctcttcttccaggatggatattacggaatttatcattgatgcgtgagattgataaaaaaagcaatgatttacaaattactctcgaagaaaaacgtggcaaatatttgaaagagttaagcaaagtagctaatcctgaatcgcaaaatattgacaaagatgtcaatattttcaagatagatgagatcaacgaactacaaagggaactaaaagcgctattaaaagagaaaatcgcaatatcagaccaaagcgtccactatattagatacgatggtgaaattttaaaaaaacactacgagcagttaagagaatcatttacagaaaacttcatgaataataatgattctggttcgtcaaatagctattcaggaagaactagtcttcaaggtcaaataaactttaaaaacccaggttcaaataacactattaataatatagcaaataactttaacggcaatgaattaaatacttgccgcaactcaatttctgaagcatataactctaacgataactgcaataatgaatcacataatggggataaaaatattgaatcccacaataaaccgtcatttgctcatgaaagcattagccgagcatcaaaaaggcgtagatcatctactgcaactcatattaaggacaccttcgatcaaattacaaagaaaccgaatgcttttgttggcacatcaagtagccaaaaatcagatcagaataatttatcaaatgataatcaaaatcaactttgttcaatatgtgagggtattgaattgattaataataagtttgttaaatgcgaatattgttcaaataatatgcatattacatgcagctggtcaagcaatccctttctttgtagaaaatgctgtaaaaaaagttctgttcaaccctcaattacgtatgatattgagtattctgcttcactaataaatactcctaaatcagataacactaaaatctcaaagggctcaagaaaaaagtag

SEQ ID NO: 596 - DNA, 297 bp, Cryptosporidium hominis
atgtctgttgtatcttattcaagatttcttgatagtgccattatgggaatatttactatttgtttgtcaggtcttactctttatttgtttggcgaattttggggattgtgtcagtcaccacctctttctaaatggagcattggtaaaatcatgtcgaccctatttccatttaaaaggacttttgatgtaaacctgactcacatattactcttttcaattattatttgcttattaagtttaagaagtgatcaaggtacaaacagctcaaagtgtgggcaaaaacaaaaaagaaatgat

SEQ ID NO: 597 - DNA, 504 bp, Cryptosporidium hominis
atgaacgaaagttcaacccatattcagagcaaaaaaataccccaaaatagaatatcggatattcaaacaatttttcatttatttgataaggataaagatggaagcattagtgggtctgacttatttgagactttcaaatcaattgggcttgacattcctccacagcaaatagatgtgcttttaaatgaaataaaagggcgcgcaagcacaggcatgcaacaagatccagcaatttctagctctattgattgcgcaatgttttctggattcattagtagacagcttgactcagcacctttaagtgaacaactaagggaaactttttcattgctagatattaacggagatggctatattaccccagaatgcttagcagaagtttgctcaaagcttggtgtatcacttactgatcaggatgcaaggcaattaatggtgcaatcagatggccaagcaaaagcagattataataaatttgtgaagcttatgcaactttcaaagggataa

SEQ ID NO: 598 - DNA, 1656 bp, Cryptosporidium hominis
atgcttaagatggatggaactgaaaaaataattaaaaaaaacaatgctttgctcattttattcttaatgatttttttgataattgaaattggaattggaatctatataaaattagaaatgagcaatgcacgacttaactataatattttgttgaactctatattagaaaactctagatccctttatcttggtcttaatgatggtatactgcaactctattcttgtgaagaaaatattgagcaaaaaataaaaactgagatgactaaatatttgaatgcaattccaaatattgcatattcttttcctttttcgttttgtttaagtaacttcgattttagagacatcaccagcaatatttattatgattatttatcaattgatatagatttttggataactaattcattttcaaatttttctggcattcttaaaagtattgagaactgcatgaataactctctatcatatgctctttcacaagagtctgccttcctattagaacctattatagtttcaaagaaacaaatgtgggcaattcatcaaaaaatgagaaattactcaattaatatgacaaatgaagaattcaaattcggccaaaatactctaatttgtaataattcaatgatacatgatctggagggtagtccaaggatcacaggagttttaataaatggaagcgaatatcaggcacctctatttaaaatagatacaaaatcgctggataaagatttcattaattttgcaattagtggtaatgatattaacagcgaggaaactgagattagtctcgataatatcattgaaaatgccggattagtacaaagtagtaaaataaaactaaatggtataaatctaattgtccacgagtcagaagataatgattttccgaaacatttaagcgaaattaaatttttaaatcaattatttgctagtccgcaagaagaaaacatttttgtaaatatctcgaatccaagaatactagacgttaatgatgttattaattacagtaatggttttaaatcagcatttaatagaacgatttacattccaacttcctctttattaagcattgttgaagtattttctgaaggtatgaaggagttagagagaaatataggtaataatttagtgggaaatatcatgctaatacggtttttttcgataataataattcttatttctttggtttttacggcgattatttttattccattgatattgattgagagtgaaaaaggaaaggaaatattctcaagttatgggtttttaatagtagaaagatacaagtatttttctaggaaatactcccgtgaaactaatagttctctgggagaattctattcattatttgagaagctttttaatgttattcataaagtgttagagggcaaaaaaaaagaaaaaaatgagattacaaaaataaatgagactccaactctaactatatccaaaaatattgaattgaatattgtctacaaacaattaatggggatattcaggtttaaattatgttatgtttggaagttctctattttaaactcgtactgcctaccactaattaacgatcaacaaaatgaatttattgttattgacaatattaacacaaatatgaattcaatattgtttattttctcaaaattgatagatggagattga

SEQ ID NO: 599 - DNA, 291 bp, Cryptosporidium hominis
atggcatggataaaaaggtggattactcaaaagtattgggaagataaatttgaagaagcactaaataaacattttaacacaaaattaccaattaaagttaaaccattttctaacgggtcagacctattcaataactttactattcaatggttaaatgctatatatcaatttgatcaactttattctgaaaatgcatatgaaggcaaattctttgttgaagcgtttactagaattagaaaaaactttcatgcttggaatgatgaatataaaaaaagtaaatgggatatttga

SEQ ID NO: 600 - DNA, 735 bp, Cryptosporidium hominis
  misc_feature (647)..(647): n is a, c, g, or t
atgcatgagtatgatattgaattaatatccctattacaaaataacttaaagcgtgggggttttaatgaagataaaataccaaagaaggatgtgagatttcaatatttaaaacaaagttttccatataaaggagtaaattcgagtattaattgtgctcttcaagatgaaatcaccactaacaatcaaagctacttattaccattattggcatcggaatacccgaataaacttctatcagagtacaggtctctagatttagagctacaaaaattaagaagctctgtccagagatccacattgtataattcaacaaaactaataaaaagaaataaacaagttgttacagaaattagaaaaaaatttatcggtttcgaaaagagagcaaacgcaacaatcaatcattttttttcaatagttactcagaaatctaattcaagccaatcgatattactacaaaaactatctcaatttaggaagttaactattttgagaaatattttaaaacttatagttgaactaatagaattaccaaaacttattgaaagctttgtttctgcaaatatgacagatgatgctttggacacacttgaatattttgagtcaaccataaagctactagaagcttcaatttcatataacaaagtttncaaaatgaagagaactcttctttcacctattggacaacaaactaatggagttggtaaagattactctcttgtaattaagctcaactaa

SEQ ID NO: 601 - DNA, 1143 bp, Cryptosporidium hominis
atgtttgaattggaaaaattattagcaagttatagccatccaattttaagagaaagaatagaatatttcggaagatttaaattggatattttagatagtaatcatctcaatattgaatcattcaaccttttagaacagggaaatgaaaccatttttgactacgatggcttcgtttataaattatacctttcttctgcgagtaataaagaagtaaataagaaaagcaatacatcagaaaacaaggaaaatgatctgaagattgtgccattaaaagatatacgcagagaatcttttaaacatttaaatttagttatagaggtttataatactcatattaggcagctttggaatgacgcaaaacaacttattgaacattataagagcattactagtaatgctattgaaatttatgagtctcacagcttggataactgtttaattatttatttgccgaacaatgcaatatccgaagtattttccgatttaaataatcggaatgcgacaaaaagcgcagcttttgaaatgattacctcttcaataaaaagttgtctttattgcggtagcgtattgaatactataagatatatatcattctattgttctttggataacaaaactattttagaagatattggcattcaaggtttttccctaatttacattactttactttcaaataagaaaatatatgcattttaccccgattcacaaaataaatataaatttgcaatactagcaatcgagtttttagataaattaattaaaagcaatatattaactaacaactttattcaagaattatcaattgcaataaaccaaagtgagatttctatttttaaaaatatgcttgattcgaatacaatatcaatatcatattcaagctcacttccaaaaagtgccaatgaaattctttataatcaaaaatcagacagttcatctggtgagaaatcgtttatgatattttgcatcccgatttcttggttagactcaacagacgactatatcaaattatacttcgctgggctcattacgttgataaataacatattgctgcaaatgatcccacagtgtaaaagcacgattagatgtggattaaggaaatttgttctcgaattaactagccaggaatgcgagggttgctaa

SEQ ID NO: 602 - DNA, 2418 bp, Cryptosporidium hominis
atgggcggatcagatttccctattgggccaaaacttcgtattagactgaaggcagaaaattctgaaacagaaattggtcttaaacacaaaaaaagaaaaaaatatgtttcatttaataacggaggcattgaagctgcatcggaagattccaaagtatctcttttaattgagtgtaatccgccttctttacgcagagtagaattcgcagaagttttgaacattaaattgaatcagaacattgataataaagaagatacagttgatctaatgtcagacgaatcggttgaaaatgaagatacattggattatcttgataaccttgagatggaggcaaaacgaataattgagaaaaacggtctgaaaaacaaatttgatgcccatatctcaaaacaaaccgtagaaaataaagactttaaaaataataccttaaacttatctgataacgatttgcctaatgttggcaatgttgaatgcgatgaagaaatcaaaactagcaatgtcattcaagagactagaaaccaaataactacaaataaccgagtttcttctcctatttatagtaatttatcacaaataaacaaccaaagtagtcttcctccgcagcctatccagattgccccaaatgttgtccaacaaccactgaaaacatttgctaattctcttttactgtcaaaagaaaaattttccacaaggtcatttactccattggatccaaatttgaactccaggctcctattaaaagttcaacttccagaatccataaatcaactatattctttggaaggtattactcacgaagacataaagcaaaaccctaaaaccgatgaaagcgatgaaaccaatgaaactgacaaaaaaataccaatagtgattccaacttgttctgagtggtttgatatggattctgtacatcctattgaacttgagatgctttctccaatatttaacaatgagataattgatttgaggatcgatgaaaaacaggattacagagcagaaatgagtggtaatggtaatagtaactttttagaagaaagagtgttttcactaaatgatgaaaaaattaatgaatataaactgattcggaataaaattattgaaatatatagggaaactcctagacaatacctcactgttactgaatgtaggagacgtattatatatacaggagatgtctcctttttacttaaattgcatgcttatctcgaattttggggtttgataaatttccaagcagacattaagacgcttcccccaaagttaagaaaacttcgtgactatagacttaatgatatagatgtcaatcactctaacaataaaagcacgctaaacatttctcgtataaatgatgaagcaataaataacccattcataaactcaatgttagtgaattgcgtttcatgtggaaagccgtgtatatattcatattatattcttagagctggggttgtttgtggagtttcagtggcagttttagatcgctgtgtttggtgtattaggtgttattcagaagggagatatccacctattttaaactctgggcactttattaaagtggatgctccagttgtatcatcagtaactaatcctgaagaaatttccaggatgggagccttaggtatagcctcctggactaaagaggaagtacaaaagcttattgaagggattgagtattacggtgatgattgggatgccatatcttaccatcttgggaatgttaaaacgcctcaagagtgtgttgcgtacttcattcaactgccaatagaggaacccttcatgagaaacattaacccatcaaaaaacacgaagccctcatttccatttatggatgtgagcaatcctctaatgacgcaaattgcattaatagcgtcaacaataaaccccgtggtcgctgcatctgccgctaaatctgcgttagatagaatattagaaatcgaaggttataaagaaatttctaaagatgcttcactcatgcccgataaagatgctcatttgagaaacgaagctgcgggaagtcgtaatgctaacgccaattttaattctaaggatagccaatatttaccgcaatacataccaaaagtttcttcagcgaagtggccgagctcagcactactgggagaagagggaattcaacaagtttgttcaaaggcactagaaaacgctgctcttagagcaaaagaactcgctgaatgggagagaaatgaggttaaaaatataatgccatacttgattgacaacacgattaatcgattagaactaaaactgaggcagtttaggcatttgcaatctatgatagatgaagaaagaaatttattggaagtaagacttgaaaagataaagaaagaggacaatgaaattaaatccaaacttagtagcgctaagggtcaagttatgtcgaaacaaactttaagactataa

SEQ ID NO: 603 - DNA, 1446 bp, Cryptosporidium hominis
atgagtttaatttctaagaaggaaccactttccatttcaagtaaattcaagtttgttcagcaaaattgcagaatatttttgttgaaagattacaatataaatagaaatacctcagtgttctcacatgataaaatgatatttgattggagaaatgtagggttaattgaattaatatactttgatagtgacgaatttattaaatgcccaatctgccttgattcagacttgctggttccaaaaatatcaaattgtggacacatatattgttggccttgcataataaaacttatgaatattattttagaaaacgatgaatatgcaaaaaaattcaaatgcccaatatgtttctcgaatgtgttgctaaatgagcttgtttcattaagatatcaaatagttaaaaaagtccaaataggctcagaaattaatctatgccttctttacagaaatgtttcaagtccacttattcattttgaattcaatatgaaaaatttagatgggaaagttttgctggaaaaaaacgaaaagggtgctcagttccaaagaatcggattaatttctgaccaaaatgaaatattattgcatgatcttcaaatgctgagaatgagaaagctagaaaatgagagaagcggctcagacgaagaaattggctacattgaagagtgtatctcaataatagagaatatatttaaattaaaaggagttactcctagatgcgaaagattttcaaacgatgcttttgatatgctattatcacattacggagaaactgaacttttagaagaactagaatatagattcattaactcttcagctaattatagtaatcaatgtaatatgaaagatatattttatttctaccagttatttgatggccaattagtgtacttggagccattttatgttaaagtacttcagactgaatttggttcaattgaaaatttacctaaggcactattaaatgtttcggttacatcaataaaagagtttattatcaatcatcaaaatatcagaaaatataagtttttgagtcatattcctatgggatctaaggtttatattgtaggcataaatgtattaccgtatatttcaacgaaaacaaaagaaatatttaatgctgaattagaaaaaagagtaaataagagaaaaacaatcaaagatatgaattatattaatttgctttatgacgagataaaccacagttcaacaggttatgaaatgataaatttgaatcatgcaaatagctgttcaaatatagagaaaagcaatcaaaattcagcgagagccacagatttggattttccaactttggaaaaatattcgaatcttaaaggcaaggataaaataggcaatgctgcatttaataaaggaaattcacaaaaatttttacattacaaaagtaataaggatttttactctccattaagaacatttagaaacgctatttag

SEQ ID NO: 604 - DNA, 1008 bp, Cryptosporidium hominis
atgatgaataccaatgggttaagacaaaatagtcttgttcaaggaaaaaaagagaatctatctgatatattgggttctattaatgggaataaagtttgtgccgattgcggtgctaaaacacctagatgggcatccataaatcttggaattctaatatgtattgactgtagtggggtacatcgtcatcttggcgttcatatatcaaaggttaagagcatttctttagataagtggaatagtgattggataaaaagatgtatgaaaataggcaactatatttcgaataagtactatgaacataagcttcccagtgggtttcaacgcccaagctggagtagccagcaacactctattgtggagcaatggattagggataaatatgaatttaaactatataccccagataatatgattccgccttcattacaaattgatagcatggaaactacagtacctaacgaaaaaacggtattgaaaaattctgaagattttaataaacctcaaaaatgtaataatatggtctccagtaatttgttagaaatcgaattagaaagcaaagaatcatcaagcaaagttgaaaaaaatattgatctaaagtcaaatcaattgggaagcgaaactgcaaactcgagtttgaaaaacaagcacaaccttgaaaatcaagctgagagagcccttgacagagttagttcatttgaaaattctgaagtaataaaaatcaaaactgtaaaagaagctattgagaagatgtacgaaaatagcgttgaatcgccgccttcattaaataactttaataaagtattaaatacaagtataggaagtattgagaaatccacaagttctgaaaaaattagaaagattggttttgatcttagtgataaattgtctaaaaatgaattcaaaagtgaagaaaataagagtcattgtattgttgaaaactctaaaaagccgtgccctttcagttctattgacgcattttccattattaaagaatcattttctaggtaa

SEQ ID NO: 605 - DNA, 1278 bp, Cryptosporidium hominis
atgcgtttttttattgctactgaaccccatattttttcgccgctgaacccgattcagtttaaaataagtcgatattttctggaagttatgaaagcaataattttgtcaggtggttatggctctaggctccgtccattaacgcttacaaaacccaaatcaattgttgagctatgtaatatcccaatcatagaattccagattgcacaatttgctagtattgggataacagaaataattgtagcacttaattacaaggccaatgaactcattcccacactaaaaataattgaagatagatatgctgtaaaagttcatttgagtattgaggaaaagccattgggtactgcaggaccaattaaattagcacaagactttttaaaagaagacgaacctttttttgtttgtaattcagatataatatgtaattttccattaagagaaatgcttgatctttatcacaagaaaaactctgactcggaatgtaatggcgtcattcttataaagcaagtctctgacccttcaaaatttggagtagttttgcatgacgaaaatacgcttatcgtagaaaaatttattgaaaaacctaaggattttgttggtgatttcattaatgcaggaatttatattttgtcaaaaagaatacttgatctgattaaacctaatcaacaagtttcaattgaaaaggatatattccctatcatggcatcatcaaatacactttattgcaataaattcttcacaaacaatgaaaatatatgggcagacataggaaatccaaaagacttcttattaggaagtaagttatttatggaattccttaaatcaaattcaataacagggcatttgtgcaatgataagcatggttctaagacagaattgcttagtaagctcctaaatgaaaataaactcgaattatctttcaaaacaccagaacttagaataataggaaacgtagttattcatcccacatcctcaataggagaggattgtagtattggtcctaatgttgttatcgggaaaaattgtaaaattggagatggagtaaggttaaaagattgcgtgatatttgacaatacaaatattaacagttattcagttatttccggctcaattattgggtgttattgcaatattgggaagtggacacgcgtagacggattgtctgtatttggtgatgatgtaaatattcaggacgagttgtttattaactcatcgacaatattgcccaacaaaagtgtgactacatctattaatactccgaacacaatttgtttatga

SEQ ID NO: 606 - DNA, 1317 bp, Cryptosporidium hominis
atgattttgctttatgttttgtcttttttgttttctacgttcgttagcttttcttgtgcttcatcgaaagtcatactggatcctttgcagcatgatgtccagatactaacagcaccaaatttcgaaagcttgttgtcaaagtaccgcaaaaatggtgttacttctgtcttcttctataatggtgatgataaggtagctgtgagcgagcttctaggatggtataatgatgcagcaagagaattgaagggtatggctaaggttgcagcaattaattgcaaagaatttaaacaattttgcagcaaaataggtaatagtggtaaaataatcatttatccagttctccccattccaacatttgaatttaatggtgaaaaaagcgtaagaaaccttaagaaccaacttttgagatacattcccagagataacgtttcagtgattggagttccaaatcaagaaagctctaaagttatcaaaattgaggacttcctcacaagacacatttctgttccaaaagtacttgtgtttagcgaaaaggaaatacctccaacaattattcactctcttgcaaacgagttcaataaaaagcttttgttcggtttcattccgaactgtaagaaaaacgatatctcgataggaattacaaaaaaatttcaaatttcaagcttcccaactattatggtatataaaacagcctcgaaagcaccggaattctataagggcgaaattaaattcttgccactgtttgaattcttgaatgtatatgcagaaacatttgtaatggggggaggattttcagataatgaatctcaagattcgggctcaaaaccatggttgttgcaacgaattcctgaactaacaggactttcatataatgatgtatgtggaaaacacaagaatttatgtttcatctacttaaagaatggcgaaatctctttggaagagcagtctatgctggaagagctccaagatttgtttactcctcatattgcaggtagaggtaccaattttaaatggatgtggatggacatttcaatggaagatgaattcatgaaactttttaatgatgatgggaacaaaattactcttccatctgctgtggttctgggcactagtaaaagactaaaattcacagttctcccaagaaatatcgaaggagaactacagtctgcaaataaagacacaattaaagactttctagataaggtgatcggtggtgatgctagatttaccaatattaaagggcaaaaactacctaagtttatcgaaagggtgcagaataagaatacgaaattggagaaaagtagagacgaactatag

SEQ ID NO: 607 - DNA, 480 bp, Cryptosporidium hominis
atgaattacttttatttggaagaacccaatattaatttgatttattgtacaattgtttcgaacataaaaaaatcaaatttatctgtttgcaaaattgaacagattattccattagagactttgaaatgccctattttgatggttttgcatatttggaaagcctatgtatacttcaattatcaagaaaataatacagaacttgaaaaaagtaaaacattccttctttattcgatagttgggtatatttttgaagaatatattactgatgaacgaggtttaaaaaatgattgtttagaaagattgcttacattttcaatcatttcaattttgtggattttatcagctaactactgtaacttatttaagtgggttggcatcgatcaaattattgaaaaaactgaatatttcttcaaaaaaattgaaaatagtgattatatatttatttgcaaagcaatcaagaattttattgcaacaaactaa

SEQ ID NO: 608 - DNA, 843 bp, Cryptosporidium hominis
atgttcaaagaactgggtgaagcttatgaggttttgagcgataaagagaaacgaaatatatataatcaatatggctcggaaggattacaagctggatttggaggtcctacatcagatcaaggaggaatgggtgggggaatattcattgatccaaatgaaatttttgcacgatttttcgcttcagatagggcaggtagttttggtgatgaagaaggaagctcatttttctttagtggcccaagtggaatgttcagacaagtacacatgtcatctacgcataatgggcgttcttcaactagacacgccccaagatcgcacgaagtcccattattagtaactttagaagagctatacttagggaaacgtaagaaaattaaggttacaagaaaaaggtttatagaacataaagtgaggaatgaagaaaatatagtcgaggtagaaataaaacctggctggaaagacgggaccaagttaacatattctggagaaggtgatcaggaatcccctggaacgtcgcctggagatttagtacttataattcaaacaaagactcaccccagattcacaagagatgactgccatcttattatgaaggtaactatccccttagttagagcattaacaggttttacgtgtcctgtgacaactcttgacaatcgtaacttacagatcccaatcaaagaaattgtaaatccaaagacaagaaaaattgttccaaatgaagggatgccaataaagaatcagccaggccaaaaaggagacctaatacttgaatttgatatttgttttccaaagtctctcacaccagagcagaagaagcttattaaagaagcattagactga

SEQ ID NO: 609 - DNA, 216 bp, Cryptosporidium hominis
atggaatgggacacttgtgcgagccatattattatacggcaaacttgcggtgatatttacaaacttgaaacatttttttctggatcagaaacccagttcaaactaggggaaccacttacctacaataaagaagttctaattaatccatattttgttgcagcaaatgaaaaagttatagaaactttaaggaatagaataatctcaaaatcagactag

SEQ ID NO: 610 - DNA, 306 bp, Cryptosporidium hominis
atgagcttagatgaatttaataaattgcgttacgaaactaatttagacagtaaagtggtcatttctgctagggaggttgtcgaaattgggtttcttgctagcaaagttatcatggaaatttacaaaaatattgatgcggaactaagaattaattacaaggataaagataactctccagtcacaacagcagatttaaatgcgaatgaaatcatttgtgctaaactctcttcgaagtggccgcaaataccaataatttcagaagaatcagaaactgatacttgggaaaataggcaaaagtataagtaa

SEQ ID NO: 611 - DNA, 930 bp, Cryptosporidium hominis
atgagaaaaagtattatcagaacaaaaaatcagcttgaaaggatatacaatgagagagcactcttagctcaaaatgcatcagactttgttgtaaagttattttacacatttcaagatgataaacacttataccaagtaatggagtatttgcctggaggggacttgatgtcatatttaataaaatatgataaatttagtgaagaagacactagattctacatggcgcagttggttcatgccgttgatttagttcatcagttagggtttgtacacagagatgtaaaaccagataacattgttcttgattctaaagggcatctcaaattgttagattttggactttgcaagttttctccactaattgaaggagacaaaaatagtgaataccaaaccgaaaatcatttaagatgtgtcaatttaaacactaaatcacataaagatagtaataaagcttctgaaatttcctttaatgagaacaacgaaaacaaaagaataaacaaagaactttatcgaggatcaaatttactggaagaaaaaaattgccaaaatgaagatttaaatatttctctgaagcatttggacagaaagacaattcattctactgtaggaaccccacagtatatggcaccagaaatatttctcagacaagggtatacacatcttgtagattggtggagcgtgggaatactgatgtatgaatgtctttatggaggagtaccatttaatgacgatacgcataacccaattaaagtcgcaataaaagtaatgcagtgggaaaagttattattactcccacatccatgtagaaaaatttcgcccgaagcactagatctactaaaaaatttgttgtgtcatccttcaaaaaggtttgacggtgaacagattaaaaagcatccttttttcaatggtaagtttataaatttcggttag

SEQ ID NO: 612 - DNA, 246 bp, Cryptosporidium hominis
atgatagaaattgattgggataaattaagacaatgccctgctccattcaacaaacagattaatgagaatatatataaaggcaatgttacagcaggagaactaattgatgagtctccaaacaacacaagatatggtgttcagggttcttcactagttgatataaatttcttggattatacttataggaataaggatcgtaataatgatcctatatcaataggagaggccattaaaatgtgcagatga

SEQ ID NO: 613 - DNA, 1551 bp, Cryptosporidium hominis
atgaaattgatcctcattgttttgtttttatccattagtaatacgattgttcatggatttcctccctttttaagagaaggcaaagatattgtaagtgctggaatttgcagaaatctctgtaaaggtggacaggtatttactccgttcctgccaccaaaagagcccgattgtagctcatctatctcatgtaaaaaatgtgactacaattcaatcattaaaaatgatccttccacggtttgttcctatactttttcgaacgaatttgtagatagtgactttgatactcaattaactttatttcatggaaagtctcagcttattattccacataatagtacattgagcagactttcaaaagaaagtaacgtattaaatacaaataagggagaaaaaagccatggcttgtttactgttgcagttcaatggaagaagatgaaaggcatagatgtttctcaatgttcaaatggaattgcggaaattgaatggagtttattcaacataggtgtttacaggaattgggatattattgcaatgatcgaaactaagccagaagcaacattcccattttgcttcgaaaatgtggagttccccttagatcccacaagatcaagtaagattggaagtaaaatgccaaccaatttaaaaagactcggttattcgatagcaaacgggagaccgtccgcaattcgaattacgaaaacaatcgctgttaatcaaaaggaaatgaagataaacccggaaaaggcattagaaatactgttaaaaaaatatgtgtcctttaaaattggcatcaacggagcttcagtaaaaaatattttttcagaaacttttcatgaatccaggaaagatttatcaaaagatgataatagaacagagggagggtcggattctaacacaaatgaattgtcacattctgattttaatagtagtttctctggaaataactctgaaaacagtagcaaacctccagaaaagaaaaatattaaactagaaattttaaaagaaaagcttttagataaattaagaggaaggggttttacagatccacttatattggatagcatgatgagtttaggattctattcgtgcttcaggataatatgtaccaaaaagaaatccggaatatcaaagagaaagtataggctacaagaaagaattcctttaactcttgaatctgcaagggatatccattctaaagcattgagtcaattttctgatttgatttcccccttttatactgttcctctacctattcataattccgaatattgggtaaacggtgattacaaaccacacattatttacaaccaaagtccactgcaaaataaaaacaaaatctcgccaacaaaagtagaaagtaaaagaaaaaaaagctttaaaaataatattgaaaagggtataaatagtgattttgattcggatttttcctcttcagattctgatttgttagcaattattgcattaaccaattcagaaacacttcaaaacggtgcaagcgtaaatgaaatacttgagactgattctatattagatttagaacgaaataattaa

SEQ ID NO: 614 - DNA, 981 bp, Cryptosporidium hominis
atgactaaaactgctgaattctacaaaaataaaggtaacgaactttataagcaaaagaaatttgatgaagcattggttcaatatgatctggcgattgaaatagaccctaacgatatttcgtttttaactaataaaggtgctgtctatttagagatgggtgaataccaaaaatgtctagaagtctgtatgcaggcattggacaaacgattcgaagtgaaagctgactttacaaaggtcgctaaggcatataataggatggcatcatgctacattaaaatgaacgagttacagaaggcaaaagaaatgtatgagaaaagtttgttagaagataataataggcacacaagaacttctcttaaagaacttgagagattaattgagaaagcagagaaggaagcatacattaatcctgaacttgcagaaaaacatcgcattgaaggaaatgatttatttaaacaaaaaaattacccagccgctaagaaagaatatgatgaggccattaaacgtaatccgagcgactccagattatatagcaacagagcagcgtgctacatgcaactattagaatacccatctgccctgatagatgtgcagaaggccctcgatttagacccaaagtttactaaagcttggtctaggaaaggaaatattcattactttttaaaagaatatcataaagcgcttcatgcatatcaagaggggctaaaatgcgaccctgataataaagaatgtaatgaagggctaaaaaacacaatggcaaagatacagcaggtatcttcatctgatcaaatcgacgaggagcaggtggctcatgctcttgcggatccagaaatacaatcactgctttcagatcctcagtttagactagttctagagcagctcaaacaaaatcctgcaactcttacacaggttatacaggatccaacaattgcaaatggaattcaaaaattgatggccgcgggaatcttaagaatgggctga

SEQ ID NO: 615 - DNA, 3738 bp, Cryptosporidium hominis
atgcattttgaaagttcggacggtaaaattaaagaacaaattacttttttgcttaataatgaaaatacaaatttcgattcttcaaaagcagaattaataaagaacttaattttttcttggaaaatattttcagagcatatggatatagagaatgcggagcaatttacaaatagatttattagcctaattggggaacatgttttttcacagtattatactataaatggaaaaattaaacgtttctacactcattacgaaaatccatttatagtttacttgcatgttttgtacttaaaatttagtctagggaacttttctggtccaatttcttgtacaaacctattgaatatcttgtttggtgattacaatacagaattttcaaggattttatatagaattcacatttttgagattcagaatatgcttcttttgatatcctcttattatttaaatattaattggggatatatttacaaattaattccagggatatcgaattttaactgttctaatgatgcatactacactcgaaatattaagaatagaggcgatgactcggctataggttttatcggttctaatttgcctagatataacattcacttaagctcgtttttggttttaagagattgtatttatattgtgttttcattaatttattattcaaaaagcagagaacttgatgactttataatcgataattattgcggactactaaaggacatgacttatcaaaaaactctattattaactggccctaaaatttcaaacacaaataatggacttacaggttcatttaaattaaaggaaaggtcttgcatcacttcagcaatacccctgttatatgttttaatacaatttatttctaactcaaatgaaacggaaacagttgtaaatgaaatcatgtctaggataactaacgaacatataattgattctgggcagtatttgaaggataacaaattttgtagcggaaataattcaagaattggtatttcaagtccacaatttgtaatttctctgaaaccctcttacaagttccccgattataataaatgtattgatattttactcaaaggaggagaatttttgtctgtgtatccaacaccaaattttttaaatcttttaataaagagaataagaggcaattatacttttgatgtaggaataggtgatttcagcaaaaaaaatatgaatgagagcagattaagtgcactattagaagaattttttccgaaagtaatgcttaaactatctaaagatttgacacatttgatcattgaggaaatatcaaatgaaactaggactagagctagaggcttatctacaattagtgttgagacttataaagggaaaggaattagatctatctttaaaagaagacccaagaaaaaaaagatccctattgaaaatattatcgctacaagcattggttattcatcaagaccagaatctattcctttgccaagccctggaatgaatctaccttgtttttgctgcattcaaagtgagttagatggcacttcattattttatagaacactgaacatccatacaaataaaagatgttttaaattactttctgttaagattcaagatttatgtgttaaacagtggcatgctattattaggcaattcatggatttaaaatttcatcaagttcaagcaagtaatccaatttcaaaaaacttaattaagataactaaaagtaagaaatataataagatagcaaattgcttacttaattcatgcaaaataattgataaatggtatgaagaggttcttccaaaatgggggacacattggaattgtaattcaatacctgtttctattcataatttatctcttagcagaaatcaaaatattaataagaatagaaacgaatctgaatatacaaagctttattttggaaaatatttaaagaacatttctcagacacttcagccagatagcttcaatttctggttttttggatctcactggctaaatcaaaatactagtatgcacatatttgtgaatagacccagattaaccgtattaaaatcatttcaaaatttaaaaggatattcaatggaaaatatttgtcctagtgagaatgggaatagcgtatcaaattggattaattttttgcagtataaattacatagttcatatcctttgtacacattcccaatcattgatagaggagtaagatttggagctcccaattcacaacttttgagcgatctatggtctgttggaattccaaatgatataaggaataaaatttggaaaatagttttgggaaatgatttgaaggtatcaaatgaactttttgatattttaaatttacaaagcaaattaaatatagataagaatgatgatagttcaacaaattctgttatttttcgctatgctctagaaatacagtatattttttataataaaaaaaagaattccaacataggcaaaaagttatcgccttacattgaaaggaaagttgaagtattaaattcctcggcatcattttactatccatactttttttcacagaagtgtggatttgcaagggaatttgattactcaacttttaaatatgaagaagccgatatttcactcccgctgataaacacagatgagtattttattgatataaataatgtttatatttcgagaagaatgataaaaacagattcattagaaaatgaactattcattaatagaagcaattttgaacagatccagagttctgatgatataaattttatagatagtttaaattctgaatcaatgcttgctttagatttctcttcattagaagcattaaaattaaataagtttattcaataccatgaagtttcaaatactcatagtaattcgttctttcaagaaaacatggatttgttgaagaaaaatgatactggcaatccaagctcgatcacgataattaagggtttacttgatacaattggagcattaatatcacatatacctaacattggcttccaaccttgcttaataaattatttatctgtatttttgatgtatatggaccctcctagcgcatttaaatgtattttaaatctgatcaattcttttgattttctttttatttcaagcgatataacttcaaattcatttgaaggtattgacaaatgttcaattggattgttatcagaaccttcaactggaagccttcttttaaattcacaatatcatcaatttttatataatgataatatatggattttattttctcatattttccaaagctttgtatattcaaaattaccacagctttaccagcacttgttatatacgattggtataaatttcgaaagtgtagttactccatggttcaggcacatattcatggatacattatcacttcctgtcgtacttatcatttgggataactttcttttacttgggttacctttactttttcaagctggtctttctttattaaagctttgcgaaccacaacttttgaagtgtgaaaatattttggatactttgaatcttttattaaataactgcgactacaactcattcgtaataaaggcagattcatttactaatacattgagagaaatgcagaaagtatgtgacgttacagagatcacgtctattacttcacaatacaagttgattgaacaaaaaagatggatattgagaaatcaacagtcggttaggaactatcttcttagtcaaggctattactgtacctcgactcccaatactccaaaaggaagatag

SEQ ID NO: 616 - DNA, 942 bp, Cryptosporidium hominis
atggaaagttcgttagaatacatcgggtgtctatcaggtcattctgattgggtaacatcaatagcagctcctcctgataactcagatattgtagtttctgcaagtcgtgacaaaagcgtccttgtatggaacttaagtgatgctaataaggatcagcactcgataggttcggccaaaactcgtctaacaggccacaaccaagcggttaatgatgttgcagtttcaagcgatgggtcttatgttgtatctggctcctgcgataaaaccctaagattatttgatgttaatgcaggaaaatcagtccgtaacttcgttggtcacacttctgatgtgttttctgttgcattatcgccagataacagacagattatctcagggtcgcgcgatcacactattaaggtttggaatgcaatgggagtttgtatgtatactcttctagatggtcagcacaacgactgggtatcatgtgtgcgtttctcgccttcaacaagccagcctttgtttgtttcttgtggatgggataagatagtcaaggtttggagtcatgaattcaagccaacatgcaatctagtgggtcactcttctgtattatacactgtcactattgctccggatggttctttatgcgcttctggaggtaaagatggcgttgtcatgctatgggatgtaagtgaaggtaaacatctgtattcattggatgccaaccactcaataaatgcgctttgcttctcgccttgtaattactggttatgcgctgcaactgataagtgtatacgtatctgggaattggagcacaaattaccagttgcagagttcgctccaccagctccaataaagaatggtttgccatggtgcgtctcactaacctggtcaaatgacggtaaaacgctatttgctggttcaacagactcgaatatttacgtatataaagttaaaaattaa

SEQ ID NO: 617 - DNA, 348 bp, Cryptosporidium hominis
atggaggcagttaaaggagaaagggggattgtacaaattaaaggatgtttttatagtttaacaccaggaggaataataatgcagaacattgtgatgccattaatgacaaaaagtttaggcgttttcattagagagaatagagcattaagaaagcaaaactcatcacatagaatatctccagaattggtgaaaaatctttcatttcaaattgttaatggcttatctgcattacattcatctggatatactcaccgtgatttcaagcccgacaatattttattgatggatacagatgacagtgaaagaaagtttcctacaattaatatttgcgatttaggtaggttgtaa

SEQ ID NO: 618 - DNA, 708 bp, Cryptosporidium hominis
atgtttgattattcaaagagaatagaacatttgatgacaaattttgaacaaattagcagaattaatgatgaaaataaattggtgaagaatattttaattaaagaaatatccggtattgaaggcaacattgaaatgcttaaattggagttctataggatttcaagccgactttctgactcacttaaagagaaagattacttagagtatgagttgaataaactcaaaaataagtacaaatcaaccaacgatgagttgaacgaaataagaaataatttatcagcaagaaacgaagaatataatgaattcaaaaaactaaatgaatgcatgagaaaagaggtcgaggatttagagctagcaataaccttggaggagaatgcaatctccgaaaagagaaaggaactaaaaaacctggaaatggtcagcatcggaaaggaaacagaaagaagaaagcttgacaaattggcctcccagactatttcggaattaaaaagaaaaatcaaggtaagagagataatcgaagacaaagtaagcgtcccatcaagttccattccagtaaaaattcgccacgtaaataacaaagaaagcaaaaattccaactataaagattttaaagatcaaaacaaaatactgatcaatgaacgaggaaagttgtgtagttcattacaaaacataaaaataaaaagaataatggcgcaacacataatatga

SEQ ID NO: 619 - DNA, 1008 bp, Cryptosporidium hominis
atgtcagatattactgttcttgtaactggagcctctgggtttattggctctcatctagttgaatatctgttgagtaagggctattatgtccttgctctggataacttcttcagtggggatgtgattaatattggccagtgtagagataaccctaggctggaaattattcgacacgatattattgatagtatcaagctagaagtcaaagaaatctatcaccttgcatgcccggcatctcccattcactatcaaaaggatccgatttacacgttaaaaacgtgctttattggaactatgaatattttagggttagccaaaagaacaaactcaaaagttgtatttgcatctacatcagaaatttatggtgacccattggttcatccccaaaatgaatcttattatggaaacgtaaatacggttggaaccagaagctgttacgatgagggaaaacgaatcgccgaaactctctgtatggaatattatagaagtcatggtgttgatgtaagaatagctcgaatctttaatacatatggtcctaaaatgttgtttaatgatggcagggtggtctcaaactttattctctcatcattactcaatcaagaattgcctatttatggggacggaacgcagacaaggagtttctgttatgttactgatatggtttatgggctctataaactaatgaaattagatagggagaagattttagacaacatgccaattaatttaggaaatcccaatgaaatctcgatattggaactaggcgaagtaattcgtgaacttattaaccctaatctaaaaatatcgcacagaaagtttccaatggatgatcctaaaaaaagacaacctgatatttccagagcaattggaatcttaaattggaaaccaacagtggatattaaaacaggaatcaaggaaactataaaggattttaaaataagattggaaaataacaagccagtagaagttttgcatcaaaaggaagctaagccgatattaaatagctaa

SEQ ID NO: 620 - DNA, 1602 bp, Cryptosporidium hominis
atgggaggttgtaaatcaaaggtcgataagcatattgaaaatagggagattccacaagccccagaattgagagttgaaaaacggcctttagttgaacttcaggataagattacatacgagggtgaatggttaggggacaataaacatggatatggaattcagaagtggccagatggtgccgtttttgaggggaactttgtcaatggaacagcaaacggatacggagtattcattcatactgatggcgataaatatgagggcgagtggcagaatgatagagctcatggccatggcacgtatacacactccgatggaagtaagtatgtaggcgaatggaaaaatgacaaaaaacacggtaaggctattgagagctgggttgatggtagtaattttgaaggaagttatgcatatggccttaaacaaggttttgggaaattttcatggcatgatggttcaaagtatattggtaacttcgacgcaaaccaaattaatggctttggcatctatcattggaatgatgggagagtatatacgggctattggctaaaaaatcatatgtttggttatggcaaatttgattggaccgatcatagatgctatgaaggacaatacattaatgataaaaaagatggtgatggcaagtttacatggccagacggtcgagcatatattggtcaatggaagaatggaaaacaacatggaattggtatattttataatattaaaaaggaaggtaaggttggagaatggagagatggaagtaggttgaggtggataaaatcttctctagagaatggcgagttggttggggagggtttgagtttaagagaagaatattctaagcaaagggaagagcttttgaaagcaaatgatttgtatgaaaattatagaaaacttccaaagaatgatttggaactccagcaaatgaggatattacaaaaattcgatgaatacctactcactttgagtgactcagaaaagggtttggaatcaaataaacaagccgcatcagatattttggtagattctaataatattgttacacaattgaagaataacgattctgcccttgaaaacaaagatcaggaaatggagaacgctgatggtggaaatgaacagttgaatacggacagtttgcagatagaagaaacaaaaaatgaacaagaaaattgtggttcagagaatgttgttgaatatactgctgacttaagccttgttgaggaaagcagtgacaaagaggaaaagcctattagcgcccctctcatacaagaagacactcaaatcaatacagaattagtggatcaagttcaggtagatagtaacaaagatcgtgggatgactggtgggaattctgctttagacttattaaactattctgagaataaaggagagatcttggaaaattctggtgcagatagttctaactcaaaattggatagcttagaggttaaaccttgtaataatgaagatatacaaatatcggaacaagagatcaaaggagtttcagtagaaaatataggttcagaattgaaagctaattcactgactgaaaaggaattggaagatatagctgaaaataaagggttagaagattcaaaatag

SEQ ID NO: 621 - DNA, 228 bp, Cryptosporidium hominis
atggatcaaatacactattttccattatctgaaacatttctttacaattatttggaatcattccctaaattagttaaattatgtaatgtagaccaagaaacctctagatttgatgatgaaataaaattaaatctcttgagcttaatgaattttgaagaaggtatactaatagacgaaatgtactggcttaattcggagccttgtatatgtattattaaatgggattaa

SEQ ID NO: 622 - DNA, 837 bp, Cryptosporidium hominis
atgctttattttcatgaagtaataaagcacaaaaaccctattattaaccattttcagagtgtggattttgatattttttgttttatctggaacaaatatgtaaattatagtaaaaccgaaagtcaattaacaagtagacagatttcaatatttttttccaatattttctgtagaaatacaaatattgctcagcaaattgtagaacaaggatttcaatataaaagtctcaataattgtattgatttcaatgtttatctcgaaagaacacgctcatttattgatagaatttgctatattacaccacaaatactctgtgagcatactattctaccaaaaatagcaaacaagttggacaaactgctaaatacaagatcacttattgaattgtggggaaaatacaacgtaaccgatagtaaagtattttgtttggattttaaaatagaaaaccaaataattcagtgtgtttcattattatcatggctctcaaacataattatctccccatcaaagtcagcccattattcatcagaaagttcttcgaatgaaaagtcagcatttttacctgttgcagagagatctgttgttagagttctatgtataactcaggatataataaattcccaacttgatagccgaatttaccacaatttaatcatcaattttaacatcttattaaaacactctgtgcactttattatttcagtagcaaactcatttccgcaactaaataaggcattaaaagatacactatctgcattaaagcaatttatgagcggtcactcattatcaaattcttcaattcaccacactattaataccattgatgagatactttaa

SEQ ID NO: 623 - DNA, 498 bp, Cryptosporidium hominis
atgaggaaaaaaaagagttcttcacatttaaataacgaaaactccatagtagaaaatattgaacgacttccttctcttgggaaggttcccgagcatgaaggagcaattttgatgagttcagaaatttcgaaaagtatgaagcgttcttcttctcaaatcactgatgaattggctatttcttctttattaagtaatgcgaagtttacattatctgttataaagattggtggtaatacaaagaccaaatatgaaaaaaatactcacggctttatcgttgttcatattttatcatgtaaagcagattccctaatttattcactggataacaaatacgaatttgtaatgtcgaatggaagctatgtacatattcctcctaaccatttcttctccttcaaaaatttatctaatgagtctgcaaagatatctttcgttgtgcttccaaagaaaattagggaagttggtaatgaacctgcatttcatcatcctattgttgactaa

SEQ ID NO: 624 - DNA, 213 bp, Cryptosporidium hominis
atgttcattgaaactagtgcaaaaaatggatacaacatcaagtctctgtttaaaaagctcgcttcaacacttcctaatttagactacattcaagaaggaaagaatgaagcaaacagttctagtagcttggaaaacaataatgccaataaaatcgttgatttacaatccggggaagaaaacggtcgttttaactataaaaaatgttcgtgttaa

SEQ ID NO: 625 - DNA, 1980 bp, Cryptosporidium hominis
atggacagaaatggctggagtgaatatttgaagaagcaaagacttcaggacttaaaatccttagcaaaacaacttggtatttacattaaatccaatacaaaaaaaagtgactgtatcgacatcattctgaataattcccctgacactcctctaagttctaataatcttgattttatacttaaagaaaaaatatcaaatgatcaacacaattttccttctgaaacatcaattttgtccaatattagtgagtcaactaatttaaatatcattaaaataaatgaatattttcatactgcttcggatgctatttgcgattcatcttgttccatgtgccaaaaaaatctttccgatattatagttaactgcgatgcttgttacagaccatttcactctcgctgtgtaggttttgatatcaaaagagctgaattcaataataatcacatgatggttttcatggaaagtatatcaaaaaaagatggcaaaaaattcaaggctaatttaattaattttatttgcccgttttgtagattctttgtaatcgacccatataacaaaataattaagccacttttttttactactttttattcttacacagcaattcacaatatacatccaaagtatggaaatattaactttaataactcaagccaccttcctcacttcacatctaagtattctttctctccaaatctatttttgaataatggtttagaatctaatgacccggatgctttcaatattatggtttattgtctaagacttgatagaatggatcttaatcacgaatttccaagagtcctatttattaaagctaacggaaaggttattcaaaacattgaatctccgagctacgatcatattagaagagattgtccattatatttgaaggattatttagttaataatcaattgatgacaaagcaaaatgtcaacattacgtttagcacattaaatgcactacttaaagactcagaaaatagtgagttgttgcctattcctacggcaccgtatataattggtttgtttttaaccaaaacaataagttgcgataatattttggatactatactttctgaaggcacattatccattgaaatttcaaaagctcacttcaaaaatattttagaaaataagatccaatcatctatatataatcaattatatgatgactcatcagatgagataatctgcttgaataaagaccagtatttaaataccttatgccctctaactatggataccattgaacttcctggacgtggcatattttgccatcatataaactgttttgatattaaagcttttattcaaattaactctacaattaaggcatttaacaccagatggaaatgccccttatgttaccaaataattagaccaagtatgctcaaattagacagctttgtcaagatgattattagaagccccactatacccagagaaaacaataaaattctgataaactctgaaatttttgatcgaattaaacaaaatgaagatatgcccggagaaatgtttttaaaaacctcgaattcaattaaatacgagtttccaaaggccaactcgttaaattcgccaattaacgagcatctaactataataaaagaaaaatcttctcaaaattcagatttatccttgccaaacaatattaaagattgttttgatgttcaaaatgaggtaattgacatatctgatgatgatgatgaaaatgagatgatagatgatcattttatagttaacgatgatgagctcaattccttgttcagcaactctaactacatagatataaataatggaaatgctaattattctgaacaaagcaaagaaacagtacttcaaaattatagcgaagactcaattcttctagataataaaaaaaaaagaaaagtttcagagggccaatttcttagtcaaagttctggaaggctagaaaacacttctaatggtgacaagacatcgatttcacttagattatag

SEQ ID NO: 626 - DNA, 2133 bp, Cryptosporidium hominis
atgtgtgatagagttgacaggcatgtattgaggaaatatgaactggtaaaaaagttggggaagggtgcatacggcatagtttggaaatctattgatcgtaggactggagaagtagttgcagtcaagaaaatcttcgatgcatttcaaaattcaacagatgctcaaagaacatttagagagattatgatattgacagaactatctggtcatgagaatattgtaaatttactaaatgtcttaagagcagacaatgatagagatgtctacttggtttttgattatatggagacggacctacatgcagtcattagagcaaatattttggagcctgttcataaacaatatgtagtttatcaacttattaaggtaattaaatatttacatagtggtgggttattacatcgtgatatgaaaccatcaaatatacttctaaatgctgaatgccatgtaaaagtagcagactttggattatctagaagctttgtcaacataagacgtgttacaaataatattccattaagtattaacgaaaatactgaaaatttcgatgatgatcagcctattctcacagactatgttgcaactagatggtatagggctccagaaatacttttaggatcaactaagtatacaaaagggattgacatgtggtctttgggctgtattttgggagagatattgtgtggaaaaccaatttttccaggttcgtcaactatgaatcaacttgaaagaattataggtgtgatagatttcccttctaacgaagatgtcgagtcgatccaatcaccctttgccaaaacaatgatagagtcgctcaaagaaaaagttgagataagacaatcaaataaaagagatatattttctaaatggaagaatttactactaaaaataaacccaaaagctgactgtaacgaggaagcattggacttattagataaattgctacaatttaatccaaataagaggatttctgcaaatgatgcattaaaacacccatttgtttcaatttttcacaacccaaatgaagaaccaaattgtgatcatataattactataccaataaacgacaatgttaagcattcgattgatgactatagaaacttggtatattcagaaatatcaagacgcaagcgagaattgatcagtaacaaacaccaaaatgttcaaaatccaaatactgcagtgagtaatcctagagttaatagagtatcgggtgctgttgaatttgctactccagaaagcaatcccaacaacattacttcaaataagtccaacgaaccaatttatagtaaattccagagtgaactacaatcaaacaaaagatcctccattaataaaaacccaccagcagataactcaaaaaaaggaggcatactaggaaactttttctcacaagtatataatacctttatttctggctcagcaactaataaaacgacttcttttggtaatagccaaaccatttccaattattccaatggtaaggttgatgagaaacacatacaacaaatgagatctgcaacttcgtactactctaactcaattaacaatagcaacccaataaagaaagggggaggattcataggaaataatttaagctctacaaatgataatacggcgaaaacagccaatagtagcactaaaaactccaagtacataacaacgggggcagtaataaaaaatgccaactccacattttcagtaagtacaaattgtggtggaaattcgcacgtttactatccaagagcatatatgtacaataatataaagcataatcttccagattactctctaattccgaactcagagttgagcaattcactttcgggtaaaaatacctcgaatctaaaatactccaataatccagaactttcaaaccaattcaaattgaattgccatggttccaatcaaactagcataattaatctacaaatgcaacaaaatcggagcaatacgagcaaaataacatattataatgagcctaatattgaaccaaattctaagttaaacgatatggtcggtagaaaaagtacttcgtctggagttggagtgaatacgttgcaccatcctcctccattttatacatctcagcaaaacaaaaacgttaacaagaattatttatataaatattag

SEQ ID NO: 627 - DNA, 1398 bp, Cryptosporidium hominis
atgattaaaaatttctcaatgtatcaagttttagaaaagtcgaagcggtttttgaacaatctaataattgattcatcaatgctaaagattttttgtgaattatcagttcacagttctaataaaataataaacgaaaatatttacatattgaaattgagatctctcagtatattggaagaagtaataaatcttgccttttctgtgaatattaatgtcatagggtgcctgaagaccaaaattattaacgatatcaagccatatttaactaagttttgcgagtttattatctcaaaatttgagattgatgcaaacagtaaagaaacagcatatatggtgtcgttattaacgataattaaaacaacattactttatgacgaaaagcatgaattaattaattatttgaatactgaattttgggtttggcttttagatgtattcataaggagaagagaaaatagccacatttcagttcagtgtaaaactatttttgaattaggaatcagatttgggtcatattcaacattggagaatttgttcaataaagtcaaactggttgataaggtgtcgaaatttatttatgatgggactgatctagatggcaatttaatagaagagagagagtttgtaaataagaaaacgggcaaaagaataagaagagtttttggttcaatttacaatttgtttattgttttggaacaaatttacaacaattttttgaaaattattgtaccatataatccttatatttatgaagtgattaaaaatgttatattttctcaattgaataattatagtaaaatagatgatgaagctatggaaatgttaggcttgttaataaaaaatgaatttgaaataaattatttgtcgcaagacagtgaaaaaatcgaatttgaaagcccaatagatatggatccacagaaaatatccttattagcaaatttatcttgcaataccaaatttcacgagcttgcaaaaagctatcaaagtcaaaacaaaacaaactatattcaaaattcattttcaaaagctgaagatttaagtagtaaattgacaaagaatatagaaaattccacgttgacccctaattctattaaaaaaaaaactaattcggaagatccttcgatttcaaacgagatcaatacttcaaacaatcaatctccatcaaaaattctcagaagctacttttctggaagtattgttgatttatttaattgtgacgaaaactgtgaatgcccaaaatggtcattttgcaatgttctcaacaagttgaagattgaaaaaaattgttcgactggaattccgaattttcctgttcttccgctcgaggaaagcaaaaaaattcgggagactcgaaagaggcagataaaattatgctcttcagcccaaaaaaacgattga

SEQ ID NO: 628 - DNA, 1113 bp, Cryptosporidium hominis
atgtttaaaggaaacgtaattgactttaatcgttattcaatattaattgatgaaagacttaaaattaaatcaaaagaaaggatgcgtccaaatgacttgttctcagacccttattatcaaaaatctgactttgaaaaaaattgtattgatacaatttcagaaaatacaagtaaaaatatgttaaaaaatatatggaatctcagtcaagaaaaagcaaatacaaatccatctgaaacttcctccaattgtaataaattttataattatgaaaattatttagggatcaaaagaagtggttgcaaaaatgccacttttgaaaagaagtcagaaagtaaaatggaagaatttattaaaaatacttctgcaaggaagcagaaactatttagagaattttcaactggaattgtactaggagatgagggagattcgagggagaaaatgttttcctacgtttctaatatattgagcaatcaaaacaacaaagagaaggatgataatgaaaattttaagttggcttaccctttttattcaaatattttcaacattgaaaatcgcactgataaatctgagctaagtaaaagatttttgcttgaacggcgaataacgaataactccgatattggagacgagtgcgctgcaatgatactatctcctggaacacttaaatactacagttttgatagagaaactagaacttacaacgcaattaaagatttaagcaacaataacatatctgatgaatacaatttggacaatgttactccaaaatttactccattacaaaaaaatttgagttctaaactacatggaagtgacttctataataatgcggcaattagaagttcagaaacaatgttcacagttagattccgcctgaaaaatattagctcacaaattaatgagaagattattaaaaatactgctgcaaattgtggtgcatttgcctatcaaataatgtttgaatttgatccaattaaatggtgttctaaaggtattgcaacagggatgcttagatattctggggatagcttaaatgcttttaaaagagaattaatcgaattattcaagattgaagttgagatccttaatggaattcaggaaagttcagaataa

SEQ ID NO: 629 - DNA, 702 bp, Cryptosporidium hominis
atgagtatttgcttaaggggtattcagaatgctcttgaaactaaactaggagagttagatacactaaaatcacatgattggaacctagaaatagatgcatttctagatgaagaagaaaaaggtacagcgaaagaagggggggctattatgagtgaacataaatgggagattgaaattcaaagtttgaaaaatgatatttgctgcctttttgattcatttgagaaagaggtagatttactaaataatgatggtatgaataccgataggtatagttcacttcttcagaatttgaagcacgactataataacatttgcaagtatattgactctagaagaaaaagggtgaaccttttttcaaaatcaaacactccgtccggaaataagtatcagaaattatacatagataaaagtactgaatcattcgaaagatctcagttttatagggaaaagaatataattaaagattcagttttaaatttaaattcaatgatagatcaggcattgaatacaactcaatcattaagtggtcaaaatcatactttgaaattaatttttgataagacgcgcacaatgagaaagaaatctataagcaatattcaaagtgttgtaaattcaattatcaacttgaaaaagagacaaaattttgtagtttcagtcttatttatattacttgttgtcattataatatacattaagaagtag

SEQ ID NO: 630 - DNA, 561 bp, Cryptosporidium hominis
atgatcaattccctattccaactcttatttggaattttattgatgattctagatgttcctggaagcccacgttggtcagcaagaggtagaacattgattaggaaagaagcaaggtttttaacccatttaacaggaaaaagcctttgccttttatttcttagttgccttacatccactacactctggcctcaaaggagaggggcaggagtactagcacttctggcctttctgacttctgttgcagttgctggggttgcaattattggattattgatatctctgcaaaaaagtgtaaggcttgaaagagttaggaaaaatattatcacaacaaaaacatcaactgtagctgatgtatatagaagatatgcgatcgcagatccagtttatgggatgcaatttgaagaatttagtagaatggcagcagattatactaacggaagacaacagtttggagttactgatttaagcattatatacaatgctttagacgaaaaccaaaagagtggaataaatgaaagagaattttcagagtgggtaaatggctctactgtttatctatag

SEQ ID NO: 631 - DNA, 804 bp, Cryptosporidium hominis
atgtatggaaacaaagataaggaaataggagtatttcaagagaagatagagcacagtggggagatagtggatgctactttggcggaatttaatgtaaaatatcaaacattattcttcattgcgactcttgttctgtctatagcaggatttttttctgcaatatattcattatttgggttaaggatcacaaactttgtaaattcttgccttcagttaattgtaggagtgcttttattattgttggatattcctgggcaaccaagatggagcgcaaagtttagaagtgatattagacgtcaagcaaggattttatcaaagttaacagggaaatctctttccctcttgtttttgtcatgcctgtgctcaactactctaagagcaaataatagaggcccaatgataatttctatgttttcgaaaacaaagtcaaaatctcctggattatttttactaacattcttggtttgtttacttacttcatccgttgcagtattgggtctccttatttcttttgagaaaggaataagactgaataggattaagaagagtgtaatatcgagttatacaagtgttggagcttgcaatactattgaaatatatagaagttatgctctttctgatccattatttggaatgcttggcgatgaattcaatagattaataagcgacagaacagataacaattatcaattttctcaagatgagctaagcattatttttaatgcattggatgacaaccaaaaaggatcaattaatgaaagggagtttgttgagtttttttcatctagatttacactagtgtag

SEQ ID NO: 632 - DNA, 618 bp, Cryptosporidium hominis
atgaaactattaggggttaatagttttgctctaagacaatttgtagagggatacagaggaagttatattccaagaatgagtccttatgaattcttgaggaacgtaaataattacattatcgagaataatcctacattagtcgatgggtatgcagatttctgcaaacacatttttattccaaattttacagaggcgaagcaatcaattgtaaagatcacaaatgaaaacgaaaagtatattaagacagggtatatttcgaggagagacgaagagattccagtattgtcaaggtggttcccaaaggattccccacccgcatcacaactaattaaaagcaagtatttagatatcattctttatagtaaagaacagtgcgagaaagaatcaagcattatgaactgttgtctacaagatattctagatgataaggaaaagaacccggactggtatataatatcaattaaggcgcaaaatgaaagcttcgaagtcccaatggagccaataacaattcttagaaatactttaatagaagagggaggtagtggggtcccattgaaaagagaaaaatacttggagtcggtagagttttggaaggaacatgccattgtatttagctag

SEQ ID NO: 633 - DNA, 555 bp, Cryptosporidium hominis
atgggaaatattcttcattatcttatcggccaacggaattatcactattatgatgagattgcattagattgtggagtaaatatgttttctattcaaaaaaatgtcgaacaaacaaagatcttaaaatataaaagtttatcaatgaaaatttccgaagcagaaagtttatataacaaactaatggacatgagatatcatacagaacaaattattgataagtacaactctcttacaagattatttgaagggatccactgtaaaatttgttacctggactttgctcagagatgggtttatcagcaagactgcaataaattttacaagtactgtatagaattagaagctaggattgctgagcaagatgattcaataaaaagaaagtacttggaatattgtgatttcgtccaattatacagtattaagtcaggaaagattaagtatttaaataaatatccaggtctaaaaacatgcctcttattaaatagaaaatgtccaaaatgctacgaatctaaaaaaatatctcattcgcaagcaaaagtaagtatcaataattaa

SEQ ID NO: 634 - DNA, 1221 bp, Cryptosporidium hominis
atggaagaagatgataaaataaatttatttggggtttatgaagaattgtttcatctcttacgtgatggaaaagatgaggtaattaaaggaagtatggagctactccttgatcagagtgaaatggaatccctatcagaatttttatcaaataaccccaactatttcagaagcattcttctacttattggaaacgatatttccagcatatcagaatgtgctttgaaaattttgataaatctgtctcaaaagtccgaaattggagaagagttatgtagaaattggagcgcaatcgaatattcgatggataatctaagagagcagatcaaatcaaattctactgtaccgtatcatttatctctaaacttgatgcttatttcaaatttgacacgttattcaaaggggagagaaaagttttttgataagtctagacaaagtaaaagtttttatttaacctatttactcgagtgtctctctaactctagggataagaaggagagagagatgatcattaatattttaaataattgtacatattgtagtcaagggcgagtatttttgtttgatagtaatttaggtattgaattactcaacaaagtttcggagctaatgctagcaacatcaagaaaagatgatttgataatgaccaagagtctaatgagtattattacgcacgtttgcctagataagaacttacatacaattatatcaaaaaaagattgtaatgtaatcccatcattatgttgtttggtttaccctaatgaaagtcatcgaaatctaaggtatagaaaaagcagtaatatattatccgaactccaaaataaaacgattttttttgattcaaagcgcgaaggaacgaattccaataatatttcgtttaacgaatttgaaaataggaatcccaaaaaaaagtgtgggggtgatgatgaagaatttacagattctgctgcagaagacaaagtttccgagtttataaaaaaaaatgcaatcggccctgttaataaaaatatatctcaagatgtatttgactgtatattagtattaatttcaacgattaatgggaggactttccttcgagagttgggagcatatgaagttttgagagtatggcatttatatgaatcaaaggatgaaataattagtgggattgaagatattatacatttattagtatactctgaggacgagcttctacaacaagataatagctctatagatgcatag

SEQ ID NO: 635 - DNA, 780 bp, Cryptosporidium hominis
atgtatagaaaccaatatgatacggatgttgttacttggtctccacaaggaagagttttccagattgaatacgccatggaagcagttaaacaaggcactgcagtagttggagcaagaaacaatgagatagttgttcttgcttgcataaaaagaagtacaagcaagctcgctgggtaccaaaagaaactatacaaaattgataaccatattggcgtagcagtttcagggattactgcagacgctaaagtaatttgtaactatcttagatcagaatgtctaaactactcattcacatatgattcaccaatgccattgaacactttggttaacaagcttgtattgaaatcccaggtaaatacacaagaatacggcagaaggccatttggcgtaggattgctcttggcaggatttgatgaaagcggcccgcacttatttgaaacatgcccttctgggaattgctttgaatattactcgattgcaatagggtcaagatctcaagctagcaaaacttatttagaaaaacattttaaggaatttgctaattgtagcaaggatcaattgattttacatactttaagagcattaagatcaagcttgtcatctgaacaagaaatgaatcaagaaaatgtggatgtggcaattttaggaagaaatgacgtttataatgaattattagaggaagaaaaaataaaatatcttcaaattattaaccaagaacaaccgccaactatagaacaaattgatgaatctcaagaaacttcctctatgcaaatagactaa

SEQ ID NO: 636 - DNA, 1359 bp, Cryptosporidium hominis
atgtcaatagagagatcttttgattataaaacttcatctctttcatcatggaatttacaagaatacatagcaactttgtctagcactaatgcatgcctattatttgaagatatttcttgtgtaactgaattattttcgtccctttctgagatacaacagaatattgtgtctagacttatgattttgggaagtggatatggaaattacataggagaacaagctatgaatatatggatacttacaacaaaaagaaatgaattggaatatgcaattaggagattaagatcattgaaaataattaaagtcaatgtactagattctaactcccaaaaaagttcatctgattctatttctgtgcaataccaattaaacccaatatttcaaaaaactttatctaaatttttgtatgaaggggatatatttaatggatttgaaataccaaagagaaaatccgagataaagatctcgtatgaatctctcacgaagtttgtaagaaaacaatggagtaatattttaaacattattgttcaattaagcggaagtcaaaatattccaaaaaatagtgctaatacattttataaattcaaattaatttccccggacacaataaaagttctggataatatccacttaatttcttgcgatattgggaaatacaacaaaaaaaattctccgaattcaaagggacttagaattcaaatttatagtagtttatctcgagaaagtagtgaacagttatttgatggctttgatcaagaggatagatttggatcccaaaatgaccaaaatgcactagacatatacaacgagataaaatacgatatggctggaagcaattctaacagtgaagaagaatatttgccaaccaataatttaaaaattaaaccaaagaagagagttattaattccaaacatacccttgcaaaaaaccaagttgataaaatatttgaacagaagttggcaccaaaagctttttgttggttactttgtgatagctgtaatcaattgttaatgcttcttaatggatttataaaattagtagagcttgaatcaaccattgaaaatggagaatacaaatttagtcaaataaccagtgaaaatatactaaacccaccaattccaaatgtaataagtctaatactgcgtatttcaagttcaaaaattggccagccaatttcaatacataagaaaacgaataataatattttgatgcgatttattttgtttgcatatgatttaggactactctatattgatgaatctattattgagagtagtctatattctttgaaaaatagattcgaaaatcttcgtgatttaaatattgaattattatatactactcctttttcattgttg

SEQ ID NO: 637 - DNA, 558 bp, Cryptosporidium hominis
atgggtaaaatagaactaggaacaattagatgtggcgataatttggttgtaatgcctaatcgtgctaaggcaaaaatacaaagcatttgccttggagaagaaatggatgaatacgcatggtctggcccaggtgaaaatgtaagaataaagttactaaatatagatgaagactcactttctaaaggttttgttttatgctcccaaagcgatttatgcccagtagttaagaagtttaaggcacaattgctttttgttgaactattagaacaaaggccgctaataacaagtggatatgaatgcattattcactgtaacacatcttgtgaagaggtctgcattgaggaattattggaaggagtcgaattatcaacgaaaaaaaagaagaacaggcctgccttcgtaaaatctcaatatatgttgacgtgcaacatgtcccttaccaatcctctttgcattgaggaatttgttaagtgccctcagttagggagatttacattgagagatgagggaaaaactattgcagttggtaaggtattggaaatattagacagcgtttga

SEQ ID NO: 638 - DNA, 579 bp, Cryptosporidium hominis
atgcaaaacaacttacctgtacaaaattcatttgcaaaattaggagctttatcattattaaaacaaagcattcaaggtgaagattctgaaacaaataaatcaaaaggaattactgcgatatcatcactggtacgccataataaaaccctagaagactcatttatttccgataatggaataccacttattgctttgtggcttcattctgaaaatgtaggagttcgtgaaagagcactgtcactattaagacacctattaatacaaggagtagtcaacagtgaatatatcattggaaataataacagtaagatcatagatactattttaactctttcaagaaacaactctatatctaacagggaatatcaaaatattcaatacggcgaaacaatctcggaaaccttactcgaactgattaatgctttcaatcctaaacttagcagttcatcaaaagacaaaatccgaaaagaagttaacaaacgcatgactttcctaattgattactgcaaattacatccggacgatgatatttcaccagaatattctatacttattcaatgtgaaaaattattagtttaa

SEQ ID NO: 639 - DNA, 792 bp, Cryptosporidium hominis
atgagttttaaagtagaaagtaatcttgtttgctcaagtaccttaaaaagttacaataaatcctatatcaagaaaactagaagagggaagattagaaaagtttcaaatgaaatttatgttagaaacgagatactatgtggacttaatttttgtactttgtgttacgggaaatattcgggtatttcaaaccaaaaagttcggaatattatttttcctaactttgatatatttaataaatacagcgacttcattttagaagatgaatctttaaatcacgtggtgattccatattcaatactcgactatttgagtgagacagatagaaccgttattaataaattaagaaataaacttagaagccaaaatgaattaccaatatttaaagaaattgaactgacgaatgaaaataacttgtttgattataatgttaatcagtatattcgatttccagacacgcaattcactgaaacatgtttaaatcactcaattagtagatttaattttgaagattgtgctggaaattcaattataaaagtagctatctggtttattaatcatttatcaaaatccaatgcaaatattcgtttctatattttgacagaaaatgaagaatggatcaaaaaatttacttctaatttaccatttgactcaaaatgttttattgtaaatccatatgaatatattaattttgtctcaaacgaatatgtaaattctggtgataaacttcctttcaaaacatcgttggtgaatgataatagtcatcgaattcctgcagcccgggggatccactag

SEQ ID NO: 640 - DNA, 1914 bp, Cryptosporidium hominis
atgatttctagaaataggggcgaaatagaagtaaccaacaaaaatagaaaaatgaccgttaatataattgggcaccttaatctaaataggtctatagatggtgacttagttgtttttaaacttgatgaaacattaaattgcgatgaaaagaacttaaaatcccaaatcaaatctgaattggagcttgatcaaatagaggatttggaacatactgaaatagcgggaataggaagtattttattaggagatgacgattatgacgaaaattcagcattaaacatccaaaatattagcattcagagtatagagagtgaagataataattcattaactttttctgaaaataacaatttttctgggagggttattggggtattaagtcgcaattggggtgaatattgtggctctttggttccgatgaattcaaatgatgatcgatttaatatttgcaacaacacctctacaaggcaacatagaatttttgttccaatcgacccgaaaataccaaagattataattcatacaaaactttcatccactattgaaaatcagagactagttgtagtaattgatgaatgggactgctcatcattttatcctactgggcatatagtaggagtattgggtaaagctggggatcttgaaacagaaacctcagtaattttacgcataagagatataaattcatctgaattttctccatctgttttgaaatgccttccgaatcatgatagaaacgatgattggaagccgaatgaaattgactttagagatagagttgatctaagaaaaaagttagttttttctgtagatcctccaggatgcaaagacattgatgatgctctaagtattgaattgatcaacccaaatgatgataattctcaagaaaattggtatcttgtttctgttcatattgctgatgtaacgcattttgttaagcctaacactccaatagatgatgaagcatccagaagatctaatacatgttatcttgtaaacaaaaggatagatatgcttccagaagaactcacaacaaatatatgttctttagtttcaaataaagatagattatccttcacatgtaattgggaaattaacgagaacgcagaaattagaaatgtatactttaataaaacaataataaattccaagtactctttcacatatcttcaagcacaaaatatcatcgatgacaagtgcaacaattcagaaatagcaatttctttaagaagactaatgaaaatttctcaagttttaaggaaaaatagaattagccgtggtgcgattgaactctcttcttcagaagtaaaagttgattttgaggaatctagaaacttatatcaagacttaaatcacaatgatttgggcaaagaacaaatttcatcggtaattttgaatataaaaaatgtatacgcatataattatttgaatacgaactcaatggttgaggagtttatgttattagcaaatgtttctgttgcaaggcaaatcgtttcaaaatttccaaactgttgtttattaagaaggcatcctgaaccaaagtacgatcaattagagaaacttaaacatgtcctttcaaaagttggaatcagtaattttacctatgaaaattcattaagcttatctaacagtttgaaaaatattctagattcagaaattataaagaaaaatcccattattggaaaattggttcgaattttgacaacgcgtacaatgaatcaagcattatacttcacaacttgcaaatctgtggagggaacatttcattatggtcttgcagaggaaatatatactcactttacttctcctattagaagatatgctgatattattgttcatcgcctactttcggcttctattggactagagccgctatgcgaagtaatgtctgacaaggactatgtaagttcatga

SEQ ID NO: 641 - DNA, 537 bp, Cryptosporidium hominis
atgaaaagttttattggaattcaatttattgcttatttatttttatttttctactgtttaaacgttgctagatgcgacaataaaatcaacaatttactagaacttagacaaagtatattacagcatgaaaaagaactcgaaaatctacatggagccacaagcaatttggttggagaagctgcagatgttttgaatttcagcaagaagagaccgatatttagtgaattgaataatttttccgccccaggagccccaactacaacaataaagatgactttaaagttccctaacactgctcctgtaaatatcaatcaaggaaagcttcgagaagaaataaggaacaccgcaactggaaatggtgatgcggtcccaagcattaacccgataccattagttgttatacgccccgatgctttgactaacttattatcatctctttctgcaacagtacatcagaggaaaaaaattgaatgtaagtttattaaaaatttaattttcattctaattatttttagcgaaaaaaattattcaacttga

SEQ ID NO: 642 - DNA, 759 bp, Cryptosporidium hominis
atgcgtacacatggcggtatgaatgtcatttgtgacaagtatcgttttacatgtatttttattcatgcaatgtgtttctgcatgcagccctttttcctatttcaggaagttcaaggaatattgtttaaattgaacataggatttttattcttgagtataatattatttgaattattcatttttttagacaaaatgcataaacattatagattattttttggattaatattcctttttatgggatgcggttacattgggtcaattagagtgaatttattgggaaacagagctttatattcaacatttctggaacagcaagcaacacttgaagaaatggtaaaggaactatcatcaaatactgcattagggaaaacgagatttggagacccaataacagacaaaaacaaccaatcaggtggttcagctccaactgtggtgaggcacggaagagatacaataacactttcaattggttatgggccgttatcaggcttaggggagttgccattttttggaaatactggcccaaaagttccgataattataacctcacctcagccaatattagatatagaaagcctctcggcaagctatcaaaaagaagcaaatactccgggaagtgcagcttatgtagatgagcaagctctcgcacaagctgttacaaatccaaaagtgaactctgaccaagtagcagtatcattaaaaagtactttgcaaaatgctgcatactttgctgctgacgcagaactctataaataa

SEQ ID NO: 643 - DNA, 288 bp, Cryptosporidium hominis
atgactcaaaacatcaaaactaagaaaactactaaggtatcaaagaaagaagcaaaaaaaaataaacctaagagagcaatgactgcgtttatgtattttgctagcagtagaagagcagagattacagcagcaaatccaagtttgaggtcgcaagttgctgaagttgctaagattcttggtgaggagtggagagggatgagtgaatcagataaggcaccattccagaagcaggcagatgcagacaagaaaagatacgaacgagaaaaggcacaaatggcaggacagtag

SEQ ID NO: 644 - DNA, 4281 bp, Cryptosporidium hominis
atgtttttgaatggagaaatgaacagaagccaaagaaatgctattcgtcggcttagaagtttggctgtaatacttgaagacactcatatcgataaagagcgtagtattccattaatttctaaagcgataacgtctcaaaagcatattcgtagaagagattcaacagaacgtaatattgcaactaggttagactcatttaaattgtcaatgggtggaaaacctcatttgcactcagcagatctctttgaaaacttcagtcccgtgcaattagaaagacaaaaatgggtgccaacattgccatattccttatcttcaaactgcataaaaataaaagagattgaaattcctgacttgatccaaaaagatgagaataaactcaaagaactattaccgaacacatttgggagaccatgcattgaaataactagagatgaatcaaagaactcggagaattcagaccatgctcttagagttggaatcgtattatcaggtggtcctgcaccaggcggacataatgtaatttgcggtgtatatgattttatcaagaatcatcaccctgatagccagctattcggatttttaggtgggttagatggtcttttcaaatcaacttataaggttatttcagatgaattaatggatcgatttagaaaccaaggaggttttgatatgctttggtctggtagagggagaattaatggagaacaagatttggaaagagttgaaaaagtttgcgagcagcttcaattacatggattaattgttattggtggcgatggctcaaattcaaatgctgcgttgatcgcggattacatggcaaagaaaaacaaaaatttttgtattgtaggggtcccaaaaactattgatggagatttaaaaaatcctgctattgaggtctcttttggatttgatactgctgcgaggacttacgctgagtgcgtaggtaatctctgctcagatatttgtacatcacaaaatgtctatcacttcgtaagagttatgggtagatcagcatcgcatttggctctggaagtcgcattgcaaacaaggccaaatattgtttttattgcagaagaagttgagcaagaaggaataacattatttgaaatagtgaagaatattgtagatttaatggaagagcgttcaaaaatgggtaaaatgtatggcataatattaatacctgaaggcttaattgagtttatcccagaaatgaaaattttaattcaagaattaaatgaaatccttgataagttaaagtatgaggggtctgaatgcgatcaggaagcttcacctgacgactttgataaaaagatatgtagttgtctttcggagtcttctgcaaaaatttgggagtaccttccagaaaatattagagagcaattgttacttgatagagaggctactggccaaatacaagttgcaaaaatagcaacagagagattacttatactacttgttgaagcagagttacataggaggcatggaacatctttctattatgattttgagcatgggcaaaccaaggaaacaatttcagatcaagtagaaatttcaaataagtcaaatggctcaatactgatgccttttggatttacaatgatgcatcattatttgggttatgagggaagatgcgccatgccatctaattttgattctaactattgttacgcactgggccattgcgcaggagcgttggtttataaaggcatgaatgggtacttggcagttataagaggattagaagggaatcctcttagttggcaagcatgtggtataagtattactagaattatggaagttaaaaaatccagacaagacggtcagtgctatgctgcagttactcgtcagttagtcgatttgaatgggccacttttcaaactattaaaacaggttcgagatatttggaaatttcaagatttatatagggcgactggacctttacaattcgaaggcccatgctctgaaactatcccttatattgtaagaacgccagagttacaagatttattatgcggagaggatgcctcagttacagatactgatataaatattgtacaagcaaataatgggggagggaaaagaggtgtatttaatagaattcagggaaccctctcctctctccaactttatcgcacaacatatagacctccgttgccactgctgcttacccaccttaaagcaagatgtaaaccaactactcaatataatctatctgaccctctgataaaaagacaaattacaacctgttatcctcatttatgtaattcaaatcacttttattgccaagaagcgcaacttgacatttcatctgaagagcccaatgtagggttgagaataggagtattgcttatgtctagacaagcacctggaattgcgaatgtggtatggggactataccaccgtctaaaaatggtaaggggaagatgtttgggcttttatggagttaaaggatttttgcaagggaaacatattactcttactgagaaagatgtagatcttttgccgaatcaaggaggatcggaattaattggaagaacgtatacagagtgtttagtttcgaaagagaatttggaaaaggctagaaaggtttgcgaaagtttacatttggatggccttgtgttgtgtggctctgcatttggaatgacccagggcgcaatcttggcagaatattttctacaaaataactgtaatactaaggttgttggtgtcccagcaaccgcgtctaacaacttagcaaatgatctagtagaggcatgcgtagggtttgattcaagcactaaattgtatgcaagcttaattggaaatgtattaactgatgctgcttcaatgcctaaatattggcattttattagattaatgggaaggcagccttcaaatgaagttctggagtgcgcactacagacacatccaaatgttgtaataattgctgaagaatatggagcagctgataaaactcttgttcacatcgtagaagatgtagcggatgtaatatgtaagagagcggagtttggaaagaacttcggaactgtactcattccagatgcattactttcacatttaccagatatgaagattttaatttctgaaataaatgaattacgaaggttcgctgaagaacattccgagatgaaattgtttatctctgaaatgatgagtttgggacacagcgatcaccccacactgtcagatcacacaaatagccaagaaaaaagctctcgtgtagatgtggctgataacaaaagttcggctgcgaatcaggaacatagccctgcagatagctttgatggaagtaaatactcttctaaaatgactccctggagtctcgcattatttaagtcattacctaggttcattagaagagaaatactctcattagatgttgactctgcattttccgcaatagagaccgaggcacttcttgttttaatgataaaaaaggaacttaagaaaagaaaacaagataatagatacaatggcaattttcagccgtttacacacttttttggatatcagggtagatctgctatgccatcacagtttgatgcaaagctagggtacgcgcttgggcattttgcttcgatagttgttgagagcggactaacaggccatctttgttctattagagggttgtgcggtgatgtttccgattggagaatgacagcaatcccatttaattgcttaatgaaaattgttccttcaaacgatgagacccatcctgaactcccaagcaacattcccacaattccctctagtgaagtggatctaaaaggtaaagcatatcgttggttaaaaattgttcaggaacattgggcaatgcaagaccgcttttgtaaccctgggcctatacaatttgatggggctgctgcaaacttttatttcagaacacttcatgagcaacaatcagagtactatgaaatgcttaagcatgtacaaaattacgcggagttggttagagaaacgtgcacatttggcgtaaacgagtcatttctgaaaactgcgtttgtaactctgaacggcctacttaatctgcgctatcgtgatggaagtctactctcatcgcttccagatattgggccgattatactacaaatgaaatctcattcgggaatgttaaacaatcctacaggtcaaggcgaagcaatagaaccaattgttggtgagctctcaaacaaggctccaagcaatctccatacgtcaaaatatatttcacaaagcaacctgcacatggcacagtcgatctgtcctggagtagaagagggaccatggaacaaaactaaatga

SEQ ID NO: 645 - DNA, 3655 bp, Cryptosporidium hominis
atgtttatttacaatgaagttgaaattcttcaatctttaaaacaaaacacagataatatttacacgatcaaaacgactcttagtgcttggattcaacaaattttttttctttcaacattttggcaatcaaaaaaagtttggtcattttcgtctcaatcgaatgacaagaccataaaaataaatcatgatatacaaaatgagattgaggcacaacaccaacaagaaagtaacaattttgcaaaagaaatcattttgaacgaagggacaaacaaaactaataaaatgaacgaaaaaggcataaatcaagtaatacaacaaaaaaagaaacagtttaaaaaattttttgagttgcctccaaagcttgaatatattccataccatctttttttcttaattgtactattttccatagtttctatactatggattattaatatagcaaactaccagcttcatactgaaacaggcgaagttatttggaagattctcgattcgccttttagagcaagatcattctatacatttgatccaactttggatttcttcccatatatgtttaaagattgttctaaaaaagatgaaaacctcaatttcttatatgacaaagaccagttatctaatattccaggagaacttctctacgggctatatcagtcatacaggcttacaaatattacttcattaagtcacctaaattcatggattcaaaaaatttttatcccattgataaaaacaaaaaatactcaaacttcagaaaaaaagaattttttgatggatcttggccatccaacactctattcaacagttaacccaatgttattatttaaacaacattttagtcccgttaaatgcaattctaatccaatttcgtctggattatatttaagtacaatctctagatcaaaaagctcattaagcattaaagatatttcaaatttcaatccattgtcagtaaataatgtcccaacttcattatctgttccaaatacccaaattcaaaaaatcagaaatatatttgcacgtattcttaaattagtgaattttaatcatggaatattcagtagagagttaactacttctgcggaaaagagttctcatatggagtcaactctatcaagctcaggagtagatagaatattttttttatatgcaggtaaagaatcggaaatttccgaacagtttaataaatctttacatggaaatgatgaaggaaacttattttgggttataaggtcttattctctttctactggaagcgatgtaaatgtcgacttaatcacttcattagattcgtttgcttcaaatgaagattttaacattccttttgatggtttgtttgattatagtatggatactctagaaatttactttccgattattattccaaatcaaaattctgtttcattgataaagttaaaatttgaacttctacgtactgggaaaattgaaattgaatattcttttgattttgtgaaacatgaatggatcaaacaaactattaatcaaaatgggatttatattgattcaaaaaatcaagaaatttcagaagatgttgatggaaatgaaaatgaaagtgaaaaccaagtcaaagactcggattcaaattcaggaatctgggttttttcatttgttctgattgggatacagtgttttattttcctaatattccttatattggtcatttacaatttttatagaaaaagattattaagaaaaagactaatgaatcaaataaattataaaatggatatttcagaatcagaaagtgaaagtgaaatacaaaaaaaaaagaaaattcgaaaacttggaatcagaaaaattgtaagaaaaatcggtagaaaagaaatagaaaatgaacaaacaacaatcaaaaaacaaaaactagaaacatttggaaatgtacacttaaatgaaaaaaaaaatgttttagaatttaggaaaaaaaagttcgcacacaagaaacagaacaaagatattaaagaggaaatcactgattccaagcaaatagttgaggaagaattatacgatgaagatatattaattttgtacaagctaagtaattttaacattttaattattgtaataatgttaattgcatttttcgtattatttttttcttcaatcgcatattatattttaataatatccacaaaaatttctattaacattaattcaattgatattgagggtggttttaattcgattgcttcatcacatggagatccattgccctgggagatagaaatatcaaacttgaatgatatcaattcgaaactaaatatgattggttctagttcaggtttttataacgacaacgtgttttccttcagtaatttatttgaaacaataaataacatccaagaaataagtggatactttgaaatgtttgaaataatcggagtttttcttattatcacatatttatccattatttttatatactccagcttacttgttgatcgtcatcggcgtacaaaaatattaaagatgaggcgttacatggaaaaaactgggaagaaactaactggaaattcattcgaatctctctcagtgtttacattcatggatacaacgtcccaaagaggttttagctggaatgatgcaaattacgcactttttcctattttttgtgttgttgcttcaattattctgattttttctttgacaggatattcgatattaggttatcaggaggcaacatatttttcatactactattcagtaataagctccttattaatgatttttaattataacagtgtaaagcaagtcatgatgacgtcaattactccagatatatcaattagatttaaatcaaatattattacatttatttggaagccattgtattatttattaacgttttttacctttaattttattttaaaggcattaattcctgcttccataattttttatatgcgttcagttgcatctaagaacttgcaaatttcacaagatactctactttcaaagttaaataatgttgcagttacaagaccatcaattccagtattcacaaatgattgcatctcattaagaatgaaattttttatcaaggcactttataaaaaattaggaaaattcaaaaaatttgatatgaatttaatgaaaggtaacacaattgaagagcaaaatgaaacagaagtaaatttaacggaaggaaatcctgactggatctttgcaaaattaataccggagctttttaatgaaataattcattataaactaaatattgcagagcttgtcaataaagaccagcagggaatacaggaaataagagattatttgggtaatatatcactccaattattgttaattcaagaacatttagtgaagattgagtttttgagatgtaaactttcaatgataagacaagaattgatgaaaattgaagatgttaaaaaagatatatcaagaggaaatagagagtctcaacactatattgatcgacttttacagcgattaatgagtattaatgatgaaatcgaacacttggatgaaagtaacagagttttagggcaagaaaaagaaactgtcaaacaaaaaacatcaagcgtcgctgcaaactatactcttcaaaaagaaaaagaaaaattctcgactaatttcttgtttgaatacggtaattcatatgccaaaacattatttaaaa

SEQ ID NO: 646 - DNA, 1692 bp, Cryptosporidium hominis
atgtattctactaatatgggcttattattacagtgggatgactcacttttagtctcgatttcgttaaattgtgatgggacaatcttaaaatgctttaaaccaaaaataaatggcatatatgaaggcgtgatttcatctagtgcagaccctgactattttaaaaataatattttgttttatcttaatcgaggaaatcacacttataatttaggtaatactataaattacgaaaattcaagttttattaacggagcacatttatacaattactcgaactattcaaaatctaatttaaatgtgatgatattcggaactattatgtttacgataaataagtatttttcagtttttgcctataatattgataaccaccagataatttggagaaatgatagtttaagacaaaaggatcatcttaagctatataaaaaaaagctatttgttctgagaaagatattgcctgaattggttattgttgatcaatccagcattttaagaatagaaattctttctgggaaaactatttcaattgaaagttatatcgagtcatcaaaattgatagtctctacccctccctttacctcaaatgaacaaaatatcaacccactgctaatattgttagacaaacataataaaacattaaaatttgtgggcttagacaacaaaactgtaaatatcaaagataaatcttatttttattttacaaacgaatctaacataattaaatgttataaaatgatctctgggtatgattcagaagtacattggcaatatgtatttgatcttgacgaaacaatttcagtttattctacacctgagtgtagctattgcaaaagttttccagtaattgttgatgaaaaatataatattattaatagatttgactatccgtatttgctgggggttattacgagtaaaaagaaagttctcttgtttaatcagattaatggaaatctaatatattcatcttttttgcctcaaatgtttgaacctccatttacacttgaaatttttcaaaatattattttgattacgtcatttcattcaaatcacaaagtaccagttattttaattcttgaattatttcaattcattaaagaagaaacttctacgggtattaatatgctagacaaatttatattcctggtttccaacaaaaaaaatgtaaaagaatcaaaaatatactcagaaaaacatgttcatgttcaagaaaccacattcttgtacaactatgaactaccaattgattactcattattaagtagaacatcagaatcattagcttccaaaataatactctttgggaatgaaagaagcaacgtattagaatgcatcccagagagattattcactacattaagacctaacaaaagtaaaaagaaaaacttgatccataacagtaatctacctttttaccaatctattctatcagaaagaattaaattttcaacgaaattcaacagcaaaaaaatattttcattcccacatgaaacatatgaatcaaaaagtaaattactttcagttggatttaattccctagaggtatttgaaatatatccaaatacatcattcgatcttttaccttatgatttcaattattataatataatcaatacggtatttttaatactaactatcacagctatttccatttatttctcaaagagaaatcagctaaaaaagtggatttga

SEQ ID NO: 647 - DNA, 1446 bp, Cryptosporidium hominis
atggtcagaatcgagccagataggaaatggtttggaaatacaagagtaatcactcaaaacaaattagaaacatttcgcgaggaaatctccaatgcttttttagatccattttctgtcgttttaaaaagatctaaacttccaacttctcttttaaacaataattctcgtccagagaaatttacttgtgagaaaattaacttattaaatgtagagccgtataatcgtacttttggccaagggcatgaaagaagaaagaaacctaaaattatctttcaatttgataacttgagtgaattagctagtaatatagaacaaagtcataataattataaccaggagcagcccaatagttttgaatctaatgatttttaccttgaaaaaacagaaagaaaaggtgaatttgaaggtttcgacctattaaatgatgattcagtgttaagaaagggaacttcaaggagaatctggcaagaactatacaaggttattgatagttctgatataattattcacgttttggattcaagggatcctgaaggtacaaggtgtaaatatttagaggaatatatatctaaagaatatcaaaacaagcatattttgtttgtattaaataaggttgatttaattcctaaatgggtagctagtaagtggatttctttttatggatctattagaccaactattgcatttcattcaagtattacaaattcatttggaaaaagaactttatttcatgttttgagacaatatgcatccttattaagcgataaaaaacatgttagtgttggctttattggctatccaaacgtaggaaaatctagtataatcaatactttaagagggagtaaagtttgtagtgttgctcccattgcaggagaaacaaagatctggcagtatattcacttgactcacagaatatatctaattgattgccctggtattgttccaccagaaaatgcatcaagttataatgtggtactgagaggagcgatcagacctgaaaagctttctgacccatgcatttatataaaacaattattaaatattgttaaagaaaggcatataaaagaaaaatataatctaaaaagtacagataattggaaaaatcccgatgaatttttaactcttgtaggtaaaagattaggaaaggttttacgtggaggagaaatagacttaattacaactgcaaagattatacttaatgattggattgttgggaaaataccatattttattcctcctccacaaagttcctctgaatttgcaattcaagaatctaccgataaaaatctgattaaggcacaggatattgagagaattaatgtatgtaaggaatttgagtacaataatgaaaatatgaacttcatagatgaaaaacctttaaaacaaaaagctatctgcagcaaacaattgaataagtgggatgatgtggtttgccagtttgactag

SEQ ID NO: 648 - DNA, 471 bp, Cryptosporidium hominis
atgcgttcttgtacgtatatatatatatatatatatgtgtatttttttttttttttttttgcatgcgctctgcaacgctttgttattttattagctcttctcgaaatatattcaaggcatatgggtagtgaacaatcaaaaacaaattgttctaaagaaatcaatactgaagttgaaaataacaaaagcaagatcaaatcaaatatttcaataggactaaaaagttcagtaaaaaagaattcaagtatcaggaaaactagctcatcagaattggatgaatgcagcgataacgagagctttagtttaatagtaaaacacaaaactcaaaattcaaacatgaaaaaaggatttattaactcaactagtaattcgaaaaatggaaataatgatctagattgggatacaatcatacatattattgatactgatgtgatcgaaggaatggtaattattgaagattcaaatgaataa

SEQ ID NO: 649 - DNA, 1203 bp, Cryptosporidium hominis
atgaacattttctcaagaccaaattggtttgtttacgatatttgcgggatattatgcatgattcttacagaactcctactattatattcagctttgatattaaatttctttttcataaagaaatttcttgattcaggagaacggattttatttatatttaatttaatactttgtaactctatatatataatttgttcattttgtcatctatcatgtaccacaactgatcccggagtgatgccaaacaatggtgataaaggcgaaattttattacctattgaacttcagactcaaactgtttctattcgctcatgcgcgaaatgtaataatctaaaacctccaaggacgcaccattgttcggtttgcaaaaggtgcatatttaaaatggaccaccactgtccctggattaataattgtgttggaataaataatcaaaaacattttttgctatttttggcttatgtgttccttttttgtgcttattcgctaatacttatttgcattcgtttttataaatgcatctcatattctttaccaaatccaagcgatattaatgactcttatttagattttcagcttttaagctctacaactgaattattaaattttaaccaaaaagccaatgaaacgccctactatgactgtaccatcactccaatatcgtttatactcggttttagtgtgattattgagggcttgatatttggaattttctgtatagcaatgtttgttgatcaagtcatttgtatcatcaataatacaactggaattgaacatttaaaacaagaatacttatatagtaaaaaaaaaagtgcatattccttatttattcaggtttttggctcgaagttttcgtggagatggtttttacctactatgacaaggccaccatttacaactagtaattttgatatatccaaatttcttgactttgagtttggagaccttattattgaccctgaaactggatttgattgtgatcaatcaaagcaagacatacaaagctacgatagctcaattttgttcaaaaggatgaaatcaaacagaataagttgttgtttcatttgtgagggaattgattcatcaaatatgtcgattcccaatgtttcagaagatttctctatttttgaaaatgaagtaagaaaaggtggcacaagcaatcctagttttaaagaaattctaatggatgatttacacagatga

SEQ ID NO: 650 - DNA, 291 bp, Cryptosporidium hominis
atgggtaaggcaggaaaaggtacaggtagtcgtggtaagcaccatggtaagactcatttcctatgccgtcgttgtggccaaagatcctatatggttcaaaagaaacgatgcgcttcatgtggttatccatcagcaaaaatgagatcatacaactggggtcaaaaggcgaagagacgtagaacaactggaactggtagaatgaggcatctcaagaccatggctagacgctttaagaatggatttagagagggaactgtagcaagaccgttgaatatggcagctcataagtaa

SEQ ID NO: 651 - DNA, 216 bp, Cryptosporidium hominis
atggcagaatcttttggcattagtcaagagtttttagaaaaagatattgtaaccttcatatcttcttcaaaactctcatgtacaattgacagagttaagcaagtaataatctgtagtagaaatgacaaaaaaataaatcaatataacgagctcgttcaaaaaggtgacttattgctaaatagattgcagagacttacgcgtattattcaagtttag

SEQ ID NO: 652 - DNA, 855 bp, Cryptosporidium hominis
atgaacaaaacgatttcttctgacaaccttaaggacgcagttagaaagtggcatgcaaagagaaaaaaagactcaaataaccaagcaaatagtgaaaacacgggatcagaacctgaaggtatatttggtacaaagaagcatgacgttagacacatttctgcatggagccacaataattttgctgaatcaaaccaattatctcacttcacaaatgagcaaaaaagaccaagatcgactgtaatagagaacaacattaaatatatatttgatgggcctttgtcttttgatactataatggcattgaaaaagaaaaaatcaaatgttatttttagcaataatgaaaaaatgctcaataaccccaatattgaacaaaatgattctaaaagcgcaataaatcaatgctacacacatcaaactaacaactctcaggtaatggacaattttaaagatgaaattgatattatatactcgaagtctataagcgctgcccaaaattttttcaagagcagttcaatctcggaggtaattaatttactagaatacattttaaactttttatcattcagcactcaagagttgattagtagatataataaaaaagcttattttgacaggcatgagaagtcactaggcatttgcattaattttattttaaacaaatctaatctaacggatgaacagtttgacgaaatatcactggagtaccttgccaaatatcctaaagtttttgaatcacttaagacattgaccaaaatcaatgggttagatgatgtggtacccagcgaaataagtaatcatcttcaaaagttaaactcgcagattgacaagatttacaatttgctattaaataggtaa

SEQ ID NO: 653 - DNA, 2505 bp, Cryptosporidium hominis
atggataatggttttccgatatctcttcttttagttaactataaggaatttgttagtatttttttggatatcccaaactgggaaagactaaaatcaaatagtattggaagatacatagaaaacagagtcaacataatacagaaacaaatattgttaaatggagaaacaagttactggaaatttgaacagtctttatgcattcttcttcgcttatcaacttgcctaaatccctactcagatattcgagagtctatttccaatagttggcaatcaattatcaacagtttgaatgaaacatggtcaattggttcaagaagagacgaagacccaaagaagttattaacggagtataatagcacattattttatacaaaaatcaaagatatacacccggatttgttattcagcatcaccctgggaggaagttgcatttcaattagagaagcaatcaaaatatttacatcagaaaatagcgaaaataatcaacattgtcttccttgtggaagattcatttctccagagtatttagttcctggtacccctgggttttttcctaataacaagttttatttagatgagaatgaaactttttggaaagatgttttcaatacatttcatgggagaattccgtctgtatttagaattgtttacatacttccagagtatgcaaaagcgctactcaaatcttacaaaataaatatggaagatcaaaactttggtgctttaccactgcactaccgtcactttattgggattttatgttcatccttatacgacaacgattacatgatcaaattagaaatgcaaatgtacgtatttaacaatggtccaattgaatggttggaaaatccttcagattctctaccagttaaattctttgcgctttttgaatttctaaaatgtattacattcgaacctgcctacatttctaatgaacttatgaatcatctgataggagaagtttcagatactcaagtttggacaataacagaactatgccatattttatgtattgttacaacaatacaatcaatatcgcaattgtcatgttcatttggaataacatctatggatcattgggagcttggcccagatccattggaaggaccaaattgcgatggaaatacatgctacaaaccaaacccagccactatgaaagattgttttgaatatcgaaaggtaatctcgtcgaatttttttcatgaaaattcaaatcccgatagcttaacaacatcatactataaagaaattttatcagaatatatagatgtagaaaaagaagaaaaaaattatacccatcgtataaaaaacaatcattcaacttcaaatacaaacaaaaatatgtcaatgccaaaattaagttttttaaagcttccaattttcagtttaaacaagatttacaacctcagattattttctcaaataaactcctttatagatttaaagtggatattagatagcacaattagtgcaaagttaaaaaggaaacaaattaacgaggggaaagactactttaatttagatagaacgtccttattttcagatagtcaaattagatccaatgaatatctgcgagaatacactcaaatcaacactaagaattttaatgataatgaaaaaaatcttgagagtgagtatcattcaaaacaaaaatatgaaggagagatttcaactttgattagaataaaagatttgcttaatcactttccgccccaaggcgatattttaggtattagcaaagacgaaattcctctattcagatcaaactctgacaaacataaggctgatcgagttcttctttcttctgtgatgaattctaaaccaaaattgcagtttaattctttatccggaagattcaaacatataagcaactttattggggcagaaagccctaatttagttctaaataagctggaatccaacaaaaaatttagttttaaagacaatgaaaagacctttgagtttagaaaaaacaaaaaagaattgaagaatggatgccttacaaataaaaatgcgcacttcatgagcatgcttaatagtttttcaattcaaatgctagaatatgaattctattctgaaactgcatggtctgttttatcgatttactcaggagaatgctcaaagtgtattaaggacgaattagacattcttttatataactgtaataagaacattacaacaatttgtgatatttataaggttcccacaactaatcccataaggtcttcaatctggagctacgtatttaaactatgtggaattgtcaaatttgaaatgacagaattggttcacaacagcttccttcccctcgaattaaaagttttactcaaaaagacaattcgatctcctcagagaattctacgctcagacttcgaaaggtgtagaatagttttttcatatacagaattaatatattacctaatagtcgtatgcaaggcaaaacaagctgtaactataatctgttcgatacaatcattatcaaatattttaaagggtgctcagtga

SEQ ID NO: 654 - DNA, 1386 bp, Cryptosporidium hominis
atggaagggatacaaattcctgaaatatatatcaactctgatatgatcttatcttttgatgaagaggcttgcaattggaatgagacatcaagcaatttaagcaactctcctaaaattttgaatacaagtattcaaaataccagtaataagttaaatgtaaatgttaacgtaaacgtaaacggaaatgtaaattacagtcatagtaattccaagtgtagcttcagtacgaacaatatttcagaagaagtgaacgcttctgaatgcaatccaaaatttctagaaatacacagaggtaatacaaatcataaaaagatttcagagtctatctcattttctcaagaagaaactccgaaatcaataataatagactgtttattaaaagatcaaaaccaatttaaaactgaaaatcaatatgtggagtccagtcaaaacctcaatttgttttcgtatttggagaataatcttacagaaaaggtaaattcagacaaatttaaatcaattaataaagaaaataacatggcaaggaggcgtagagacgacccaaaactttgctggagatgtcacaagcgtgatgcaacaccccatatgagatcatgcgagccctgtagagttgcagatagacagagatggtcaagaaggagaaacttgtcaaaaattatttcaggtaaaaatgtaaataataataattccgagcacagtgttaaccattttaataaccagttaaaagatgattcatctatttctctatgttcagacaatcaaaaaattgatacttttaatggtggatatatccaaaacagcacacagttaaagtgcgataatcaatatatatccggtacaaacgagcattacagagcttttaataccggaatttctaatgcaaatagctcggcacaagttacaggattttcagtaggatatccatttaaaacagatcaatggcgtgaacaacaacagtctatttcatttagagaaaacaggaatattcatccatgcgcagaaatttcgcaaaatctttcttacattacaatttcatactttccatcatcatttagtggccttacaacactgccagttagtgcaaaatttgcttccgatgggtccatgaatggattagagaccctcccatccgtagttttatcctttattgttgataaatgcaatgagcagctccttcagagacaattaggaaggcaaaatcaccaaaacctggtatctagcaatacaccatgtaattcccaagttgaatcaggactgggaaatattttaatgagtaatgtagaagctaataaaaatataaatggaactggaggtattggctcattccataactttcattgtgctaatattcatagtaatacattagattctagattttactgttga

SEQ ID NO: 655 - DNA, 2022 bp, Cryptosporidium hominis
atggtcaggtcaatattatttgctcttcctcctattcctgttggactacatagggaattagcttctggaccagtgattcaaagtagtgttgcagagtttgcttttaaaaaaaagatagaaccggttggtgaggcatttttttacaggtatgaagggaaatactcaagtaaaattaattttttaaaagaagaaattaaaattgaaaattcgattcctatcaataatatttattctcaagaagagtgtcaaaaaaaatctaagaaaatatctggaaacaaacttgccaagggcgttttatcgttggcacgcctgaaagagctagttgaagaaaaggaaactctctataaaaaattaggattggatgaaaatgtatgtgttaaggaaattaaacaggcatacagaaaactagtgctttcataccatcctgataaaaataaggaaaatagttcagacgcaaggtccgaagaatttcttaaaattcaggaagcatatgaaatattgagcgataagaatctgaggcacgcatacgattctgcattgccatttgacgattccataccaagtgtttacgttagcgaaaataatgatttttacgaatttaaaaactttttttcacctatttttcgcagaaattcacgatggtcaatagtaaaaccagtccctgaaataggaaacattgatgacaatattgaagttattgaaaacttttatgaattttggagaggattccaatcgaatagagactttagtattcatgaagagcatgagctgaaccatgcggaatgtagagaagaaaaaaggtggatggaacgacaaaattttaaaattcgctcaaaatatattagaaatgaaatttctagaattaacaggcttgtcgatctcgcatataaaaatgatccaaggattaaacaacactttgaaaatcttaataaaagaaaagaagaggaaaagcgcaagaaaatagaacagaagaaaattgaggaagaggaaaagcgtctaatggatgaacaacagaaaaaaaaagcaattgagctaaaatcagcgattaaatcattgcgaatttcaataaggaacaaaatgaaaaatatttccgatgtaaatattttttttgataaatttcaaaaagaagatttctcagtttgtttaaaaactattgaggactttaattggattaatatttttttaaaaaacatacatttaaccgaagtagtccaaatccattccattgaaaaaattaatctaaaacaatgggaagaatggctccttaaattagatcactttcaacttgagcatttagacaattttttgaataaatggattgaagtgtttggcgagaattgcagtgatgattatttgaaaaaattatacttgatttttactattaaaatccttcacataaacaattttgatgcgaacaagtctttacaacctacgaaaaaaaccaatgaaagcaatatgtctaatctttcgaacgattgcgtaactgtaaataccgaaaatttatcttctgattggacagtttcagaaatgagtctgctcgcaaaagctctccaaaaatatcccggtggttacaaaaatagatgggatatgatttccgaatatcttaaaaatacgaaaacaaaggagcagatattaacaaaagttaaagaactatccgagtctgagaaattggcaaagctttctaatgaagtcaaagaagagtcggcctttgacacatttattcagtctaacaaaggcgttttaaaaaaatttgacaatattcccgatgttagagattattcaggtacttcaatcataaacaatagcgcaaaaaatgatgttacacaccagaagaaagaaattgatctttggactagagaccaacaatgttcattagagagagcattgaaacaatatccttcttctttacctttaaatgaaaggtgggagttaatctcttcttgtattccaggaaaagattcatcgcaatgtcttgctagatacaaattaataagagaacggttattaaagaaacaaaagtaa

SEQ ID NO: 656 - DNA, 1038 bp, Cryptosporidium hominis
atgatttttttaactccaattcttccgattttatcatgtttttgcttgcactatttatggaaatattttgagaaggagtttggaatcattacatcactcctttcaatttcaattttaataattactttttatggtgcatatatttattttaaaaaatcgctctatattgaaattgattttggaaagtttgccaacaaaaaagaggatttcactgaattcaacagtaatttgatgcttagcgttttcgaaaggtataacagggaaagagaaaactgtttgaatggtggtctggttgctgttaaacaaggagaagacgatcctagcgagattaaaaataaaaaatttgtatctcaaagtgaaacgcattcaagcgaaatgaaagatactgatatattatttcatgactctaagctatcgttttttggtttaagcatgaattcacctaatactagcaaaaaattatatcaacataataactgttataattcctcacataagatttgcagcccttcactactggcagatacctttattcaagcggcagacatcgcaagaaactatcaaagtgagcactaccgtggtatacataacaatagccaattacaacattcgaatattttgataggcagcaatacaaatacattggctaaggctgcagaaacaaaaaactctaattcgcgattattcagatctgttggatattcttttcactcgaatatagaatttgctagaagcagattcgaagactacatttcctcgttacaattcagaattacaaacaaaagagtaaggaactcattgcctggaaggctcctttccagcgtatcaaattcagaaagtggtattaagaaaaacgcaataagcaaacacagacagtcttcaattcctagtattttaattgaatcaattgatgataaatctactaaagctaaagccaatagctctactccaacaagaaagatatataatagcttcttgtctccattgccaacatcaaaaccatctccgatcttattatttacagacaataagaattaa

SEQ ID NO: 657 - DNA, 1680 bp, Cryptosporidium hominis
atgtacgattcttcaaatcagaatatttcctgtaaaggaaagctagcattatcaggaggccacctatcgactttgtctacaaaaaattctgctccatctccaagctacataattggtccaagcaagcagtctgcaacaataagcggatggaatagattaaactccagtttaggatctcaaataactaatcttgcaagctttatccatagaagagcagggagaatttccagatctcctagccctgtaagagggaatataaatttaaaggaaattcgaagctcaaggcttgaattaagcactgaaagatcactagaagagctttcaaagcaaacacttaactcatttttaagcattgaaaagagaaatggaaattcaaatctcggactttcctttggatctatttctaaagaaataaactcagcaaaacaaataggagaatccgcaatttgcaacgaaaaaagcatatacgaagaaaacagggaattaaaaaaacaaatatctgaattgaaggaaataattatatgtaaagagggagaaaaccaaatgttaaaattaaaattagaattatttcacaaagaaatgattaaattttccggtatttcactacaaggtagagagtctcttccacctttgaaagttaaagctagaaataataaacacgctaataaagaactggatgaagattcattcaaactttatatttgtggagactactcaaatgacgataatgaagtgttctctagaaaaaaatgtatttggaggccatgcgaagaattggccaagaataatcttacagaaatgggaattagttttgcgtgtgttaagggcaaaagaataaataaaagtatggtgaatcaagacgatttctgcattgtaaagctagctaataataccttaattattggggtttttgatgggcacgggcgttatggacataaagttactgcaattgtaaggcaaaagatcattaagggaatacagagtatctttttgggtatgcctttcaaatttgaggataatagccaaatttcagatatcacttataatcataatttaggttcactacaagaacttaaccaaaaaagaattattatttcgattttgaaaatattcgagggaattcaaggctatttagaaagagaaggttcttttggaacttctggcacaagcgttacttttgcaataattgacttcgaaaggttaattatggtacagttagggagttcagggggaattattgtagattcaaatacaggtgacacgatttattcaaccccaaggcacgatttaagcaatattgttgagaaagagagaataataggtaatggagccactatcaatgaaaataacaggttttctttaaatcgtattgaagaaaaaaagccacaacttttctctattacaagaagtctaggagactctgatggaagagtagttgggatttcaaataagcctgagatatgggaaatgaaaatagaaaaagggagttcaatgaaagttattctggcaactgatgggttcctcaaattttcagatgaggcaagcatagattataacaagctctgcatacaaaaagagcttgattcagcaataaaaaaatgtcaaggcttttggttaaattcgacaaataatacgtctgttgatgatattactgttatttcgtgtaatatttcaaattaa

SEQ ID NO: 658 - DNA, 924 bp, Cryptosporidium hominis
atgaaaggtgactctgaagttagtactaaccccaatagtaaaattctagcagaattagcccctgaaataaaaaactacctgcattttcctgatgaagccaatttatatcccaatcaattaatgtgcagaaggataattgttaatgatgagaatggttttgaaaagtctaaatatagtgtttttgatgatttattaattggagatttaaactttttactaagaattatagatgctaaatataatgcttgcactattctaaaaaggataaggttgagcgaaatagttgaaaattataaagtttttgaagataaagaagttaacgaagaatctaatctcttggatatattacaccttttccccaaaaactatacttctgaaaataaagcaattaatatccatgattcagttttgatggacagatattcctttggtaggacaatgagtgatattatgcttattttgcagtgtttgcctacaagaaaagccaatagcgaattgtgtactttgtttgactcagagattaaccctcccatttccattaaagattattttacaaggctttctgagtacttcttatgtagcccatctttatttgtgttaatgttcatttatattaaaagaattattgacaataatccatcatatattttcgacacgaaaagcgcgcatcgccttatgctggcaactttagtcatttcagttaagctgtacgacgacaagtttttaccaaatactcactacgcacatgttggaggtgtttcagagactgaattatctagattggaagtagacgcgctactactcatagattttaggttgaaggtaacaatagaggagtttgtcaaattttcttattcattaaggtttttaggagaagtaataaagaaatatggcatagctctcagagattcaaatgtaatatga

SEQ ID NO: 659 - DNA, 1317 bp, Cryptosporidium hominis
atggttaaatttggtacatacattatagagaacaatgataatggaccacaattaataagaagagaaaagtctgggccattgattgtcttaaaggttggaacatcaactttaacaaatagcaggacaggcaaactttcggtttcaaatatcggtgcgttggtggaaacagtctgtgatttaatggataaaggatgtagagttgtattagtgtcttccggggctgttggagctgggttgcttcacatgaatatcagagaaaaaccaaataagcttcacctgaaacatgcaatagctgctattggccagccactactaatgagagtttatgaagactttttttctatgagaggcgcaaaagttgctcaattactaatgactagatcagactttgtcaacaaagatagatttattgactttaagaacacactattggatttgatacattggaacgttgtcccaataataaatgaaaatgactctgtaacaactattgatcttcatttcggcgataatgatacactagcagcttactgtgcaattgcaatatcagcagattggttaatattggctactgatgttgatgcactttttacaaaaaatcctcgacttcatagagatgccgttccaatactaaaagtaaacaatattgattccattattcatatggaaaatgacgtttcagatgaaaattgtggcactaattttggaactggaggcatgagaactaagatttttgctgcgaggattgcggctgcagccggaatttcaacatttttagtgaatgggtcgcaccccaacagactattgcaactagtagactcaatagattttaaaatgaataaggctcataataacaatgcaataagttcgtattatagtcctactagtgaagccaatgatttagaaaaggttagtctgtgtgaaagcttggatatgaattctagtagcattgaaagccttgctgatacaaaaacatgtttcgagcattcctactcctctatagttggtaactttatcgaggaaaccccagaatcaacacaagtagataatggtataattacatgtgctttagaagaactatatcaaggagaatacattggtactatttttgctaggcaggctctaactcaagctatgaaaaatcataaaaggtggataatgagcctacctatttctgggaaaatatttctcgataaaggagccatcaaatctgttactgtcgactcaaaatcccttttttctgtgggaattgtcaacgtgaagggtaaatttgaaacaggagatgttgtttccattatttgcgacggagacaaatga

SEQ ID NO: 660 - DNA, 1632 bp, Cryptosporidium hominis
atggactttttaaattttccaaaattcttgtttggaaacatatatgaaaggatatatgaatgttgtgtagtgaatgagcttaaacaagaaaaaaaagttcaacagcaaaaaaagctaaaatttaataacttaaatatattattttacaatcaaaaagactttcaagcaaacaaatactctttaagaggatgcatgacatccagaaacaactataattttcaaaaaagtgaagagttttttacgtgtagaaaactatacaatgaatcaaagctagctgcttgtgaatatacaattcctattgaaaaaacccacagacagtccattgaagattataattcaaattgttggttaagtcagaaaaaaaaatctggattcaaaattaatataattccatctaataaaacgcaaataactcctattaatgtccaaaaggtagtaaagaatgaaaatgaatctgaaaaaaaaaactctaaaagtcaaattaatggagcgaaatacatcattcccatacttaatctcaattttactgaaaaaagaaatagcgagttaatgacatatagagaacatttttccgcatcgaataataaacagatttcaccgattctaagtaactttaaagataaaacacttgaaggtggtagaaagttacaaaatgaatggatcaatgtaaatatgcttcttttatctgcataccacgaccgtactatacaaagcactaaagcaaaaatcgagatgttaacattctatgcaattgaaatttgttttaaaaaaatagattctaaactccacataatcgaagaaggcagttttggaagggtttacaagggtaggtataataactgtgatgtcgcagttaaggtaccaaatctggatacaatgaaatcagacccatttggagttactgaaagaatcttgagagaatggaaactactagcaaaaattaaccatcctaatattattggtttcaaaggtggtataatattgcctaacaagcatatttggttaataacagaatttatacaaggctgcgacttacattcactaaagtataagtttaagtatgagattccaagagaaaaggccataaaaatgattaagcaattaattaaagccttagacttcctacacacaccaacaaaggaaaagggaataatcatccacagggatattaaaccagaaaatattattattgataataataattggaatatttatttgtgcgattttggagatgcagaagaatttggctcaggaaacaaaaggagactatcaggtgcaacatggctttactctccaatagaattattaaatgcagatccaataggaaatcatatatcaatacaaagcgtttcgcaatataacgagaagtgggatatttggtcgctgggatgtgtattacaggaattttttggaaattcaaatccttttgagtacattgtagatgttgcagataattctaaccagatttactcaaaactagtgaaagctgtgagagaaaataagtacatccccaatatacccacaaatatccaccctcaaattagaaaagtgatagagatgtgtcttcagccagatcctcgtcttaggcctagcgcaaaagttatattaaaaataatagataacgttttttaa

SEQ ID NO: 661 - DNA, 5061 bp, Cryptosporidium hominis
atggttagaaacgtaagatctaaatatgttgttggatttactattcatgctgggaaggggtttattactccgaatcaaagcccaataaacccattagttgtagtaaaatgttgcggaagagaatacaggagcaaaattaagtacaataagttaattgcgactcaatgggatgaatcccattcatggaacgatatatttttgactgattctgaatgggacatgtcatttattacttttgaggtacaatctgccaattcattttggaaaaatgatgttattgggcaatgttcaatacaattaaaaacacttaaacagagaaaaaatcactttttaaaaaggcatttcaacattactgagcttaatgatacttttccaaaaggattgctttatttaacagtatatgcatgcggtccgaatgatactcccccgacaagcgatatactggaattaatgaatgcagaagaagataagtttcagaataatcaagttgattttctaaatcaaattgtaggagctcacgaaatgaaaaaagagttctcaactttagaaagagaaaagcagatgtacaatttatatgtaacaatttatagagttgaagatttattattcaaaaaagggctaagagacccttttataacagtagagtttagtggttgtagtatgcaatcatcaattgctcgcggtgtactagatcataattttaatgagtgctttagatttcctgttgttgtaccaatcgttgaggatataataatattaaaattatgggataattcaacaaaacccccagcaatcattacacaaggaaagttttcatttgcgagagttagatctacaacaatccctgtaagatggtataacttttatggaaattctgcactaaatatagaacttgggaataaatattctaacgatattttctttacagaaaatgtttcttcccaaagcgatatttatttagggagaatacttatttctctaaaaacagagctattaagaaataaagatcaattaatgccggctcaagtgatagctgctcagccgcttgatgagctttttactcagccatgcaatataatcgcagatgtatactcaattaaaggcatttttggaagaaatgcatgcgtagaggtttcggttgggccaaataaacagagaactgaatttgtttcgcgtgaggtcgaaggacaaaattatgatgactgtaaaaacaatatggtgaataaatcaaaaaaacaacaaagtatggataattttgtctatggatcaacacaaggtagggttccaaatattgaaattgagtctcaatcaaaggaagaatttacttgggatataatcatatcagtttatactcacactaattcaaatgttaataaggtggatgctcaaggaatattgagtagtagtgagctggctcatggttccaaaagagttgcatattgtcgattaaaaataaccgacataccgcattacatcgaaaataagccactaccacctatttggattccattaaaacaaacaagagatggttggatagatatgatagataacaaagaaagaagctacaataatagatttgaacctttatcagagaccgaaaacgaaaaaaatattgaaactaacaatatacaagaaattgacttgtatagtattggctcaagtgctatcttgatctctatttctaagcaatttgcttcatcagtaaagcgtacaaagaggcacacaataaagtgtatagattatgagctaagatgttatttgtatgcttgcagaaatcttaatgaaacaggaaaagataggacaaatccctatatagtagtttcatgcaatggagtctatacaacatcttctgttaaagttaatactaataatccaacatttttagaatgcttatttttgagagtgaaaatagaatctgatcctttaacatcttttccaactgttgcgcccatcacaataagtgtattttcaagacatagttggggaaaaagatttatcggattatgtacctgcatatatgacagaattaatggaaggaataaaaataatgagcctattagtaccttagagccgttttggattaaattaaaaggtggtgcaaggttaaacaatcatgtcggcgatattttactttgtattgacattattaaactgtgcgattcaaaaatggtgccaccacaacctttatttccagaattaaaaagggtacagatgatagttactactactcttcttcaagatttatttatgatgactgaagaagatgttaaatataatattaagtcaaagctttcgcaggatgaagatttatcacttttaaaccaaggaataattggttcaaagattgaaaaatatagaattttaaaggagatgaatggtaatttttttcttgaaaatcatgaaaggggaaatgtatattcaacagaaataaaaaatccaattattgagtttactgtaagcgcttttggtagagttgatgctaccacagaaggatctgaaaatgttgatgataagctactaaaaaattcagagggtagaacaaaatcatctagtagcattccaacatataggcagattgtacagtggaagtctataacatccgccggggcaaaggaatttttcaataaatcttggaaaactttaagaggatacaacttcgaattcttcaagacaatctctctagatatttttttaccgttatcgccattatttgatccaagactcacaataagaatctttgaagggttagtagatgaatctaaactagttggtgagtttgttatatctttagtttcgtttctaccttggatacctgatgttgattctgctcacgagtggatttcttcaaaacatgatttttctaataacatagatattgcaaaaataacaaatgtattatcaaaaggatctaaaaaaaaaaacttaattaaacattctggcttagcaagtattgctcttgcagatatggaagaagataaagaaaaaaagatgaattcaacagcgcaccctttccctgctgtttcacaacaagaagaaatggaagaacttaaaaaaaaaagtttaatgaaccaggggttaaaccaagccggagttccaattactttaataaagtcctatactgtttccaatgtatattaccctaggatatcgcagaacatgttcacaattaatttacatatcccgtttcactttattattgttgcagagggaaagactactgataaaagaaataatttgaaaatcatgatatcaaattcagggatggatacaggaggagtgattactacaagcacatctggaaagacagtttcactccgcccatcaattgactcaactatggaagaatttctttcagatattcttattccaataattcctgtgagaaaaaaagggtttgatggaaagatgaagacatttgggtacttaaggggatatattctcttagcattgcctggggtactagatgaaattaattctaagaagagcaatgagaatattataaatgataatatagatgaagacgaaattatatctcaagaaataaaacaagcagttgagaataacaaaatttctagatgttacagccatgagatgatcagatacataataaatataaatagtttatataagaggatcaaaggtgataatgtgtacccaaatcctgttagagtacgtctatatatattgtccgcattggcactagtagtcccaattgactatagtgaaaatatttatcaggaatcacttgaaaaaaaaacgctctttgaaaaaattaaagataaactatcaataataaatatgtttgaacaaaacataaggataaaatcattttatatttcaattgtttacggttcaaaggaagaaaattttaggtcgactgcaaaggggacattaaaccctttattttacgtatgccaggagtataacgtaaactttccagttgaatctaggtttgagattagggtttggggaatacaagaaaaagtttatccatatctagcatgtaaaatacttgggttactaaatcaggaaaagaaagaagatgtcgaaaataccgatctgaatggaaattcgaataatgatttggttattaatgaaattaataatgaagtttgccaggagttgggacccgaatatgatgtttttattgggagtactgccatggacttaactgatagatggcatagcaaagaatggcgtcagatgatgagagaagatcatatacccattgaatatcgtccactatacagggactgcacaagcaatgtcaactatggtttgttacaaatgtgggttgaaattatgagttcaaataaagcagcagttacaaaaaggtatgagctttcagaaccggtaccaacagaagtggaggttagggtcattatctgggcaggaagagatataaaaactgcaaataatttagattatggagattatttatttaaatctaccctagattgcaaacagtatccagaatttaggccagattttggtaataataacccaagggtacaacagactgatgttcattataattgtagaactggggaacctgtttttaattggaggcttgtttatccgcatctggtaacaccaataagtggttgtttacttcaaatttcaatttaccattatagctcatttggaaatcacgaatttatcggcgaagttaatttggacttaagaaaatacataatgaatgttgcaaattcgttagaagcaattgatgaagatgtcgaattgccacttgtgaactcacaaagcgtagattcgtcatttgatgctggttttgtgcaagtcacaattcaaataattcctcagtcagaagcaaatagtaaaaaggttggaatggggagagatataccaaatagatttccgaaactagtaactccttcagttggaagaaactgggaggatttcttacaactgaaggaaaggcaggatgcgcttagacctatttggctgaaaataagaatcgtttatataatttttgcgatattattattttttatcataggtgcggtatatcctgcattgttttaccagtcaatttattcctaa

SEQ ID NO: 662 - DNA, 507 bp, Cryptosporidium hominis
atgagtgatcgtttttcactcttttctctatcaaaaatttcaattagcgacttattaatgttaaaagagaaaaaatgtgaaaataaaattgaaaatgcaaaatttatcacaaagtcatcgaatcttgaagacatttttacagaagattttaagcaaaaaatggagagaaacaaaatttgtttgagcgtgaaggcgcaaggtgatgttctaactcattttcctcttttcttaaataaaccatttacttctaatgaaaacaataaatctttatctggaacaattgatacaaaaaaagaaaatcttcatttaaatcaaacgaacaatagtgctatttcaaaaaaaagaagtaaaattaataaaataattgaaactaatattggagatcatttgatttatgaaatgaagattaacaaaaatcgattcgcaagaaaagagttaactagcacaaaattaatttggaattcaattcaagaaaatattaaaagtattatttcttctactgaatag

SEQ ID NO: 663 - DNA, 366 bp, Cryptosporidium hominis
atgtttaatccaatttctcaaaataatagaatcttaattgatcattgtaacataccttgcaacttcatttttaggtcagactcaaatgcagaagatattgaagggtttgcaggagcaggagtatttcagtcagttccattattcgatcctattagtaaatatgttaagtatctgagtcagccaataataaaagaccaagattacagaaatgaagctctgagacaattggcaacaatagcattttatgttcaagatgaatttgacgaaataccacaggatattgagggctgtataattgaagattgccaaggatcaagcataaaatcatttagtatagctattgtacagtcaagaccccaggtttag

SEQ ID NO: 664 - DNA, 2955 bp, Cryptosporidium hominis
atgttggatcggacaataagagggaaaaagagctggagaaatctttcaaatttttgttcatctgcagaatacaacgaaataagtgaagattcaactgaaatcgatatgcctgaaataaataaagtagatgattacatatttgaacaagaagttgaaataaaaatcaaattaatagattcaatgccatttgatcggttcgtttgtgtctttaagacattagacgagaatggtcatgtttgttggcacaaggaaggagataaagatatagaaattgtaatctccttccaagaaaaaaaaaatgatagatggaaaggaatttggtcagatatagtatttgatatcattaatgcagaagttgaatggggaagtataactttgatgcacagatataatttaatggatcagattattaaaaaatggtcagatgaatttataaatggtacttacaaattcatatctaattcaaatgtaatattatggcatgagtttgaaaccaataacaaacgagagtctactgatcgtaatttgatagcaataaactccgtgaatattagagacgcaatactttgtggtgaagaattctgggcatggattatgatttggatgagacttaattctcttggagtattagattggcaaagaaattataacactgctccgaggttattagctcaatcagcagaaacagcttcattaaccctaatatcaaagtggctggagatgcctcaatacagataccaaattagattaattgcccagtcaattattagagggggatctcgtgggcaggaagtaagagataggatactacatataatgcataagaatcgtattccagaagatcatggaaccttttacgagcaatggcatcaaaaattacataataatacaactccggatgatgttggaatatgtcgttcaattattggataccttagaaacaatggtaatgaagaaattttttcaaaaatacttcatgaagaaggattatcttgggaaaaaattcgatcttatgaccgtccaattacttcaaagccatatattcctcctttcttggatgttaatactcttgcatctgattttgaacaatatttagaggtactggtggatgttcacgaagcatcaaaccttcaaagatcatttcattattcaagagagtacttggatgaaaaatcacaaaatatctgcgcatctgtgatatttggggaaaataaacggtttgataacaccaaagacttaaatgttttgcatggtcgattaatgcatgttaataaggcaagagaagaaattttaaatttgatttataatttatacggagggaaacaatcggatacagatactcgcaattttcgtgcaattaaagaaataatgtacttggatttaggcctggaaaacttgcagtgcatgtttatacaaacaatctgcactataaataacaactatgataatattatacatctaattgatgaaatgaattctttcatctggatattatttggtcatgacccctgtaataaagaattagaggcaattttttttgattggaaagaattcaaaatattgaataaatcaacaaaaaactatattcttattttgaagagtttagtagataggctacagctttttattggatcaatgatggataatattttttcaatatgggacccaaaagttactttctttggaagaagtattggtttatctaaagacgatccaataataaaaaattttatggatgaaattttgcgttctacactatattccacaatttcacttcagattaaacgaataaataaatatttattaaataaaactgatcctaatgaattgagtgattggcaatttattagttatcatccctcatggagagatgaccaaattttcactggaatttttaagaaattgaacaaaataacagaacttactgaagatccgtataagaaaataatttcttgctcgaatatttctggagaggaagatattccaatgaatgtaattgggataattttgacaaaccctgaaaattcaccagatttactttctcatttatcggttagagcaaggaatatgaatgttttactagttgtttctcaaaaccctcaaatttcagaattcattaattctatagaggaaaatgaaataattaatttaaaaattagaagcgatttgaggcttgagatcagtaaaaacaatgagattttagataaaaatgaattgattgcaaccaaatctttgaatcaagtaaaggtaaagcataaatcaagatttttcgaatttaaaaacaagattaaaggcttaaacaaatgggtcttgttaccatgcgaaatggataataataatgtcgggcaaaaggcattaaaccttgtcaagctaagacgattatttacatcaaaaagtattgaactacctttttttgtaccaagttgtgtttctttaccatttggtacattgaacaaattattgaacagcagcacatttgaaaaaataacttcccaactaaatattcttgaagaacaatgtaaactagaaaatccagaggcatttgaaatacttaaaaatgtttgcaatatcattgaatatgaagtcgagccatgcaatcaactaattgaggaattaataaatgcgatgaaaatacttgtacagctagatttagaaaatataaatgttgatactataaaagaaattaataaagaaaggattcaaaaacattccaactcgatgaaattaatttgggagaaaattataaaggtttggatgtctgtatatcagccaatttcattcttgaacatgaaaaaaattggattaccactgtcaaatgtatacatgtcgattgcaattcaaaggttaatgaatgccaaatacgcttttgtactacacagtaaaaacccaattcagaataagaatattaacttaacagaatacgaagagatgtatggagaattggttatggattag

SEQ ID NO: 665 - DNA, 1689 bp, Cryptosporidium hominis
atggaggacgaatcaccagttggctctccaattctaatattagataaaagcgatcctgtatttaatagtgaatccgaagatgaaaatgtttcttattctgtgattgatgtggaaaggagagagagggtggtggagacgttttcttggagtcctcaaggaagaggggcagaagctgagtgtagaatttctattgaggagtttagaattcgaataaaaaatctttgccaagactattttttagattttaaaacccaagactttatcaatggactaaaatgtatttcttgcccttccttacataatttagtgatagtaattactatcagaatggcattagattatagtttgagcgtgcaacaacaagtatcagcactgctaacgatattaaaagactctcacttgattactcaacaacaaattgaagatggtttagaaaagcttatccagtctatagacgatatatgtttggatgcaccctattctccggagagactggaatgccttatagattgcgcaatagttgacggcattattccatctaatttcagatgtaggtatcctgaagcttttctaaacaagctgattgaacttcgtagaatatcagaaaataatccaaaagaaatttttaatgcaagtgaaatagaggggctgaatcttcatctaaaaactcttagaacattcaagtcatttatacttgaaaatgaggaggacttcttttcttcaggttttaacattactgaagttgaaaaaataatatcagatgcccatttggcagcttataaaactgcattttggaatggaattgactggacggctagttctttcgcggaaaagtcttccagcgaaaccaattcagttccctcaacattgtgtttcaatcacgagtttgtaaagaatattgtaatttcatcaatgagccggaacaatttacaaagagagctagtttctaatgggttgaatttattatcgccttcgataatcaattcagttgacatctcacttggatttatgaggattcttggaaacttagatgatttatctctagatgtgcttaatgcatgcgaccttacaactaaatttatcgcaagatgtattgtggacgaactacttccaccttcatttataacggtgaattcaattcttcatatgggaggtcctggcggaactcaagctttgaatatgtccgagcagtttttacgcaacaagccgagaaatttgttgagacatcaaacacaaaatatttggttgcaaagtgaagatgtgaaggaggatattttaatcaagatggaagttacaaaagcactagataaatattcaatttctcttgacaaaagagaatgcataaaaacacttcactcactaccattaacacaaacaaataaaaaatacttagttaagtatattattcttcactttattgaaaaagtatcgctaggttcagatgatcaatttaaaaataatttcgtagagttttgtgaccgtgagatgagagcaggtatatctttactagagtacttattgagccaagggttccttgatgaggatacaattatggaaggatttcatatatatctagatactacacgtgactttgcatcagtagaccagcaaacacaagaggttttttcagtttttgtttcaaaagcaatagaacgcgccctgcttccatataattggaaaacaaactag

SEQ ID NO: 666 - DNA, 5910 bp, Cryptosporidium hominis
atgagcgatttttcttggccaaaaagtgatgttagaaaatatgaaaatgaaatttatagtatccttcaaagttttgaaaaagcacaggaatgggctgatcttagcaattgcctacaaagattaaacagatgtattagcaaagagttctgcgatattccaggagtacctctcaaagaaactatttcaaagagacttgcccaatgtttgaatccgtctttacctagcggtgttcatactaaagctttagagacttatggaggaatatttgggaaaataggcaagaatgaattaagctctgatcttgcactgtatggatccgggcttttcccattttttgttcactcgtcaacacaagttaagcccatctttcttgacttaattgaccaatattttttgcctttaggtccaggtttgcttccatgtttatccgggttaatagtagggctactcccagggctagaggattcgaaaagcgaatgctatgatagaataatgaagacattccaatcaatatcaagcagaaattgcgttggagaaaaaaattttatgtgcaccctatggctagttattttgagaacaacacaagttaggtatcctgctttagaagtgatattagcaaggttctcaactatctatacatctaataaaattatttctatgaagaaaattcagagtcttatcccttgtagtattctctttttgaaagctcttgaatcttgtattgatgatgaaaatattttggttaaaagatatcttttggatttcctaatttctcatgttcctattaatcaacgaactagtttaaaactttattatagccatattgaagaaatattgcctcataaatcaaaagttaacttacttaggaaagcactgaaactttttttaataagagaatggtcattaacaaggaggttgatacaatggattatgaatgataaatacttttctccagaaaaaaaaaatgaatataaaatggatgatgaaatagtgcaaacattaattgctgctattattgaggagttaattttctcattttcactcttagacaattatttctcggtttctgaaaatagctcaagctttgcaaaatatcaatcaattaggatttcaaaaaaccccaatagcttgcagcaaacaaataatttagcaaatcaaacaactattcttcagcctattaagatgattaatgcattatttgaagaatttgttcaatgtgtgaactttattgctcctaaaatattgattccaatatttatgtattctagagaattgacgataaaggttccagagttaaaagattctataatcaaagaatgcagatctcttataaattcaactaatttaaacccaaatatttttttaaacacaattaattcaacttttttgaatcttttaaaaaaaaaaacagaaaaagtgattattgatccaaatgaatctttagttacaagccctacacccttactcttgaaagaaattattttgttttacgttgataacttcttactgaaccaagaagctgaagataattcattagaatctttctttatggatttgtttataattttaattaaaattatggttgaatttaaggctgaagagaaagaaatgatcatttttaccgaactatgtatattttctttaaataatctaagagctttcaaggagattaataataatgatacacttgaatcttcaattgaaacactcaaacaatttattggattcatctcaactttcttatatgaaaatgtgtttactgaagataaaattactctcagaaacctactttatgaagctttaactaaactatttaatattaaaatattcaatgaaatattactaagccaaatggatatgtctagcttatccccttttgaaaagtttccaattccatcttggctctataaattattcagtcgattaattgaagtggatttcacagaatactcacttctaaaattagaaaactatcatattgaagacttttttaaatgccttaaaattataattgatttattatttaattcgaatttgttttctaaagaagaatttataccatcttgttgggcagaatgtactctcaaaatagtgaagatgctttggggctttctcgatccagaacttttcagatttcatgaacctacaacaaatctattgattgacttagaaaactgggcccaggtaaattttagtcgtatatcaaaccaaatcaatatccacagtcaagcttcagttattaggggaagttctattttgaatcaattatttataagccagttaagtgtattggacattgaccttagaattaaaaatatcaaaaaattatctatttttatgaaatattcagtaaattctatttacaatattccaccagaggtgacgtttctaattctagaaggtctagattcaaactccattcaacttaaatcatcttgttcaatttggattatacaagctatggaaactccaaaattaattttggaccatcttcttggtgacttatcaggatttgaattcgtccttttaacgaataaaaggttacaatataaagacggcttagattttgcaagaataatctattctttggaacgattagttgccttaatatcaatggaaaatattaatattattcaagtattttttgatacaaaaattgataaattatcaatctcgtttaatatttttcaatatgaaatattaaattatttcgaagcattcgcttttatttgtcttgcattatttattgctgatattccaaattcaagtgatttaagggtgaattgtacagcaattaattctttgaattttattttaaataaaatatgtaataactatgtagtttcaaagaaattcaactatgaagacaaattaatgactattttgtataatattataaacttagtattggaggctttgcaggaatcaataacaacaaggaaatacccattacaagcaccgactattcaacttctgaatacaatactacttattcaaaggcaatataaaagtattagtaataaacttgagccatcctaccttatttcagcaaataccaagctttttacgattttgatcagtggaatacagcaaaccccaaatttatccaacaatcaaattgaaattaataaaaatgactattatattttttcaacaaattactcatctatttcatcgtgctcgtcactaataaaaccatatttagacctttcactatccatttttgaagaccttgatcaagaaacccttattcaaaatgctaaatccataattttatgtttgtgtatggaacttgttgtatctatttctaacaaaaactattcagcaattttacaatacttggattcaattttaaaagttttattgaatgttattggaattttacccacttcaaatactctcagtgaatctaaacctaataattttcagaataattcaggatttatttattcgctttttagttcgcaaaagtcctatccaaataaaaactgtaatattgaactcaactccttagttaacactcctcaactacttaataatccacctgaaacaattagctctgtaacaaaaatttcaaaatctttaattttgaagaatacaattttaatcttgtttagtgctttaattgaatcagtcaactttgtacatgaaattagattgacaaaagaaaccgcaaatcttgatatggtatgttctcaaattttacgttatgtagattcaattgcatttattattgcttggaatgcttcagatgcatttgttttttcaggaattgcctgttggtctcatgtaaataatcaaataataaaaacaaaatcaagaaattcattaaatcaagaaaatacgaataatgacttaagaaatatttcaattatttcaatatttcagttaaattcaataaaagaattgattggccctgcaaccattttttctgtagttggtgactttctttcatatttttggctcaattcaagtgttgtcggtactccaaacagtacgaagtttaaccataataatgaaactcaagatacaaaggttcctagttacgtattattcttttcaaaaattaccatagataaaggttggatctattgttataaactttggaaagaaacaatggtttaccactttttatacactgttctcgtaacgtcttcattttcaaatggtcaagatgaatttcttaatctttgggaaattatttcaacattacttaatttatttcttcaaaatgttaaacaaccaaaaagtatattatggtttgcaacaatactttcaacacttgatagttctatgtcctcctcaaaagacgtgccttcatcttttttccttgataaaagacttttatgtatttttgaagataaaaaaatgattaaaaatttaaataatttgatttatatggtactatttttattacaagaaaatttctcgtcaaaagtttcaggggctgttcttcctcaacaatttgataaatttccgccccttcctccaaatattgaggcaattctccaatcaatagaatttgatttttctcatgaatcacagcttccccgtgaaatctcgaatattcagggaaatagtccgaaatcaattgttagtgatgaccccagtttacttttttcatattattctctggggttcctaattatgtataatactgaggttgcgttccatgcaagtaacaaaaggctgtttcttagaaatatttggggttcatgtatagttaaatcattagattggatgttccaacccttgctaaaaaggaataataatgtcgcaaatatgattcataaatactttctgttacttcacattgacacatttccttttaggattttcccagactatccttcaggtatcagaaagccagtaattgaagctttgaactcacctaattttttctgtattgacagaagaacatttagatgctggacaaatattatttcaaagctagtctcatacgattcaacttcattatctgctgttggtagagttaatatccttgaaacttatgtttctttacaaagtatgggaatttttagtacaaaagctgcagaacttcaaaataggtgcaaccacataaaaagacttgcttttttaattttttgctgcccagagaatacgtttcaattacaactttcactcattttagaaaaattggttgaaaatttaaaactggctccagaatatttaattgattctgactcaaatattaccctccatttcgtttatttagcagagcaagttatactatgcctcagagtacttttactgaaagtacactatcaatctttaatgccactttggccaatagttctagcagaattaattaaaatttttagattaaaaaatcacaagaggcttaaaatttcagcaatgaaattcgttgacttggcatctttattggatattcctgaattccacctctatcaatggatttttgtcattgatttttttaatacgaaagatactacagaaactgacgatcaaaaatataacgaaaatattccaagtccagaaagtatcttgttttctccattttgcaatatttcggatgcaaatgaagatgctgataagctagttctgggaatagatatgaaagctttggatcactcttttaatacggaaataccgaagtttcctctgatctatcagcgaaataaaacagaatctaacgataattttgttgaaatggcattacaactaaataacaactgtctgttgaattctataaagggttctaaaattgattacgagaagttgttgaaatcaatagaaaatgactttcttgactttcctgataatttattggattggagttacagctgcgatctatactccttatataatatgattttgaaccaaaaatccatattaaaacataactgcaataaattctcaaaaatttaa

SEQ ID NO: 667 - DNA, 402 bp, Cryptosporidium hominis
atggaatcactttggtggttaaaaatttttgaaaaatttgttaaagaaaaaatgagcatttcaattccttcagataacatattaaatggagagttaataaaattcagttcttttaataaaattggtcactttgaagtcattagtcaattaaataatcaatacttctcttgcttctgcagaaggtgtcacaaaataattaatacaaaattaattccgaataattctagatatgaaattataagtaggatgattgtatcagctttaaatagatttagaagtttatttcgttgttctgaaactaaaaaattaaacgaggaagatattcaatttataattaatagaattttaatcgccaattgcgaaattaataacgccctaagagaagtacctgtaagttattaa

SEQ ID NO: 668 - DNA, 929 bp, Cryptosporidium hominis
  misc_feature (856)..(856): n is a, c, g, or t
  misc_feature (890)..(890): n is a, c, g, or t
  misc_feature (923)..(923): n is a, c, g, or t
atgaatactgaatctagcagctttgaatggctcgatgtaataagtaggcaaggtagtaaactttcaagaactagttttaatactgcaagaacggacttatcaatatactatgaatgcaatgaactagaagaatatattgaagatgaaatagagttacctagtgataaaagtgaagaatatttcgattttaaaaagtctgttactacgaagtttactgaagtttttccacgttctaagacaagaagtacatatatttcagacgcctaccatgggttttcgaataattatgataaaaacaaggagcacgaaagaattcgatcgaaaacaacaccttacaagaataatatttcagacattattagtagtgctttattcagggatgtttttttaattgagaattctgaggatgtatttatagataatagcaacttagtttcaaaaaagtttaatacaaaaattaaaattattaaggaaggaaataactttcaaagtatcaactctcaagacagtttcgtaaattacttaaatgataatacaccatctacacattttactgaatcccaagtaaaagaaaaccttattaaaagcagcgaagatactgatgagagccatgagaaaaagcaagattctttccagaagtcatgtaacttagaaaacaatcaattatttgaatcctttgaagttaaattaaacagcaaaagatctatttttgaaacaagacagtcttataacgctacaaaccgaaacttatttaacagtaatcctcaattaatcgaaagtaaatctagaaccactgattctaaaacaaatattgaaaaaaataaagattttaatagtaaattatacattgaccttnccactttttttgtagaggggagaacagatattantagaaaagttagtcagtctgactgtatcttatncacttt

SEQ ID NO: 669 - DNA, 702 bp, Cryptosporidium hominis
atgggaatataccttttatttggttcagctgatgatagattcaatgataattttatgttactagcaccagctctagttatttttggaattttttatgataaaaatatatatttgaataagaaaaatagtctatggaaaagatttatttgtttatttataatttgttggtcagtaatcgcttcaactcgatctattattcatttcattcaaattaagaatagctgggctttttttatttacttgatattttttacgtcgattttcttaatttgcaaaataatattttacttaacaataattaaaataaataaaaataaaataagaccactggaaatctctgcaaccagtctattaaatgtttcaaagatagggatcccaattggagttcttgttcatacttggagaatgaacaaattactacctagacgtgagtacaagttgtttttatttgacttggcaaggtgtggccgtgtatcggctcttaaagtaattatatcttcattcatttcatttggaataatttttcctttgcaaatcataactattcctaatatttcattttttgagtatgccctatattccatattccccagtattttattctcccatgattatattacaattggatttatatccgcaacaattataataatattaaataaaagcggagattataaggtttctgaaaaggatagtatataa

SEQ ID NO: 670 - DNA, 3879 bp, Cryptosporidium hominis
atgcaaaaatatgaagaaaaatcgcccttaataagaacaaataaaagcagtttctcaattttttctttttttaactctctactttttaaacctagcttgagctattctgaaaggagtattcatttaagcggaagaacattgccttcaaaatttgtgccaaatgtagtttgtaatcaaaagtactcattcataaccttcattccaaaagtattatttgaccaatttagtaatttcttcaatttcttctatctaattgtggcgctacttcaacttattcctgaactcagaactggccctctatttacatacatcgctccgctattactagtactatcaattacaatcggaaaagaagcaattgatgattttaagagatataagagagataaagagttcaataacaagaaatatcgtaaaattactaggaatggaattcaagaaatacgttcatctgatattaaggttggagacttgatagaaattaatacaaatgacagaatacctgcagatatactctttctgagaaccaacgatccaactggtacggtatttgtcagaacagatcaattggatggcgaaactgattggaaagttaaacgtgcactgggaattactcagcacttggaaactttggatgatatttttagtttagaaattattgcaaacattgaaggaccaaaaaaggatatatatgtttttaatggaactattcaatattacgagcagaatattactagctcatttaatcctgatgatagcggctcctccgtcaattcacaaatatctgttggccacttaagcgctacaaatctagaaaagaatatatctgaatatggagctgacacagcaacacagccagtagtagaaccccttatgcttgataatactatctgggcaaatagtgttttaacgtgtggaaagatatatggattagttatttacaccggtattgaaagtaggtctctgatgaatacatgcacaaagagcttacgtacaaaagttggattacttgacagccaagtaaatacattgtcaaaaattttatttttattgcttataatcacatcttttgttcttgtattttgcaaaggttttgatacactatggtatgtttcatttgctagatttatgttattattatcttccataatcccaatatcactaagagttaacctagaaatggctaaaattgtattttcatcccagataaatagtgacaaaaatatgaagagtgtaacagtaaggtcgagcattccagaagaacttggaaggattgattatctattaacagacaaaactggaactttaacacaaaattatatgatagtccagacattgcacattggtcatgcaatctttcaccaagaaaatttttctgaaattgtggatgcactgcaatatgtgcaaaaggggcgagtaaacattgagaaagaagaaagaatcattatagatactatggataatatttcaacttttcccattattagcagtaatccaaccatttggaataactccaataatactcttcatctacaaaacttcatgttagggatagctttatgccataatatcttccctagatcttctattgatgctaacctaagtaatgaaaacagaaataattcagcagaagacattttagataataacaacttgggatctgatgagtgtatggttgatttgaatcaaaaacatatagtatatcaatcttcttcccctgatgaaattgcactaattaatttcgcagcgagcttggggctcagactagttagtagatcaaatgaaaatatggacttagatttggaaaaactgtatttaggcgaccacttaagaaattctatggaaagtggcttgtataaaaatgaaaaaaattttccagttaggctttctttcaaaatcctagcatgcttccctttttgtagctcctcaaagcgtatgggaattttattagagtttaaggggagatatatatatttctgcaaaggcgcagaaagcgtaatgattgaattgctccgtcaaaaagggtctggatggcttatggaagaatgtacaaacttggctaggcttgggctaaggactctagtattttcttacaagattatttcaaaagaagaatatgagatttttaacagtgtgtattcttttccatgcactagtttattacaaagagacaaaaatcttaatagctctagaaaaatattagagagcaacatggaattattgggtttaactggagtagaagacaaacttcagatcgatgtgccgcttacgcttgaagcatttaggtacgcaggtattaaaatttggcttcttactggcgataagcttgagactgctctttgcattgcaatttctgctgggctgaaaccaaagtatttaaacttttatattttggagtctaaatatttaaaacataatgttaattttaccgagaagctactccaagtagaagaattaaagtatcaactccaaaggtacatcaatgaatctgcaaacagcaatgttttggttgttgaaggttcaattttaagcctatgcataaaatattgtccatttttgcttatacatgcagcatccctatctcctgcagttgtatggtgtagatgctctccgtctcaaaaaaaagatcttgttcttcttctaaaagaatatcatctgaaatatttaaaactatgcgagtcaaatgctctagtttctttagatgatttagattcgttaagtaataaagatctaacatatgaccaaaataatggtgaatcaggaaaaaatattgataactcaaaaatttgttctgtcaagaggcgtattaatgaagccaaaagtggttacaatagaaaaaataacaaaaacttaaatatgttcagctttgatgaactaaactctaaatcctttgggataaataatttcccaaaactagcagaatatgaaggaaatattgatgaatgggacaacgattcagatccaatgagtaattacagtaagcaaaacacattatcttttgtacaaacagaatccaagaggatatataatttagcaaatgtttcagtaaatgctagaacatgtaggatatgtgctgtcggagatggggggaatgatgtgggaatgattcaggcagctgatattggaattgggatagttgggaaggaggggcaacaagcagcaaatgcagcagatattagtatacatgaatttgctgatttaagaccgctctttctttggcatgggcgtcatgcatatcagaacagtgcaaagctggcgcacttcgtgattcatagaggattaattattgctttcatgcagtgcgtgttttctgcacttttttattttattccagtagcgcttttccaagggtggctagcggttggttacgcaacatattatacaatggcacctgtattctcattggtttttgatgttgatgtaaataggtcgactgctttattataccccgagctatatcgacatttgaaggctggtcgagttatgtcaacaaaaacttttttctgttgggtttggaaatcattatatcaagggaccgtaatcatgttgggagcatttgtacttttcaaagataatatccttatgaatcttgttgcaattacattcacgtctttgatactatcagaaattttaaatgttgttaccgaaattcattattggaatgaagtcataatatcatcctgtataatttcaatattaatttattttgcatcatttttcctcttagagagtcacttcgatcttcagttcatttttacctttatattttggggtaaaatttgtgttctcacctctatttcatggggtccaatacttctatacaaattgatcaagaaaacgattcatccccccagatactataagttgatgcaacattag

SEQ ID NO: 671 - DNA, 468 bp, Cryptosporidium hominis
atgtatatggaagagggttttttaaatatatacaacaaagaatgtagattttgctttggagtagaaacagatcactctccattgataactccttgtgaatgcaagggaactcaagcatatatccatttaaactgtttatatagatggcaaaggctgcaaatcaacagaccatggtcaagcagattttgtagcgtttgccttcatccatattcaataccaagaaacacgcattttgttttttttcaaggttctagaatcaaactcttttattgcggaatattttcaacttacattaaattaatttttgcggtttttgccatagccaatttgcaggtatttagtgatttatctcctcatttaggtaacttatcttttttttctatattgggatttattttctcattctttttgtactataattcgaggaagagaatattcataaataacttacaagccgattcaagttga

SEQ ID NO: 672 - DNA, 1446 bp, Cryptosporidium hominis
atgaattcaaataacacctttacaatatgtagtgaattgaatattgaaatctcgtccagtgatgcaaaaacactaaaaattattaaaaaaaattgtaatgataaagaagttgaagactacgtcgttgttgttcctccatatatgtttgaatacgaatcgttttgtaaattaagatggagagacagaaccttaagagacttgtttttgaacgagtttagaaccagacctatagaagaatacctgagattaatagaccaaagaagattaagtgttaatgatacacctgctaattcattagactatattgttcgcaatggtgacaaaattaaacacagatcgctatttatagagcttcctgttgcgacagataaagttaaaatattgtatgattcttctaccttattagcagtttttaagccttgtggcattccatgccatcctcaaggaaggttcaataaactttcacttacaaaattaattcaatcagaatatctttcaaaattgaatactaacagtacttatattcatccgataaatagacttgatagagttacatctggccttgtattgcttagtaaagattcttcaacaactaaaaatttatcatcaaaagtccagtttgcacataaatattatttagctatgataaatgagagcgcttcaaactttatttcgcatgtttcccagagtagcattgaaggcgtgagcattagggagctatctctggatgaatcacacggaatcacaagccatgtaatcaaatgcgagattggacttaaaacgttaaaagacagagaaggcgaatcattaataacaagaattgacagttcagaaaatagtaagtactctctgacatattttttccctctaatttcatgtttggacataaacgagggaaaaaaacaaaaaataaatgaaacagataagtattctattttgctttgtaaaccaattactggaagaacacatcaaataagggctcatttgaaatatattggatttcctatcgttcgagatattctttatagcgataaagttttaccaggaattaaattaaatacctcaagttttaagttcacggactcaaatttgtcagctagctgtatatataacataaaagatctagaagttgaagagctattaaaattccctttacaaaaaaagtactttggtggaggtggttctatgtcactagattcttctgatgggcttgcacatgtcgaatattttgtagaacctccaataggaatatgccttcactcattattatatattttaccgcctagtgtacccactgaaaattatttgatttttaaatgcaaagttttgcccgattggatagctaacaatacaaacctgaatattgcaaaagtcttggaagattggccttactggaacaagtcgatactaagtgaattaaaacataataaattaggactgttatag

SEQ ID NO: 673 - DNA, 504 bp, Cryptosporidium hominis
atgttgggaagattaactatcgaaatatttttatctatcataatattgttcatttcttgctccacacagttagaacttgatatcatgaaggaaattggaactaataataaagatttttttcaaaaagaaatatctccagttgccatttcaagaattattgcaattaaagatcaactaagagtatttagtgggtcaaatactgatacttctataagagagggtaattttatttcgactataatggcaaacaatttgaaagagtacataggattagaccacaaggtaatgtcagggagtaatagaggtgcattcgtaatatatgatacaaatgactatccttttgcatgtaactgcaattcggcgcaatatcaaaactggaaaaacgccagtgaagaccaaaatataaaagtagaatgtactaacacaataaatacgggaattttcaatagcaacgacattgattattgtgatcctacgaatattgcagcatcacaaagtgtctga

SEQ ID NO: 674 - DNA, 69 bp, Cryptosporidium hominis
atgaattccggagctaatgaagattatgatgaactggaagacaacactaatgataacgatataatgtaa

SEQ ID NO: 675 - DNA, 705 bp, Cryptosporidium hominis
atgttcaaaaaaattaatatattcctcaaaaacgaaaattttatatttaatggctctattattggttaccaagaaattttatttatcattttaatcacaacaattttggtttattttggtataatatcagtattatatgatgcagaaattttacaaaatgttatagatgagacaacagaaattcataacagagagtcaattaacaatattaattctttaaacaatatttcagcacaaagacttgtttgcaagtttattagtagctttaataaaattgtttacgatgttaatgagttgagttctgcccaaaaattcaatgaaagattgttaaaactgctttccgaatcgtttccgtcaaattcaattgatatcagctatcaattcttattcttaatttacagaaaaatacttgtttcgaaaacgaaatgtttagtcatatctcatctacaagatttctctgaagttatgtttcataggttaaaaattccaaaacatacattagttttgtgctactccgaaataattaaattagatgattcaatattatcaaaggaagaaaagaatctcttcatacatgaaaaagaaagattgcaaataataataaatagtgaaagggatatagtgctacaaaatattaagttaaatatattaagagttgcaaaaaagatcaaatttgcaatagaagtggtcatttttttatcttaa

SEQ ID NO: 676 - DNA, 1419 bp, Cryptosporidium hominis
atgagtgaaaatgaatataatgaaaaagataatcaaaataatggaaaagaattgggaactaaaactgaacaaaaaactcagcttctactcgaagaatcaggtgttttaaatcttgataaacctctaaatgaaatagaatctattgacaataaacagaataataaaaagaaaaaaaagaaaaagaaaaaaaaaggaaaggagaacctatacgaagataaagatgatacctatgatccagatcttcctacttattcaattcctatacaagataacactcatctgagaaaagtttgcaactggccagctattgaatttagcaaacaaacatctcctccaactgtgcctataaataaaatttactcaagacatgaatttccagagggcgaaataattgaatataatgggtctaactcatatagaatatcgtctgaagaattaaaagataaagaaaaactccatattttggactacgcctctttaagaagagcagcagaggtacatagacaagttcgaaaatatatgcagagtatcattcgaccagagatgaaacttatagatatgtgcaatattttagagagtaaagtgaaagacttagttgctgcagaagggctcaagtgtggatggggatttccaacaggatgttcgcttaatcattgtgcagcgcactatactccaaacccccatgactttacaaaattaacccaagatgacatttgtaaattagactttggtgtacaggttaatggaatgataattgactgtgcttttaccgttgcattcaatgatgtttttgaccctttaattcaatctactttagatgcaacaaatacaggattaaaagttgccggaattgatgttatgttttctgaaataggctcagccatagaagaagtcattaaatcttatgaatttgagtacaaaagtaaagtttataatattaaacctattaagaatctaaatggtcattcaattctaccatatcatatccatggagggaaatcagtaccaattattgcaacaaatgatgacacaagaatggaggaaaatgaaatatatgccatcgaaacatttgcaaccactggaagaggctacgttacagaagggccagattgtagccactatatgaaatactacgacaatcccttcctaaacgaaaattcaaccagacttaattctgctaaaattcttcttggtggaattaatacccatttcggtacacttgcgttctgtagaagatggttggaccaattaggatttaataagcatgcactagctcttaaatcattagtagactcggaaatcattcggccatatcctccattaaacgacattccgggttcattctcctctcaaatggaacacaccattttattaaggccttcttgtaaagaggttgtatccagaggtgatgacttttaa

SEQ ID NO: 677 - DNA, 885 bp, Cryptosporidium hominis
atgacatatttatttatttatgaccacttaatggacccattcgaattcaaacaatgttttccaaatgttgagtttaggttttttggaataggaagacttgataatttcaaaattaattggattgcaaaaggcttaccattttattgtagaacgagaccaacgttgatgccttcgttaaatacggcaacttatggagtaattattgaaataaatagttacgaaaaaaaaatgatcagggaatacaccaagtatttaccaaataaccttttaattgaaacaaatgtcgtaatagttaagttaaactttgagaatttcggaaaaaattcacagaaaaatattttattttctaattcaggaattcgtgaatcaaaaaatcagagttcatttgatttaaaagttatgacatttttcacagaatcttcaaatatgatatttgatagtacatttactgactttttgttggaaaaacaagatgatttttcaaattatacatatttaatagaattaagtaaatcatctaaaaaaattagtccagcacttcctagtgaaaattacataaacctgataacaaaagttgcaaagttttacaaattacccgaagtttatatagaagaaaacttaaatttatcgtctaaacaaagactaagcttctttgaatccatagtcagaaaaattgcgcttaaatacatttatctcatcacaaagttccaaattcaggggattggggtcggaataatagatttactttgggaacttgacccacaagacccacttgtatttgccgattatgggaaaataaacaaaggaattgtttttttaattgcaacttttattatcatgcttctttccccaatattgtgtttcatagcatttttttggaaataa

SEQ ID NO: 678 - DNA, 1284 bp, Cryptosporidium hominis
atgctaataaataacggagagggtcaaatatcaatagaagatccaactcatagagttaaaattgttatttcaagcaagacattatttggcaaaggtatttattgctttaaccatttcgttattgcaagaggcaaaatgaataaaataactcagagttttcatgtggacctgatgttccatcctccaatccaaaatattgataaaaatgtagcaaatgaaattctatccaatttattttcaagcataaattatactttattaaaatctgaagatagagaaaaaaatatcaaaaatcaaagcttaaacaaaacaaaattttttagaactacaaaatacttggaagatttaaagattaaagttcaggtatcgagaaatgattattgggtaattttttcagatattgtgttaacaagcatgagggtaattgaaaatttacgtaaagtgttttctggttatgaaaaaatgattaaagactcaaatattaatataggatttattttattaggcaattttattaatatcgactttgataagaatggagaaaattggacggaagagaaaatttgtgttgaaaatgaacataattttagtaacgtaaatgaaagaggaagatctacaagtctatttacttttaactcaaactcacgtgaaaatcattttaaaaattctcaaaacaatttcaatataacgagaaaaggttttgaaaggttcaaaaatgttctgaaagaatttccagtgttgctttcaaactgcaatttcttcattatttctggtccaaatgatattggacccgatttacttcctaaaccccccctttctaattattatgcatcatacttatctaaagtgtttccagattcgaaaattcattttctttcgaatccatctgttattgatgatagtgatattaagatgttttgttcaaggtattctctaactaaggaacttaaggaaaagactttattttcttactgtggtacaaaagatgtgggtttcacaactcaatggaatattgaacctgaaactttagaaaacattataccgcaaactgtgttaggccaacaacatttaactccaacaagttctaatgtcatgccaaatctagattatttcttatttttgctaccaaccccaaaaatattaattattggcgactctagtccaagctactcagtcaaatcaatgaaccaaacttggatagtgaatccagggtcttttaataacacatgttcatgggtccagtataatgttttaactgattcaattgaccatgtatggttgtaa

SEQ ID NO: 679 - DNA, 1632 bp, Cryptosporidium hominis
atgtcatcagatatcttactttctgattatcaaaatgccaaaaataatacggtcattgaaacaagtcctgttgatattttaacaaaccatcttgtaacaaaagtagagtttgaacaagtcgaaggacagagagagattagaggaaacaaaaatcaaagcacaggttttccatttttaaggaatgcaaatttaggaggaaaatttaattataataaaatgggttttcaatcggcactttctggtaaaagtgttttaaatgcaaaatgtattattttagaaagagttatgttaaaaaatcaatattctgactttgaatacccattttttaatataactgcaggaaaattggccaatgaatttggtattgagaacggtataaaaccttctaaagacttaattcgaagcatctttgccaaaagaatttgtttaaatgacaatggaatgataatactatcatcaggggcaatccatacccctttattactttataagtccggaataggacctcttgaatctcttcaaaatatgaatataatgccattgctagaagttccaaatttgggaacaaatatcgtcgacagattgttatttgcaattccattttttttcaaaagtgatgtttttactaaccctttcgtaaacccgatcatgtcaagtttttcaaaaacttctggaaattgcggatatagctgcagcactattaatatcgagtctttgggaggaggaagaactgtggaagggacattatatgctacaagacttattttccctccaagacttaggaataatattgttacggattttgtgattgaaatattcaaaaaatgcgcagaaaattacccattaagtggaggagtaccaatttgtctgattttacagtatcctctagaatgtctaaggagatctgctgctgttttttattttacatctgaacctaaaagcagggggggaataaatgtaaaaaatgatggaaaatttgaattagatgggaactatttatcggaagaagaagatagagaaaacgtaataattggacttagttctgtgataaagatgctaaggtcaggaagatttcaaaatattgcagaacaaggaggatactcttcatgccctatgacagtattgaatggcataattggcgtgcttgcatctgcaagaactgagagattatttataaacaaaccactatctccagattttatggatgagctagaaaatgtttataacatcatactcaattataaaaattcaatatttccagatgaatgcaacggagtttctgacccaagggattgtcttgaaaggaaaaacataatatttgagaaaattgcaacattccctccaatacttccagacctttcgaataaagacgaaattttaaggttagcttacaatataggaacaagtatttggcattggtcaggatctgttccattaggagagcttgtggaaaatgaatcgtttttattatccggcacaagaaacttaggtattgttgatgcgtctcttttaaaaatattgccaagaattaatcctgtctatacaatcatgagtttaggaagatatgcagggacttcaattattaatttgcgtaaaaaaaatcaagaaaataatgaaagaatatattcataa

SEQ ID NO: 680 - DNA, 576 bp, Cryptosporidium hominis
atgaatattatgcaccggtctaatgtattattatacaatattgaatgtgtacttgaagaagataaatttttagaatatgcattcggaactaactattcagaaatgcttgtaacatttgacaaaagcataattaatattattgcatataaaaagatattacactctcttgagtccgtcaagctccaaattagcagtaataaagaacttaaagatgattaccttggaagaatagagatattaaaattgaaattggaagataagctaaatgtagaattattaggaaatgaaaatcaatcccaaaatatcaaaaatttatcttcacatttgaagccaaaaaaaaatatttatgaatatcttgaaagtaattcaactaaatttgcagagcatagtttagaatcgccacctacttcgaaaaataatttgaaaccagaaaatattgataatgggcttgatataaaagttataaatgagcaattcaaagatgaattggttgaattagctgaagaaatgaagtgttctgcattcagatttcaagaattacttagaagtgaaaaaaaagtaagtttttctccttaa

SEQ ID NO: 681 - DNA, 1029 bp, Cryptosporidium hominis
atgcagattaattacctaattttttctgtattttctgcgttacttcttgggttaaatagtccagtatacgcaataactactgagtccaatgaatgtgttgcaaataccaaaagcaaatctgaaaatagatttagaagatttttggatggtttaaataaagtggaactcaagcttcccaggatatccagaaaaaatgttattagtgaatatactgttgaggatttagtttcaaagttacgagaagtagagaaaacaagaagtaacacaaaaaatccattcaagaaaataagatgtctcattcaagagtcaaacattaagaaaaaaatcaattcattacttaaagaaaagaatgaagaagaaaaattcgaaaagtttgaagaagaatttccgatggattattctccaaaggtattatctgaagaggggtctatatcgccttatatcccagtggttgttgaagactacaaggacgtagaagttgcatcaggaacacctattagaaatgatgaggaaatgcaagacgagattaaatatttgacatcggaggatgctgatcaatcggttagtggagagttggatgatttggcagatccaattacatcagaaactggcaatgaaaatgaaggcactgaagattccgttacagaagactttgaaaaaaaagttttagaagacaatttggaagactatcaaaccaaagatatggatggtgaaagccagtcgaacgagaatgagcagcaaacagatttagatctgcaagaaaacgcagataaagaagaaaaaggtaatattcaaaacaagggaagattaaggaacatttttaaaagaaaaaagttaactgcttccgaaaagcttgaaagattaatgtcacttaaaaaaaatattgaaagtaggatttctagttctaagagtaaactccttagaagaattttaggaatgaaacttaaaagagtgaataacaagatttctaaaataacggatgcagctgtagatacagttactgaatcaggcgagattgacatcgaatag

SEQ ID NO: 682 - DNA, 207 bp, Cryptosporidium hominis
atgattgttgaagaagataatgaatttttagaagatggactttatgacagaaattctctaaatgcaagcaggaaggtcacagaaaaaagtgaagttgatgtaatgaacataaacagcaatagaagttcattgaacacaaactctggatctaatacgaatcgatcaaagcaatcgaagaggaataaaaggaggagctacaggaagtga

SEQ ID NO: 683 - DNA, 306 bp, Cryptosporidium hominis
atgaactcaataaagttattagtagaatcattcataagttcaggagatatctgtgttatatcgaagagttattgcccgtactgcataaaagcaatcaatagcttgaaaagcgctggatattcacctttggttatgcaaatcgacggtagagtagatactaaagaaattcaagattactgtagggagctaactggaagtggaactgtcccaagagtatttgttaaagggaggtttataggaggatgtgatgataccctgaagctgttagaagacggctcattgagtagctttgttgaaacgatctag

SEQ ID NO: 684 - DNA, 909 bp, Cryptosporidium hominis
  misc_feature (895)..(895): n is a, c, g, or t
atgagaaaaatagattgcaattttattttaattctttggatactactgctaacacagctaataccagaatgtacttcttctagtttgaatagtaaatctgaggatttaagagaagttaacgaaattgatatcgtacaagaaggtagcaatgtagtggttcccacacatttaattagagaatatggttattatatattaaatgacaatggtttcagctcaaattcactaatttgcgagtttgaagatgaaaatctacaacttaaatacatgaatttcgcatccacattagcaaaagttacttcaaagttgttattgaatataaaattgacaaattccaatcaatataatatttacaaccaaatatttagtagaattttgcacctggaaagtgaagactcgggatttcattatttcctaggattaaaaaatatgtatgagcaattgaaatatatcaaagataaagagtttatatttagcgaaaaaggattagaatctgaaattaagggatctattgaaagcttaagcaaagcaatagatagtttatcagaaaaaaatgaccaaaaaaaaagtgaattctgcgtgagcttatatctttttagatttaaaggtttaaggcaaatcatgatagttattcgcggattgctatcacttattcagacagaagaaatttctgaaataaatacccatttagatcctcagtttaaaaaagtatttgatttgattactcaaaatatagagcatttaggtatgtacaagtcaactttacttgagattaatataaaattggaggaaacgttattaggatgtttagatgcaattaggaatttaaatattccattatttggagagaatagccaagataatcaacttttagatattatttcaaagtcgtcgnaatgtcttttgtaa

SEQ ID NO: 685 - DNA, 2220 bp, Cryptosporidium hominis
atggttttgggatttcctataaataaaaatggaaagctaactaagattcgaatggttggaaaatattctggttttggaggtgagactcctgtttcatttgcaattgttgatgataaacaatttcagcaagattcttcctctcttaataaaattcaaaaggggctatttcaaagtgccatctctaattatgtttcaatttataagaatcttgctccactagatagttctcataggcaaaatagagagtttgtttggattgtaaatgagaaaagccacatattatacatgttacttttaagaagtaaaattggaaaagcaagtttagcattaaaagaacttggtttgatttatccagtcgcggataatgcgcaaaatgagttccagatcagttttgcaaatgttttttttaattctatttccagacgaaaaagtcttaataatttgttttacgacgtaattaagaataagttgattattttaaatagttctgacaatatgcgctcgtattacgacattggtttttcagaattggaatcagatacacaactattcagtaatattagcatttcccaaacaagcattcttgatattccggtttatgaatctgatatttcacaagccactgagtcatatttatctgattcgttgcctctcttttgttcttcaagaagaaattactatgacaattcaattttactaaatattaatgaaaatttttcatattctgaattattatcatataggctattaattaatgtaataaaccccaaaatattacttaaaattcgcaatttacctagccaatatgcattaagaaaaatctttaattttggaaaagaacttttattggactttgaaaagcttagaatttcgtataatttaccaataatgaatattaacgataatataggaatttcgacgataagagaaaatatgaagctcttcctcaaagggatgattcaatacacaacatactcacaacttgaaagattttcacttcacatttcaccagatttgttcagatacaagcttacaattccaactacaaacaataaatctattgttaaaactaaagacgaagtttttcagttaaatgggataacttactttattgttaggtattctgaagagactattatttctggtctttcaactttggttgaagaggtgctaaatgggagaacaaacattgtttttctgatgcaaggattagatttaaaacttttaaggcctggggacttaccttcagatagtagtcctcaaattcatttaatgaaaagggttcctattgagtttattccaagcgagcgtatggtaagaatttatgcaagtagctatgatacggaaaatttaaaacttgtatacggcataatgtcgctttatcagggatttgatcttagcatagtaacagataatgaggaatattattattttaatttgctttgttgggattcaaataatggaacctcaaaacactgctcatacatccaagtattcagatatctaaagtcaaatatatttgagaaattgaaattatatcaaaactcattaaataataatatttccttatctttaatcgctgaagaaggggaaattttgtcactagattttattggcctaagtgtgatttctaggtttgctggagcagttttatttaaagctgataaatactatgaattattttacaaatctgaacaatactgggacttatgctcttttgttcaagaattttacaaattctcaacagatttgcctattaaagctataaattatgatccaaaaataaaagatattattttcaaaccagatttttcggaatgcccaatcccagagattgcaaacttaaatatctacgccaatcttcctcattttataaaacacaataacaatcctcaagaatctggttttgtatttacactatataattctattcgataccaaacgctttcaatcctcattaattatttcctctctggagaaaaaatatttattaaacacgaaggtattgaagatgtttctgctccggaatcaatacttgaaatacttggatacttcgatattagaattttgaaggattctttaatatctttattcctcaatgaaatatcattaaaacgtacagaagttgaaagcgcaaaaatagtttcaaatcaaattagatcaatcataccaaattcaatggttgtaggcattaatattcgtaatgaacgcattttctaa

SEQ ID NO: 686 - DNA, 1995 bp, Cryptosporidium hominis
atgttaaagttagatttgggaaggaaaaatattgtttttttatatattattcttgaaatagtacgtctagcatattgttccattcaacagaaccctgatcttaatcaagatggtttaaattttgacaccgaaattttgtcggaagcagataaattaattgagcttttggaatcagcaattcctaatgttgctcataattgtgctgatgggctagaacttagcccattcatggatattcaatctggtgatactttgaataaagagaatttttcctctccacaggccgaatttaaacaattgaccaagccagaaaaatatgctgaaccaattgataaacgtaaagaaattgattatggagctctttttaactgtaaatataaatatcctgaacgaacttatagtaaaatgtatttaggccacctaaagactctaaaggaatctggaaaaatgcataggcgtgcaactgtatttcaagatttgcatccgagcgataaactaagttatttgcagaagaaccctcctattactggaagtatttttgcagatgaaccaaggacaattttaagaagaaaaaaacctaatttgtttgcagaagtaaccaaaaaggttgaaattggaaaaggggaacctagaaaaagtgaaaaaagcttttttgatatgattgatggacagaaaagtaaattaaggaaaatgcattctcaggatcaatatctaagaagatttatttcttcttatgaccaagttttaaaagaattgaaagctaagctcaaatctataaaggataaagactctggacttagagagaaaagacttcaagctatatctgaaaaattatcaggatacaaacgtttagttgatgacggaaaatcaatattagatgatttagaacgttctcaagttcaattgttgaatactcctttgttaagtcaacgcgccgtaaagagcagagtatttgaacaaggcacaagaattgaaaatctgtatagctggtatgaggttgttgtgcctcctaaacctcaatattgttcaacaatgaaactttcactgaatcgagtcggtgaaaaaggtcctgcttcacaaagtgaaagtaaaactgatttagaaacttcccatccagataaatttaatagtcatctttctgttttatctagaggcccgaagactagacctagcgaaatcaaacaaaataaatttagatgtaaagtagaaactgcaggcgcagagagatcaaattcagatagcaaagaaaatggttccggatctggaatgcttggagggcctattcaacatagtactgaaggaatggatacttaccgcgcaacttatgttgaggttgatgattcctctgatgagggggacacaaataatccaattgatcctcctaatgcaaactcaagcgtctcaaacattttgaagctattacggcttgatatagatctgaaaacaagtgaagaagctgggaatcgtaatcaaaataataccggtgatagatatcttgctaaatatatatcgagatggaaaggcagagttagtgggacaaaaaagtcaagtttaggtaataaagcgagggattccgaatctaaaatggctggaggatctagtggtcattctaaaagaggggctgctctccatttagcttgtgctgatgattcttctgatttaggcgacagaaatgaccaaaatattcctaagaatatattcacgagcaaagcatacgttttgaagctattacggcttgatatagatccggaaacaagtgaagaagctgtgaatcgtaatcaaagtaatactagtgataaatattctagtaaatgtacatcaatatggagagggaaagttggtgggacaaaaaaatcaagtttgggtgggagtggaagttccggatctgaaatatttggggggtctattcaaaatggtgctgaaggagcggatactttccgtgcaacttatgttgagattgatgattcttctgatgaagattattcaaataattag

SEQ ID NO: 687 - DNA, 543 bp, Cryptosporidium hominis
atgtctaaaagagtatcactatatatttttatttttttcgtattgtttgacatttttgcaacatcacaatatgagatttccccaaatgcgactgtgagtagagctgaagtattatcttttgaaaatagcgaaataagtctgaaagaattagcatctagactcaagaccttcctttcagttgaacaaataatatatcttgttcaggaaataatcccagaaaaccttaaattggttgctaaatccagcgaatatgattattttgatgtgagtgaaagcgaacttaaagaaacctatgaaggtataatttatcaaaacctaactaaagtgcctatctatcagctagttcatataccagaacttttatctaatgccactcatttaaggaaaattaggaatgctatccattccccaaggccaataagacctagaaaacaaataaaagggagaaatccaagtaatattccaggtgcatccccttattttgtatatgagagagtaatagaaatatataattctgattctgacattcaaacagataaatag

SEQ ID NO: 688 - DNA, 5034 bp, Cryptosporidium hominis
atgttgaagaagacgacaggaaatagaaaggaagataaattagaaagtgtctactcaaaaccacctttcagctataactcaaacattgttttaaggcatctaccaaaaattaatgaaaaacaatattccaatacttggagtttattccagaaagacgatacttgctcacatttaaaacactttgttttaaacagaatggtactttttgtagcatatgttcttgaattttggaggaagagcagaaattccgaaaaaatcccatttaaaagtattactgagatttgtattggtttctctggtgattatttaaattttagacctaaagctagcgatttcaagctgttcacagaagattggttatttcaaaaagatgaacaaactctttattcgaacactctggatttactttggaataactttttgatttttgaaaattctgccttcccaaaaaattctgaagaaactgaatcagattatttacaaaggatctataataatgcacttgttcccgaaccattgtttgttcatgactggaaaaatattgagcttcctattagaatagatatcgctgagtttacaaaacttttgctacatgtacaaaaatctgtagaaatattctctactcttgatgatataacacttaatcatgtaacattagtcagagcatttttggaatctttttttgaagaaacttaccaatttcctataataatttctgagaaagatatacttttattacttgaacgccgtgaacttgagaagaagcctttggatgagttgtttttcgaaattatgtcgtccaaaagtgattggtcatggattaagcatgaaacttcatcccatgcaatcttaatgcttctcgaatacttaaaaacagtaaagaaaagtgtggaggagagtattaaaagaactccaacaaagagtgatatttattctgcgcctagggcagtgcttgctcacggaaaatggttaataaaagcaccttatcctgtattttatccatcaacccctttacaaaagagggctttacatggcctccccaaattcctaataaataaggcccgttacattcaggcatattttattaatgcttttgacagagttcttcaatttgatctctcactccaccttgcagacattgtttattcgctcacaaactgcgcaggagatgacaaaaaattagtagaattgcttagagaacgaatttctattcaaaatggtcaggacttcgttaatgacaatgtagtaagggagatttataattcttgcatgtccttcagtttttataagtatctcctaaaaggtgcattatcagaagaacaagcgtttgcagcgccgagagtgttttacaaacccaaatttggttggagattctttcctccaaatgtaccagacttttcaaggcttttggttttgagtaaagctttcaaagttgaaagtgaaaataatgtatttgatcgagattcacataaattattagatgaaacaaattctaatgaaatagttgttagaccatatacatggacaactttaaaagggatttatgaacagaaaaaactggaaatttggcaacttaatagggcaatatctatgtgtgcatattttaatcattggatttcatataaattctcaacaaagaattcgagagaccttcaagtatcaaattgtataaatgcaatatatcgtttgagaagcacaaataagagtcaatcacaatcagaaatatcgcaaatttttttaaggtacttgggagtaccttttattaaggaaaatgattttaatgagatgctttcagcattcacttcattcgaatgcgtgggtaaaccgaacagtatgagcactagacaatggctaatgaacttatataggattcctcaaattcaagaaaataataaaaattctctttcagaagaatttgaatcactaagatttcacataccacctgtctttggtgagcaaaaaactatttttgagcatggacagccccagatcaccagtattaatgcggatactccggaaatatatattccaatggatctagattctgattcgcttaataacttgagggagttatttgaaaagtttacttatcgttatttaagtagggctgggataatggttgaaactgaacttgaagctctaaacttttcaatggtagacgtatttaagattgcaagagatagaaaattatcattttctgaggcactacagcaacatgtttctgatattgggggtaatgttcaaaggaatattttcaagaaactctcagcagcattctttagatttattcttttaaagtttgcaagtagcaacgaagaaccatttgtacagatactgagacgaatttccataagtagagtaattactgatggaggaaagctcccatttgatattcccttgggtatagtttcggggagactcgatctagaacttccatacaattcccactcttttggagaagtaaattttgcaagattggtagttgcatacatgaatgaatatttgatagaactttttgatcttagaaataaaattttatctgatggaaccgtcgaaaaaaatgttcttaaagaatttccagggtttgttaaagagaattgtgtcgcaaaaagtatggatatcattagaaaaggggggattgatcttcagaatgcattagatcagtcttgttcatccgaattatcttggatgagtatgaaagttctgagaatgttggtgtctgggctaatgacgtactgtaaacttaattttagaggatttccaattgagaaaaatggaagaagcattttagatttttccagggaaaatttaaattcccctatagtattgtttgacaaatacttcaaaacttggacaatgcaaaacgcaaggaaaaatacaagagaaggcgaagattttggctctaaattttctacattggaatccatagggattgtggatcaaatgacaggtacaattatttcttcaaatttcaatttctgtagtgaaatgaatacatcccagataaatagactactgattaagcttcaatattacaaacattgtatttctgagaatgcaatttcaaatattgaagttgatcgactattggatttgaatatttggtgtcttgctttacgacagaaagtaccagatatgaagaaaacatattcgaacatgttgttcacttattttggaattagcggagcagttaaagagagtttcgagattcttgaggactcatttgaatttttagaagaatctttgttaggaaaaaactctttggtatctattgggcagtgggcccaagatttttattcatcacattctaaaccattttctcaatttaattcgcttgtaaaatctgataggttattttgtccaagagtaattactgaagacgaattgcaacaattgcaaattattcagaaagataacatatttaatcgcgtagaagcattccaaggattttcagagattttcttaagagagaaatatggaataatttttgaatcaagaccaataattgtagcgcttttggtagatggattctccattattaaaccatccaactctaatatatcattaataaggtctatgatacctattgcgtctgaagaaattgtaaattcattaattggagcatttaattctttcgaggccaatttattaaaaggtggtttgacttctctagaagatttgtataagaatccaatttgtgaacgttctcaaggaaattggcatttttatattgaattggaaacaataaacagggctgatgtgctaataaattcaaagttaatcttttccgaattggaaattaacagatttcaaaatattgtagcttttttgaatactgctttgaattataagtattcagaaaaaatgttgggatcttatatttcgtttaaagatattgctacattatttaaggcagaaatagacctttcttcttttggacatattattaattatttccatagaactttacaggatgatttaagtttttcaccttggcttaccgtgaaggcactaaaaggtattttccaggcctttatttcttgggaaaggattgaaatcttcaaagtctccccaacgtactcaaaaaattttggattagtggtttctagtgctgatatggctaaatataacaattctccagtgggattgatcaatggaaaatggcattggtatacttggtgtaaaagaccagactttaatttaatacatcgcgaagttttaggagatgaagttgtacatgttttgacacctcaagaaagaagtttatatgggattcccagaattaaacataaatttgagattgctactttatttattcaatattttctacaagatgtgttgaatattcttataccatttaaaccggatgttacaatgaagatctttaagggggaaacaaacttatcacctgattcagttgagtttttaaaaaaaatatgggaacattataaaaactcttttatttataaaggttccttacctaagcacgatttattccacaacccaataatcaatgttgtaaataaacaaagattcttcccaactgctgcaattcctcgatttgataattttgatacaactcttattccaccttccctaacagaaatagaaaacttctatcctggaattgttattggttcaaagtttgaaataaatagactgattactatttgcgcattcataaatctaagctttgaaatttttattgatgattcaacagaaaaagatgatattattacgccaataggtttatatgatatattaaaggacaagatgaatattttaattattgaaaaacaagacgaaattacaggtttgtttaggcaatggcaattttattcaggtacccaagaaaaagcattgcatttaaagaatacattacttaattataataattttgaaaagtctatgttggacaaaggatgggatttttcgaaattatatcaaaaacctatagtttttgcagtccaaaatggttataagatgaactttaatttgaaaagttatatacctaaagttaagaacagagtgtaa

SEQ ID NO: 689 - DNA, 750 bp, Cryptosporidium hominis
atgttacataaacaaataaaaaattttataagtataattctcttttatattgacatctttcagagtttttcctatgtaaatttaacagaaaatcaacatatctcttgttttatgcaagttggagtccatcgaaagtttgtaaacccatatagaaataaaatcaccgttggaccatatggtcaagaaaaaacctgtaaaattgcttgttgttcaaaaaaattttattgtgcgacaaaacaatcaagttgcagtgaaacaaaacattcgggcatgctgaattgtaattgtgcgaacaacttgagctcctgttcagggtgtaaaggaagttcctgcacatattctaattcatctaatcattcatgcccaaaaaattgtaattcctcctgttttgaactgcactcaagtgcttttatttcttgtaaaaatctttccccaaatgatttatgccttacgtttccaagattcaaaaaaaatcattctaaaaagaattgcaaatgctgtacccagtttgaattaagtgaagatgaacttgttaaaataaaaaatgaagctggggtatttggaaaatttaatgaatcatctgaaataactactgaatcagaaagttctgaaattgctgatgatattgaaattaatgtgaacaaaacgtctaattctactgaagcaaagttttcgtatgatgtaagtgcaaatttatttataatttttaatttaactattgcattagatttatctagcaattatggataa

SEQ ID NO: 690 - DNA, 7839 bp, Cryptosporidium hominis
atggacaatatgggattctttttgatgccctcgttttttaagatgaagataagacggctaaagtgtttgcagttcattttacttctgctttcattcgtaagctttaaaatatttatgtttggtatggccaatgcaaacatagatatgaacggtccgcctgacagagtttactactaccctatcggatttaatttggcatctctattcattgggccgggagtaggcaactttctttctatagatagtcaagtaaccaatttcgtaagcccatgtcaatttatgcatccaataacaatacagtttattggatcttatccaaaaagtggcatgactccaattaaaaatattatttgtgattcggtttcattacaaaaaagcttacagaagttccaattaggtgtagatacagtaaaagttgtcaaggcttgtactgatattgcacaagttctgatggaaagtgaaactacgtatacaatatttaatggggcaaataatattacaatttggttagaaggatcgaaactcgtgaatattgttaaagaatttaatgaacaacttccagataatattccccaaataatggatagggacgttaaataccagtttgatcccacaatatttggagaagacgttatggataaagttggaatttctacatatttatttaaggcaacatcattcccatttaaaattagtgtagattattctgaagttgttcctggcacgaattctcatggaaccaacattcctgtaattgaattctctgcaaatatcaccttaagctatgaattttcaaagcagagctcaggattgtcatctttctggacgccccccactggattcggagggtttttccccatgctagttcctaatgataagttttcaaatggcgttttgtatactacatatacagagccaggtaagcatgctggatttgttgcctggggcaatataaatatcccaattacgagcccctttgtaagaatagtacctccttctagaatacctggctccgaaatcgtttgcacaagtaattatgatttttactatccaaccaatgaagaaccagatggttccgtcaaaaattatcctagggatcttgaatctttgttcaacaaagactcatcaaaaatattcagaaatactgtagctgtccaatcttactggaataagatcccatttggcgcaaattggtatgagcagggttttcctgttggatctccaaattcgcaatggatagaaacaggtaactactatggcggctgttattttaatggaaccttcccacttgttccgagctcaacaaactcgggatttgcaaatacaatctgttcaactcaatctgcaagcatttcagatgtatataagactgcattttatcctcccccactggaatttcttcaatatggtgttagtaatatgcaaactatgattacgtcaatacttcaatatggcgtacaaagttcttcagattcatcttcaatttttgatttcaactcaaatgttgaatttttgggggcatatccatcatttcacatatttggggcaactcctggattacaattaacatctccttctccaaggcttaacgttccttttgtacaatactctggcagagatctaaaagcaggagaccctttctttaatttcaattttcaatatatgcaagatagatttggccattgctcagaaccaaatggttgttggatttgctcaaaccctagggtgattccctggaagacagaaatcattgatcaaatgaatttcacagaattctgtgcttcaaatttaacagtaatccctaattcaagaatgattgcactaaaattctattatggtaattttgaagaagatattcctgctcaaattgccagtgggttccaatcatgcttaaaatctgttccagatagatggattcctgttggattgaatacaaccgagtttacgtttaaagcaggagaatatcacaccaatactatgttcatatacaatactctctcaaatgatacatgttgctctccaatgaatacttattattatttccagcactattacacaatcgtcaccgatatttatcagcccattcaactaacccaaatcacaccatatacagacccatatgcaggaggaatcctcccagggatttttatgagcagaaacttttcttatcagttttatatggatgtttatcccgataacacttggactgaaaattcccaactaaaactgcgatcttggctaatgtgccctgaaattgagaatattgatttgatagtaatgccagaaagtttattgcttggagacgtacttatttctggtggaaaagttgggggatctgtgaaaattcctccatttgtattatctaagttttatggaagcccaacttactgtatattaagggcattcatatttgtgaatgatattgtagagaagaataacattgaactattaaaagctgtaagtttgaacgaatatgagaaactaaaccccagagtatataggtcagatgaaggtatgcatgaatatgcacaatggatctttgtaaataatggatttctagctaagagttcgaatattctggaaccccatcctggtaaaacatcaatatctgatgcattatacacccctgtgaatgtaacccatcattacaacttcacaataacaccatttttattttctgctgttgctttgaataaacctgtatttagcccagatagccagatttttgaaatggtattgtctggccaacataatcgatttggtcttaggttgccccctacccattcaaaatggtatgtatttactagaactgcggacaagtgggatcagggctgttttgtggaatgtgaaggagatatgagtagaagtccttatgccgaatggtgtttacccaaattcgtcgaaaataacccttttaattataatctttgcaactacacagttgtgaccacatcaccagacatttctgagtcacaaatagaagatgcaatagctgttgttacaaatccaatttcttatctttcttatgtcgatacaatgagccttgttaatgccattttttctcttccagccacttttgaacttgtatggggaaaatattttcagctaatatatgaaactgcaatagattcacataatatttctttcaaccaagactatccgtttgcacaaccaacaacattagctgtaataaacagaattttgagcaagcattactatagagaaaggcttgatattaaaacttcactaccattcaattcaatacaaaggatatacactttggttgagtgctttttagttaacggacttgataaccttgttttaaattctacagatctaattggtgctacaaacccactgccagagttatcccctgaaaatttgaaaattttgttaagtatttaccaaggtgtagcttctagaaagagctatactcatggagctcaagatacctactccataattactgaaaagactggtaatattgtatttagtagtacctttaatcaagtagatatgaacaaaggtgtcaaagtaggtgggatatctttcccaaaaattgatatgaaaagtatcaaacccgaagatatactattccataacggagtttactacagagttaacaaaaaactatatgaaaataacttggcaattgaagggtttaatttttgtgcgaaaagttttaacacaataactgtgataagaacaggcggataccttagtaactacttggtgacaaaaagcctagaaaacattgaagaatttcctctggcatttacttctttcgtattatgcactttggaatatgaaatttggaatttagaaaataatgttgaactttctttctttgcagaatataaagaagaactggattattcagaagtaaaatgtacagcaatgaaacaagatcaatccgaactttcagatgaactatgcactacagagagggttaaacatttcacaaaccaaacaattgagttcaagtgtggttgttctgcaattacatattacggcctaaagggaaagccaatcccatatatcccaactttatcagataaagaccttaagccattattttctaaatctaggcccaatatacttcaaccatatatgctaatttcaaatcctaaattgtccacctattgtaatgacttccttccaattattattcagctaaaaaacattcctgattttgttccagatgaaagcttatctctgaatttcaaatgtgtaattccaaactctgcatactctagtttagaattttgtacaaaatttgaaaatgaacttcaatacatggattactctttttcgagactaggacaaaacataaatttaacatattatgtaaagccggatattattcaaagaacagctcttccaataaaacaatcattttggagaccgctaaatcaacaagatgaacttcctcaaataaatggagtagctggagtaacagttttattgaacataactctcgaattaagtaaattagggctaggaaacaatttgcctgatttatttggatattctactttcgatattattacatcaatagaaactagcacaaaggaacaagcctctgaaataggagagttatctacaacatatattcctagcaaactaatcaattttcctggagcatttaccaaatcaaaagttccagtatcatctattattgagcacgttattccatattctataccatataattctttagaaaactgcccttcatttttgaacaactatttctcaagtaattatttaaaaagcattgaatttgaaatgagcgaaggccttggaattagtaaagatagttgctttaacccagaattactgtcatcaattggtagctgtaggatttcaattacgaatgaagaatatattaaaggtgggtcatttgattgcataaaatctacttcaagaaaaaatttagaaatgaatatcttagaacagccaatatcaatgataaatgttaccaaattatccactaaaaactcatttgcttcttcgaaagataaggtaatttttcataacgaaacaatccaaccaagtattaatgcttatttttcatcgatagtttcaaaaaatcatccaaaaataacaattgaaactggtacttctaaaactatcgaccagattgtttctcagagtggatattgtgattctatcaagacgggatgttcctcttgtagagcttcaagaagttatcaggctgatttccaatttcaaaatcaagaaatccgatactactgctctgcaacttcagatgaaaatcaagttgaggatcttacaacagggttattagcagcatgtagaacagatggatcctattggggtcaagcatgttcatttcaacagtcaaatgcgacactttcaggtaatgctacctacactgaacttactctaataccacaagaaagtttaactcatatggtcattgcagtgggaataaagagtaaaattatagatgcaatcgagtgtaagaacttctatctttctatggttaataaagaattaccactacaaattattccgcacaagattccaagtataatttctaaagcctctgagagtttgctcttggcgaagataaaattcattggagggaatgaatgggataatgtacaaggacttaaattcctttccttcgcgtattttgaaaacacaggatatgttcaattaaaaactactcccagtgtttacaatttaaaagaccaagcaattcaaaatgatctaatagctgtttcaattaaattaaatattactgaaaccgatgtcaacccaagagatggcaggctttctgttatacttttagttataaagcaaaattctaacgaaataataaatgaaaataaattgaacattattgtaaaaagaagtaatattcataatctagcttcttctggtgattatgtatcatacgtatgggatgatctcttatttcaacacgatttttcgttaataaaaattaaagggacaactgagaataaagggcctagagaaataattcccattaactttaagatttcaaacttggctgggatgagtaattggaaatattcaatactggcaacacttagtgaaaatggcttagataatgaacaaaataacaaattcaaaagtaatgcgctactactatcctttttaacatccaatattccacaatatttaagattacccacaaattatgaatcttggaaaatacatctaattattcataaccaagataatgagttactttgtgggatagactgttcagaaatcaataatgatgcgattgacaaacacttaagaaatatgttctgcgtaaaaagctcgagttcgaaatgcaattatttcatttttcaaaagtcaaagaaaatctttgaagtagggcaagtttttctgaaagaagatgaacttaaagaagagtactctaatttattagaatattttttgaactatcaaaaaattggcactttaaatgataggcttatgattgcatcgatcttatccgcaaaattagatttcctaacgatagatcagattgaaaaatttcaagagaaactaattgaaatagatcctaataataaagatacaacaggaggaaattcagtaatgattctatacattttttggagattatttgaatttagctataggaattttgataaagcattaccaagtcattcttttgaccctgaaaggttatttagaattgcactaaaggctgaatgtggatattttgaaggttttaaaaatcttattgtagatattttagatttcttggttgaattaagactacttagtaatattgaagctgatactaatttgtttggagcattttcagttaaccaatgggcaatgaataatgactttggtagccagatagaaattaaggggaaaatgacaaaattatcaattcaaagttcaatattttctgatttagatttacatagcggtgcagctattggaaatgaactagttattcctactcttgaccttagtaatgaaaaacttgaaaatattgatatttcgttaataaagaatatatactttaagttacatcatgagaatgttgactaccaagaattttggggaagaaatttattcattaactgccatgatcctagatatggccttactattattaaacctccattgtatgattatctttttgaattagccaataaaattcagcaagataaaagctttaatggagtatttcaaaaagtatatgacgtatttatatctaaatgcggctatgaatatcgtctttacgggattgagaacaaaataagttttattgttagcccagaatacactcctagtgttgttttgggtaagcgtttaagctaccaatgcacatataagggaaaagatggttcttggtatcaaaatggctgtgaaactaaattaaaacagggaaaaatagtttgtagttgtaattctattggagaatacggattaattacaacttatcagtcctctctcacagaagttgtagtaaagttatctcacaatccaggatcaatacaagaagttaatattaatggtattatatacaaggttaataatggtaaattctactataataaccaggtatttgatattatttctaatgaaataattaccatttatccagatagagttactgtagggaagcgtcagttccccttagaaaattatttcaattatgatgttgttacccaactaacccttaggcaagaaggcgttcttggcacgataagtcttagatcaaaggagtataatgttgatattgaaggatctagcatagttcacgatgggtttaaccaaggaaattattctcaaaactcgactataataatcatttaa

SEQ ID NO: 691 - DNA, 381 bp, Cryptosporidium hominis
atgaaacattttttttcaattaataggatatttccaaatatatctattgaactaaagttcagtttaaatcatatctttgactttatacaagatcagcacactcactacagaatattaaatgccatttatattttaattattgatcttaaagatgataatacattggatcccggagcagtaataaacaattttatcaaattgattggaaggttattaaaattggaaaaatatgaaaataatgatgagcttgatttaagtattagtttagttgaaatatttttagatacattctttcttattaagtttccaaagaattgcaacttaattgaattaattaattcaaaaatgagcgaactaagggtatataattttggattttaa

SEQ ID NO: 692 - DNA, 1935 bp, Cryptosporidium hominis
atgaataccctttatacatcgaaattcatattttttggagttttcacagttctttgctcttggttcccatttacatcattacttgctgctcctggagtttgttctaggagctttgaagggctgattaagcagacaaatgggggcataaatttgatattagtatgcacagtaatcttaattggactttatttatttttttctggtattggattgattaatttgtcaggttgtttattgagattaggaatgccatcagactacccaaacgctgtaatgagggcatttatgtactcacagttcaggagcgattcaaattattcaaagtctgaaattagagaggcaaatgtacatcttactgtaaattcaatatatagcagcagtaatgtgaataggagtgttgaatcaaagcaaaatattgatggatattacaatactcacattttgacgttagacggtgagttcaaaaagaggttaaagagagcaatgcaaactgctaaagcaagattaatcttagcaattgtaagtgtaatggtagtgatatgcgtttcttatgcttcatttgctgtctttgaagggtctcaaatttttttggaaccaaatagcataatattgaatcataatgggattgatttgttaggacctgaatcagaatttggaaatacatgtttacttttaataattacagcaatttcaataatcattctgaacatgaatacgtgcggctcatttattctgtgtattgtttcttgcatacatttttttggattattacttttcttcactctttattttataaacttttctaatgaagctggtctatcttttattagttttgaaagcgaaagcatccaatttgattgggatgtacatatctggggcttcgttggaggaattttggagatgggagcctttgtgatttctgctgtttcatttcatataatcttgcctggggcatttaaactctttcccgattatgaagtaaagtcttcaagaatctggggaattacaatatctttgattttgtttatttttttctgtggaatatcaataattttgggtacagtcccttcatttccaattttaccttatgggcttgagcctagcagtgaaggaattggtctggcatggaggattttggagtcaaaaattagttcaaatagttttttttcaataaaattattaaagcgtgttttccttctgggtaactttatcacttggattcttttcgtctcaattgttatgaaatgcatagataatatcattagaagtatttcaaaccaagttgaatgtaattttgaatcgttctctccaaacaaaaattctttaagtaaaaggtattttttaagatctgcaaaacagcaaatttatggaaatgaaacaaataatacaagaggaacatgtgagtatttatcaaacgacaaaattgaagcaaacaaagtatttttttggacaatagtcaaaaatttaaaagcgttagtaaacagaaatagaattctagactttgcaagatattttgcgagttctgcttcagcaattggaataatcttttttgttcatcacaagctaatttccgagccatatctgattcctattttcagatcgttatctgcctcaatattttctattattgtcctgattttaccttgtgcaatattttggtttgtattttactctgaaatggttccacaatcaagttctaattatcagattttgaatttaatatttcttggccgagtatcctcaagaattgatagaaattatgagaaacatagagataaactttccatatacaatgataattgcaatttctcatttaatcccctcactttcgggtttttttcaataacttttccaattttattagggtgcacaattttggtttacgagatttctaagttcgcttcgttgtgcctaggtttaaggtttaacagttag

SEQ ID NO: 693 - DNA, 558 bp, Cryptosporidium hominis
atgtatgaatacacaaatatatgttcacagagggaagtaagactttcaatctttccagaaaaatatccagagaagaggaaaatttctgaggaaatacaaactgaaaatatagaacttcaaacagattggagcacgaaatgttgttgtacttcaagagtaaagttttcagatacggacattcaggaggatgccactattgagggtgaaggtaattcagggggacaaataatcgatgagatagcaaacgctatttcaaattatagaagagatagcgtcttgaataccatctcagaatttgaaaaaaaattgttaacaattggaatggctgaagaattaagtccagaaaacagtgatactgaaggtagtgaatatggagaattaaatatgagaaggcattctgagctggcttttaaacctttggttttaagtgccgtagaaaatagaagagctacagctcctgataatatgaaaagaaaaattatcgatcaactaaaaatacaaataaatgaagataatactgaagagttaagatctaaccaaataccaccaaataactaa

SEQ ID NO: 694 - DNA, 831 bp, Cryptosporidium hominis
atgaatagtaatcaagtagtaaaagcaaaacaattagtcggggtagtgacttatagcaaaaataatagaaaagaagagctctattcttcttgcgatggaattataaaagaggttttgtcgcagggttttcatgattttgaggctacttttttcgtaatttactgtgatttaaaaaatccagtactaagtacatattttggatactcaatcgttcctattactgagaaaaacacagtttttggaaaatttgaagattcaccagctaaaaaagagataaatatcaaaaaaaacaagtttaatgatcgtaatactcgacttatatcaaataaagaacacaaaaaattatattccgagcaaagcacaaatcacaaatataactcaagtttggagtatcaaaatagacaatcaatgcattgtgttggtaaatttcaattagactcgatttgcatgaatgaaggggattcagcatcatcagataattcggagaatcctagtaacgtaaaaagagttgaatttctctacaaaaaatgtgtaccaaataaaagtaagcctgcagatagttcattaacagttaagttgaaagcatacagaaaaagcttagaagctctaaaacaatcagtagcaaacattacagacttttctcgcgtaggaaatataaaattggaggatgaaaagcaactagactttgataaacaaaagaatttagtttcaaaaatgtctactttgtccattaaatataggatatggatatcgttagcattaacgataataattctaacacttatagctttgcttagaatatctaggtattctttcacacatagtacttag

SEQ ID NO: 695 - DNA, 228 bp, Cryptosporidium hominis
atgaaatcgaaaggtagttctattaaagagaaaaattccgaatatacacccaaggatgatgctgtattgcttccagagaaaaggagcttatttaaaatatgtgataatggcgttacagtccctagattggagttgttttatgggtatctgaatattccattgaggtatatttccacttttacttcttgctttgaaggcagtatgtgtagtattgtgtacaagacttag

SEQ ID NO: 696 - DNA, 1245 bp, Cryptosporidium hominis
atgaaggttgaacaaaatgtgataacaactgaagcaacccgattgctagaatgcgaagcatttaaagagagaaaaatgtttgaaatttattattccaacggcctttattatttggcaattttcaagggaagatataatattcaaatgagatttctcactttaattttaatgtcagttcagtgtatttgcgttgtattatgcatgaagttgagcgttacttatccagcaagtgatggaaaacaatacttaactccagttgctgtagttatggtcgaaattttgaaattacttacttctctgttcatgattttccagatttctggtggaaattcgatcaaggagtttatttatgctttaaagtgcgagtttctacatgatgtacgaggaaatcttctagtagttgttccaggaattttattcttgttccaaaacaaccttacatatattgcaattgaaaatctccctgcttctatataccaagtaactgcgcagttaaaggtacttactactgcattgttcagcgttgtattattaaaaagaagacttagcactactagatggtttgcttgttttttgctatttgttggagtattattggtccaaaaaaccaatattagaaataaagggaatattaattctttccagctcatgattggctttttagcatcagtcacgtgctctatcacatctggtcttggatctgtaattatcgaaaaggtagtaaaagacccggatgactctaagattgtctcttctgatatcgaaaactctacaaaactagataatctaattgatgaaagacctaacgatagagttcaatataagtcttcagtttggggtagaaacgtcattctatcccttattggaatatttggaggtactcctatcgcttggattacatgtaaagaaaaaataatcagagatggagttttccagggtttctcttggctaactattctagttatttttctgaatgcgtacggaggtttcattgtagtcggagttcttaaatactcggacagtattatgaaatgttttttcaatgctttaactatcattatcattaccatattatcttgggcatttatgggtgataatacgccttcaatcaagttcttcattgcatccacgatcgtaattatagctataagtgtatacacttttaataaagttttcccagattcgttctacgcaaagtttttgaggctcgttgaattcaagaatagaaatacagagtctcattaa

SEQ ID NO: 697 - DNA, 384 bp, Cryptosporidium hominis
atgaaaaccaatattcttctaattatatggaatattattatgaattttttcattttgttttgtatctggatggagccgtctcgattaggttgtattctgagaattaactgtgacgatcaaacttcaagatcgctcccagataactggattaaactttcttcaccattttacgggcaatacaataacaatattttccctaaatattggaaaattgaacttaccttttggtgtttttttttcttaatgcttaatatcatcatttccatagcattgagaaccttaatctttaaatttagagattttgagcaaattagggctcctaatccctcaaaaactacatctaatagaaccgaatcctctctcaacgaaaatgttgggacgtaa

SEQ ID NO: 698 - DNA, 612 bp, Cryptosporidium hominis
atggaagactattcacgcgaatatagtgaagttttattacagttgaaagaattacaagattcagaggcatttttagaaccagtaaattggaagaagctgggacttgatgattatccggatattgtaaagaatccaatggatttaaaaactattggaaagaaaattaaggcgaacttttatacaaaagctgaacaattctgggcagatatagatttaatttggtacaattgtcaactttataatcacgaatcttcggaagtttaccaacagagtattaggatgcaggatgcggcgaataatctaagagatatgttgttcccctcaatttctaagaaaattcacaagagaaagtacgagtacgattctcataccgaatcagaagatgaagactcatcaaatatcttaaaaaaaacattattatgccagaggatgtctagacttcctccagagcttctcgctttagtagttaggcatatttattctcaagatcaacagataattcagcacagtggcgaacataaattttcgatagacatagatttcatgaacaaccagttattctctactacttcagcgctcactaagagactcctaagattacaattgtcctaa

SEQ ID NO: 699 - DNA, 1488 bp, Cryptosporidium hominis
atggtagctgttgtatcaagcgactctcataaagagaggcagtcaaatcgccccaggtttattactcctgtctcagcagctgaaaaaagtattcctgtagttccagctcctgatgaaaaaacttacaaagagacaacagaggcgattcgacaagtcctcaatgaatggaatataaagataagaggattaacaaagatgataaatgatagaagcgtggggagggaagctttcgatagaaaaaaaagtgagttccaggcaaagctagatgaatatcagaaatgtattgagaatcttgaggaggaaaggaaactatgtatggctaagataaatgaaaagtctaaggagggccgtgagatgaaggctaaccttcagagccttaaaaaatctgtagggtataagtcagaggaggagattgaggcaaaaattaaagagattgaatatcagttggttacttctacattatctctcaaggatgagaagaagttactctcacaaatttctcaacttaaacaaagccgtccaatagttgggaggtttgcacatatggatgcaagcgcctcatcatttgaggaaaactcaatcatcccattaagagctaagattagttcaattatagaagatctcaataaatttcgcaagcaaaaaaaggaggtatttgataaattgcgtgcccttacagcagatagacaaaaggctttagaaccacttagatcgctttatgacgaaaggagcgcaatgcaaagtaaggtagaggaacaacatacgaaacttcgccaattaagagaggaatacgatcgtgaaatgaagttgtttatggagtatcaaagtaaattgagagctttaagatcagaaagagttaaagaggaaaaaattttaagagacctctatagacaacgtgatgatctaaggctagcattagagcaagaggacgatcctccaatttctactgaaatgcaacttgttcagcagtctctaagctatattcagaagcttatggaatcccatggtgttattgacaagacttcacaatctacaaaggacaaagctaccttaagtgatgagagtaagaatctctctgcttctgctatcaaaggacgcgacaaagatgagtcagtactcttaccaaagaatcagaggaacgaagaatatctaattcctcctaagggaaagaaaaataagagaagacagaactcatcttcaaataactctagctcgactcacaaatctctagttgtagattttgccacaatttcgacttttgagaaagttgatttggatgtacctatgactactgacgaccttcctaaagcttattcacttttattggaaaaacatctcaaacttaaaagtgaatttgacgagaaatttgcaaatcgcgagaagagaaaggaggagatacttaagaagctcggtgatatagaactaaaaatcactgaggctggagggattcttgaagacgcagtttcctctccaaagattgaagaataa

SEQ ID NO: 700 - DNA, 1065 bp, Cryptosporidium hominis
atggttaagatgagctctagagagagtgattttaaggtttattcgaggaggaataggagcggaatttggcgattactattaattaggttgtcagaaacaaataaagaaataatggttattgttcagaccacaaatgtagaaaggattggagttaagaataaaatagttgatttattgatagaagagtttattgataaaagctttgaaatggaccttatgggatataaaataaaaagtttgtatcttcatcagtccgattctattgtagatacctttgatattggaaagttagatttgcttcatggaagcccccagatttcgtttaaaataagaaatactgaactatttattggtccattgtctttttttcaaacaaacacaaaagggtgtgaaaccttgtacaacgagataagaaaagttatcgagataaaactcttggaaaatcttaaaaaaaatgaaaatcttaaaaaaaagaaattaatcattttggatatttgttgtggggtaggagcaattgggctaacgttactagatatttttcgtgatttgggaaggaattttggagatgttgaacttattggaatagattgttcgagagaagcaataaattctgctaagaaaaatgctgaaaatattggaattgaaaatgcaaaatactatacaggtacagcagaaagcatattaccaaactttttagaaaatttaccatccaataacttggtaatcgctattgttgaccctcctagaagtgggctgcattcaagcgttattaagtcactgaggaagatggcaaaaatagagtatttaatttatgtaagctgtaatgttgagtcacttgttaagaattgcatagaattatgctcagcatatgacccacacactgatcagcaagaatattttcccgtgttttttccggaatgcgcagtccccgtagatatgtttccttttacgaaacacgttgagactatcttatacttaaaaagatatgtaaataattccaattcatcagcactttcaaaaagcaaaacagataatattagtaataacccactactagctaggtag

SEQ ID NO: 701 - DNA, 3009 bp, Cryptosporidium hominis
atgtcaaacgtactgacatgcaaagcattaaagatattatgtggagaagatatacgttactttgagcttgcagaagttgcatacttggctcgaatgaagaaactttacgtatgcttagggaggcattcgatatatttactgaaaagaaatttaaggaaagtaattactggaggaaagctaaagtattctcaaattgaggggatttatgaggatataagcaaagatacccggtttttaattcttcttgataatgaaagggatgagagatgggtagacgacaaacttattatcaactgtttaaataggcacgtactttgtaattttctagagatggcctggaaagctgatcatgcatttagaacaggaaagtattatgactttcctaggttcggaatcaacttgaatgaaattagaaatggattaaatatttctaagagcaaaaattcgagcattaataaaattaaatcaattgcaatttggggaatgaattcaagagaaaaaaacattaaaggacggtatgaaacgtacaaatttacagggatattggacgaaaaaacactgttagcaattcaaaaacaattaaatttattagaagaaggatacacgactacaatatttccatttgctaaaatagaagagtttcaagactataaaaaatatatctttgatggctatttcttctttgcaaagcaaggttttgaaaataaagcaactcaatcacacaactcacagacaggttcatatgtatcatataatggcgttgaaattaatattaatgtacatccacagatatttttaaaccaaaagaagccaaatactaatgacactcaaaccagagaaaataaaggggcagaaacaaagggttactcaaatattggaagcaacctgtataatgttgctcaagaatatgttaggtttctctccaatatgtcaaccgataaaacttactctgtatatcttaatggccaatacaacaaaaaaatgaacctctctgatgacatttcaacctggtcttgttgggagatttttattaaaacatcaagaatgagcattgtatgcataatcatgaggagatgctatatccctccaactttagactcatatcaagatatttcagtaacttatacttgttcatataaggatatgaaatattttaatttaactgatagggatttgttgagagagtgtagactttcggcggattcgatttcaccaatttctcaacatcacactttatacacagaatttattcagtcccaattggatactttgctattcgacgaattttcatatagttggatatctacaaatataaagttacatccagcattcaaggtaggagcaagatcttttctcaagtcaatccttaaaatgttggataaagcaaatattctagcagatagtgaactaatagaagaaattgatctattggaaaaaagtggttcaagtagatacgaccaagagaatgaaacaaaagttgaagtatttgaagatcctatggcatgcattcatgaaatgctttcacaaatttcaggggtagacaaattctctagaagtattattgaaagacaaaaattacatttttttgagcttaggcttgctaggtatttatcttactgcgttgatgggggcctacttggagcaaaatttattatcgaagaccttgtatcgtctgttgggatggcaaataggaatgttgatagtaaaataaggcaagttttggactatttgttacatgtcagatcgaaagatatgtctacggattattgtcaattaaagcttgtaaatctccttcagaatccgagatttgtaagagattattgctttgtgccttctgtaatggcaagatttgtaaatagcggatattgtgcaagacttatcccggctgggaaggaaacattatatatagaatttctaatgaatcttttaacgctacctataaaaagtaactttggacaaagatcgcaattaagaatatctattcttcaacaagtgctgcacgcaacaggagactctaaaaaaagggattattatattcagatggtccctttacttgttgagattttttctggaaatgagttggacggcgataacactggttcaaagtatgctggggctgctctacttaatctatgcttctcaaacgatatattaaaaagtgagcttgtaaaagcagggatatctagcgcaatagttaagaagcttcagaaaagagacgaccttcaactgacaaaaatatgcctctccctcgtggtaaatatttctaaagacccttcacatcgacaaaccttgatagcggaggggatattaccaataattgctgactctctccatgagattcttgaagattttaggccatataatcaagatttagttttgcagaacaaaatccatggacaatttagcatttattcaaaacaaaatagcgactgggatgtgctacctattattttaggcgtaattggccaattgagcaatgaaaacgatataaaacacatgttcatttctaattggtgcgtgcttgactatattttgtaccttttccacaaccttgaagtttatgtgggaagtaataacgacatgatttgtaaaataattttttgtataaaacagctttgtaattcgagttggattgtgcaacttcgtgttggtaaacattgtattccaactcttattgaaataatttccacaccagtaaataaaaaagaaaggagagaggcttcaactataaaatttattcagtactattcttattgggtcccttttcatactatatcagaaaatagggattcttctatttttcttagcggaataaatggagatgtaatttttcattcgttattattgctagagactctttcttattatcatccaaactgtttggaaatgatttcattcggtattgaaaatgcacttgatctgtgcttggagtcttattgcatagacactatagtaataaaactaaactacctaaaagacgtagtaaagaaagtatcgctcaggatttag

SEQ ID NO: 702 - DNA, 3489 bp, Cryptosporidium hominis
atgacagctacggggaaaagaaatgcagaagctgatcagagaagacgctctgttctagttagtgtggataaagttctagaccctacatctgaaaaaaaagacgcttcaggaaaatctgggcgtaggacagctcactctagcaaaaaaatcaactcaaattctgctaagagtacgcaaacggatagcagcaacataggtagttcatgcggaattgagatttcttctggtcaatctccaaacaaacttggtcatacgtctttggctccaaataatgcacaacaccgaaaaaagaagccagataaatcaaactgtggagaaatccgttccaattttaatagtatacaaaatttagcttctaacttaccttcgctttccacatcgtgttccccaacctccgtatcagctgtaacacccacccaaaagctgttatctacatcagcttccgattgtacaaaaatatcaaaggtaagtgttaataataataacaagaacagaaacagcgtaataatcgaaaatactacaaaccctgtaaatattggaagtaatagtttaaacgattcaaatcagcaatctaaaggcagcttttcacagggaattgctcaaaataatgccatatcagaaggtcaacaatatggtcaagtacacattcctttgatatccccgatgcctcatcagttttggtacaatcatttggtccctcaatgcaactttggtcatattgttccccctcctccggactactttcctgattcaaaaatatctttaaataccccaaaagaagatttaatcttaccagggaatatttcccctcatcctcaacaaagtgttaattcaactggcattataggtaataatttaggtgcatgcgcaccggctatattcaattatcagatcccttatttccagccatattcattaagaagctatgaaatttctacattaaatgtaatcaattatcttatcccaaataaagaatttcgtttgaaagtttcaagcgtggttaatgaccttagaaattggcttgaacaatctaaaattcctttgttagtatttccatacggttcaacgagcacagggttcgctgatcaattttctgatgtagatattgcattgattccaaaaaaggattcgtttgacaaagctaaatatggagatgcgcccatatctgatatttttactaagccacctggcctaattttacaggaacttctaggcctgctacaaagtgactcgttggatgctctagatacattgagtaagaataaatcaactgactctttcgattgcatgagctcattgaataatgaaaataaattgaaagggaagggcgctgtatcgttagaccaatcggcagaggtacgaaagcttcgtaatccatttacgtgtatacaggatataaccagtgctcacataccaattatcagaatgcttcatattcatacagatatagttttagatatttcaattgctctaccatcaactaacaaccaagaagaagttaaggatgggcaaacttcgggctctttatgcaagattcaaaaggctaattcattacctattattcaaagcagacttggaatccttacatggtatgcaagaatggatcctcgagttgttcacgttgttgtgctaacgaaagtatggacaaggtttcgtgggcttaggaataccttaaatggattccctggcggatacgcctggacaatttgtgttatatactttttccaaaaaattggcatccttccggttattgatgcaaatgagttctttataaagtcacataatgcatcaaaaataatatttaaggatatactagaagatctaaattctgatcacatccaaagcagatgcaaatccagtgaaaacaacttggcacttacttcaattaagggcaattacaaaaaaggaaaaggtgacatttatttgcaaaatggaattgaaaaaattgagggaattccagaagaaagctatttagatgggaattttccttctttggtttctgaattagatcaagaggagacagtgaattacaaagatgatatagaagatgtaactaatgttagttacgacacagaaacggcatctggaagcgctggggtagctgaacaagccagctcaagcgattcaagttttgattctgagccagataaaggttcaattgaaaaagatggagttggatataaaatgctataccttgatgttgtaaagggtggtaaatttcaatataaatcggatttagatgaagtaaagggcggccgcgctgccaaactttccgtaaaaaacaggtattctatcagcaaggatgttaattccgaaaaaacacttctgaatgtaaagaacttaaatttagataagccgccagaggaacatgaaacgtttggtgaatcaagcaggtcctcaatcggaagcaccgcatgtacgtattctctttctcctggaatattaagttcagacaatatatgtattaactgttccgattcaaaatactcttgtgcttgttctgaatctaatatggcgtcagttgcaagcgtcggatattccatagatactggctacaagaatggtactaagcaatcagagtcaaatgccaataaagaatatggcaattgctttttagctgatattaagggttataatacacactcgaacgggaaagtaactaatgataaagaaaaaagtgaggaatgcggttcaaattctgtaagggatatttttgatattgatgaattatttagcgaccctcctacattaattaacaatgtaaaaatttttgaagaatctaagttcctcaagttttctcaaagccacacattattttacaggtttcttaaatttattgaaactcatctttggactacagttattgatatcagctctccagacattattaatactactattccgggtatttgttgtgatataagaaatccttttccgggcccgcctgcatgtagacctatttttgatgagaataataaaaagcaccttcggaatgaaattcaaagagctattcaaattatccaatccccgtttggcgattattctagtatttgtggagggtatcttaatatatctgctgaatgttcaaagggaccttttacaggcacttcaggaataggaagcggtatattaggagttggccttggattacctctatctccttctaatgttaatgctgcgaagcaaagagtctcctccaatcagtattttggtccctttgaagctcctcctttacatattattggctacaatccagttattagcggctacgaccagaataatagtaatgctatatttcctgcccaagttccagttgcaaatttgtacactgactctccgccacatttgatactcccttctgtttctactcccctacatatacctcctccaccgccacctcctcctccaaaaattaagcagtcatcatcaatattaggggtaattagaggaaattcattcgaaagtatcaaacacgctaactcaacttaa

SEQ ID NO: 703 - DNA, 4050 bp, Cryptosporidium hominis
atgcaatcaaaaattgtctataatactgacagtatggcacaaattgaagattttagtgaaaaaagaaaagaaagaacgcttaaatgtttcataaaaaaattaattattgagaattttaaaagttacaatgggaggcatattatcggaccattttctgaaggcctaacatgtattgtaggcccaaatggctcgggaaaatcaaacctaatggatgccctatcttttgctcttggattatcatcaaatgacatgagaagcacaaatttgaaagatttaatctaccgaccagagcaggaaggagggccagttgatatatcgcaatcaaacaatactgtaggactctctcagaaaggttctcaatcaaacttgtcaaataatgctgaggtatctcttgttttcacattacagtttgaaaataatcaagaaataatattttcaaggagaattttatcaagcggagcatcaaggtatttaattgataaaaatgttgtctcgcaggaaacatatataaacaagctggcagattataacattctagttaaagcgagaaattttctggtttttcaaggcgacgtagaggatgtggcgcaaagagcaccaaaagaactgacaaaactctttgaacaaatttctggcagcgatgaacttattgaagaatatgatcgtttatctaatgaacagagcttaaatcaaatcgtgtcacataatagtttcaataggaggaaactcctcgaagcggaaagacgagagctgcagaagcaaattgaggaagtgaatgaatatgagagattagaagaacaaaaggcaaataatcgattggagctggtactttttcaactttactgcaatgaaaatatggggggaaagtattttgatgagcgacaagctatagataatgaaattacattaatatgccaaaatattgaaagtgaaaaacaaaaaattagggatagtgaatctaagcttgccaaggataatcttgaatggaacaaacaatataatgatctcgaaaaactggaacaggatgaatcttcaaagaaaaatgaaataatcaaatacgaaaatagcattaaacgcaataaattagaactaaaaaaattacaaaaacaaatggaaaatatgctaacatacaaacagaaaaacaaaaaattaattgaagaatacgaggcaaagacgcagtcaattaataacgagttgagcaatttgaagacacaagaatcctctgaattcatagatgcaatatcttttgatttacaagaatacattgaatgcaaaaagaaagcagatatagcatcttctaaattaagagaacaatcacttcaaatagaacgagaaattgcaaataaacttggtttaattgaaattttagaaaaagaaaatgaagaaattcaaattcaattaactactagtaggagtttgttagattcaatttcggcaaaaattaacgaacaggaagaaaagctgggccactcaaaagagactgaattagagctaaattctcaaatatttgaattggaatccaattttaatggctttacagataagatagcaaagctttcagagcaaagatatacatttaacgaaagaattaaggatatagatgcaagaaaaggagaagttcaaaaggaaattgaatcaaggaaattaattgaagatatgaagaattacataaatactggaatgataattgggaaagaagaaaacattgtttttgggaggctttctgacatgtgtcattcaaataacaaacaatataattcagttatagactccgcacttgggaagtatagcgaatatatagtggttagtacttgggaaactgctaagagctgcatttgctggctaaaacaacatagaaaacaaccaatgaattttctacctttgaactctatcaaattagataagagaggtaattcaacagttatggaggctaacttaagagctatatgcaataataacaaatcaatgaggtctttagctaaggacaatttacactcatcagatgaaaggatacttcctgtattagaattttgtctctttggagtgattttcacgcaaagcctggaagatgctaagaaaatattttacactgaagctccaagattgggaataatacctaaagtgatgactttcgatggtgaaaaaatacttaagaatggcaatatttctgctgattcttctagaaatcagatgaacaacaaaggttttgcaaaagaatatgcaaatttactgagcaaaatcgaaacactaaatgaagaaatttgtaggcttgaagaagcagaatctgatgggcagagaagattatatagattgaaagaaaatttaaagagactgaaaattgataaaaatgctatagagttaaaaattgaaatttataaaaaaaacaaaaatgagaaaagcacaggaataagccttttagaaaatcaattcaaagagagagaggaggaaatattgaaacaccgttcagaatacgaaagtttgtgcataaaattggaaaatctacgaaacgagattcatgattctgatcagaggcattttaaacaactttcaaaaaaactaaacatagaggatattgcttctctcgaacaagaatccagaaaaaaacatgaagaacaactacaaaagagaaagaaactttctagcaggctaaatattatcatagaagaatatgatagtattaagaaaagagacaatacactgaaggaaaaatttaaggaaaaagaggtcaacttagctcgtattgaaaatttgattattgaagaatgcaaacaaatcgagaaattgaacgaagaagtttcacaaattgaatttaaacaaactaatcttaaaaattcaataaaatcaattacatcatttaagaaagaaattcaaaaagaactagaggcaaaaaagaaagctttattagaactccaagggctttgcacgagtaaagagcttgagagaagttccaaaaatgaagaattagaagctcttaatggtgaactgattatattactgaaaaatattgtatttgagaacattaaaattcctttaatctctggagaatatgatgacattagaaagtattgggaattttttgagacgagcggtaaaaacaagagtgaaaaccaccttgaatatcttgagcccccaatgattcaaatagactacagtgcattgacggaagggcagaaaaattcttctaaatcactaagacaaatagaaagtgaagtctcgagacttaaaaagaatatttctgacatttcacataagctagagtctttgaacccaaacatgaagtccaaagggaagcttaaagaaatagatgcacaattggaagcactcttagaagatcaaagagatataagaaaaaagtcaatggaaattgataaatcgtataaatcacttcgtaaaagacggacagaatcattcatgaaatgcttcgaagctgtaaaagaggcagtcggagatttttattcaagactgacatgcgatgactctaatattggcggtcaagcatttttagatttggacgatactaacttggaagaacctttttcatgtggtgtaatttttcatgcaatgcctccatctaaacgtttccgagacatacaacaacttagcggaggcgagaaaacaatggctgcgttagcactactttttgcaatgcaaagttatcatccatctcctttcttcgtgctagatgaagtggatgcggctcttgatcctcgtaatgtacagtccatagccaaattcctaaaaaaagcttcatttcaatcaattgttatttctcttaaagatagacttttttcccaggcagatacacttattggcgtttacaaaaatagagaaatgcagacaagttctactatgactctagacttgcggagatattctcagccagctaccgtaatattaaatgtgcaaaaagaaaatttgggatataactctgcattttccagaagtattgaatatgactcacatgaaggcagctctttaacaggcgccaatttctttgaaaaagaatttgatcaggatattggcaagggtcagaatatttcagtcgattaa

SEQ ID NO: 704 - DNA, 2046 bp, Cryptosporidium hominis
atggcagctaatgggaatgatttagagcttatcacaagcattctatctaagaatccattaattcataggccagacattgtatttggaaaattgagtgacggcctagattattgtatatttaacagtgaatcgcaaagaaacagtttccacttgaatcttgtcttaaatacgggcagtattcatgaagaagagtttgaaaagggatttgcgaattttgtccaacaattgattttaaccgaattaaataaagagctgttgagaatccgtacagagcatttaacaaacataacatcatcaactgattttcattgtacaattttcaatatatacaatgaagttgaaaataccaagcttaacgactcagaacttagagcaactttctttgatgtattagaaatttttttgctaactatttacaaattccgggagaaactatcttcgtcctcagatatattttcagacagaatagaagaaataaaaaataaaacatttgatatcattgaaaaatctgataaatctgtagcaaactatatcgaaaagcaaatttttttgcaatttcatagagatactctattacctaagagatggccaataggagaaaagtcgagtattgaaaatatcacagtaacaggtttattaaagtttattaataaatggtatcttccgaataatatgtgtctgtttattgtaggagacattcctgcttctaatgaacttttggcaaaccacttatctagttttgtttctggaattaaaagtttaaatcttgaaaaacgagcctctggtattaatttatatgaaacttctagctcccacaatattttttctgtgaaagagcgtattggacacaaaactataaataacgcactaaatattatcgaaaaatacacaggttcagattttcaaagggaagttgtcattcagcatccaagtattgatcaggtctcaatttctattggagtaaaactagagatttgcccattagtagatgaaggtgagatttttatgaatgcagttgacacaataatatctaacgctatacatacaaaattactgaattcactatctcaattggcatgcgatgaagaattaacatctatatcttgggacttttacaattcgtctcgtgaaaattgtggttggaatacattttcaattgttagcgatgaaaagaactggagagcagtttttagattaggcattcaacagattgtatctatatgcaatacaaaaatgtctatggaggagtttgaagagatagtattaattactatctctgactacaaaaaatcggcagaagaagaattaggagatgacccaaaattagttcttgatggtttgattgatgattggctttgcggaagtattccattgagtaaaaagcaagaatatcaactattttgtaaagttgtagaccggatcaatcccgaaattatacaatgcaggtgcaaagctttatttagccatattatttactactttgacgaaaatgatcattataataaagaatcttcctttacaggatgtatttttgtgagtaagccattacataattcttttcagaattcagaaattgatccagaaaactctataaatacttcgaataacatctgcaaagctccagaatcagagtcagaatttatcaagtcactacttgaggaatataaggcatgtgtttataaagatcttgaattatctgttgaatcagctaaaagttattcaaatgaagttttttttgagaaaaatagctacaaaattgagagaatgtcagaaagctttgaatttggaatttgggatgcgctcaaggcatctacatatattactatagataagatttttgactctataagaactaactttaattcgcttgttggcgacttagtaaattcggacgaaagcattgaacatttgaatggcaaatattccataaaagagcttgattcacttgctgaaagaatcaaatttaattcaaataattttcaaaatgattcatacgagcaaggaagccatagcttaccaaatgacatttgcgacttaggtctttaa

SEQ ID NO: 705 - DNA, 5988 bp, Cryptosporidium hominis
atgccagctaaacacgatgacatatgttcgttatatccatatactagtattatttggaaggagcttagcagaatttcagctcaactttctcaagaaagcctaattgatgagacaaattgtaataatgaagaaattaagttcaatataatggccgatctgataaggctcctatcaaagcctcgcctttttctagaagaaagcatgaacaattttatgattgagactatggatttgtttggaaacgatggaatatttttaactagcatagtgttagaaaatctagaaaatttaatattagaaatagatcaattattatgtaacaataataataaacaaatttttcaaaataaagaaaatatcactaaggaagaatgtattaatttgattggtattatctttagttatgtagatatttccaattctaatagttttccagatgagcacgaattagaatataatgaagctataaaaaatacgagccaaaacgatacaaacatatataaatttgaatcaaatgattttcaaaataagattgactttttggtggaagaaccaaaagtcgttacaacaaaaaccgaactttttgaaaaggttttcatttctccattaagcattccagcatcagtttcaaaagaattagaatcccaactaatatcaaccgaaaaattaaataagaaattaagatcagcatttaaaggtttaaaaatgtttaattttgttcagtcaaaggtattcagttcaatttacctatcaaacagaaatgttttggttgctgcaccaactggttctggaaaaactaatatcgctttacttgccattctaagatcaatttctgattttgtcggaataaatacactagattcggacagtgtttctgattattataaagagccagacccaattaagttcaagattgtgttcattgcaccaatgaaatcattagtttctgaaataactcgcaagtactctgtagctttacaagaacttaggattagggttgttgaggttacatctgatgcagctgttccaaaggaagtgatagatagaaatcacattattgtgactgttcccgaaaaacttgacataatgacacgaacttatacctttgatgataacacagggcaagttaacttatttaattctctccaatgcgtaattttagatgaaatacatatgttaggagatgaaagaggtccttcagttgaagcaatagtatctagaattttgtataatgttgagatcagtcaaagaccaataaggttagtgggtctttctgcaactcttccaaattgggaagattttgccacctttttgaatgtaaacaaaaatgacgcgtttttctttagtcaagcattacgtcctactcctttagagaaaacaattataggagtcaatgaaaagcgagtagatattgagaaaaaaagagaaatacgaaaaagaaatgataaaacttcaaatcaagatagctcgctaaataaagaaaaacaaagagaagaaaggcagaaagataaaatatcagagcagattaattcaaaggaagatatttctaatatttcagacttgtataattccattgcatttaaaattgttttagattgcttggaaaaaaatgaacaagcgttagtttttgtacattctagaaatgaaactctttctactgcactttattttaaaagaatgttaaacatccactctataaaaagtagttttaatcgaggaacttcgtgctcagataataataatcaagaatttgatggaagcattaagaacctaataaaaaaaaaaactattggaaattatttttcaacagatgaaatgaataaagttaataaaaaagaatttggtggtaactacttgctaaaagcacttagagattgcgataattcatcaattaaagacctattcgattttggcttagggattcaccatgcaggactaatttcaagccaaagaaaactatctgaagcactattttctcaaggtctaattagagttctgattacaacagcgacattagcatggggcgttaatctacctgcgagacatgttattatcaaggggactaatgtatatgatagcaagaaaggtaattttaaggatcttggaattttagatatacttcaaatatttgggcgtgcagggagacctcaatttgagaggcttggatctgcatatatgataacatctagcgataaggtacaaagttatgtcaaaaagttgacatttcaagctcctattgaatcgcaactttcaaatgaatctaatttgtgtaatttgcttaatgctgaaattgctaggggttcaattttaaatgccaaagatgcaagcaggtggttgaaatatactttccttgtaactagagttaaaaaatctccaatagtatatgggttcaaagctgaagaaataataaatgacccaaatttagcacagttttgttacaacaatataagcaaatgtttagatttactctatcaatccaagctaatacgttacaatataatcaatgacgaagtcagccccactcactatggaaaattagcatcaaaatactacatcgatttcaatactgcaaatatttttaggaagcttatattagaagatgaacgcaattctgaaagtgactcttgtttaagtgatttcaatatcttagaaattgttggcaaggctaaagagttttcaagtatggccccaagagaggaagaaattgaagaactagagaatatagtttgcaaccgccaagttgcgagtattatcaagaaaagcttagatgttactaatgttagttccaaagttgcgcttcttctaatcgcatattcacttagaatcgaaataactacccccacccttgtaatggacagcatttacatttctcaaaatggaacaagaatcttgagatttatttttgaattgattcaacttagcacttttggagtttcagaaagagcacaaagagtattggaatggtctaaaatgctggaaatgcgaattttttacactcaatcagtcttaagacattttgtatacttttcttctctagataaaaccttaaaccctaatgagacttttgcttctgagcgttcgaatagaaatacaaagtttaaaggcccactaaaaattagctctattaaaaaattagaagactatgcatcatgggaaatgataaaagatctagcaatttctgaattaaaagatattgtttattctgatgcagaaaaaatatcggagtatataaaatatatcccgaaaattgatttcaaagaagcgtttgtatctccagttacattgaagatagttaaacttgggattaaactttaccctaattggaaatggagccaaagatggcatggaataagagaaaaattttatctttgggttacaaatcctaacgatggagcaattctttatactaaccaggtccaagtaacacaaaaaagtgtgaatagtactgtttcaatcacggacttaattccaattccagatgaagatccaccattttttttaaatattagaattatatcggataagtgggttaatcttgattttgaaatcgatttcaatcttaggcctgctttagataattttacccaatcatcttatattcaaaaagaatttttacaaacaaatagtgaatccaatccaatctcattaaattcaattccagatataactgaactccttaacatacccccaattcccattaaatcgttaaagtacccagaaataattgattattataataataaaaagatattttttttaaatcctgtgcaatctcaacttttccatattttgttctattctgatgaaaatatatttttgggtgctcctactggatcaggaaagactatggttgcagaaattgcaatatttagagctttatttgcagatctagacagtaaaataagtatttcaaagcttaaaactgaatcaaaaaaaaaatctaaaatagtttatattgctccacttaagtctcttgcaaatgaaagatttaatgactggaaatttttattttcaaataccctaggcttgaatgttgtattaattactggaagctctcaaacttccttgttagaacttgaaaaagcatcgataattatttcaacaccagaaaaatgggaaagtttcacaagaagatggtgggccaagtcaagatcttttgttcaagatgtaaaactcattatttttgatgaaattcatttaataggtcaagaaccaagaggatctgttgttgaaaccctggtttgtaaaactaggtttattagtcattttattgaaaaatacaatgtaaataaaaagataagatctctttcactttctacatcactttctaatgcaaaagagctctcttcttggctagaagttggtgcttcaggctactataattttcctccagagattagaccagtaccttgcacagtatatatttcaggattccaagaaaaaaattattgtcctagaatggctacaatgaacaggccaatttacaataaaattctcacgcactctccaaaaaagcctgtaataatttttgtagcatcaaggaggcaaacaagaattactgcaatgtctctatctcatatgtgttattgcgagggacaaccaaatagatttattaatactgagcgaaaagatagttttggcctcagtttggctggttcaattcgtatggcaaaagataagtcgctaaaacaaaccctagaatctggtatcggcattcaccatgcaggactttctgaatcagatagaaaccttgttgaaaatcttttcttaaatggaataattcaaatagtagtagctacatctaccttagcttggggtgtgaattttcctgctcattttgcaatcatcaaaggaacagaatattttgatgcaaaacttggccaatacatcgactacccaataaccgatgtacttcaaatggttggtagatcaggaagaccgcaatacgactcacattcagttgcatgcataatgacactagagtctaaaaagtctttctataaaagatttctttatgattctcttccacttgaatcatgttttggagtatcgccacttattgagatttttaatgctgaagtatcttctctttcaataaaatcaattccggatgctatatgcttcctctcaagttcttttttctttaaaagagttgtaattaatccagcattttatgatccgaacgttttccaagttgaaatagcgcaagctgagggacaaacttctttattggatgttccaagagtaagacttatagtttatatcttagaaaaactgatcaatgatacattaagagctttgattgggcttaaatgcattcgaataagtttttgtagaaaagatgatcactcaacaagttcgaaatataacctaacttcaaactcatatttccaaaataatctcaaggattctggagaattatatgaattagaaccagaagtcgatggattaaagcctgggaagtctgggtattcagaaaatcaaaattgtacttggagcaaattatttccgaatattaataaagtcaccgaaatattttctaataatagccctcccatatccatatttcctacactattgggacaaatatcttcattcttttatataaaatgttctaccatttctaaactgaacaaatttcttaattataaagttttgaaaaaccactttgtttcttgggtagaaatattgtctcttatctcacaggcgcaagaattcgaaacatatcctgttaggcataatgaagacaaaatttgtactaagatgcttaagtatttgccatttggaaaactaccttttgagccaatgacgagtccgcaccaaaaagtattcatattattacaggcaaatatattttccatcccagttacggttgtagactttataaatgatatcaattctatccttgatcaagttccaagaattctgcatgcatttatccaactcaacaagttaggaaattatctatcaccaagcgcatttagctca

SEQ ID NO: 706 - DNA, 1122 bp, Cryptosporidium hominis
atgataatagtaggattaattggattggataacgtagttgcagaatatgcattcaggttcattgtggaaaggtttagattcaaaggaataagactcgtagattgtgagcgaaattgcaattttgataatgcagcgaacaagttaaaatcaacgactaagttagaaagccattttaaaacttttggggaggaatatggcgaaaaagtaataagacaaatttgcttttgcggaagcgattcagaggaatcttatgatgattgtattaagttcagagcaaagaaagctttcatgatatcaactacagatttgaactcaagttatgttatttcaaaaataacaaaagaaaatgaatttgatatcttttcaaatgcattttttgttagtttggctatagatctacctttgatttctaagctttctttgctagaaacgaattacgagaatgcaaattttgaagaagttgaaaaatctattgagacattaaaaaattccccaggaaagttaaaagaacttgcttcaatattggttcaagattttgaagagaaaaaaaggggcatttgtagactagtaagaagatctgattattatattagctatttcatagatttttccgatttggagaaaaagttgattaatcttgggctatctaaaatagattcacgcccaaactgggatgaatattttatgaaaattgcaaaactagcgtctcaaaggtctaactgtgtttcaagaaaagttggatcggtaattgttaaagaaaaaaaaatcattagcacggggtataatgggactcctaagaatatgaagaattgtttcgaaggcgggtgtacaagatgcgctaacccaaatagagtagagggaaaatcattagaaacttgctcatgcatgcatgcagagacaaatgcattgctgtttgctgggattgataagtgtatcggagcaactatatacgttacattgatgccctgtatctcttgtacgaaaaatatcattcaatgtgaaattgaaagggtcgtatttactactgagtatgcaattccagacgagatttccaccattaaattacttagagattcaaatgtaaaggtggatagattagtggaaaaacaatcgtgtttatga

SEQ ID NO: 707 - DNA, 1023 bp, Cryptosporidium hominis
atgccaccaaagaaccagagtaagcaagagagaggacagcaaagagccttagaaaagcagaaacaaaaaatcattgaggacaaaacgttcggactaaagaataaaaacaaaagtaaaagcgtacagaaatacataaaatctgtaacttcccaaataaacaactcgaaaggagggcaagttaaccaggagcttaaagcagcgcaggcaaaagaagaaaaaaagaagcaggcacaacagcaagctctcttagctgctctatttaaaggtactgaaaatatcaaaaaagtttctgcagaagatgcacgcaaagttgacccctcaacaattaaagcagagcagaaaattgacctttatattgatcaaagagatcaaaaacaaaattctggctcaaaaaaagctcctttgagccaagaaccaacatcatttagcacagaaattatatgcaaacacttcctttcagctgttgagaagaaacaatacggatggttttgggtatgtccagaaggaggcgataattgcaaatatcgtcattgtttgccagtgggttatgtaattaaagaacaagaaagtgatgacggtggagacatagaaggtgaagaagaaacattagaggaaagaattgaaaggcaaaggcttgagcttccaggcccaggaacgcctgtaacatttgaaacgtttatggaatggaagaaaaaaaaagaaaaagaagaagaggagaagtctaaggctgatgcagcaaaacaaggtaaacaaatgtctggacgagacctgtttgtttacgacccatcacttttcgttgatgatgaagatgctgctggaggagatacatatgaaattgatgaagatgcattcctttcagatgatgacattccagaaatgaatgcctatagcgaaatgattgaggaagaagaaaatcaagttgaaagtatcgaaaacgatcataaagacaaggacaaaaattcgcctgaagttaaaataaatcattccattttccaaaatgaaatagatttgccagaagaataa

SEQ ID NO: 708 - DNA, 843 bp, Cryptosporidium hominis
atgaataagaaaaggaaatatttccctgttgggaaatcaaataattcaagatcaggaattcctgatctaagaattttgaataaaggaattttgatgtcaattacagtgaataataaaagtattgcagcttatagagatatatctagaattcttttaagtaattccgaatgtaatgaacaggaaagcccgaattacttaaatgatgatttaactattgaagaaagcattgaactagagacaaagaagtttaagaaagatgattccagattcaaacttatagacaatatatcaagatgtctggtattaattcaatttaacgattcaaatgataagccatctgctttggttgaaaagcttatgaaaagtgtatatgaacataggactcaagaaaagagagggaagaatgaaagtgattctggctgtttattatcatccagatatgttagtagattagtcccactagatataatttgctcagcaaaattagatgaaattcgtaaaaatatgaaagctttgatattgtcaagcttcaacaatgccttttgctcagagtctgaatttggaaaagaaactagttgtgcttcttgggcatgctactacaattccagatacagcggctctgatattaagagacaagagatatatgatttagtatccgaactaatttggggtcctgaagacggcccaaaataccaagaatacaagaaactctatccagtcgatctaggaaatccaagtaagtctattcttgttgagattactaggtctttttgtggaatttccatcgtttgcaactatcataaatattgcaagtttaacctaaataagatttctagtaactaa

SEQ ID NO: 709 - DNA, 690 bp, Cryptosporidium hominis
atgatagcggaaaaaaaagcaaataattcgaggcacttacttgaatttttattccgcagtgaagatgagttacaaaataatgagaagaaagagacactgaacagtttgaatacaaaagttcattctgcaatgattttcaatatggaaatatttagaaacgaaaggaggaaggaattagatcaacttttaaagttttcgaatgaggaatttatcgagagctctgcgctgagaactgcaaaaaatgattcgaaagtagaatatacgtgtgacattcgcttcggaagtacagagctttggagaattcaaagaaatttacagaaattcgagaacgtgacggaaaataacagaattaaaacaaatagaaaaagaggtcttatttcaagtacagacaaaaaaataattttcgatagagaaaagtatgaacagcagatgagcgagttgaaagctaatccagaaaggtccgaatttcttcgaacttctcatgtcccctctgacaacgataagaatttgctaataaatcagtatataaagaaccaaaggaaaaaattcatatcagagtcgatttatattaggcctgatatatatcatataaatcaggagaataaaaagtacaatgagaaattagatagggcttatcacgaatatacttctgaaattaaacaaaatctagaaagaggcacggcactttaa

SEQ ID NO: 710 - DNA, 921 bp, Cryptosporidium hominis
atgtttaggaatttttctttcaaaaaatctttattttcaagttgttattcaacattagaacataacagattctttggaatagattttagaaactatttgcatattttgcagaaaaacaaaatttatggattatacaaatttagtacaatagacgctaagcaaataaataattttgatgcgtattcaaggtatagttggttcccagaaactcatgatagtattttattaaaatttaaccatttgagaacaactttcttacttgaacatatttctaataagtctgctagtttaaatggtccattaagtggcaaaaagatattggatattggctctggcgcaggaattttttcggaaagactttcagaattaggaggggatgtactgggagtcgacgcatcttgtaagtctatagacatagcttacaaaaatgcactttgtaattccaccagctttaaagaaatctctaaacttaataatgaaaatgaacttaaaaatttcatgaatagtatgccaaaacctaggagcctgagatatttcaaaggcggaatcgaacatatacaaaaaagtgagatatttgatattattatagcttcagaggttattgaacatgtaaataatccaggcatttttgtaaaattaataagtaagttccaatacctaagatttactatctctgtaatcctgttaggtaatttacttaaaaaggatggaattgtattgtttacaacacttaatcgaactgttctctgctacatatactcaattatctttggagagaaaatttttgaaatgataccaaaagtaagttcgattgactatttcgaatcaattcacgaacataggggacacatagctggagaaagtttattaaaccgaatgaactggatggttttgcaagaaaaaatggcttatataaagtag

SEQ ID NO: 711 - DNA, 921 bp, Cryptosporidium hominis; identical to SEQ ID NO: 710

SEQ ID NO: 712 - DNA, 351 bp, Cryptosporidium hominis
atgaaaaataatttatttttaataattatattaattggatcagtttttacttcgataattaaatgttcgaaaaaagagatagtagctgctaaatcatcaacaagaaaaatttcagatgaattaaatgatttattagcctctaaggcatacttttttgttgaccctaattatttttggtcactcaatgctactacgcaagttgaaactaaagcaccactttctgaatcagaatttttggttgtcaatgctccttcaattggaattgaagaattaatatttataaaaaatagaaaaaaagatggggaaatattttattcccatgaatcaaactcgtttctaacttatacttta

SEQ ID NO: 713 - DNA, 567 bp, Cryptosporidium hominis
atgttaacaatattccgatttcctccaacatcaagtattgcaattagtgcaatttctaaaataagcgaattgccgaaagaaaatattcctactcgtagtttacaaccaaacgacgaaattcaattaaatagtaaggttagcgagagaagtcattttgaagaacaagcaaaggctgagaaaactccaaataatgcaattattaagttgttggaggacaagaagaatgaaatcaagaagaacatagaaaatcttgcaaatcaactaagaagacatatccgtcaagtcgaatatatagattcaagaatttgtgagctaaggggagagaaaatagatttacagagctcaaggttaatatctagtcttagattagattctgaacattatcaaaccagtctctcgagggttagtacggctattaacactggaattaacactccaaattgcgagcttgcgagtagtaatgaagctgaagtcagaagcaatattctctcttataaaatggaaggtgattggttaattgtcccagaatttaaagaaatcgtctctaggacagtaaattcctcataa

SEQ ID NO: 714 - DNA, 1122 bp, Cryptosporidium hominis
atggtagaaaataaggatgagattggcaatagcattgtttttaatcaaccatggattccaataatgagaatatcttttaaagataataatgaaaagtacaatgaaagttcgatagtaagaggcgtaattactattaatgggcaggctgctgcatgtgggacagataaaggcgaaatttatgtacattcattggaaacaggaaaaaggattttatcacatgagaaagttggaataaaaaactacgaacttggtaatggcggattaaacgatataaaaactgatcaatcaggaaacttgttggctgcatgtttctctcctggagcaataagtatttatgatcttagggctggaattaaaaaaagtgggtcgcttttgggtttaaccgttatgaatttagaaaatgcacatgaaggggcatgtacatgtatttcagtaccgaatgaattactttaccaaccaatattctcaggtggatacgatggttatattagaagctgggatcttaggaagaagggtttcttttctcaagttctatctcacgaagctcccgttgctagcctggagcagagtaatgataaaagagtcttatcttcggcatcatttgacggaaaaatacgaatttggaagtcctcagacttgaaacttttaaaaacgctatctggcccacaaggatctaattactctctacattctatattctcatttaatgatgaacatctgctctgtactggagactcctcatcttgcatttggaaatttgggcaagaaaaaacagaaaagttgaatattagttgggaaaattcaaaaaaacttcaaaaggattattccaacaatatatatgacaacaatcatttgcctatgcttacaggattttccgtaatttggagagatcaagtatttgttcctaggattaaccctgcaacagcccctgcgggggatgcttctgtatattgcttacacacagcaaaatatttatactctttgactcctatctctccttccaatgcaattattacatctatatccaaacatccggatttaaataataatttgattatgactacatcaagtctcccagagccttccatagtactctggaggctcaatgaaattaatagttag

SEQ ID NO: 715 - DNA, 897 bp, Cryptosporidium hominis
atggaagaccaaaagtataaaatatataggcataaagagctacctttaaatatttgccactttacaactttaccttcaacgcagatctgggcttatgaaaatattgattttttaattaatacagagaagttgtcaccaaatgtatggacagtaattaccgcagataacatgacatctggcatcggttcttatgatcataaaacccgtactactcgcacatggtatacgctagatggcaagaatttaaatgcgacatatttaacactaagacgaagagaaatctcagaagaaccggaaaagaatatttcagatttgagtttgtatactcttgggattgctttgtcagtttgcaagattttgggggagtttggtattaaagaaccaaaaataaaatgggttaacgatatttatgttaatgggaagaaaataggaggtattttatctaaacaactagaaaaaagatatgtatttgaacaagttgaatatgagcctattgtaattggaataggcttgaatgtacttcacgataagtgcaatcttccagaaaatgtggagtcccctgcaacgtcagttaaaatagaaagcgagttagattcttcacttattggtattaatgatattttggaaagcctacatttggaagttattaaatcagtaactaatataaattcatcgagacataaaggattccaagacaatactctagcagaagttaacaagaggctgctttataaaggcaaagttgtaaaaataattgactatgaaaaggaaggaaatgaaatagaaatgggagtacttcagggaatagataagaatgggttcgcaatcataaaattaccagaaataagtgggggtgagctcaaaatatctcatggaagaattaaattcgatggctaa

SEQ ID NO: 716 - DNA, 516 bp, Cryptosporidium hominis
atgagaaaattcttaacatgtattatagaacataaaagcatagaatctataagcttgcatgaaaagtacacaaaaatttcagaaaaatgtgctagatctggatacaaggcttcagagtcaaccaaaacccaatcattaaattgtatttactgctacaaagagatactacaatctttaaaagaaaaatatgatgacatgaagagtattttccaaacagatgaggatgaatcatttggaaatatatacattattgttatttatttggagaagtttttaagaacaaaaatttctgtgattacacaatacattacttccacaaattggtttatggcatattcagcttcaagagaattttgcggcactctcgtaattatctttgatctttggacgagagtgactagagattttttctggccgtatacaacagtagcttcaggtaattacctctcaagattccctattgaattaggtaagttaattatttcaaatattgccaataacaatataaataattaa

SEQ ID NO: 717 - DNA, 3018 bp, Cryptosporidium hominis
atgtacaaattcaataatttattaggagtgccatataatggaggcgatattctttttttctcagattcgtcaaacttggtctctaatgtggacaataggatttgtgttcatgatataaaatttaacagaacccatgtattgggatgtgaagcaagaagtaatataagcaagatgtgcctttcacctgacgagagcattctaatttgtgtagacgaagataattatggttcaattgtcaacttttcaaaagggcttattcttaatagaatgcaatttcccggttcagttggattcatttgctatagccacaatggaaattacattgctgcagcaattgattctggaatatatatatggcatgctccatgtatatcaaaaggctggcaattgatattaaagagaaagcatattatccacaattctaaggttaattctttagattggagtaggtgcggtcgttttttacttactgctagcaatgacatgactgtaaggcttatcagcattgaaaagattgaccattttgacactgtagcctttattgcccacaaaaatccagttgttggctcctacttcacgaaaaatatgcaattcatattttctgtaagctctgaaggcgttataatattctggaaaccttcatccaaaaaggaaagtcgaggtaagaaagtttttaccccccaaaaaattctccccagacaaataaagaaatctagggcaaatactaaattagccttagacacagattcagacattgaaccagaattttatgatggaataagaagtaaatattggattgaggccctgagagcatatgtaaatcaatcaaaaggagcgattattacaggctgtacatttaattatgaaaagaacctggttgcaatttcaacatctaatggagtatttaccttatatggaatttcagttgggctggattctgactctttggacccaagcaatgtcttaattaattcaatccatacgttttcactttctaactcccctttaacttcactaaaatttggtgcaaaaggcgaatggctggcagttggagctgcaaaaactggtcagcttatcatttgggaatggcaatcagagtcgtatatacttaagcagcaaggccattcttttggtatacaatcttctagttttagcccggtaggattaactcaagggaaatggaatggaaaagcttctcatgacgattatcttggcattggatcaagaacaataattgcaacaggaggggttgacggtaaggtgaagctttgggatattagttcaggatataattttgcgacattttcagatcacatcgccccagtttctaaagttatttttaatccccaaggcaatgtcatactatccgcttccctcgatggttcaatcagagcatatgatattatgagatacagaaacttcaggactttaacagccgaagaagataccggcgttcagttcacatgtgttgcagttgatagagctggtgatttagtagtagcaggcagtcagggcgaagaatgcaaaatttatgtttggagtttccaaaccggtaaactagtagataaattatctgggcatacatccaacatagttgacatcgcgttttgtccctcgctttccagccctggaattttagcttctgcttcatgggacggcactgttagaatatgggatctttatgctcgtgttggtaaaggagcaacaggggaaaccttagtacactcttcttccgtgctttcaatagcatttgaccctagagggaataatatgcttgcaactagttctttgtccgggagtattactttctgggatataaataaaggcactgttgaaggtagcattgatggtctaagagatattcatagcggaaggagctcttcaagtgcattttctgcaaataacagcaaaggcggtggcggaaggcttggagcaaaaacaaaccaaaatattaatagaaaccaacacttttcatctatctgttacaatagtaatggaagatttcttcttgcctcctctagaaactcagctagagtatgcctttatgatacattaacctttactttggtttctactgttcaactaacaaattctcgtttcttttcgggaattagaatggagcttaattccaatttaaattccaacaaaaagaaaaaaagaatccccgattctgaaaatcctgatgaaatttggagttcttcaaatagattaatcgagaaagagaagattattcgtgaacataattctttaccaggaactattgttggggagttctcaagccctagcaggcaatctcatttttctgtatatgaggtggcattttcccaaaattcatcgcattggattgcttctactagccatggagcattccttttctgcattgatactctaggaaattcatattcaggctcttcaactcacttaaacatgttagacacttttaaaaagcaaataatgacaaaagaggtaaatgtgagcaatattgatcattttctcaaagaaggagattttttaagaggcttgattcttgcattagcaatgaataatttcaatatacttgcaaaggcgtatatccaaattccaattacttcaattgactacattgtacaaaatattgtttcattttttcttccgaatatgctaaactttttaagaattgtaacaagccctaataataaacaatttttcagattagaacgccatcttatttgggttgaatctattatcagagtccatgggaatacattcctaaatgtaaataaaactcttagtgaatctctaaataatagtaaaactatttttgaaaataatgcagagaacaaaaatagcgaggaaagcgaaaagcttaaacaaaacaaactcgcaatattatctacaaacctcagtgactgcgatacaagaagtatttttcttgcaattttgatgaatatctctcaaatatactcattttcaaggcaaatatatgactctaattgctctatattgcattatatttcatctaaactaacatcgaaataa

SEQ ID NO: 718 - DNA, 927 bp, Cryptosporidium hominis
atgatgatgtattcagggcatatttcaagcaagttagaaaatgacaaattatcatatagttgctaccaaggcagggaaaaattggaatataatgaaagttggtttaataaaatcaagaatagaagtgaagttggagtatcataccaaagccaacttgaaattttattctggatagcattttgtctattattaatggttgggtataagtacctttcggatggaagtttttcagcaatattgacactttcttcagcctttcagtgctttgcatttctattattggcatcaaaggtaaatactcagtgctctctttcaggaatttcactaagaagccaaatactgtattcaatagccttaatttcaaaactatcttctaccttattttttaatggatatttaccagtagatagatctggggactgggtataccaagtggctgatgttgtttcattggctatttctttattattaatttactggggaaatacaaaactcaagtatcaatataaatttgataaagattcagtaaatatcgtgatccctatagtattttctgctattttagccgcaattatacacccagatttgaatagttatttccctgccgactttgcttggacattttcattgtatttggagacaacagctatgttaccgcagcttgttatgatgacgaaaattggaggcgaagttgaaactcttacaagccattatttggcatcattggcaacatcaaagattctttcatttgtattttggcttttttcttatagagagcttgctccagagcatggaaagaacgttcctggttggaccgtaatggcttcctttgcgattcaaattattctttttacagactttttgtatgcatacattaaatctgttcgcttaggaaaagcattgattatccctacaagtattgtataa

SEQ ID NO: 719 - DNA, 1785 bp, Cryptosporidium hominis
atggatgattacgactcacagtcaacagttgaggatgtttcagaatgggcagagcatatagaagatgtgattgaagaattacaaaggaattatagaataatacaaacagagatgagttgtttagtagaaaaattacaggtagtaaatcgacccaggaattatatttccaaaagagtagtatttccaaaaaggaaccataatgccagaataggaaatgaaaacttaaagaattctagaaactgctgcaataattgccaaggtaattctacatacaagagcagtaaaattgaagctctggaaggcttagctgaaaatattcttgggatagcaaacgagcaatatataaataatatggtagaaaaatcagtatcgaatctcgaaaggacactagtggataaattggataagaattgcgctcatcaccatctcgagttgcagagaaacattacagatttaaaagtgcaacagtcaataatggaatcaactgttagagatattgcattacagatccaggagattgctctagaactaaaagatttgaagacttccattggaaacagagtggttggagatactatgttaacaatgtcacaaaaaaatcaaaaagatgatgaaaatttggattctaatttaaattcgaacacattatcaagttctgattcaagttcctgttcctgcttatgttcttgtacggaaaagtcctcaaataatggaagttgtagttgttacgagcgtaatcaaaatggaaaacttgaagggagcaaaatgctaatatatgaaatcctaagagatgtttttgttgaagatgagaatttggttgggatagggaataatttagatgaattggaacttgaaaatctatgtttaattaggcagctattcaaagattttgtaagaattattacacaaggtagaatcgaaactcttgagaaaggtattggagaaattcgtaataagaatgctaaagatgaaaaaaacacggaaaaaagactcgaagatattaatcttttgattaaagatgagctaatgaataggtcagctgagagcgatatgatagcaaagttagagaatagaatccaaggggtaaaaaatgaggttgatagtatacaagatagttttattagcattaaaaacgatgaattatttaataaagaacaaattgaaaggttggaaaaggagttaaataaccgttcagagcttatacagtcagctattaaagaactaaatgatgaatatttttctctcagaaaaaagcaagaagaggaaagtggtttcttatttggggacgagctttcaaaaactataactgataagatatcaagtatcaaagatctggttagctacattagtgatgaccttttcaagaatgaagagaagctgcaaaggcaaataaaaaggaattcaaagatcattgaagagctaaaaagcggttgtgtagaatttgaaaagtattcggatgagaattttatagaaattgccaattccctgaagaattttagaatgcaaacgattacaatactctcatctatgtatgaagttataaatgagaatataaccgatagagtaaatgtgtcaaatttccagcaaaaacttcaagagaacttcaacgaatcaagtgaggaatttaaaggaatgattgatattcgtccgcacattttctctatgcaaagtaaccaatgtccagcaaaaagtcagaatactggatttaaaaattttaatgttgaaaaaaatagcaattcaacaagtcagaaaattcctccgaatgcttatcatattaataattag

SEQ ID NO: 720 - DNA, 3399 bp, Cryptosporidium hominis
atgtggcatccaaatgtttcgggccacaatgaagggctagaaactatctctaccatgaatccgttggcaaaggttggaccgactgagaaaaaacaaaagggtaaagttagatctggtccaaccaattctagtaaccaaaggagggcaggtactagattttctaataatccaaatttacagacccaatcccatgtacctacccagccttcaccagtttcaggagttgcggtggggccaatgcccattccagtgtcggcttcaaactctctgggaattggtaatataaactctccttctttaaattcaattggagttcctgggaacattgtggttgctccgcccattaatcaaccttctcagggtcaaactgtatcttatagaaacacaaaaaagatcccaatagatcgttcaaagttccatccgagtatttctaatctggctggtgcaattattggtgtctcgggatcaaatcagaaatggatggaacaggagagcggagctcaggttcagattttaggtacaaccggcaatgacccagaaggtcttcatatattagtgcgatataatgagccacgcgagctggagattgtagaagcaattattgaagagataggaagagcaacttttgaaggcggtggagggtttatctctcatattttgccaaatagaaagcctgtttccccgactttaactggactacaaggtaatatgattgtatctgcagctctccaagatcatacctctggaattgaaaagcagattatgggaagtggcgtggccatggggggaatgccatctctacctccaaactattcttcatctcaacctctatacaacaacatgtctagtaatattggaatgggatttattcctagaggaaatattgtagcccctattcaaatagaatggccaaaaactcccccagcatcaccggtagaatttgaatggcttttgcatttagtacttcattctgctcttagccaattaggtcctatggtcagtcatggagttcctatgatacatattccgatgttatatgactcctttactagtttccgttttgagcatgatgcgacttcattcttccagtcatgcataattcaaaatggattattgggcttaatacaggctttacctcatatttttatagagggcccacatactataatagattcttcgaacattccaaaactgtctccaatttttaaagttaatctttcatcgggcgttaccccactattgcttccagcgcaatcggtaactgtttcttttgcggacttcaagttagctgctgaagcattttggaagatgggagcactgccaccaacattttctggcttcggaccccaggttccacaaaatataaatggaaccagtggcccttcaggattagcagtcacaggatcgacaggcactatttctgatcatgtatataatacaagtagtgttgtatctccgaaccaatccgcaagacagcatcaaggcaaagattcctcaggttcctctattggagaaaacgtgttagctggtggtacaaacaaaattaagaaagatcagggtgcaaatagtatcataaatacaaattccaatcaaccaacaaaaggctcttctttaatatctgatgatgatgatacatttggaattgataattcaagctcaaaaaatggagtcattactaatggaacttcttcagtcgctctttcatctcattcatccactacaactacatcttcaggagtgacatccatagtaaacgttggcaaggataatatacctcaaacatctttaatgatagttttacaaggggttcacttccttttgcgaagatggataagcaaacgattggctcctcactacatccctaaaagctcattagattttcttcctttggatattttagaaagtgaattttcacaattttatgaaattcctttaaatattgaaatacttggttggacaaatttacttcattttgtagaggcgttcccggatgtttggactgtcgagaatgttggcccagatgagtttactttgataccattaccatatcccgacttctcaatgattgcaaagaccaggggcatcacaaagctcaacaatgagaagcattacgattcgaagcccgattctaacgcttttactttgtctgctcaaggctcttctctggcaaatatccacaaaagtggaggttctttagataatattcagaaaattgtgaagcaaactcaggactttgtggcagaagctattgcttcaggatatcctgcaaattccttggaaatcaattctataaatgagataataaatggagtaacaatgggtatttattctctagataataacacaagttcctctttgtatgaactggtaaccaaagttacaaacctattacctaaatattcgtctaattctgcctcaagtactagtaccaacttccccaacaagccaattagtggaagtattagtaaatcccgttttgataatgcatataaaggaacgaatggtataggctctatgaatgggttagcgaaggggacaaagtctggaggatttcaacatcaacctcactcactgcaaccaccaacagcctatccctccacacatatttcccttgcaaatgaaaaatctattttgggaggatctgggaatcaccattctttgactgttccacaagttggtgcatccagatttaacagtatgaataatgctaaaaatgaaataagatatgatattggagctgcgcagcctatgtctactcataatcagcataatattcaccttcatgctccccatcaaactaatgctcaagtactcaatagcaatctttctacaggaagatcagttaatggtggacaatcaaaacgtgtattttcaaatcaatgtgcaggggctagtaagggtcctaaacagttagtagggcaggatcaacgcccatatccattgtatgaccaacaaggtagtaatccatcaactgaatttgtcaatctccagcacaacccaaatcatatgaatcctactcaaaacacatttggaatgcaggaagcaagtgaaagcaatattcataatttttatcatcattccatggacggaaattcccacttttctacttataacgggggtggcatttctagtattggaaatagtatggcagcctcatgtcattatgattatcattcatttggagttcaatctacaaattcagcatttgttcaaccttctcagaatcatagtatgaacggtgcgcacttttctaaatctgttgggattccttcggaccaaactattggtaataatggaaacaataatggaaataatatcatgttatctctgcctaaccatgcaagtgtagtgtctaataggtctggatgggatcgtaaaaataaatcaaaaaacaattaa

SEQ ID NO: 721 - DNA, 1311 bp, Cryptosporidium hominis
atgtacatagatgcttcgcaaagactaggatgctggaatttcattttaccaaaattgatttccgaggattttgttatttgcaccgataaagaaaacccaaacattaagactatagagaagaacttaaccccttgtattgaatcattattagagttaaacccaatagtaataggagaagcggtcagagaaaaacaagtgaatcttaaatctgagaccaatagcgacttccttccttcgtatctagaagacgaagatgtttctatttgccaggcattgcaattctttgttaaaggaagaaaaagctcagagttaattcaagatgagataattttaaaaaacacaacgttttctggcttggtggatattttagatgcccctggtgttctagaaatcacgcaaaaaaccattaaactgtccttaattcatgttttggttgagcttgcttttcaaacactggtaattttggaggatcacgtcagagtcgaagaaacaggtaattccatagaatcatactctagcaaaatgattaattctcaaacaaactggctggcattattcaaacattcttcaaacaatgaaagacgcaaattacttactgctaacctcgaggagatccttcagttggacccaaactcaaattcagaatcaatggtatgggactcaagcaatctatattttacatggcttctggctactaggataattctctctctaactacatattttccaagaatactacgcgaaatatggttgcgcaattctaataataaaactcaagctattttacaaaaattggtaattaactacttttcacctatcattatcccaatagaactcaatcatatccctctaattattgagaaaatgtcaaacccagataggaaaatcacatttgatcataatgtatcatctagggcaattaaaatgagctattctgagcgtggattcactgcgacgctctcttttactttctcccaacatcatccattagttattccgaaagtgaatatcccaagtgttgttggagtgtctaagaaacaaaattctaactggctcatttctgtcattaaagccgttaggtacaaaaatgtcactcatgccattctaacgtggataaataatttatccttatacttggatggcgtggaagactgccttatctgctattcaattgtgcatccccaatacaggtcattgccgagaaaaagatgtcatacatgtaacaatattttccactctgagtgtatttacaaatggttcagaacgtcaaacaaaactacatgcccactgtgtatttctttgatgcactga

SEQ ID NO: 722 - DNA, 1578 bp, Cryptosporidium hominis
atgtctgatgagaacacaaattccgtgaatgaatcagtttctgagcaatacaaaatcaagggaaatgagtcttttaaatctggcaaatataacgaagctattgaatattatacattggctataaaaacctcacaagcctcaaatgaaacccaaaataaaaacttgcatatctactattctaacagagcattgtgtcacattaggctcgagaactttggctcagcaattgaggattctggggaaagtatcaaatgttgcccgagtttttcaaaggcatattatagaagaggtattgcatatttcaacttgcttaaatactcccttgcaagaaaagattttatgatggttttaaatttaactcagaatgacagagatgctcaatcaaagattcaaatttgtaccaaattaatcaaacaagaaaagtttatggatgcaatttcaactgatagatcaaaattgatacatgagactatagatttcaatgcgcctggtttcgcagtttctaatgattactcagggcctcactataaacctttggtggatcattcaaaatttgcccaatcaggcaacgaaactaatttgaaatctagagaatttgttatacctaaagtgccagatgcttctctgattagagagtcatttgttactgagctaattgactttttaaaaaatccagaaaataggctgcatagaaaatacgcatatatgattgtttatgatttaatacaagtacttaaagaggttgcttctaagccactagtcagaattaatattggtaaacaggaacatattactgtatgtggagatatccatggccagttctttgatcttttgaatatttttgatattaacggtttaccttctgtaaacaatgggtatttgtttaatggagatttcgtagatagaggatcattttctgttgaagtaattcttgtgctttttactttaaagattatgtatccatatcatgtacacttggctagaggtaaccatgaaacaaagaatttgaacaagttgtatggttttgagggagaagtcttagcaaaatatgactcaggtctttatgatttgattagtgaggcattttgtttccttcctttggcacatgttattaatgataaagtttttgtagtgcatggaggtctttgttcagaagataatgtaaaacttagtgacattgaacagctttattctagatgtgagccagctgattccggctttatgtcttcattactttggtctgatccacaacaaaaggaaggaaggtctccttctcctagaggagtgggatgtaattttgggccagatgtaacgctcaattttcttaaaactaataatttggactacattattagaagccatgaagttaaacaagaaggttatagcgttgatcatgatggaaaatgtattacagtcttttctgcaccaaattattgtgactctatgggtaacaaaggagcatttataaaaatacacgaatacgaccttaaacctaactttgttcagttctatgctgttccacacccaccagttccagcaatgaaatatgcaaattctatgctttcatatggaatgtaa

SEQ ID NO: 723 - DNA, 3303 bp, Cryptosporidium hominis
atggctaaggctactgcacttgagctcctggaatctctttacaatgagctgatgaaaaaggcagaggaaggtgcctacagtggggaagtcttagagcaatatgcatgtagtgtgcttgcaaatttgcatgcaagcaaagacccatttggtatttaccatcaggaattggcttctcaagatgatcgaaaaaaaaggcaaaacaatccgctgagccatgtaatacgtaggctgacggaagaaatctttgcgatcacaacaacttgcagctatcccattttgttaaccccgagactctatatagtatgtgtatcattattaagcgaattatctttgggaaagctttctcctttatttttagaaacattcgatggctatgcggacaaatttgagaaagatttcaaaccattaatgttggaagtgtttatcaggaaagctccatggcagatactagtaaaaaatctcaactatctgataggaaatgtaagatcgggagtagctggagccatgtgcgacagtaaaataaagatagaatttcaagagctaagctctatcactagccctgagatgagtaatttaggattgctaaattttctgcccctattttttacaaatttcgagtctttaaaaaaaggaatattagaaggcaggtattcgtttaatttcaactcaagtaagggcaaaattaaagcaaatagtaaaagaacttcaagcttggtagactttaatgcaattattgaaaaaacaaaaatagttgagagttttattcctaaaaaaagcgaaaaaacgaccccaactgaaataattaatcaagcattggataattttgcactgacaagagttagcattgcagctttgacgagcatttttaataaattcggaattgagtctggtaggaaagaattaaaagaatttaatttagatattagttttattattaatgcatttgaagcagttatagcaactttgctttctggtaccgagatgttcagtttgaatatgtgtgaaagcaatgataaagtattcgaatcaaagcataaagaaaacccgcaagcagtctcacaacaaatatttgaactggatggaagcatttcaaatgatatctttaccttggaaaataagacaaatatatattttcctttccatttccttcatattcagatcgtttctgggctaagaaatttaattataagcatgagcaattttaaagattcaaataaagtaataaaaaattcttcaagcttaaatgacttaattattgcctatattatgagaatgttaaatcaaatagaaaggattctcgagttacaaggcttaaattcaactaaacaagatcatgaaaattctacattttctagttcaagaattaataggtttttggagttgattccttccgaaactatttttttaattcaagaaatgtcaaattactattacccatgcagatctatatttaaaaaaaagctattagatattcatgtctctcagttgaaaaatactgagcaaatggtttcctcattttttatgacttcttttactcaagttataagtatagaagttggaaatgatttagattgtgatttactgatggaatcatgggatcgtatcttcagggatgttgtattcccaaatctactggattcatatacaattgatttatttataactatgatttgtaaccccaacactctcaatagcttatctagaattaatattgaatcctttctagataaatatttgggagtaattacaaggattctagcttatcatccagatttatcggccaaaccaattcttgtatttattatgaattgtgttaaaaacttaaagattcaaatgcctaattatgaatggttagctaattggatgaagattattttgagtgcaatttgtatgccattgataactctcttcccacagaaagttaattgcgatgttaatgatctcaaagcagtaattagccccatcaaacctaacaatagaatcctgaattccctttcaattttggtttaccctaagatatatgccgataatagaaaaaaaggaaaacctgatttaatgcatattatttctgatctatcaactaaccttttgttggtatcaatatataactctaactatacaggaaacaaaagattacacactatgacagctttaaatgtttgcattaagttacttgatttgttaattaatgatttaattgactcacttgaaagccacaaaaaacaaatagggagtgattatttgccttcagatgagtcgataattagtatagaaaagaaaaatattgccaaattaatttctggaatatttaaggtatttccttatttattccaccaaggagcaaactattctcaagaaatctatgaaaagatcgtaaagcttattactttcattattactagatttaatgaattattattctctgatgaggttttcgaagtcgttttaaatttattaaaactggattttcattctaaccttgtaataatttctccaatttgctgggcgattggggaagtttttatttcaaagatcgacaataattctcttgaagaacatgaaacaaaaattttcaagctaattaatagcttgaagtctttgatagaaagttgttgcacgaattgcaatcaagcaaacaatgaattgaacaagaaaaactgcaactctggaactgacacagactcgaatactggtttaatggatgaagctttaagtgaattctcagattcttcatattcttcattcatttctgactcttctcttgaaattgataacgttgcttcagaagatggacttgaagacgatactatcgatagttttgtatattctagcggtggagctactggtgaaggaggaaaaatagcatttattgaccattttacaaataatgaacattataataacaaaatttatagaacaatgagtgaaattctgaatgaagatgatttgaaggatgtatacaaatatttggacaatatctacctagtagaagctattatatcaactttatgcaagattggactaagttgtaaacaatccaaatcaaatataattactttactggagatatgtttaagaaagttccaaataaggggttttgaaaaggataacttcgaagacgaaaatttaattttccaggaagatcaacttttacaatattcaagattcatcttatcaaagaaaattagtctttgcattaaatcactgaaccactcatctgtcttttcttctgcattaaacaagccaacaggacctccaagcaccttattttgcaataaaagcttaagttcaatattgttctag

SEQ ID NO: 724 - DNA, 534 bp, Cryptosporidium hominis
atgcgtcataacaacgttattcccaatgtgcattatcacaaaaactacaaacgctggatcaagacatggtataaccagccaggtagaaagcaaagccgcagaattgctcgtcaaaaggcagttgctgaggcaggctttagacctgttggaatgttgagaccaattgtccacccaccaacacaacgttacaacatgaaaacccgtcttggaagaggattcactcttgaagagctctcagcttgtggaattaacaaaaaggctgcaatgagcattggaattgctgttgaccacagaagaactgacttatctgaagagacattccaaatcaatgttgaccgtctaaagaagtatattaacggaattgttcttcagccaagaaagggaaagaagactaagaaaggcttcgctggtattccaaatgactctgctagagaggagttcaaggccttgaagaatgtaagccatgaaaaggctttccctattaaggcccaggctttggctgttaaggtaagtatatcgttattaactctatag

SEQ ID NO: 725 - DNA, 435 bp, Cryptosporidium hominis
atgactatggaaagccgtatggttcagacctttggtcgcaagaagaatgctgttgcagtagctctttgcaaagaaggaaagggattagttcactttaatggaaagcctttggatcttatccaaccagaacaactcaaggttaaggcttttgagccaattctcttattaggaaagcaaattttttctggagtagatattaggatcagagtgtcaggtggtggttacacatctcaagtcttcgcaatccgtcaggctttagccaaggcaattgttgcttacactcagaagtttgtagatgaagcaacaaaacaagaaatcagagatatcctcgtttcttatgaccgttcattggtcattgctgatccaagaagatgcgagccaaagaaattcggaggtccaggtgcccgtgctcgtattcaaaagtcgtaccgttaa

SEQ ID NO: 726 - DNA, 2232 bp, Cryptosporidium hominis
atgacggtttccttagtttcgtgcaatttacctgcacaagagctggcattcacaaactttgcatatgtaagttcttcaacatatacaactttaaaaaatctttctaacacgcaaaatggaactgggcaacctcgaattttagttaaaaatcttattttgaatattgaaatagatgaaagagttgctcatggggaattagcattaaatagattgcatcgccaatttgctaggattgaatcaagggagagaatagaagttgaattggctgtgggatttggaactactggtagtgaagctgcaaagagtattgctggaactcttttgcttgaggcagaattatttgtcgggtctagtcaacagcttttattagatggtgaaagaataattccaggtattttacagagcatacgtaatcaagtagttacacaaggccaaaaggtatcatatttctataaggaagagaatctattgttactattgacagtaaaagatatcttatctctagatagcttattatcaaacggtaacaagaaggaacactctgattctaaaaattctcattttttaataattgactctacaaacatggaattaacaggatctaaaacaggaacagttagatttcagaatgaccacagaagtgctccgaccttattcagacatcatttcagttttaaggacattggcatcggtggcctagacgatgaattttctgtcattttcagaagagcttttgcaagtagagttattccaccaaagctactaaaggagttgggaatacaacatgttaagggcttgattttacatgggcctccaggtacaggaaagactttaatagccagacagattgcaaaagttctcaaagctagagagcccaaaattgtgaatggacctgaaattctaaataagtatgttggacaaagcgaggaaaacattagaaacttatttaaagaggcagaagatgagtatcgccaaaaaggagacttttctgcgctacatattattattctagatgagcttgatgccatttgcaaaagtaggggagcaggatcaagtggttcaacaggagttggtgacagcgtagttaatcagctattaagcaaaattgatggagttaatagcattaacaacatattattgataggtatgacaaataggttggatctcttggatgaagcccttttaagacctgggcgcttcgaggttcagattgaaataggactgcctgactctgaaggaagattggagattcttgaaattcatactaagcaaatgagagaaagctccagattggcaaatgatgtagatttaagtgctttggcacaagaatctgccaacttctcaggtgctgagctggaaggactggtaaggtctgcaacatcctttgcatttcaacgccatattgacatgggagatatgactaagccaatggatgctgagaacattaaggtttgcagaagtgattttgagtcagcattagaggaggtgcaacctgcatttggtactgacgaagatgagctgcaaagtttagttcctagaggaataataaagttgggtagtgagtcacaaagaaacttagagctattaaagaggctttccgaacagatcaaagcagatgagaatctttctacattggctgttttgttatatggagataaaggaacgggaaagtccgccttggctgctcatatagcaattacaggaggattcccatttacaaaattgcagagtcccctccaatttgtgggtatgagcgagtcagcaagaagtcaagagctgagaaaaacatttagtgatgcttataagagcgatttatcatgtattattctggatgatattgaaagactgatggactttactgctattggccccagattttcaaatattgtattacagactattatgattttaattaagaacagagcacctaaaggaagaaagcttctaatacttgcaactacctctgagtacgaatttgttcacacttctggtttggctgatatttttaacttgtcgattagagttccatctgttgaatcacaggacgttccaggaattttagactactatcagaatggcttgttcacacctgatactttaacgaaaatctcggattctcttaggttcccagtacctatcaaaaaattactatttgcccttgaactagtccaacacaaattcaagaactcttcaacaatctcccaccagggactttttaaactcacttcatga

SEQ ID NO: 727 - DNA, 528 bp, Cryptosporidium hominis
atgacaatatttgaggtgaaattgtcttcagtaacaactttgcaggatttattgggagaaaatgagtatgttaaagacaattataagaactgtgatatactagtattagattacgagggaaaagaaaaactgggttttttaaaccgtgacatactattgacagattatagactaatttttcttaaagatgctgaatattcaactcagaattcaaaaattcccagtaaattctcttgtggggactatataaatatttcatctataattgttaacgcagtttcatcgtgtgaaaaagccgaagataatccgtatttatacattcaattaggtgatcctgaatttaatgaagacagtgatgaggatttggagtctagtaaccgcttttccgaaattaacattcgttgctctgaccaaaatactatctatacgcttttcaattctatatcggaaacagccgcatatatggagcaactagagaacttatctgattcaaaatcggatgatgagttaacaactgatcaagaatga

SEQ ID NO: 728 - DNA, 435 bp, Cryptosporidium hominis
atgaaaattgaaactgaaatttctctatttttttcttttctaattctattatgtgaatactctttttctttgggcaatattcaaaataaatttgaaagatttagaacttttaatactaatcatgacttgctagagtctcatcaaaaccccagttcaaagatacaaaggacaagtgaggatattaaatatggtataaaccctttatttgaaaagcctgaattagatgacagatatagtaaatataaaaaaatatacgacaggaaaaaccaaaatgaaaaaattaagagaaaggatcaattaagaaatcaagtggaagaactgctagaagatatggactatgtaaagcaaaagcaacgatacttagagccagaaataccagacaaatatttttcatttagaggggcagaagaacattcaattgatgatttggactag

SEQ ID NO: 729 - DNA, 1389 bp, Cryptosporidium hominis
atgatccacaaactcatatcttatgcttatccagatatattaattgaaaggattcgtcatttagaaacacaaaatattttgaatgaagcacccaaaacagctaaactcagttctttaaaaataaaaaatgggaatgaaatctctgttacatttaagaatgtacccaaagatgaaaaatcagataagtaccatcaaactcaagaattacctatagaagagcttccaatgactccaatagaaaaagatattcctgagcttcctgagctggatattcaggaaaatcttgatttaagtcaaggtcccagtactcaacaaagcttagaaactaaagtattaaaatctgaagatgatgttttgaatgacgatgaaattttagaacctaataaagctattgaaaatcctttatccaaaaattatgattttaatgttggagatgaatatgaaaaattaaagtctgattattttaaaaacatcagagctggcaaaattgctatatataactctgatgacgaaccaccaagacaatctaatcgcaaagaacatcaatttgtattaagcgatgagggaattgataatgatggacaagaaagagcagtagaggctgagaaaatagacattaataattctgatggctcctatttaggagctgatataaatcattgcaactataaggtaaacttcaaacaaattacattacctgtatcaaattttactaatgaaatcgaacggaacaatatcaaagatattttaactcttaacgtaacatttagcgagcttgagccatgtaatttggaaacgcttatttcagaggtgaataaaatagcaaaatccatgggaaagaattattctcttgttagaatggagcataatgcatcagagagagagctactagctctttcaaaagataacgagaagcaccatcttttggatctcgaaataactaggggtgatgaatttaatgcatttttaatacttgaaaaaactcaagaatctgactattcaaagaatgatattgataaacatgatgtcgaaattatatctgatctgactgaaaaacagatttctattgcggactgtcagatatacatgaccatttttgttgattcagcgtcacttcgcgataatattaaccaatccttttccaagaaaccccttaacaagaacagaagcttaggaaaaggaggaaaaaagcatcttaaaccaattaatatatgcactcaaagttatgttcctattaaaaaagtactagaaaagatcaagattatattgaaagtagattcaaatttgaatgaaattttcatatgtggagacaaaattgtagatacttgtagcagtttaccagtttcattaatcaaatcagaaacatgtgttcttcgatttgattcataa

SEQ ID NO: 730 - DNA, 495 bp, Cryptosporidium hominis
atgttgtgctctaagacggaagcacttaaacaagaaaaaccagacatttttagtctagcatataatgatgatatttgctcaactgcaaagaatctcaaaagtctcgatgatatggaatcagagctagtggtttcctcatgcgtaatgcttgtggaatatcctcttactcataaacaaaaaagaaacctcaaattcgaggtgggcttccttcctgcccccctatccttgatatcttctgcatcaactcttggaaattacgaatttaaaggcaatggcccatgcgctcttacattaagtatgtattttataaagacttgtggaagagcttgcaatgtaaacagacctatagttgctggagtttcgagtattccagtgtcgtgcatgtctcaatgctcacagtactcaaaagacttttgtatggtcggatgcaaaagatatggttgttccgtagagtactatgattgcatgaatttattatgtgggaccagtccttaa

SEQ ID NO: 731 - DNA, 207 bp, Cryptosporidium hominis
atgttgcatttcgactttcttctaatattcttcttgcttccatttcttggaagaactatggatcctgatttaaattttaaaaatttgaatggatccaagaagggattggttaaagaagagcctccctttgctaccagcgttgaaatgaatgaaaataatgaaacaattgtaagtaaactttctcatcaaaaccattcattagtataa

SEQ ID NO: 732 - DNA, 429 bp, Cryptosporidium hominis
atgaggtataatggattaactgcaagaagtacaaatagcacattacaggaattggatggaattaaattaaaagatagtgaatccatagtcgataatcaaagagcattacaaataagtggttggatgaatagttttggattacctgcaatttcttcgactactattctttcacaatcaaggtttactgagggctcattcatgcattcaagtggaggtcgaaattgctctccactattaacattaatatttgttcgtgtttgtaactctatctgtaatgccaataacgactcttcttctggaagatcatcaatacctattttttgtttaagggactgtcaaccttttgcaaagtttgcctgcttgcgtgggtgtagaacatttgggtgccaagttgatatatacacctgcatggaacttatgtgtcagtga

SEQ ID NO: 733 - DNA, 477 bp, Cryptosporidium hominis
atgagaaataagagtgaatttatggcattcaatagtgaatgtaatcaaatactaaaaaaatcagattctgatgatgtcaattcttggaaaaatcatgaaaattttgaatattgtaaagaaatgaattttactgataggaaactacaaataaagtcaggatttggatctcatattagacttccccaatcaacatcatcgttaagaggacctcaagatacccctcaaggaaatatatttaaatatcaaacccaaaaaatatgtttatctgtgctttccttgcattatattaaagtatgtgaaaaactatgcgatgcagagagtgcacttacggtagaagaagaggtattcccgagatcatgcttcccaatttgtgtggattttgcaaaccatgtttgcatacgtggatgctcttttttcgggtgtaatataccttttgatgcatgcagttaccaaatgtgtaacttcaagcttacgtaa

SEQ ID NO: 734 - DNA, 549 bp, Cryptosporidium hominis
atgtccaatcaaataaaccttccgggtggattacctggactttctgttccccagccaccaggatcaatgccatcaggagttggttcttctacaaattcggatgcaataattgttgatatactttgtgaatttgctgacttctttgtagatctggcaagtaatgtggctgctcgcactggtaagatgtggaaacccagaatcttattgcaacagaaatctaagagatctattagagcaccagaggatccaaataaaccaaaaagaccacatactgcttatacactatggtgtgaacatattcgtcaaaaagttagagagaatgaccctaatcgtgcacttcaaatgaaagacttagcggaaatgtggaatagtcttcctgaacaagaaaaaggtccatgggagagaaaggcacaagaatttaagcaaaaatatcttgctgaaatggcagcttacagagcatctggtcctacgtctgttggtggtggaccttctccatctgctcaacaacaaatgcaaccatttagttctactagtatgacaggctggtaa

SEQ ID NO: 735 - DNA, 1176 bp, Cryptosporidium hominis
atgattaagtataaagctataggcaaatatttgatactcctctgttatgctttaaacatctttcttagtttagttttttgccaggagctaacatcaattctcaatcctgaaggtgggggtgggttttcatgtaattatactaatgcagaatatacttgtggtggatattcggtcactccctggagttcatggggaacctgttctggttgtaacggagtcatcaccaggcaaaggtcaatttctggaagcgtttcgcaaggggggccaagcacaaccgaaggtgtaaaatgcctcaacaaccaatcatgcgaaccatgcagttatactcagtggtcttcatggtctgcatgctcagacacatgcgaatctgggaccaaatatagaactcgcagagttagttcaaatgtagattgtggtgtttctgaagatgaacttaaacttatagaaactgtcagctgcaacaatgatccatgcaagtgcgatgaaacaattagaggagaaaatggactgtactacagaggctgccagaaatactctaggtctggccaaaagtgcttgaattggttgtctctaaaattcgatgcttttgattatttagcaactcttgaaaattctggtattgctgaccactccttttgcagaaatcctatttctaacaatactttagttccaacaatctggtgttacgtaagcgcatctcctctaattccacaactctgtgatcctgttccaactgattgtgtagtttcagaatgggagcagtggtcctcttgctcttctacttgcgaagaagggaagattacccgtacaagaactattatccaagaatcacttcatggaggagtagagtgcccagtagatttggagcaggttcaggattgctcagttgatgttatttgtccagttgattgcgtattaggatcctggagtcattggtcatcatgtagtgtagaatgtggtaaggggaattctactcggtccagaagtatactgactcgtccaaggggtacaggagctgtttgtcaggaatatctacaaacaaagtcgtgcgaaggagaaggctgtatgagtttttgggaaaagaacaaatactcaattattggttttgcagtgttgggagtcgtcctaattatatctattatttatattttaattccaagtaataacagcgtttag

SEQ ID NO: 736 - DNA, 1428 bp, Cryptosporidium hominis
atgaagaatctcgtgaaggttattttggggcttttatttggactagtttcagtccattctctaagcctgagagcaggaagccaagaattggctatcgctgaagacgtttcagatttatttgatgggagagaagtcagaaaaattgaggtaagatccccagtttcaggtatattaagcaaggtgaatatccgtcaaactggctatcatagctcaggaacagcttttgtagtaacggctgactctagccagtattataagagcactatcaatacaggaggcaagaatgtatcagtaaagagagtcattgatgctggcaggaatgtatacattcagatctttagggattcatatgttacattatatacaaacaaggctgttggcgatagtgtttctcaatatgatctcttagcaatattatttgtcgttaaaactagacagggagaagctccacttgttaagaagttaccaagatccgttccaacaatgccaattcctaatccaactgcttcatctactactgttgatttagatactgtgaactcaagtttggattccagttctggacaaatttctgaatcagtagctgctgaggaagccgggatcgataaggagcagaaattggacttgacaggagagagctcaccaacagttgaagctgagagagttactggagaagtaaaagccgatgaaacatcaaacgaagttgtggctcaacagacatctgaagagattgctgaaaaggccgactcaacattggataatcttgcttctattccagaaaaatcagaattagatactgatgtttcagatgaagaaaccaacaaagacaatgacttctccgaactttcagaatttgcatctgattcagaagagtctaagggagcaagctcttctcgtaattcagagtctgaacctgaaccagtttccgtagccagttctgagaatgaatctcaaatgactaaacctgatcaagggattgagccaactgcagaagaattgtccacagaaatcagagcccttgcagaaaatcagaatgctgaaactcctagtttagatcaaggagaaacaattgaaactcaaacaagtattgttgaggtttctgaggttagccaagcacctgaagatgttattgaaaccaagcctattactgaagagatttcagctgaggaaaattctcaaaaggtagatgtacctaaagctgaacaagatttgaaggatgaatcttcagttgagcccccaattgaatccccccaattgaatctccagctgaatctccagttgaatctccagctgaatctccagttgaatctccagctgaatctccagctgagtctgcaactattgcacctacaactgagactgccgaggaagtcaaagaagaggagcttttacaaggcctcccatctcaaccagttgttggtcagttag

SEQ ID NO: 737 - DNA, 1074 bp, Cryptosporidium hominis
atgatttttgcaatttcaattatgaattggccatatacgatatatttgaataatgtggcaaaagaacgggcgcttacaaagtttaaagttggtttaaagaaagaaaatgagtctgaaaagatagtgaatttttttaaggaaaataaaacactatcgatgagttttttgtttatagcaacaatgatgttttctttacatattcttttaagtttttcagtaaaggggatactggttccagtgatattgtgttatatttcactacctttattcgttaagtttgtagctaaagctaatctaaatgagaaaaatgactcaaaaattacgtcatttttagcttatttaccactttatttatcatccgcatatattggtttgaaattggatgattcagtaaacaatacattttcttccaattataatccaaataatattctcctctatggtatgagattagctggtgatgaaagagcactcagactatgtatttcgttattattctacaatttttattatttgtcaggatttttggatcttttatttcaagttgatactgaaattgagagaaatatctatcttaataatttagctcctctcaaaattattatactaatagctttgaatgctttatcttttcctgggaataagtctctagtttcatatatttgggcatatccttattatactggaggagtaacaacatgcatttttattattggaacatgggtttggcttgaattgttcagaattactggaactcagctttttaaaaatgtcaaaatttctgagaatctacatagacatttttcacgtagtgggatagttatttacatcacacattcagtatggctggagtttgtgaccagatattttttaatatactatatttccccagatagctcatattctttgtatgacggaaagtccattagcctctttggctttgtttttcctggatttggtatgatgagctcttggatattacttaatatatcgggtataatcctcagtgttattacttacatttccatcatcaattttaggatccctagattgttcttcggcattagtaattaa

SEQ ID NO: 738 - DNA, 3123 bp, Cryptosporidium hominis
atgaattatttaatactctttactctgttatctcagctaattgcagctgtatactcctttgactgcacctcaacctcggctttagatgcctacttgacgaataggggtggttctcttaattcagcaaagtgtgtatcagttgtattgcttgatgcatattcaccatcaattttaagttccacgtcatgcgatgctttggtcgtagactccaggagtgcagatagtactggattactaaactctgccagagttacatgccctgtcacaacaagccatatcccagctgtatttgacttaaatgcaaatttaagtcgtcgtactcaattgggttcaatatactgtgttcaatcctcggtctcagagtctgtgttatacactagtattttggatagagcttcagcagatcaagtttcaaatatcctattaccagtcatttcaccagcctctactaactttgaatccagagttaataatgcagcttttcaagtgagaagttggattatgacagccttcggaaacaataatatgaaatgcccattcaatattattattccggcacctgatttcttttcctacgacataatcttgcatgggttttcaaaagcatttactagagaccaagcagcatataataaatcgattcagtctggtacaactccagccccaactccagccccaactccagccccaactccaattccaattccagctccaactccggttcctttgccaagaactcagctactatcagatttcaaccaatacgatggtattgcttgcccaacaatgaagaatttctttactttgctttcagaagccaatgatccatacattaataaatatactgccgtaacaactcagatttctttggcattctctgattttacaataggtattcactcatgcgatgccttcataatggaaagtgggacttataagtttgaagagctgatgagagaaatgggtcttccgtatagtcctgttactcaggaatcaggagttacagtaagatcaacaaattatcgccaaagtcctgctatttggtactcatccttaaagaaggtaatgtaccttgacttctataatgccattcatgaagtaggtacatatgaatccttgatggatttgatcaaagctgcctacttgcaaatatttgaatttgcagataaacaccgtttgagtgaattgttggttttaccttttggtctatgggattctcgtcattcatactctattcaaattattacagccgctgttgagggtttagctgccgcattaaatgagttcttgctttataattcgcagatgcatattactattttaacagaaacgagagaaaaattcgaagttcttgttgatcaaataaaaccatacttcaatgtcatgaatgtcagaacatcagaagaattacttggtacagacacaaccactcctatgccgcccacaatacctatgagacctccaccaagaccatcaagacctccaccaccagtaccacaacgacctattgggtcattaagaccagtagcacctcaacaaccttcaattagaccaagtacacaagggacatactatttcgactccgatgaagaatgtatgtcagggacaccagtttctgaattcattcaatcaatgtacaacggtagaattcctcaacccacaacttcaaaccacttttctcttattctttcgaactcaaatccaggtgttgttggatgcggatgcttagtagtcgatgtatcagaaaaagctcaacttgaacttgctgtaaagcttggtatcagtgcaaaggaatgcgcttcagttggtagctctgaaatcaaggtgttgggagtgagagctttaaatgcttacacaattgaaccatggatgaccaatgtttccagagtctactgccttaattctacaaagtttatttataatagtagggtcaaggccgtagaagttctttacaagaaaatacttgcttctgcaaaatacagatgcactactgttctctctccattaattgcaacttctatgattacaagtgaatcaagaaataaggagtacatcctccaagcagttaaaagcatggatgaattcttctccactagccctcatagagactccatccacctcacattctacgagagaaactctgagattttcttccttgcattggatctctttgcaacttattatcttgaatacgcaagctcaggcggaattggcgcaacccttacatctatcaaccgaaactggttgagcttaagcggaatcattggaggtaatatgattccacaattcagagcaccagcaacgacaccaagaaaatcaaagaatcttttaagtagtgttaagagggaaattagtagacgtatagtgagaactacaactactaccactcctagacctactagaatacctcccccaagacctccactaccaaaattcaccggaaacaaggatgcctctagaccagctccttctgattcaatatttactagctctcattattcagcgattcaagaattcactaggctgcattccaagcctgatgttaatggcttatatagcatgaattattgggttcaacagttaacaactttcaccagtacttctttaactgaactttctaaaaggttctatttaactaatacaaatatttcagaccttgttaactgtaaagttctagctatagacgcattgagtccaggaattcacaacattttatcattgactggcaattcatatccatcgcttctaggtggagtcaccgtagttgcaaatagaagatatggagacagcacagtgccattaacaaaaacattaagtagattgtacatggttgatgtagacaatagatctgcttcatctgcttttgaagaagttatctccaaggctgtggcaaattcagaaaaacaagttgtattggaaatattttctttaaaagaaatgtatcaagtttctagataccgcgcagaacaacacatattacaagcaatcaaagccttgatcaatagaatgaaacattacactagctctagtttgaaggtagtaattgttgaggaagattcaatgttggcttcaataatattagaagtactcattagtgtattttctgggagaacaaggatttaa

SEQ ID NO: 739 - DNA, 1412 bp, Cryptosporidium hominis
atgaggcgcagaaaggaatacaaagttagagagctaaattcttttgaaattgagcagaaaagagaagatttaaaagcgaatattgaagaaagtcgaccaaaaagtagcttattaagaattgttttggattatataggtctaatactgtactattttataaacaatgtcaaattaatttttcattacatacttaatccaagattaaatacattaaaggaattataccctcatcatacagctggaaagtatgaaccaagaagtaaatttgggtaccggttctttttagtttgcaatagagtgcaaaatattggttttggatttgaatatagaggagtatattattttagtaatgcacattttaatgcaaatacagataaattaaagattgatgggaaggaaattaggctataccagcaaggatttacgatgttatgttcaaaaaaagagcataatatgaaaaagccaagagatgacgaagatttatatttgttgaatccctatatgccaacgattaagggaaagtgtatttacaagaatccctttttttattcattttttccaattaattctatttgtagggagtttacaggactacctataactaatagtaagggggagctggtatcaatatatgataattttagaaaagtgaatagcttggtttataatataattggggatgttaacttatggaaagaagagcaaagtaatagatgtattgattataaggttgaaagtgttcaaacagaccgcgaggatatacaagtgtttagggtaatttctgaatttgaggatggatgtggtaattttgaaaataatgaaattgttggatactttttcaaatataactcaattaattacatttctggagcatttgttgatgaatttgggaatctgaatttgccaatagcacagaaagataatgatgaagctgaaaatactttgaaatattcaaatttatacagggatttgtgggtttcagtgccaaattcgatgcataatttaagtttaccagaccaagatgaatatgcatttgtattaaatattactaggtacaaccagaaagagattaagggtaagataaaaatagataataatcagcaattttgggcagagtttgtgggagttccaaatagagaatttttaggactaccaatattaaatagaaatggccaattaataggagtatatagtgattttaacatagaaaatagttttggaagactcaaatattcagtttatcttggagggataaatacatttaagaattttttgttaagaataagtttgagaaatcaaaataccatacaaactcttgaaactgattttgatatagaaatccttgaacaagttgtttctctttgttctataggtgctgaaaacaatgatgaatcctgcagtaaacttgtaaa

SEQ ID NO: 740 - DNA, 4941 bp, Cryptosporidium hominis
atgatgataataaataagaaaatatcaatatttttattattaataataatcgtaatattttcatttaatatggataatttattattagaagctgcatataatagtaataaaagtaataataataataataaatcagtaaataaagatgaaatagtaaaaatgagtaaggagaaaaagaataatggtgaaaagattgagattaaagttagaaatgcaggtttaattattgatgataataatagtaacagtaataacaaattattaacacctcaaaaggatgaattgcttagacaatattataatgaatactcatttcctgattatatgtatataattgttttaggtaatttgaagaattcagtaaaaataaaaaataatccaggtgaatttattattaataattacaaattgggaaagaatagaaacttcagtaattctactgttactaataatattaatgatattaataataataacaataataacggaaaatccaattggaagagtattgtatctacaagtacaactacaattagtacaagggaagatattaataaagatgaagatatttcaaatggtaatagtattagtagtttaacaatatcaaaagttgataacattccatttattagtattgagagtaatgaaaaaaatagtggaattgttaaaaatattaaagagaatataccatttaagcatattctcttgccttttacaacaacaacaacaactgttactactactactactactactactactactactactactactactactactatcaccacaacaaagccaaatactactactactactactaatactaatactactaatactactactactgctactacaacggctactactacagcctctaattccgccacttccaccgttagtgttattaatagtactgtaaaaagtttagataataaaattgatgaaaattggtcattagataaaggatatgaaaaagaacaagagatgaaaataagttcatttaatacaaacaataaggaagatttaaattatgctgataataataattctaattcaaatgaagaaataaataataaggaaaagtttaatggtattttaacagatttattttccaaaaatttaaatagaagtcaaaataatattcgaaaacaatatacaacaactactacaaataatcctgaatctctattattattaagtaggttaacaactaaagcacctccaaaattcttaataagttcgattaaagcatctagtaatagtacattagagatttcaaagcttgataatagtaccagtacaataactacttttattggtagcaataataataataagccatccaaattaatattgaatacctccacaacaacaacaacaacaatagcagtaacaacaacagaatcttcaaaaatcttagcaagtaatagtactataaaggttgagcttccaagtagtggtagaataagtgatattttaagtgtagataatttggaaactactaataatgcattaaatccaattaaaactactgatggcaatataagttctatctccactcaatcaaaatattacacttcaacaaccacatctactaaaaattctaacataaagagaacaattactagtagtcctaaagccaaggatgaagaaacaagaacttctacaagtacagataaaatttcaaaaactaacaccaccacaccttcaattactacaaccaattccttgaattcaaccacaatagttgatgaaaatcataaaatttcagataatgttgaccttttaactaatgttgaggatgttttaatagaaacaaggggaccatttattattgttaatgaagaaggtgaggaaaataagacaaattctaaatctaaaggcttattattgaataatagtaatcatggagagaaaaaagttgaatatgaaatcactgatggactaaataatgaacaaagtttagatatatataatgaaaatgataaaaattcaaataataaacaaatgttaaataataataacaattcaacagatatttcaatatttaatggtagtaataacaatagaaataccggaaataaatcagattctttgattaactctagaacttccagtaataaaagtattatgaacaatgcttttataactaccacaaccactgcaaagacaactactaccacttccaccacaaagccaactactactactacgacgacaactactacaaagctagttactactaccaccactactactactacgacaaccacaacaacaaccacaactacaacaacaactactactaccactactacgacaacaactactacaaccactacaaaacaaactaccactacaactactaccactacgacaactaaaactactactactaccgttaattctactactacttccaccactacaaatccaactactactaccactactaatactagtacaacaacaacaactaccaccaccaccaccactacaaagccaactacaactactactactaccaccaccactacaaagccaaatacaacaacaaccacaactacaacagcaactactactaccactactactactactactactactaccaccactgcaaaaccaactacaactactaccacttccaccataaagccaacaacaacagcaactactactactactactactactacaactactaccaccaccaccaccaccactactacgaagccagctacaactactaccacttccaccactgccactactacaaagtcaacaactactactactactaccaccaccactacaaagccaaatacaactactaccacttctaccataaagccaactactactactactactactactaccaccaccaccactactacaaagccaactaccactaccaccgtttacacaactagcatctcatatacaacttctaccaggaacgctcccacctttttcaatactacaacaaagcctataacaactagtacagctaatcctactaaaactatattgaattcaacctctacctctacggttgtaacttcttacggaaacaaagataaatcaactatctccagtactgttactgctgttgataaaagttctacctctacctctacaagcacagcttttacaactactattaataccactactactcccactgcaaagtcaactactaccacagccactactacttctactactactaccaccaccactacaaaaccaacaactacaacaacaactactactactactacaaccaccacaacaactaccactactactacaaccaccacaaccacaactaccaccacaacaactacaactactacaacaacaactagcaccaccactactaccacaaccactactaccactaccacaaagccaactactactaccactactaatactagtacaacaactactactaccaccaccatcactacaaagccaaatacaactactaccacttctaccataaagccaactacaacatctactactactactaaaaaaccaaatactaccactacaaaatcaaacactactacagcaaaaacaacaaatacttccactaatataacatatacttccaatattgatgatttatcaaatacactcaaaatgaactctataccaaataatgatatagaatttgatggaatgagtaatggtaatgattctcaactttttgcaagtaaagaagataaattattactcaaattacccattcttataacaacaacaacttctacaatgactaccactactagaaaatccttcactcctaaaacttccacttcaattcctattaacaataataataataataataataatacaataaaattaccaacaaataaaggacgagaaaaagaagaaaatactgatagtgatattggaaagcataatcatattcaaacaattacattagcattattagaatcttcgttttgtgaagaaagaaaagataactataaacaaattacaatggcattaaaagaacatatttccaatatattaggaatacatatacaagatattgtaattgatgagatatatgcagaaaattcaaataaattgtttagtggatatgaaaaatgtaatttaccaaatggtaaattaaaaggtataatatttgatttatcaataataaaaaatatattaattgattatccaacttataatgatattgaaagaattacattaatagaaaatgaatttaataataaatatggcaaaattattctatggaaaagaaatattgataacatcaataatgaacataatccattctgtcaagcaagtttaaaaactactaataatataaaattcatgtgtattaataatccaatttattgtatacataataatgaatataaatgttatactaatccaatgggaattgattgcttctgttataatgatcaatcaatatataatcatatacaaaataatcaatataatattacatatcctatgactaatgaatgtaaaactattatttcttgtactaatgatattactcttccaataataccaagatgttcaacaagtccttatagtattggatgcccatgtaatttaaatccatattcaaaattgtgtggatgctatattaatccattcaatcctggctgtcattgtacatataatcctaattcgaatgattgtaaatgtttattaaacccagaagaatgcaaacatgaaaatggattggatattattgattatgaaattattgatagaggaccatttgatcttaaacatggacttagaagattttacaagaaacattttagaaaaagtaattctttaccaatattctcaaattatcatattttacaaagcttattaatcatcttcctaaatatgatgatattatataccagtgcataa

SEQ ID NO: 741 - DNA, 1044 bp, Cryptosporidium hominis
atgaatattggtgatgttattcattttgatgataatttggatgattcaattaatttcaaattagatataccatttaatttgaaaaaagtctttctaaatgaatcagatactgaaaataatacaaaattgaatatttcaatcatttcaaatcattattatgatatttttgtttcatttcctcccatttttgaagcatcatcacatcttcacattttcagatcgtttcctgaagactactactaccactctaattctaacagcaataataaaagcaaaaataccaacctggtcatatcaagtaacgaatttattaactacttaaaaacattagaaagcaatatttcttgtaatcaagactcatcttcattgttattattatttccctccatactttttattaccatccaaaaacataaaaattcatcctcaattaacaatgatatttcaaataatgaaaaatgctcattatcttctagtattcaagtaaatatccaatattataaaaaggaaaatacaatagacgtaatcaatcagccaatagaaaacgaattttcaacttgtattaattgtaaaagaaaaataccgagtgataatttagatctacattctttacagtgcgaaaaaatgtataaaagatgcaatcaatgcgatcttattttaaaaaagagtgatttcgaaaaacatactcactgtaataaatgtattaaatttggattaagcttagaccaaattcaaattcatgacaaattatatcatcaatttactcaatgtaaactttgtaaccaagataatattaaacctatacagcttaaaatacatcaaacacaagaatgcccaaaaaggataatactttgtaggtattgtaataatttcgtacaagccggtaccgatggacattatgttgattataaagataagtattattataacttaacatcacacgaatcttattgtggatctagaacaacaaattgtaatatatgtaataaaattgtattaattaaagaattaaaatctcatattgatctagtacatgcaaaataa

SEQ ID NO: 742 - DNA, 423 bp, Cryptosporidium hominis
atggaattattaagagaacagtctttatgtagagaattcattaaaggaatagatagggtaatttgtatgattagagaaatatataatgaaaaaaacgaatctaatgataaattacatatgaaaaagaaaattgagaatttaaaaatagaaaaggaatatctaaaagatattttaattaaacagatgagtacttattgtgtattaaaaagtttacataatgagaataaagcaaatatgggtaataattttataattgatagtaatgaaaataaaaattccattcagatgaataatttagatctagaagaggatgtagtgagttattttgatgttttcccccaaaaatatagtatttcaaatttggagaatactgatcagattccatttaataataagtttatgaaggagagaatcgaactttaa

SEQ ID NO: 743 - DNA, 2037 bp, Cryptosporidium hominis
atggaattgaaagaggaaacaaatattgtgaccttgctagcagtgaaaaaagcatataattattttgttccctcattgaataatgtagaagaaatgcagccatcaaagaatgaaatagaatcggattctgaatcagaagcaggatttgagaaaaggcaagaggagacgaatacgaaagaaccagggtgcgtaaattcagatttgagaaaaaaagcaaatgatagaaaaagacttagttttgttcgatttctaaagcttgataaagtagggcctcattgtgattgtgataaagataatcaaggaaaatgtgtgagaatgcagaattggttagaggtttcgaaatctaatgaattaggattgacaaccatttatagagaattaataaatatagtcgagtacattgtaagaatggagggaagcgatataattgaaatagatttgacagaaaatggtgtaataaataaaatatttagtaatagagtaatgaatagtatatatatggatgtatgtaggacgtatccatccatttcttatttcaaatttgaaggtaaaagttacttgagtaagattttgttaatatattcattaatggatatagatgttggatatgtacaaggtatgaattttttagttggatgcatactttggcattcaaatagtgaagaacaggcatttgaattattggtttctttaatgtttaattacggcatgagagaaatgtttgtatcaggattgccgggattaagagtcaaatgcttaattttgaaccaattaatggaaaaagaattacatattatatgggatcatattattagacagggaggcactatagatatgttagctactgattggtttctaactcttttctcatatagtatacctttaaatatcattggaaaattttgggatgatttctttcagcaaggttgggttccattatataaacttatattatataggcttcaaagaattgaatccaatatactttattcaaatgatattgcagatattatgaatgcaatcaagtattcaactccaacgactaagaatggaatctttggaaatgtatttttgaatatcaaagatgaactgggaaaaagtaatgtaattcgattctttaataactttaatacattgttttctaataatactaacaataataacatcaaccataaaagtaatgactttggatttcctgattcagatttaataaatgattctggtgattataatgttgtaaatcatggtaatctaacaaatgatcctaatataatttctttacctcatgtatggagtgaacttatcacagaatctcagtttgagatagatctggatgttgattatatccaagaaatggagctcaaatattcatccaatccctctgatgattgcattgaatttttcaaagatgataatcacaagattagagatagtatacctataaattctactgatttgaatatgcaaagcttcgagtattttttagacaatgacgaagtaaaggaaaaggaagaacaggatgaagaaaaacctgctttaaacagtacaatcgcagattctcaatatgatgatttaaaatgtattgatccgccgaattcttgcgaaaatcgtttgaatcccgagcaaaaccagccttctcaaagtttggaagttggttttactaaaaaaactgacgttaacaatcaaatcattaccagatataaggaatactatgatgggataatgacaagtatttttgaacaaagtgatcatagctccataccggaatcttctgttgatattactagtactaacaatacttgtaatagttcttcttgtaataaagacaataaggaagttggaatcacaaaaagccaaactccaagcaaaagcatatatgaaattaaggataagctaaagtcttcattggaaagacttttgaatattactgaaacgttgctgattaagagtatcaacaaggatcacttgaaggaattaagtattaaatgcaaggaaattcagaaaaataaatttggtccatggtcgtatcagcaataa

SEQ ID NO: 744 - DNA, 606 bp, Cryptosporidium hominis
atgataaaaccagaaggaacaaatagtgaatttgttttatgccaaagcccccatcatatgcagattagtgcaccagatttgggtacgaaggatggtatagttacacaatatttaattaaacagctaagctcacaaatgggagccaactcattcttttctaaaggcccaaattatcgtgtatttacaatactggaggctgatgtcttatctttaaaggctcaagcagggctaagaaggactatggaaaagtattcaaataacagtagattaatattacattgtgaacagttatcatctatcattccacccttaagaagccgatgtttatgtattagggtgcctttaccctctcctgaggaggttcttcaagttttgagattcatttctaattctgaaaatcttcaagtacctaataattatctcgaacaaattgttacagaatctgaatgtaacttaagaagagcaattctgatattagaaactgctcatacacaatctttttcaaatcctccaagtgctttgaagcttccatggcaaaaggtttgcattgatattgccactagcgtaagtttcctacaaaaacctccaagatttgaatatttataa

SEQ ID NO: 745 - DNA, 288 bp, Cryptosporidium hominis
atgctttggattgataaataccagccacgatatcttagggatttgaagtgtaacaaagaactaaatagtttattagaaaagattacttcaaattcaaatggtaatattccacatttgcttttttacggcccttcagggggagggaaaaaagtaagaatttcatcagttctacacgaaatttttggagattcagtagataaggtaagttcggagaaattggaattaacaatatttccattattattgtttgaactgagggttgaattgagaaggaaagtaaagcaataa

SEQ ID NO: 746 - DNA, 1059 bp, Cryptosporidium hominis
atgacaataaatgaggagatgaatggaagtgaaaagagaatgacaacaaccagggtcataagaagaaattcaccatatttacgagctccaagaatgtattcaatctcagatctggctttagcatgtcctttgcactgcccagaattgagtatttcagatttcgatattggtagaaagttaggtagtggccaatttgggtcagtttatttggcaagagaaagaagaacaaagtatattgttggtttaaaggtacttaggaagaagaatctcgtaaagagcgggatggaagttcaagttagaagagaaattgagattcaggctcatttaaagcatgaaaatatcctccaactctacgcatggtttgaagataagagcagaatttggcttgtaatcgaaatagctccaggtggagagctttacgaaaagttgtgtacagatgggccactcaaggaataccaagctgcaagatatatgaagatgatgatagaagctattcagtgttgtcataggaaacatgttattcacagagatataaaacctgaaaatattttgataggagtggatggccaactcaagcttgcagattttggttggtcttcccatattaacaataacaagagcaggaggagaacattttgtggaacctacgattacctcccgccagagatcactaggaagcaagagtacggaccagaagtagacatttggtctttgggagttttatgctatgagctagttaagggtgaacctccttttccttcaaatcaggggcataatgttcagtactacttgattcaaaacaaacagcccgaatattcacctcactggtctccaattttggttggattcattcattcagcactacaaaaattacctcaaaacaggatcactattgctgacatgctcaaacatccttttatcaccaaatatacatctggagaaactcttacccaagagatttctttaactgaaaatccaaataaaaacttaaatgttgaaagttatagcaataatgatgaaaatgtttgtaaaaatagcaagattaaccaacaatcttaa

SEQ ID NO: 747 - DNA, 1704 bp, Cryptosporidium hominis
atgccagaactttatgaactcccatcatattcagcattgaaagaatatgcaaacaaacaaaaatgcatacacctgagagatctccttaaaaatgaagtcagaaattcgtgtttaactgtcaattttggagagatttttatggattttacaagacaaaatttagatgaagaaggtttcgagcttttgattaaattagcagcagaatcgaatttgatggaaaaaattaaattgcagctcaaaggtgggattattaatagtacagaaaagagagcagtcttacacactgctctacgttcaaaaagtaacattcctattactctctcctccggtcagaatgtactaaatgatgtaaatgaggtaaatagacgaattttcaagtttgcaaatgctatcagaaagggcgagcttcttggctccacaggaaaaatactgaaagatgttatctgtattggaattggaggtagttaccttggacctgagtttgtctatgaggcattaagaacaactcaggaaggctttgaagcttccatgggaagaagattacgctttttagctaatgttgatcctatagacattagaagagcaactgaaggattacatcctgaaactactcttgttgttattgttagcaaaactttcacaacagctgaaaccattcttaatgcaaaaactattaaagaatggcttcacaaagctcttaaaagtgaaactgctgtaagtaagcatcttgctgcagttagtactaatattaaggctacatccgattttggaattcctgttgaccacgtatttggattttgggattgggttggtggaaggttttctgtttgcagtgcagtaggtcttgttccgctttcaatccattttggcgccaacctcatgcaggaatttttggatggctgttgggatatggaccaacattatgaaactgctccagttagtaagaatttaccagtcttattgggtcttcttagtgtctataattcgacatttatggacaagagttgtgttgcagttctcccatattgtcaggcactatgcaaattccctgcacatgtacaacaattacttatggagagtaatggaaagagttcaagtattgatggaaatatgcttcatgataagattaagactggcgccatattttttggcgagccgggcactaatgctcaacacagtttttatcagcttttgcatcaaggaagaaatacaacaaactgcgagtttattggatttgcaaaatctcaatgcgattctcagatcttaggtgatccaatttctaatcatgatgagctaatgtgtaatttctttgctcagccagatgcattggcaattggcaaaactcagagagagttgaatctagaggattgtctggaaaatttgattcctcataagttattccaaggaaatagatcttctatttctctcttattaccaatctgtaatgcatattatattggtcaacttcttgcgctgtatgagcacagaactgcagtggagggatttattctaaacattaacagctttgatcaatatggggtggaacttggtaaggttctcgctaaagatataagaaacattatttcactaaaaaagaccaattcatctcctgaaattgttcaaaataaggaggataagattcctggacctaccaggagattaattgacttatatttaagggtttcaaagaacctaacgaattga

SEQ ID NO: 748 - DNA, 894 bp, Cryptosporidium hominis
atggaaagtatattgtcaggaattgaacatgataaaagcttaaacaataattttgaggaccaaaatagagaaaccttactttctgacttcccatcggttgaagattatcctggcaagaaaaaatcttatgaagcagaagaagactcttttgttaagtttgatacaagaatgatgaaacattttagtattgaagatattactttcaataacacaatccgtaactttgataatgataaggctaaatatcaccgtattattaaaagcggaatcaaatttgctgaatattctcttgaattatctaaaaggcaaaaaaagaatacatttatttctaccggaattaagaaacataggatacttaaacttaatcaagaaagaagtattgcttctgcaagtatcattgctactgtaactatcctcaaatcattattatataaggaatttccaacaaacatcagatggacatactattcattttatcctcttattctttcttcatatttgcaggcttataataacctgaaaacggaaaacaactctaaaggattcttttcaaaggcaatgtatataaggaaaagccaggcactttctagattgaataaaagtttgttaagaataacccgtcatataaataatttggaaattgatggtaaatataattattccgttaaacccaaacatttttggaagttaatagaacctactgtggtttctccagctcatggattaattactactgatttaatcaagaaaccaaaaagtctaagtggtgagtaccttaaagacgtaatgagtattctcaaatccaataagtacaaattagcaattgctcaaaataaagctagagaagacttttattattatattaatcatgacttggaaataatcaaggattaa

SEQ ID NO: 749 - DNA, 1134 bp, Cryptosporidium hominis
atggttcacgaatatattggaagcaaaattacaataatttctcgtaatgataaaagatatgaaggtgtcttgcattctatagatgttgacaagtccactatcactttaaaagatgttagatactttgagaatggtccaaatggtgctcctgggcctgcatcatcaaccgtttttgagatgattgtttttagaggaagtgacattacagatcttgcagtttgtcagccggcagcggcaacaaacaataatggacttccaaatgatcctgcgatattatcagttaatggaggatcagggacgaattcagctcagagccaaggtcagagtcatgttgctgatactagcagtgttaatcagcaaaaaccacttgaagctagtccaagtaactctagacgttcccctaaaatgagctatagcaatgctgtatcaggaggaaaaccttcaagcactaatcaagggagctcatcaatctcgaacggacgcaaagatcattccaggaatagacaaagaggtggtggatattcaggaaaatcttataaaggcagtggaggaagctctcattataacaatggtggaggtagtcaaaggtctttcattgttggagaactaaagcctagaattaatcaggctctcaaagcagaacttgatactgaatttgatttttccgaacaaaataagaaattcgagaaaacactcaacgaaggacttgcttctgctcaaacggaacagggagttaaattagaaggtaccatttcagataccggtaacaaatctggagctatgaatacaggtttaggtattagtggaaattctaatgcaagtaatgatactactgatgatgacccatccaaaaaactaacggttggaggatacaacaaagtttctggattttttgatagcatttcctgtgagactttagatcctgaacgctcaaaaaaacctcaaggttcatctgatccccaagctaaagcccttagagaaaaacaaaaacaaatagacaaggaaacctttggaacgtcagctgtaaaacctcgtactgggtcctataacagaggttctcatcatagaagaggtggaggaagtcatagaggtggatatcatggaaataacagattcaataaaagagaggcataa

SEQ ID NO: 750 - DNA, 1815 bp, Cryptosporidium hominis
atgctctgcgttttattcgtgctaagattagtattgttaatagtaataccagtaattgcaggaaaagattactataagattttaggggttccaagaaatgcaaatgagaaccaaataaaacgagcatacagaaaattaagcttaaaataccatccagacaaaaatcctggctctaaagagaaattcatggaagttgcaaatgcatatgaggttttagtcaatcctgaaacaagacgtaaatacgatgcttttggagaagagggattaaagtctgaaggatttggtggaggaggagatggaggatttgattttggtggatttggtggatttggtggatttggaggctttggggacttcggaggtttcaagtttagtgcaggaggtaatactttccattttggagggggaggaccatttggttttggaggaggtggtggaggtaggcgtcagggaggtaattcaagatctcattttgaatctcaaggaagttcctataacaacttgtattcggactcaaaacatgttactgaactttcaacaatgtcagctggtgaaatcaaggataagatcaaatccagagaatggattatgattgttaacttctatagacctggatgtgggccctgtaagcagctagtacaagcctatggaaatttagcaaaactaatgtcccagtatgatgtagaatttggagcagttaattgcgatacccattttcaactttgtcaatcctataatattgagaagtaccctcacctatccatgtttattaaaggtaaaaatagccaaatagtctttaatccaagtcctggatctaaaaatccatatagtgagtcaaatataggcaaatggataacagaaaagatgccagatcactctatgcgtctcaattcttataaccaagcgattcaatggcttagacttgggaagcatattccaaaggcagttttattcacaaacaaagactcttcctctcttttactcaaaaagattgcaaaagatttccagaatagactaaacctagcaattgtctcgatcaataatgactggctgaaaaagatattctttgcatcaccccacatggaagcttcaaaacctgcaaatcccccttatattctctcagtggatgaaattactgaatctggaaataaagttggaggaaaagcctcagaatcatcatcaataactgcctctggagaatggatttctcttaatacaatttctcatgatgtcattactttaacattgagtcgtattgttggctcatttagagcaaggaaacagcatgacattaacgaggccttgaagagcaaagttcaggaacttacttttgaattggttacttccaaagggttctgctccgagactgattcaagattttgtgttattttaattatggaaaagaacgactttagaatggataagcgttttgaagacctttctttcaagtatagaaacgacccaatcaatttcttctggatctcagcctttagaaatggcaaaaatagccacttcttagatactttcaaatgtcattctgagttttcaccgtcttcaaaaacatgtattgccatttatagagctaagagaaggaaatttcaaacatttgataaccttgagcagcttccaaagtttattgatggactcctggatggatcccactctctatcatctaacatccctagatctactccgatccctgttcctgcagagtcagagccaacagcctcttaccaaaacgatgaagaagatcacgaatatagtgactctgaagactctgactatggacaggaaagctccagggatgaactttaa

SEQ ID NO: 751 - DNA, 246 bp, Cryptosporidium hominis
atggaagttgcaaatgcatatgaggttttagtcaatcctgaaacaagacgtaaatacgatgcttttggagaagagggattaaagtctgaaggatttggtggaggaggagatggaggatttgattttggtggatttggtggatttggtggatttggaggctttggggacttcggaggtatcgagatcattgcaagaggaaaacttatccattttggaattagttcagctagagaaatggttatatga

SEQ ID NO: 752 - DNA, 1245 bp, Cryptosporidium hominis
atggacaataaaacccaacaattctttaagagtataaaggaaaaggaccctctaaataataaatgtattgactgcggagcgcctcatccacaatgggcatcagtttcacatggatgcttaatgtgtttgacatgtagtggtgttcatagaggtttgggggtacatattagtttcataagatccattacaatggacagttggactccaaaacaaatgaaagcaatggaattgggaggcaataccagattgactgagatttttagtgaatacgggctcaatggctgtgacattaagaaaaaatacaactctcaaatagctgcctattacaggggaatgttgaaagatttatgtgagggaaatacgccaggtccaaaaccctcgaaatcaattggttgtttggaatatgtccctgagagcaataataagaataataatgtaagtagcaataatggattttctccaatgagaactggtacatctttttcatcttctaactcatttggaaataatccaagtgacgacaaatatgcaaacttatttgaccgtaacattggttcaaaaggctttggaggaattcttgatagtttatcatcgtttagcatgaaggtcatttccaatacaaaaagctatgcagaaagtacaatcaaccatttgaatgaaagagggattttagagagtgcaatcgactcagtaaaagctggaggaacttacattgaagaagctggtagagctgttgttgagaaggtccaggatgagaaattctggtcaaataccgctactacaatgcaaaactctgctcaatgggttaataacactattcagagtggtatttctggagttaatgaggctatccagactgcaattgatccaagtaattttaatgatccactcaacaacattttcggtgatgatattaatgaagctgagactgacaaaagtggccaaattgatcctcaaaaatcctcagattccataaattccaattcatataattcaagtaacagtaattttactcgaactattggcagaaagccttctccaccttcagaatctttagctactaatatgaatagtaattccaaggcttctccaagtaacaaagctccacaatctgtcattagctcaagtaatagtaatgtcaacattgtacaatccgatgtaaagaatattaacctctgggaaagcgatcttggggatgattgggagcctaaagacttcaaaaaaggtaataccaaaaaggcataa

SEQ ID NO: 753 - DNA, 2610 bp, Cryptosporidium hominis
atgagctatattttaaaagataatgatcaaatttcgcaaaaaatagctcaatttgaaattttatgtctttcaatacttttgctaaatatttacatgcaatcaaattggactggtcctccttttaaaatagacgacggtgtatctaaagattggaagcctgaaaagaaagaggttgattacaacaaaaatgaactttctggactgatcacagaaagtttagataatgataaagaatttggaaacaattatcacaaagaatgtactcgttgtctggaaatagatggtgaatatttataccaaagatgtaattcagccccatttctaacttggagtatatttctgattgaattcttatcaaataggtcaactgataataaagatgaatttaatagtgaatccaatatactgaaattatcaaaatatattgtaataggtgatgaaataccaaaattaagctttataaacttttggaagcaaagattttaccgtatatggcaaaggagtttagaaggaggaataaaatttgctgcaaccccttatttagagagtacaattcttgagaagtattcaaattggttaaaaaatgaatggaatataattccagatgatttcccaataaacgatcgtttcaaggataaccttttaaggtctttcagatttgatgaagaattatcaaataatcaagctttgttttcaaacaaattggataaaaatgtttcttctatatttttacttgatctttccctttctttatccacttttagtagagcaaatccatgtgcaatattacttaaacaaatatctttaatgaatggatttaaatattcattcactggagcacttggacaaaaaagaatgaatcaaagggagagtacggcacagcttgtagttgaagtttatcgaagttctgacaatcttgaaaacgaaatagatagaaatatgatgaaaagtgaagaaccaattaaagattccataaataatgagaccgaggagaagattcttgatcgtcaatatccagaaaatgttttactcaagagtgtagatccaaatattgatatttatgaaaacgtgaaactggatgatgataaaaatagccaccttaccggatccttggcaataatagaacaatgtgtattattaatacattgtgttgcaatttatgaaacaagtccaacaaatgatgtaatagcttatgagcagctgaatgctttaacaaacagaatcttaaaattcgatataaccaaaatcaaagatgaggatcttcgcaaaaaaattcataattggttatgtttctcaacagctttatggtatagatgttatgcagaacatcatcgaggcagaacagccgatagagcttgtcttcaacttcaatcactggttgatcagtttaatgacgctgagccaggccctgaagaacgtcttagattggtattttctgtaaattatccaaatatttgggaagcaaagaaagaacttggaataagaatgatgagaattggttctgttttatcagcttataatatgtttgtagaaatgtgtatgtgggaagatgctgtagactgtttaattgttgcagatagaaaaactgaagctattgagctagttaaagaacagctcaaagttagagaaactccacgtctttattgttctcttggagatcttactcaagatctttcattttatgaaaaatcatgggaaatttctcgccatagatttgcaagagcgcaaagatctttaggaaatgcatactttaagaaatcacaatttgagcttgctcttgatgcttatacaaaggcttcattggttaactccacaaatgtaaattgttggttttcacttgggtgcgttgctttaaggcttgagaagtgggaaattgcgcaacaagcatttagcagagtagtttctttagatccgcagcaaggtgaagcttgggcaaatttggctgcagctctctctaagaaagaattatgggatgaagcacaaagtgcgattaacgaaggcctaaaacattcaagagacaattggatgatgtgggattcttcacttaaaattgctattaaaagagaagatttaaatcgtatcattgaatgtttatctggtattatgaagctcgcttcttataaagaacgatttccaatgtggtctcttccaaatattattaatcttcttaagagtgagaaatatgcccatgaaattaataattcagacagaccatattctcttattaacaaaagtctgaatttattaaaccaaatttcgcagtattcatcaaaacctgtagtttattacgttttatcagaaatccaaattttaaagaatgattttagtggtgcatattctagtaaaatgaaagagcttagaggttccatggaagtaatttttaacgaaaagatttcttctgatgacaaagagaagtatcttcaagacataccaaatatatattctgatataaaagaaatcatttacaaatgtaatgactctgacaaacccaatgaggaacgagttgatgaagttaatatgataatcacaacgattattaagaggcttaaagttactaaaccagtttggtcttccactcttgaacaaaaactttctagttctttatcataa

SEQ ID NO: 754 - DNA, 1707 bp, Cryptosporidium hominis
atggagcaaattcaagtaacgccttatcttgaccagaagccaggaacaagtggtctaagaaagaaaactcgtgtatttatggaaggaacttacttggctaactttattgaatcatacttccaatcattctcacccgaagattttgaaggtgcaacgcttttggtagctggcgatggtagattctttctaccagaagccatacaaattatttccgaaattgctgcagcacataaagttaaaaggatttggactggtgttaatggtttgtgttcaacaccagcaggaagtgctataataagagaaagagaaggcggcatagcagtcggtgggatcttattaacagcttcacacaatccaggtggtattgatgaggactttggagttaaatttaacgggaagaatggaggcccagctcaagattcggttaccaatgcaatttttgaaattacaaagaatttaacatcatataagaagatttcacttcctaaaattgatttaagtaaaattggtgcacaagaattaatacccaatcaattcactgtcgaagtaatagacacatctgaagattggctaaaattaatgaaaaagatttttgatttccaaaagattcaaaatctacttaatagaaaagactttaaaatggcttttgattctatgcatggtgtggctgggccatatgcaagaaaactctttgttgacgaatttggattaccagaaagttcattattacatttggaaccaaagccggattttggaggacttcatcctgatccaaatcttacttatgcaaaagacttagttgaattaatgaaagttaaatctccagaaaaagttgataagaacacaccagattttggtgctgctggagatggcgactgtgataggaatatgattttgggtaaaggattctttgttaccccttcagattctgttgcaattattacgtcatatgcaaaagaagcaatcccatacttttcaaaaggattggctggtgtctcgagatctatgcctactagtacatcgctcaataatgtagcagaaaagctcggaatcccatgctatgaggtaccaacaggatggaaatactttggtaatttaatggatgcaaaaatgattgatatatgtggtgaagaatcttttggaacaggaagcaaccatattcgtgaaaaggacggattatgggcagtgttggcttggttatcgattctagcccacaagaatccagatccaacaaagccattggtatctgttgaggatattactagggaattctggaaaacatatggaagaaattactacactagattcgattacgaatcagttgaaacagaaaaagctgatcaattctttaaacatttaaattctttaatggaagatcatcagaaattaagagaaatcattaaaccatatggtattgatatcaaattaacggataactttacatataatgatccagtagataaatctgttgcaaaaaatcagggtttaagatttatctttcaggataactccagagttgttttccgcctatcaggtacaggttcagtaggagcaacaattcgaatttacattgaaaagactgtgagtgatcaaacaaaagttaataacacatcaaatgaaatccttggcgatttgattgagatagttgagaaaaagattaaattacaagaatcgacaggaagagataggccaactgttataacttaa

SEQ ID NO: 755 - DNA, 279 bp, Cryptosporidium hominis
atggataactttacatataatgatccagtagatggttcagttacaaaaaatcaaggtgttaggattatatttacggatggttcaagaattatttttagaatttctggaacaggatcagtgggagcaactattagggtatatatggagaagaccgttaaaaaccctcaggaatttgaaaaaacaacccaacaagctctaagccacttaattgagatagttgagaaaaagatcagattaaaagagattactggtagaagcaagcctactgtaattacttaa

SEQ ID NO: 756 - DNA, 1719 bp, Cryptosporidium hominis
atgaataatatgaagtttttattttattttggatttttggtttatgttattggatcatccgtgaatgctaatgatttagctcttcctcttaagaagaataaggaatgcgagcattgcattctaaagggcgataaaaatattaaaactcaggttaaaggagcctatttagtggttgagagggaaactactctttctaaaactccagatacacaaattaagccatttaatgacgttcctcaaccaccaaaggttggaactgatgatgctgaaggtgatcaagccaatgttaaggaattaagtcccactgttggtgaagttccaaatgttgttccagagcctagatatattccaactgtaaagatatatgattctcaaattgaggatttatcatttccagaagatattgattcagaaacacaatcagaagagtctgaagatgagaatgaagatgaacttattttgacacgtttgcaacttggaggccaagttgaagtggtttcaaagagagacagtgaaggtaagattgagattcaaaatattggtaaccttgatttatcttgtactcgaattgaagaggaaactaaaccaaagagtaaatcaaaacttagaggcaataaatcttcaaattcaatggttgtttctggttcagattcccctcaaagtacccgtttcctgacatatgatctcttaatgttacaaaatgtaggagaggagcctactgatggtgatagtgctacttcacaaccatcttcagaggatacagagtctgagcagaatggcagtaatggtcgtgttattagaaaattagctagtggtttggaatgcgataaatgtgaattatgcacagaagataagaaatgtttctaccataatggaaagaatactgataaatcttctgaggttttagactcagatctactttcatctactactactactactactactactactactactactactactactactactactactactactactactactaccaccactactactaccactactaccaccacaatcccaccttcaatgtcagatgaggagaagtcaccatttgtaagtgatgatatctccaacgatgaagtcccagctcaagatgactcaagtaagactccatctactgaaacaaataaagatatagatatgaatattttattagacaatatgaatgctttagttaagatcgttaaggaagggaaagaagaaagcgctaaggctcagttagaacttcgtaaagatagggaactattgaccaaggttattttagatctgagagattccaaggacttgacacaattatatatacagcttgccaaactagagatggaaattagcttggttaaacaaaatattggacaattgaagagagatttagaaaaggccaaatcttctagtaactttttgactcaatatgagaataagaataatacagaattagaattaatgaaagagaaagctatgagtagtaaagtatattctcctaaacttgccagagcaatttccagacttgaaaagaaaaagaccactactcatgctattcaaaaggatgtcagtaagagaattgaaagcttatcacaagctatttctactgaagaatctcgtatttctgaattattagagcaaaagaagaaaactgaaaatataataaataagatttctagtgaggagaggttatcattcgatgaagttgataataagcaataa

SEQ ID NO: 757 - DNA, 1719 bp, Cryptosporidium hominis
atgaatataattaaagtggaagaatatttgagagaaaagtatgggatattgtcaataatagaagagaagaaaaaagatatattggatgaattagagaaaaaaggagggaagattagaaagaatgttgttggtaataagagcggtatgattaaggatgaatggaaaaaagatctggataagtttgtgttggattgtgatttaagggagtattttgtaggagaatcaattaaatttagagatggaaaaatagttacagatttgaataatttactagtaatggtagtaaaatcatatgattgtataagaccaaaaaggtcttcaattggagattttgataatgataatgatgatttggatagtgatcttaaagatgaaatttgggacgatttaatggagtatgataataatcatagtgataattttgggaataagaaacaagagaaagttgagttagatgaggaaaaagggaaaaaaggaaaaggattttcaagtaaaataaaacttaaaaagagaatgttatattttacattaacaacgggaaaaatgaaattaccatcttcagaacaatcaagtacccaaaagaatgatacagtgataattaacgctttagaatatgagagattgaattgtatgaataatgaagacaatatggtattatatccaggtacaaaattattgttgagtttacaacaaggaggattaagtaaaatacaagtacagaattcaatattattattaaataataataatgtaaaatatttgggagggaatgtggaatctttggtggaatcttggaaattgaataatatattaagtggatcaggatctaaaggattttctggatcgaaaaatctgacaaaaaaaccaccgaaatttatcccatttgtaaataaggaatcagaaaggaagcagttaaatgaacaggttaaagatgcacaacaaagttatcaacaaaacaaagaaattcaatccaagttaaaatctgttccttgtttggctttatcttctactgggaatactaatactgtcgaatctgaaaatgattccaagaatttggaaaatagtgttaaagcttataatgaatttattgaggagattcaaaaatataagaaacagaatttgatttctttggaaaagtttaatttatcatcaaaaaaggctacaactacatcaaaaatatctgcatctagtaagaatgacaagaataagctacatgatgatcgtgatcctggagctcctcttagaggaagacttcttagatcaactgagaaaattgactctgatgctagagaattcctgaaatctcgtcatgataattcttcaaacattactttatttgatcatttattctcaaaacttgaaattaaggatgctcttagtactggggaaaactcaggaggagtaggggtagtgacacaagaaggagaaggaggaagagcaggaggaggtatggagaaaggtgaacattcttgtaggggaggacattctagcaggggaggacattctggcaggggaggacattctggcaggggaggacattccagtagaggaggacattctggtgggagaggaggaaattctggtagagaaggaaattctggtagaggacattctagtagaggacactccagtagaggaggagggcattccactaggggagggggaaaaaaaggaagaggcaatggcaagtctaaccatgaaaattcgactaaacattga

SEQ ID NO: 758 - DNA, 219 bp, Cryptosporidium hominis
atgaatgatgagaagttgattgatagaggagaatgttctgaaggttttaaatttaaatttttggactatttggatgggatgagtaatgatgaattgatggaaatagctatggatcatgataatattatgggattattagaaatctcattatatccatcagaagagatatttaagtgcagtagattagcaacagagttgctctgtacaaatgtgttttag

SEQ ID NO: 759 - DNA, 2475 bp, Cryptosporidium hominis
atgggaagatttaaatcaagatttcatatcagtttgcgaaggaaatggactttattttgttggtttttttcaatcctaattagagaaatatcaagtgatttaccaccaaattgtattcatggcgatgtggttggtacatggagaattcatgtgggaacttataagccatgtccttcagatcaaaaatttgaagatccaacttgtggatttccatctccagatagggattttgcgcatagtatgttaacaccaacagagagaggattgatgaacaataattttaaactttcgtttacatttgatgtaaaatttgaaggtagtgaattgaaggttatttcaacccagaacttggatggcgttgatacaggaaagtttaatgattttgaaaaagttggtacaacgggtaactggacagtaatattagatcaagctttcacattttggacaaaatcatatagatatacagcgttcttcaagtatattaatgaacatgaagatattaatgcatcatattgctattgccacacaactcttctaggatggtgggattcgtatcctgagagtgtaatttccaatcaagataataaagaagagaataagatattatcacttgaagaaagaagtaagtaccataattatccttggctggttatgagtgaagatttaaagcttagaagaggctgttggtatggaatgaggatatttgatggggatggtaagatgacagatagaacagaatggactttgaagcttccaagatggagatcatcacctttgggattacctccagatcacccagttaacgcacaaaatccaacaattgctgagtatttaaatgaagtatcagcaaaatattcagaatttgatagtaagaataaattatggagtagaagtaataaatttgagataggagatattcagaatttggatacattaccaaaagtaagaaaagcattgaaaatttctccacattttgttcaaagaaaaaagtcaaatgatgagtatattacagaaatatcaagtgttagggaagaagagcagatttctggttctaaaaataacactgatgaaccaatttggatgagaattaggtcatttgattggacaaatcttcagcatgtttatggaagattaggaaagaaggtaggattagttcctgaagtgtttaatcaaggagattgcggagattgttttgcagtaacagcagctacaataattacgtctcgtttgtggattaaatattcaaatgagcctgatatacttagaaaaatctatgcatcatcaatacagatgtctgaatgtaatgtttataatcaaggatgcggaggtggattaattactcttgcttttaaatttgctcaggaagttggcgttagaacgcaggattgtatagatgattatgccaaaaatcttgggctcaaggaaatatatccaactcctgtttacacgccagatgaagttggaatcgcggatgatggccatagttttctgcaaacaaaaaagggaaagaagtttgaaagcaaaaagtctaaaattaaggaaattaagcaacaaggggaagatagtcaagagtatggtcaagagcataaacaagagcataaacaagggcatgaacaagaacatgatcaagaacatgaacaagagcatgaacaagagcatgaacaagagcatgagcaggagcatgatcaagagtatgaacaagagcaaggtcaagaacacgatcaagagtaccaagatgattataaagatatggaagaacacttagaaggaagtgatagtgcggagcatatttcaaatgttcacgattattatgacgattctgatgatgagaattcatcagataatgaggaattgggggatctcagtggtgcaaaacataatattcctaaaaggtttaatgttattcaacaattatgttgggacttaggcggacatatgggcgcagcaaatactcaatgtaggaaagagatccctattacaaaaaacattccaaagtcatgttcaaagatcattaaggtaaaagaatacagctatgtcaataacgtttatggaaaaactactgctcgtgatattatggagtcattatggaatgaaggacctgttgcagttagtttggagccaacattagaattttcattatataattcaggaatatttaaaggtttttatgaccctattacacgacaatatccttggtcaagtattccttggcataaagttgaccatgcaatggtaataacgggatggggatgggaaacttatggtaatgaaagaataccttattggattgttcaaaatagttggggtaaacgttggggcgagaaagggttctgtaggataattagaggagtaaatgagttatcaattgaacatgcagcagttagagcatctgttaaaatatatgacagtgatagaaagtataaggcggctgatttgcagaaggtacatgatgactcagtatttcaatatttatga

SEQ ID NO: 760 - DNA, 2781 bp, Cryptosporidium hominis
atgaaacctatatcaatacaaattttaagttcttttttactttggttagtttcaacctcatttttgataaatttagctagaagttcattgattggaattgatattggaaatgataattcaaaagtagcatcaattcgtccaggaagaggaattgagatagttttgaattctcatagccaacgaaagacagcgacagctgtatcattcagcacttcatccccttctatagtgcgtctatttggtgaggacgcccttggaagtatggttagaaatccaatccgtactttgttacacattccaagctttctggggatgtgcggaaatgatattgatgtaactaaacctacagaacttaaaagtgaaaccactttgcctaatgggctccgtaaagacctctttccatatgttatagaacataacaagatccaaaatggaacttttattagaattgatggacatggaatggttccagaggagcttaatgggcattatttggacttcttaagacgtatggttgaaggttcttccattaaggataatcaaaacaagaagggtggatcttcattgaacttgaaccctggaccagttttcgggagtgagacagtcggagctgttattgctattcctccgactttcagccaaagacaaagaaagagcttagtagactcagcggaaatcgcaggattgaatctatttggattggtgaactctcttggagcagctgcagtacaccaatcaactgatttgagaaataacgagaattcaacttttctctactatgacatgggagccaaacatacctcttcatgtatcgtggacttccagccagtaaacgccacacatatgggaagaacaattcaaactcataaaataaatgtattaggttgttctacaaactataactcaggtgggtaccttgcagaccaggcaattgctgacttagtcatcgaaaggatcagagcagccccaggaaaaagcccgctggcgggagttccgttggataactctagagtgttacaaaagattgcgaaacagagtgtgaggactaagttgttgctttcaactttgaagcaggccgatttcttcgtagaatcgctttacaaagatgtagatatttctcagtcgatttctagagaggagtttgatcgatcaattcaggagaagatattgtctaaggccttggaaccaataaatgagagtttaagggttgcaaacaagactatgaaggaaattactgatgtggagattttgggtggtggtattagagttcctggtgtgagagccttgctggatcaatactttggatcatttgggaagaatgttagccagagattgaatggggatgaggcaatggcctttggtgcggctttcgttgcagcaaaccagtcagccacttttagaactagaaacatattctacaatgaatattcatccaataattattccctaaggtttgatgatcaggagattccagtaattaatagtacatcacattaccatggaacacatcatattgagcttaaatcaagtgaagactttattgcaactttatctgagaacggaagaccaatttctagattcaacatttcaggaattccagaatttatttctaaagctcaggagggaggtgctattgaggattctatattgaatgttactcttcaaattaaagtggacacttttggaattttgagtcttgagagtgcttatggatggaagatggtaaatcagacaattagagttccagtgacagtaccagtgaactctacaaaggttgaagaggggaattcagcttccggctcaaatagtacaggaaattcaacacagagtggttctgtttcaaatggtgataagaaaagctctactaaaacaatttatgaggagaaagtaataacaagatctcagccattcatgcttaagtttttggaggagcctcttgactgtcctcttcctctcacaaaggagattaagcaatcaattagccaccatattaacgagttaaacaagctagatgctaaacacaggcaattaatgtactcaaagaactcattggaagcacttatttatgataatagaaataagttatatgacgatatttatcagaaggtaactttggaggaagaaagggaagaaatcacaaagcttctttcagaaactgaggattggctatatgagattggagatgaaataactttggagcttgtagaagaaaagattaggaaggtttcaaacaaaacagacatagttcatgttaaggcggaagagtttaagtacagaagtgagcttattacaaatgttgacaagaagttaaactacacaattcagacatttgaagcaatacaatttacccatacatgggtccagaattcgacttttgctgaggtgaagagtatgttggatgagttccaagcttggtacaatgacactaaatcaaagcaatcagagttaaagccaacagactctccagttttgcttagatttgagactctcaaaaagttagataaagttgtttccaatgttcagagagttagaaatattcccaagcctagacctaagattaagtcaaagccaaaaaagcaagacaacgaaacccaatctagcagtaactctacttccagtcagttcaatttcacaactccatcaaataacgacacaatagattccgaattcattcctcctatggataataactccagtacgagctctgaatcctcagaagcctcttcaaacaattccagtgttccaagctctgagcaaaacagagatcagtctgaactttga

SEQ ID NO: 761 - DNA, 2292 bp, Cryptosporidium hominis
atgaaagaaaagacaccaggagaagcaaagcgaggtgatattgaaaccaaatcacactcgggattggtttcctcgttccatgcagatgctcctactttccagccacgaagtggcttcgtggtagggatgggatctggagcaggaacaggaacaggaacaggaacaggagcaagtggagcttcaggctctggaggggagatgggatctggattaacagcttcagcacaaccttttatcccatcagcaattagacacaatacaagcaatacaattgatcatgagcatggaggtttccagatctcctctgctagctattctaactctcagcttggagctcaaccagctagtgggtcaaagcagaacctagtttttaatggttcgggaagtattctaggaggtgctaatcaggattcaggagggtttggagggatggatcttcttggtaatacttccgtctctgacggagctataggtgtcattagtggtctccccggatcagagtatgagggattattgcttggaggaactacgtctggacaaaagtccagctcaagcttgcaagaggaatcacaaacctctttagggggaggaggtattcatggtattcaatacggctctggagcaagttctggcccggggaactcaggagttagtagtttccagagccatggtatgaatggaatcgattcctcgaattactatggtgactcaggtagccacacagtgggacagaatcaatccgtagcagccggatcggggccaggagcggtatctggaggaataggattgggtctgggagtaggggttggtggctcaggcccctctgcagggattacccagcaccaccatccacaccctaatgtattggatctttcggaatattgtagaagggttagaggttggaatctgccattcttgagaacaatcccacagatgaatgctatcactcaaataagacatgagctgcagcttcagaacatttcccttttattaacacaaaacgatattatctcggccaatcaaggtcatggcaacaactctggagaaggaagtggaaatggagctggaggagctgggaatggttctggaggaattggacagcattatgtacctcctattgtacaaaggatcttctatggtctttgtttactcgatgattcaaatgtggcttcgacaactagattttgtggttatcagacctacgcctacaaggcaattaatgttgaagactactctgcttactgtttgagaagaatagacggttttcctctctcagagtttgaagctgtaagacctcttttagagagatggcagaagcttgcacagcatccatgcattgtatcatacagacagagctttgcatctttggatttttcacagggttcgttaatagcagtatatgattatatcccaaatgctagtacaatggaatcagttcatttcaaagaaccaatcggagagcctttattgtggaattacattattcagattgttcttgctttggttcatatccatagttctcagctcgcagcaagagtgatagatccaacaaaactgttaatttcatatagaggcaggttacgtttgaattgcgtaggaattttggacctaacaagggtagatgaatctaaaacgatcttggactaccagaaacaagatctggttgctcttgggtatataatccttgctttatgttgtggatcgctgacaattattaatgatttaaatcatgcagttgaacaaattttcctgaaatcatccttatactcgaacgatctaaaaaagttagtacttattcttctttcaaagcctgctttgaacaagaataacttggatgttttcatcctcgccaatatgctagcagcaagaatgatccctcaaattgagcacagtctgaaacttactgatgctctggagaacgaatttaggaaagaaattgacaatggaagactctttagacttctaaccaaaattaacacaattgcggacagaacacaacttaatgctattcacaagtggaacgagactggggacagatatatttgcaaactttttagagagtacttattccagcaaacagatagccaaggaagacccgtagttgatatggggcatattcttgactctcttgccaaagttgacgtcggtactagtgaaaccatcactctcatgtctagcgatggctcctccatcctgcttgtctcctttgctgacataaagcattcaattgaaaagtccttctgcgaaatcatcgcagctaccaccacaagttctaacttccacgacttataa

SEQ ID NO: 762 - DNA, 867 bp, Cryptosporidium hominis
atgggaaaccaattagtgaaattgcgagcagatagagctcaagatgctcaagatgttagagaatgggcgtttgcaactttcccaggattagaaaccaatttagaagctatctttgcttatcactgcactgatggagttggattattagactatgaaacaattgaaaagatttcaagacatttgattatgaattttggatatactgatttactcttgagatttacaaccccaaacggtacattagacaacagacatgtaagtaatggattagctatattagatgttgacattagaaaaccagtaactttggatacttttaagaactttgttgtatgttggttagataggttaattgaggctcaagataaagatgtggaaaatttgaattcagctttaaataatgagcaagagaaacaaaaggctagaattcttcatgcagtagcccaatggagagagagatttaagactattgatgatttccatgtattctgtgacgatgttagagatgctaagaaagtcgaacttgatgaggttgttgccgatgtttacgatatgcaggaaagactcaatgagcagcaacttagactcttacaaagacaaaaagaagttgaagaagtttatgccaatgtacaagcagaggaggctgctatacaagaagctctttctaatgctccaactgctactcaaatcatttccgaggaaatcgccaaaaccttcaagaataatattcaaggagatgttactcaaattgcatattcatccgaacttactccatttggagctccagtttctgctggtgcctctacttctttcaagagaaatattccaaaggcaagaaaatctacaaaagttttaggaatgtgctaa

SEQ ID NO: 763 - DNA, 318 bp, Cryptosporidium hominis
atgtgtactgaagctgaagaaatttccttaaagtttaataatctcgtaacagaattccaacttgcaaagaaagagctagaaatgctccaaacttcttatttaaacaaaagtctggaagaaggaataaaacttgtagaaaaaagtattcaaaaactttcccaagagtctaagggcattaccaaagaattgagatgttatgctgaaattacttctactccagaaataatcacaatttatataaaaaatatcaggaaagagattttcaaactacagaatactattgagagagaattaaataatcacattcaaacatattaa

SEQ ID NO: 764 - DNA, 1005 bp, Cryptosporidium hominis
atgagaaagatcttctatattttattattaaatctatggtttgcctattcctttgtttttggaaatgatttagactccaaaaaaaactatgttgtagaagtggaggaagatggaattaaaagtgaagaagaaaataataaagaggcagaattggaacaagttaagaatataagcttaaatgatattcaaaaagaaagtaattttgaattattaaataatgaaaagttatatttagaattggttaaaaaagagactgatcaattaattgagtcatcactttcagaaattggaagcttaaaaatgtcgttagatcttacaaataagactcatatacaagatttagagtctgattttaatgagaaatatctggcatataaggatgaagtaggtccaatattaaaaaaatctgccttaaataagaaaggatggttttccaatatagatataaaagttcaagaaaaattaaaggatttgtttcttcaagatgatgagacaagtaataaaaagatcttgaagaacactccattaaattatgtaaatggtatagacgttaataagtggtattcattgctcgattcaattaatatatttgcaatttcaatgttaagtagtggtttttccaataagaaacagaaacaaaaatttcataaaaaagaactacaggaactcgttgaaaagattaataaaattctgtctttgatttctactatcacttctagttcttcttgtagacaaatagcatggggactagttattatagaaggccaaaatatttcaattttgaatggaatatctaggaaactcattaaaagatctcaaaactctatttcactcttaaaaagtaaaaatgaatctattattaaagaacataatgcgatagtttcaaagaaaatcgagctagatctaaatctgaaaggtttattggacgttattattaaagctagatctgatgaacttaattctattattactgtagaagatatttctcaagatattcaagcttga

SEQ ID NO: 765 - DNA, 492 bp, Cryptosporidium hominis
atgaaaattttgttaattgaacttcctagcttatcattatcttctaaagaaatagatttgacagaattagtgattgcaagggacgttttagaaatttcagcattggtttctgttaggaaaaaagacttatttggatttgaaagagattttttgaatttacagagatactatattgattatgaatcggttagttttcaaaatttccctaattattaccatttattcctattcaatttttcttacagatacttgcaaaatccgaaaaccaagatattatcaaaggtttgtacttactatatcttctcagttgtgataaaatcagtgattttcacattgctctggaaattattcctccgaatgaccaagaaaacaagtttatttctttttcaaaaaaacttgaattgtatcttcttgatggtaattatagtaaaatcatgcaaatgcaaagcacactaccaactccagactatcaaatcttctttaaagagctga

SEQ ID NO: 766 - DNA, 1560 bp, Cryptosporidium hominis
atgtcgagagatcagatgacatatagagaatactatgatatgccacgttcagttccatacggaatacctgaaggatatagaaatgactactatcacatgaggatgcgtagggactttgaaggtgggtatccacctgattatgggtataatatggatgggagacactatccagaagattattactcatatcctggccaaagatttgaacatcacggtgggactatggaaggtataagagaatcaaagttttcaaatggaagtgataaatgggacagatcaaatggagaaagaagaaatataggaaatgatttaattcaaaatttacatgtggaaacacacagaagagatcccggtattatttcaagggaaaatgatataagaaagcagattagacttgaagagggaccaggaggtccgcctcaacagagtgttccaagctctcaagtgggtaaattaagtatgcaagaggttgaatcaggggttagaataagtaaagggcataaagatgggagtggtggattatctgttttccatacaactgggaaagactcgatttggacaaaaattgatatcttaaacaagaaaaagctctgttatgattgccagaaagaaaagtggagggacaaaattactccattatgtaaggagtgctataaatcactctcaaattcctcaggcggtaacagctctaagaaagaatgtacctactgtagaattgagttccttcagcataggattttgaagaaagctttcaaagtgtttaacaaggagatttgtatggattgttgtaagaatctttgtaaatataacacaattccagtacgttgccacttttgtgactgttggtcagcttggaactcccatctattatgtgatagatgctcctcttcaagagaacaatttggtgagcctcttccatgcgatatgtgtaggaaaagttgtgcttttgataggggagaggaggccaggaaaaagcttgatggaagactgttttgtttcctatgcacatttaaatataagaagctaaaacatgaagaggtgaaaaaaaccaattctgaatacaagagagccgagaagactcttactaaggttgatttaccagaaatagaatcaaaaaatgaacaaaatgatgacaaaaattgctttccgaatttgtcatcaacatcagattcaaacagcaaagagaatgtagactggaagattattgctcaggaaagaacaatcttgtatgaaaaggcaaaacaacatcttgctgagcttcaagcaaaagaacttagcaacaaaattgaaactgggtcattaattactcagcttaaagaatcgaactcaaatctcgaaaagaaaaacaagcttctagaagataagattcttcgacttaatgctgaacttaatgattggcaacttaaacttaataatatttgcgatgaaaagaataagcaacttaagctaattaaggatgaaaaaagacaagcaattcaggaaatggaagggttacttgagaagctaaagtctgaaaatagagagttaatggaacagctcaactcatcctctaatttgtag

SEQ ID NO: 767 - DNA, 495 bp, Cryptosporidium hominis
atgtacttagaaaaggagaaccttcatctattaaatggttctttcttcagagttaattttaaagcaatttctcaaggggaattgaaaaatatactaaaagcatgcggattaaaatcatcaacaaatacttcaagtaatcaacaaatagctttattggaaggaataaggcggtatcttttaactgaagatctttcagagcttacagatctatcgaatcctaataataaaagtattgaatctaaaagatacacttttgattataagaatattattaatgaagatactatttccttggaactcattctaaagtctctaaggagatctccccttactcttgaaaagattatgatgagcaattctgtaagtgtttctgaaatcgcagaatgctgttctagttacctaaatactccaaaaagtgttttttcaaacaagataattttggacaagatccagttagttcttgcttctttaaaaataaaaaatatagttagctaa

SEQ ID NO: 768 - DNA, 288 bp, Cryptosporidium hominis
atgtgtagagattccagacaaaaagcaggaggtccaagatctttgagagcttctttgaatgatgaaaagtcttttttcgaaaacaactcaaaactcaagtcttatcagtctcgatgtggaacttacaacttaataaatattctccaaaaggagtttctggatcacatccttaagttgcttccacagattaagaaccattcaaaaaagcttatagatcttaaacaaatggagctaattaattatggtgatttttctcaatctgatataatggatgaaataggtaagtaa

SEQ ID NO: 769 - DNA, 237 bp, Cryptosporidium hominis
atggattctctgatacctattataaacgaacttcatgatattctgactattttaaaagagggctcaggaggctccaatgtttcaaatgaattaaacttagacctacctgaaatagcagtagtaggctctcaatcagtagggaaaacttcacttttggaatacattataggtaagtttccgacaaattatattaaattgatagtaattcttatgattactattttcgttgttgattaa

SEQ ID NO: 770 - DNA, 549 bp, Cryptosporidium hominis
atgggtttggcactatcgagaatatggaatagattgttcgggaagaaggaaatgagaattctaatggttggattagatgctgcagggaaaacaaccattttatataaacttaaattaggagaagtagtaactacaatcccaactattggattcaatgtcgaaactgttgaatataaaaatatatctttcactgtttgggatgttggtggtcaagacaaaattaggcctctttggagacattactatacaaatactgacggaataatatttgtggttgatagtaatgatagagaaagaataaatgattccagggatgagcttatgagaatgctcggagaggatgaacttagagatgctactctcttggttctagcaaacaagcaagaccttcctaatgctatgagtgttacagaagtcactgagaagctacagttaagctctttaagacatagaagttggtttatccagtcaacttgtgccacagcaggtgatggattatacgaaggtcttgattggctcgcaagaaaccttgagaaggccgcttcctaa

SEQ ID NO: 771 - DNA, 348 bp, Cryptosporidium hominis
atgaaggcattcggaaaaatatcaaactcgaacacagaaaaagatgtccttttcgacaagttcataaacaactcaagaaagtatcctggccatattattagatatagccacaatggatcacccttatggatttctgataaaaatatcccctcagagactcctcaaaaatgccctctctgcaattcaaaccgggtttttgaattccaaattcagcctgaggctattgttctaggaaatctcccaaacaaagttgaatttggagtcattgcaatattcacatgttccaaaaactgccgaattgattattatgctccagaatatgttctaattcagaacaatccttattag

SEQ ID NO: 772 - DNA, 882 bp, Cryptosporidium hominis
atgaatgacgttttactaggatacttggaaaaaccaaggacgcccttagttttagattccaggtattttccttcaaaattcgggggaaagcctgcttggcttaaccctcaaaaccttcctcagtatagagatttacaatgcaatagttgcggaacaagaatgagatttttgttgcaggtttatgcgcctcaggatgacagagaagatttatttcatagaagtatctttttatttatttgtacaaattgtacttgtagtgttcaggcattccgttgccagcttcctcgaatgaatgactattatgattataatccagccccaacctcttttctatttgaagatgttaacccagaggagactattttagagcttaaagaattgaaattcaataatatttgcaatacttgcgggttacctttatctaccgagtctaaatgtcaacaatctaatactcatgataagtgtaatgcaatcgattctggagctagtaaagtaattttagatgagtttagtttagatattgaaatatgctcaactgacgaggaagatgaagatgatgatcaagaagaagctcaagacgataactttgaaaatgatcccgacgaagagatgacacccataaccggtgaaaatgatttgggtcttgaagaattacctgatcaacttgacaacattaataataaaccttacaatatgttagaaagagaacaaaggattaattgtgagaagaaacattttgaaagtgttaataaacaaaatatagatcccaaatcatcagaatacaagctttttaaaaactataaggaaaaattttctgaaaatattggtaagttctacgacctatctaatcaacactctaacaatactttactttctctttag

SEQ ID NO: 773 - DNA, 2481 bp, Cryptosporidium hominis
atggactctacagcagaagtttattctttaccccaactacaagacaggataaagagggatccaggggcttatttatcagattttgagctacaattacaacatttttattcaacattggatgtatttagattaaatccgcaaaatattcctaaagaaatatttcagttaatgatatttattgctcagacttgcccatattactataaatatggagtatgtaacaagtttattgagaaacttcttgatgaattaaagaataactctagtttaatgacttcagatatgcgagtttcaatggcaacttcattaattttactttcaaatcaaaaaattattgacattgtatatttattgcctttatggtttgatttaatgcgtcttcctgataaaattttgagatcaaagttattgaagcatatagtttcaagtatagtcaatgctaatatcaagaaaactggtaagaaaacgagtgcaaagaacaggtcaaaaagtatattaaagagtaaacaaattggtacatcattctcaatttcagaaacaacatttagttactttgccgaaactgggaatgataacaccccagatcaagctctgaaacaattaaaaagttataatatatctataggatatgacttgaaaaaatttaattctacggttatgtcatttttaagagaaagaattgcagatccaaaagatgttttacgttcaatggctattattattgatgtttataggcaacatgtttggaatgatgcccaagctgtgaatattatagccaaatgttgtgtgggttcaacttcaccaaaagtagcttcaactgcagcgagatttcttttgggaaggaattgttcaatggaagaattggaaaatgatatagaagatgaagatgaaaagagagaattggcagcagaagcagcaaaagctatgaaatctgctttactcggaatcagttctaatagtaaaaagaagaaaatggaaaaggctaagcaagcaatgaagaaattggaaaaacaaaaaaagaataagactgaaaacaactctttaattaaaagtaaccaatgtattgatttaatacattgtccacaagaatttgcagaagaattatttcatagagttgcttcacatactgatccttttgaggttagaatgacacttattggtcttatttctcgtttaaatgaacgtcatcggcggatttcttatcaatactattcatatcttggcagatatttatctccaaataataaaaatgttacaaatgttttggcttttttagcacaagcctgtcacgaattaatacctccacaagaactttcttcaactatcaagttacttatggataattttgttaatgaatgttgtaggccagaagttattgtggttggcttgaatactattcgagaaatttgtcagagagtacctttggttatggataaggataagctcttggatttggctaactttagaaagatgaataataaaggagtatcaatcgcagctaagagtttggttaatctctatagggaaattatgccaagtatgcttcatcgttctttgatgagcaaggatgctgcaatgaatatgaaggatgagaatcaagatgaaaatagttttgcttatggttataaaaagattgatcaaactatttctggagctgatttgcttattaagtataataataggaagaataaatcaaagaaagatactgagcctgaatcttgtcaatctgttaaagatcatgattaccaagtggatgaagatagcgatcatgaccatgatgaagattatatagatgatattgatcttgaagaaattgatgaattaagtcaagttgatatggaagaactcgcctcttctaatgaagatgattttgaggaccctgatgaatcagatatcggctctgatattgaagattctacttcaattaaagtttccaagtcttcagaaaatataatggatagtaataatatagtttttgataagattttagatcaggatgacttcaaattgattaagaaacttaaaacaagagtagaagcagcaaaggctgttggagcatctaaaggtccgaaaaatgaacagttagacttttctacagcatcatcagatgaaggttttggttcaggaattagtgaagaggataatacttcagatagtgaaagtgaaaatgattcagactctaatgattctacagattatgatattagtagagatattagagatgagattactcgtaacatgggtagaaagaagttgagtaaacagcaaagggttcagtctattatgaagggaaggcaggacagagaaacatttaaagaaaggagaattagaggtaagtttttgttgattcttatggtccaattgttttgttttttttgtgcatgtggttcagttatttataaggaattcagagaagaatttaaagcaaatggtctttatttctttctttctttttcctcctccaaacaattgagtggataa

SEQ ID NO: 774 - DNA, 447 bp, Cryptosporidium hominis
atgaaaattcttttctttatcatacagatttacacaaatatagtgattgttgtatatattggtatattaaaactgctttcaacctttaaaagaattaagaaaatacaccaagggtttattaatcccagattcttagtcaaagttttggagtggatttcaaacgcatgttgttacaatatttattcgtataaaaagcaacttcctaataaataccaatggaatttgctaattaaatgtgctgtgtatgattcaattattacttgccttaattcacgttataaatcacttggaattgatgatttctttaaatcttatagaataaagtaccaacagtattcctcaatactaaataagaaattcaacatatatccaagaagctcattctcaataattaaagagcattgtcttgaccttccaaaattgtatagaataaagaaaaaaggctga

SEQ ID NO: 775 - DNA, 4407 bp, Cryptosporidium hominis
atgagtgtgttgaagggtgctttagcagtgttgatgaagcaagaggttctgacgctgggagagtacctggagcagaaaagaaagattagagtattcaaagaagaaggattgtacaatgattctttaggggagttaaggaggctacttgaaaagactttgatactagaagatccttttatgccaaaagctttaaaagagggatttcttgggctaagggaacttacatttaattccttagacaatagtcttgatattaacggagacaggaggaagttgtttggtataaatatcgaaaaattgctcgagtggtcatcgatactaggtcagaactactttagctcacctagaaatcagtcgtctatgtcttcaggaaagaggtcaagaaataatgaatataatgagacattgcctccttcctttatcacagaccaaattaagaatataattccagattctgaaaaggattctccgacttatcaagtacaagactttgagctcctactccgtaagcactttccaaggattaggatctttcattcagggagttattcaggattaagaactagcttcgacactataaagcacaagaaatactcattctgtaattctacttcatacaagtttcaaaacctccatgcttggaatactcttctttccaaaataggtcctattgagattctcttcttatttgtttgctgtattatctttagaatacttggtgatcactctgaaattctcattcaacaggctggtagaatgttaactaatgacttcctggaagagcttgctagactttatgagacagggccaaaaaagaccaattcatttgtatcatcatcttctttaactccaattcttacaattgaggaaaaagaagaagttaagcctttagatgaaactccaagacaagtaaacaaaagatcaggaggaattattaaagactcaagactttctaaaatctacaaaattgatattccatatcgctcaacatttctttattgtgatcatttctcaaaaagaggaggtcttccttgtttatctgttctaagacttttacctccaaatttattaggagcaagaacactacttagatttattattcaaactgatcatatattcaaggatcacaacagacaaagtttgattggattacttggaagttatgaaatgacaaaattctcccgtgttaaatgcaaattggcttctgctatgatggaagaattccaaaatttattgttaaatattagaaatacgtctccagttgactttctaggtcaaatatgtccaatagaaccaattagagattcagatttacaaaacttcaataaattacctattccttgttttgaaacaagttctactagagtagtaaattttttaagattatacttgattaaagtattaccaaagaatatacttggtacctttaaaaactttaagacttttattaataaaaagatcccaataattgtgaatcttcatattagagaaacttttaagattcaacatgcaatgaatggaattgaggtttcaaattgggtaaatagaatacttgaagaaaaaagttatcaatttattaaagaatcaaaaaatttaatcaattctaatcaaagatctaaaaaggtaccgaataataagacaagatctagtattaaaaaaagtttaattagccttggaaaaacatatctagctaggaatatgtattttttaatagtatatttggtatttccaatattaagaagacatttctatgcaacagaaattgagggtagtaataaagtaagatattttagacatccagtttggataaagatcgtgagacaagctgataaatggtatctagaaagtatattaaaaggaattcagtcaaaagactatataatgaatttatcttcaattcaagaaatttcaaaattaattgataagaattctgagttttctgaaaatatcccaaaaataagatggataccgaaatctaaaggtttaagaccattaataaatttatcgaaagttggatctggacaaattcttcaacaaaatcttgaaagagatcacacttgtgaagaaaagaagaagattggtttttgtgattgtaattcagtttggactggtggagaccttccaacaagttggattaataacaattactattataactactataatagtaatggtaataacggtaccgtaggaaataatcataattatggtcatattaataatataggagggaagaattttacatcattttcgagccaaaattgtcagattatgacaccaccaggaagattaggagtgggattaggatttggtaattataatataggaattggaataaattcaggatcatcggtacctactactccaataaataaggtaatgagacgtccttcaagtaataggattatagatataagacgtccatcaacaaataatatgttgttttatccttctaagattttaagatcttttctattaagaatgacaggaaagaatcatcttggtgcttctcttgtacagtttggagatatttataagattataaagaattggtggataaagaataggagagacaaacaacaatttcaaatgaatgaagatttttatcaaaatcaaggtaaaaaaatgtctcatgtaaagatttatattattaaagcagatttagtgaactgttttgaaaatataaataagtccaagatttttgagtttttggatgtaatttctcttccaaatgaaatttcccttttgagcttatattcaagggctttaagtaaaacaacaattattccgccttttgataatatgaatagagactcttaccaagatgagcttgggagatcatgtattattacttcaaaaggaaaactaaatatggtacctatttttgagaaagatcatgatgaagatcacaaagtcgtcaaatcaaaaattaagaggattataggaccagatttagatgaacttctttggaatcttaaaaattcttgtttatcaaacaaggatttgagtattttgggacaaaaaaaagcggaaatctttacttttttaaattcaagacgtgtgataaactggaaattagtcaaggagatcattaagatccaccttaacacaagcttttttcgacttaggacatgttcaaagtctttaagactaataaaatctaaacaacttggaaattctatcaaatttggaaaaagatttctaagcttattcaagcaagattttggaattccacaaggatcaagtatttcttacattctttgttgtctctattataatttcttggatctaaatccagaaattcagaatcttttgggacaatcatttttttcctcttcttgcatttctttatcatttctgaatccaattaaacaagaaaaagcacaagtacttgatccaactaaaaaagatttattttcacaacatgatcttgagacaggattatcccgttacccagaatttaaagaaaatgagataaatatctataatactagtacaagtaaaaaaagaagactagaaatatcagaatataatattaatgctaaaagtgttttactgcaaccttccgaagagtttgataataatatcaacaaccagaattgccaaatccgtgtcaatctcaaaaattatgatcaagaaagtccttctcagagcaataagcaagaaagtctcttattgagatgggtagacgattttctttttctcacatccgatttggagtccgccaaaaagttcttaaagttactttatatacaaaaactatggggatcgaacgtttccaaggacaagatcaactctaattttccttggattgaccacaataatgagatcatcatctttgaggaggatgatgttttactatcttcgccttcctcttcctgttcatcatcttgttcctcatcatcttcctcgtcttcctcatcgtcttcttccttccccccttcgacagagtgcctaagcagtccagtggaagagagaacaaacaccagcaaaggtgaaaaggactgccaaaatgaaaaagaaatgattaacaaggctaagatagccttaaaacagttccataaacaagtatcgtggacaggaatgaagttttccagtgagtataactatttgaattgcatggtttccccatggaagaatctggaattcatatgtgttatggatactgtaaccttgacaactaagcaccaatttacaagtaattattcaaattttcacaggtttaagtcgatgacgatatctgaaaaccttcaaaagtcaaattatatgtggtctgttttgggtataaaattaataagatactttgattttagaatcaagaatggattgctatatgattgtaaaatcaattctttatttacggtaagttttaaatataattcaacaaataaacaaccaattaattaa

SEQ ID NO: 776 - DNA, 1149 bp, Cryptosporidium hominis
atgggaaattcagttccctcatcttcatcatcagtatcatcagaaacagttaatacgaataggaacggggctgaaaatatgagtagtccaataggaataaagaattttgggaacacgtgttatatgaatgctgggttacagtttatatcagcaatgggaatctttacggaagagaattttggagggatgaaacttaataagagctcctcagaggaggtttgtaggtcattaatatcaattttaattcagttaggaaaaccaagtagaatcacagatgcaatttctccatatcaactttttaagcaacttagacaacagaactctgatctttttaaccagcatcaacaagatgcacatgaatttattatgtatattttggaaataatccatgatgggactattaaaccatgtaatactccaaagctgtcaaacgaagatcttgagaaattgagcaaaaaatcaactcgaccaggaaatgttttttggaataaccatatgatgagaaataattcgattttgaataatacaatatgtggacagttcagaagtagaataacttgtgagaattgtggaaataatagtgatacttttgatcctttttgggatataacattggctcttcctgaagtttcagatgattatgagaagatttcaattgggtcttgctttagaaagttttttgagcaacagaatctttttcacgaaaatgatgaaccaaattacaattgttcccattgtaagagtgttgtaaacgcaacaagatgtataaatatttcgcagttcccaaatgtattgcttgtaactttaaagaggtttaataacaacggagaaaaatgtaatgggattgtttcctttaaaacagcaggaataatactcaaatctcttacagagattggccacttcaagttagtagcagtgcttcaacacaatggaagtactcttttccaaggccattatatctcctatgttttcaaaaaggagttcaacggatggtttaaatttgatgatgatatagtcactttagtagacgatattctcgaggaggatattcaggcttactgccttctttatgttctcgagtcaaagagcgctttgaactccaactctgaacaagcttattctgtgggcataaggaatcagagaaattag

SEQ ID NO: 777 - DNA, 2175 bp, Cryptosporidium hominis
atggtagatgaaggctcaaactcttctttatctccatcttctaattcggaaattacaaaaatctccaatgaataccatgaccatggcagtggtaagaagagaagaacatttagcaggggtagattcagaaagccaggaaggcatggaagccataaaccagatgtaaccggactttcagcaccaggagttccggggggtagtgaaccagcatcagtaatttcagaactaggtgcaggaaactccaaaggaagcaagtctgaaccaaagaataatcgaaatcttgggggaagaaaagatttcagcaagtacaggaacaagaaggttgacccaaaaaaaggcagttccaatgcaaaagaaggggtaggatctgaattcagtaaaaatggccgaggtaatttcgtaatgacaaagccaaaatacagttggaggaatgaattttccagacttagtaagctttatggggctaatgttattgcagaggagttggtttgcgatgaagatgaaaataacaagccaactgaagagagaaagaacaatgaagttgatgattctttcagaaaaacctcaataaagttgtcttgcaaatatcagccaagcgatccagatttccctttctcaaagctgagtgaatataatatgcaagattccaagacagaatcttcttcccctgaaaaattttcaattttaatacatataaccattccatcaggatatccaaaagaaaatatcgaccaagttgtttttgatactccagaatatcagtatgtgagttccaagtttaacgaagcttttcaggaatgtatttcaaaatcttccttgactttaaatccaatttatgaagctcttaaggcatttgataggaatttttcagaattagttttaaatggacttccttcaatagaatctattaatgaatttattcttttgaactggactcctggggagcaaaagcttctagaagaggcaatttgctattacaagtatacaaaggatgtgaacaagaagtggattgagattgccaatcatgttggtaatgggaagactgttaaacagtgcattgataggtataagtattgtaggtctttagtggtcaataaagaatcagagaaaaaaaccagaatgggggaggaaagtgatgcacaatacgccgccaatgaatcaaaagttgaggatggacttctatattcagaaaaggatggtttcgataaaacaccagtgggagaattgagcagattaaatttgatgaattatgagaatttgctcattaatggtttggaaattttttctatcgatttaattttgatcgcaattctgaggcttcaaatttattgctcaagatgtaatgaggtgaatgattataaaccaataagtattccaagtaaccatgatttgactttaaataaccaagacgaagcaagggaattgactttcttggataatttggtgttaggtaactcacaaaactgtaagaaatgtggtttaaaacattccatacacttttcaccactaatatgccattctaatgatataaaaattggaaagatcgaattttctgaatgctcattgagagatattttaccttcagatattcttgtttcatgctcaaactgcagcaattttctgaagattagagagttctttgtggggaagcagtattcagtgagctgtaggaattgttttaaagaactgaaaattaaggcagatggtttaattgttgggaatgaaatattcaacgttgacaaaagcacagattttttgcttgctgaattgaataatatgaaaaagttcaaaaaaaagattaataaggattcaaagcttcccacagctgttggaacccctcttccttcaaatggaacttgctcacattataagaaatccaatcgttggaacagatttccctgctgtaataaagcttatccgtgccatgagtgtcatgataaggataatcctgatcataagtttgaatgggcaaaacaaatgatttgtggattttgtagtagagaacagggattctctgaaaattgtaaatattgccgtgcaaatctgacaggtaaatcaggtaatgcatctggaagattctgggagggaggtaaagggtgtaggaatcctcttactttgagtaatcgtgatagcagaaaacgaaagctgatttctcgacaactcaaaaagacttga

SEQ ID NO: 778 - DNA, 1062 bp, Cryptosporidium hominis
atgcatgcaaagctcaaaagtagtcagatttggttattcacattgctaatcgtagtaatagtttgtgaaattaggtgtaaagtgaattttttggatttttttgaaaattttgtgcaagagttaagaaaagatatattaattactgaccgatgtactactaaaaaagaagaagaattaaaatgttattggataattctagaaagtgagttaattcatttattaaaagcagctaagagtgtaagtaatggtatatttggctttaatggtagaactaagaatattatattcttaagaaaattaatagatttaattaataaaaatacaaaatcaaaaataagagaaaaatttatagcatatcaaagttatccatatttgaatagcacaataattagtaactatgacattaaatggtataatcagtatgagcttgaagatattgagaggattgtaaatcaactttcaaaaattaatctaggtgattatggtataatgaaatttggaaatgaaaacagtaaatttgaaaacaattcaaaaaatcttactattaagttagttattttgtctattttttataaacaatattcaattgatcaattagcctacagaaaaatagctgaaaatacagatactgtaaataattatattcaacatttatcaaaatctgttagaacagaaattaaactgatagatgaagatattgaaaatttaatgaaaaacttagaagtttctatgggaaataagaaaaaaagtttgtcaagaaaaattgaatttatcttggaaaatatacaatcaaaattaacatcttatattgagaaaataaacaattcatttgataacataagaaaaaagttatattctcgtatcctagaatattacttattggtaatagtacttgcaaaattgttctttattttttcaagaaagatactatcaatgattctactattaaatcacatactaatatacatattggataattttgaagattatacattcatgctaataagtctacaattcggatttgaaatggttttcgcgtttattcaagaaatattacattga

SEQ ID NO: 779 - DNA, 1980 bp, Cryptosporidium hominis
atgaaattcatcaaatgttcaaaagggcagaagagagtgttattaatgataattttattactaatttcgtactacatttatattggaggctttacttatagcaaaagtaataattccagatatgtaggaagatatatacaagcttatagtaagtgcttacacggatattttcgaattcattggttggaaatacccaaactggcttttaaattaacaaatttacttccatttgtcaaacgaggaagcattcagaaactttttgattggggaaatctcactagattgaataatgaggatttattatctaccaaacaaaacaagagctgtaaataccttattatgcttttaaacccatgggacttaccaattgattgcatttctgaggaatttttggaggagaaatttaatggtagtagcagcaaatcatccacatttataatggagcataatctgaatgataatccatggaggaaagaactctatagaagcatttcggaaaggacaagtaatactaatttttttgaagatcatataactctggcaatgctcgtagaagatttagaaaacgaattgtcgagtttaattataggggaaggctttctaaaagaaacgggagaggattatctaaatagattattggatatatcactagacttggagtttagtgatggagagtgtaagagaactgtcaatattaagaggctttgggaatttggccgtctatataacgaattaaataaaaacagtgaatcttctaaagctggagagtccaaatactatagagaatttttggcttttgtttattatagatgcatttacggtgcagaaggctctaatatatctaaaaatctagaaaagaatacaaacactgaacatctttttattaagcttggaattagagataaaactgatttaaataaaggctcattctttgatgtggttgcctgttatcaattaattcctatcattggaattgaagataatgagttagtttctcttggaaatctatgtggatgggagtttgagaaaaaaaatttctactctcaaaatgacattgatcaggaaaaaatacaccttataagacaacacatagtccaaatcgatgagatttattcaaagttagatattattcggctgaacaacaagtataatcagaatctaactaaagaaaatgaaatggaagactttcagacaagctattttaaccaaataatacttttgttgaagaagactactaggcaaataatgattcaatatacctttgtgtctgaagaaatcggcaactttattaattcttcaaggaaatttgatcaaagttttgaagccaaatccccaaaaagccctagtgtctatcctattataccaactactgatctcaaaaataatatttccaatcattacaataaacaaatttcagattctatcaactggaaacaactcatatcaagtatagttgacaacacacaaaacatcctggtgagggaacacatcaacacaatgttaatcaatttcctattcgatgcaattattaacatgctgaatccctggataagcttattctatcaggcaagttttatcattaattcttatctgagcattatatcttttctattggttatagtagcgatcctggtatgctttaacacaattccatgcttcagaaatgaaaaagatgagaaaaagtcacaaagtatttggtcaaaagttttgagaatttacaaggctaatgtaattgtgatattattgaatgcaattcttattttgggcgggctgattaggtatttatatttgcctaatgaaattgagcttttaaacacaaatatagcaataataaaagcagtcaataaggtatttaatattgtactctgtccatgtgtggtgaatataataacatcattttctacagttttttcaatttttcagtggcaattaatatggatgagcagaaaactctcgttttcgagcttaattaatttataa

SEQ ID NO: 780 - DNA, 3819 bp, Cryptosporidium hominis
atggaatcatcaaagtacaagctattagagacaggattttggaatgaaatgccatcaaaaatgaagatagaatcaccaaaatcccaagaaattagtggagtaaaacaaacaagtgttgagacaatgcatccaataatagggcaggatcaatggacaaatggtatggaatgcctaataagttcagaaggaaaagatggaaactcaattgattcaaaagatttagatgatagcgaaagattagttgttggtggagtaattgaacaaaataagaacgaaataataggaggattgggtttggaatcttcggtaatttcaatgaataatggttttggtggaggtaataatgatccattaaaaagctcggatgatttaagcataggattgtccccaaagaggtcaaaatgcatgttgaatgatgatttagagttggagacagcaatagctacaaatggtaatggggttgcaggaggttcatgttcagcagtagggaaatcttccctaaagtggaatggcggagggacaggtagtaataatggtggaatagtgacaccatgttcaggccaagataacagccatatagtgactccaccacctccaatgaaccattcttatcgacaacttggaagtatgaatgcttcaacaatatcaacaactccaactagaagtattcaccacagtgcgggggtagatgttgacttagatttggatgttgaaatagatgaagaggagatagttgatgatgaggtagatttaaataaccaagatgaacctaatgttggtttgagtggaagctctcgggctaatagcgacgttggaggcggcagtggaaatggaggaagtggcagtgggggatcattgtttagtggaactcagaacggtatattcttcattaagaagaacaatggaggtagtggagttaatagtcaccaccatcatcaccacaatcaaggaggaagcggtggccagacaaagccaagtggaggattaggagtgactcaaacgagcgatcagtataaaagcggatacaaaggtgtatcttggaataaaaggatgcagagttggctggcattttggactgaaggtcaaagacgtagaagtaagacttttaactctaagatatatgggtttgatgtggctaggagcgaagcaatagcatttttgaaggcaaagcaaagcgaattacagagtattggtcagcttccaagtaagaaatcaatgcaatatattcgttcaaacatggatgaattatcatctttaaagagtatgaatggcatgtatttatcaaatatgatttcaggaagaaatttgaatagtattgggaggccaaagtttgggggtattttgaaatcgcagaaaggagatatgctttgtgattatgatgatggacatgaaggagcttctttaagtggaattggagcagtaataggaaacaatgaaactaatgaaggattaatattggataatttgtcaggtacaaatatagtaaacaatgctagtagtggtaataacagcaactgcaataatggtggcaacaacagcggaaacaaagttggaagtaatgttgggaataatggtaatggaggagttagcaacagtattagtaatggaaacggtggtagcaattttattggaattaatagcattaagatgggaggaggaagtaatttggggggagatatcactaatttggggaatatgggccatattcatcctttgatagggaataatgatttaatgagttcattagaaaataaggcactgatcaaccacaagtcattattttcatcatatgggggaggactaggaggtggcgattcgggaatggttagtggcaataatttagtagagaagctgggtctatcaagagtgggcgtgaatgggggtgtaggaactggaggcggatatgtagggatgatatacgatgatactatgaacggaggaggtatgagcggattgggaatcattggaggaggcacaaatgcagcagcagcggcagtagccgcagtggcagcggcttccacaggatcatcttcatcatcttcttcatctcctttaacagtatcaggatcaacgccaggatcatccatagtaacatcaacttctaattcaaattctgtatctaatattgggccaagcacaagcactggaacaggtacgagttcaatttcgacttcaaattcaaattcaaattcaaattcaagttcaaattcaaattcctctacaatacctattttagggggaggaaatggtggatctgcccacaattattattcacttccagactttaaatctatgaatcctacatcatcaattaatttttataactccatgacaggcggagtaggtggaggccatggaattgggatgggaatgggaaacaggataataccaggaatatcaccaggagtgattcatccgaaatcaacagtgggtggtggtggcagcaatgttggaaatgttgttcaaatggagacatatgatgatgcaagtggattaaacaagatagctcagggattatttgttggaggatctagtgtaagtggtagtagcaatccagttggtgtactgggtggaggtcatacaagttcagcagttactggagttggtgggtttgcccagggagctgcaggtggagggcaaggaataatgaatttgactggaggaagtttgatggggaatgtattaatgatgagtggaaatggaacaaacggaggaggagcttctggaaattgtggtggagggggaattggaggaggtttggaagccagtaattctgtatcatcatcaacaactgcaacatctttactacagatggccttgaatacaattaatgataatagtattaagataaataactatttgaacaatggggtacaacagcagcagcaacaacaacaaaaacagcaacaacagcaacaacagcaacaacagcaacagcaacaacaacagcaacagcaacagcaacagcaacaaataaatgggaatggacaattaccaggagtgagatttgaagattcgaagttgaaatctgcggggatggatgaaaccaaacaaatggttttaaatagtacttcaagtaatcatgtcaataatttgaatggttattcaggggtagagttgaactcaggaggagctagcaagggaggagggagtactataattcattcttctggtacaaagcagatatttgatgaacatggcaaaactgtgtcaatgggtgggattgcttcattatcatcttcctcttcctcttcaacttcttctcctgcatcaaattctgttcttccaggtacatcaggtattccaactccttcaactgtggcgtcattgttaccatcattaacatcaccattatcaacatctcaacatcaaaatcttcagcaaaaaaaacagcaaattcaccagaataatcatcagcaatcttcagctatggtatcatcaatttctcctacatctcaatcttctcaattggtatctcagaccccatcttcgtcatcttcatcgtcatcctccactactgctaataataatacttcaaaatcaattatggaaggagataataataatggtggtattagtgacaatactattggaaatgaaggatggtcagatgtatttcagtacaataaattggttagtaattcaatgaattacacaataagtagtttgaatggaggaggaatatgtggaaacaatgataaaggaattggaggaagtataactacatctgagatcaataatactctagggaattcgaatcttttaaatgcagtgagtatatttgacagtaaaatggggggtgagaaagctgaaaaatga

SEQ ID NO: 781 - DNA, 2118 bp, Cryptosporidium hominis
atgattcgaataagacttgttgctctatttatacattctttagtattgctatgtataatttgttacattattacagaatttaaaaatgataatgatcataaaaacaagctcattaaacaaataaatcagcaagttctacttgaaaaagaagatgctaaattaattcaaaacgaagatagtaatcctaatattttttttgaatccgaacagatttttgaaaaaaatgatgaaaatatttttcaaatatttaataatttacctgaaatcattaaatcatttcaagatcatcaaaaaaataacttttcaaaattatgtcaaaattactggaaaaaaggtgtaaaatctttaatttcaaaatacaaaactagttctattattaattcatctaatcattccaaatcattaatattgggcccttcatttcaaattgaagaaatgattaagtacttatcatatactactataaatgatgatattacaatgattaaactacgttttaaatatatttttgatccaataaatcgtaaaatactcgaatttgaaccaattatttcatgtattccagatcaacgtatacctaaagtaagtaaattaaaacaattaaagatcagagatattaatcatactattaaatatatatttaaagcaattcaaaaaattagcatagaagaaaatgaaaacaataacgaaaataactctttaaagtataataatcatataagatatttagatttgctcatacattatgatgattgccctataatctggaaatctatgccatttcatatttacaaaaatgatacacttcatattgaaaaatgcatcttaaattctaaattctccaaacaaatgcaattcctactctcaaacacaacagaaattcaccatgtatttttaaaacctcagcaacaatttaatagtaaatgtaattctctttcaaccttaatctcttataataatgataatagtaataacaatagtaatatgaacatttgtgaagattctacagttaatgtaaccaatcaatcctcaaacttttccttttattcttcttctatatccaaaagttactttctttcttttaactattatcgttatcaaaaccaaaataataattatcaatctataattcaaaatgatgatcagaattatcatcaaaataatggtaccatattttcaagtttaatcaataatcatctcacaacatatacaatatgtgaaataattaacaattttgttaaacaaattatttcaatattatctcgttatcatattccagaaataatgtgttatggaagaataaagtgttatattccttgtttctttcaaaataataattccatatttacatccatttttgataaattaaaaaaaagagatatgtttaaactattcaatcatcttcattgtatttgtcaattcaatcctaaaaactcaccaaattctagtggtcttatactttcaatatcatcaaactcaaactcatgggattttgcttctattccatatgttaatcatcttgataataatgaacttattgcaagatcttttatttcgaatgaatatctaaataataataaagatttatggaatcttaaaaataatactctattctttattggaagatatacagatacatccagacttgatctttcttgtaatatatataatgaaatataccataataattttcataatggaaatatttcaaatcacgtatttatatctgattcaaacaaaatctcttgtgaaaatagagccaatttacttgagaaacttacattatgcgattcaaaattcatttgtagaaaagaatcgatatcttttatagactggatcaacagattaatatctagtaaattctctttagatctatctggagtcggtccttggtctaatagacttagaatgcttatgcttactggtaagttaaatataatttttatttcatccataatatttacttttaaactttctcttaaatttctttcaggaacaatgatcttccaaaatattagatcttattactcacaccaattctatgatcttttattcaagaaaaaccgtctctttttcaaatttaataatatcagtgatatcttattgaatgtaagttag

SEQ ID NO: 782 - DNA, 1803 bp, Cryptosporidium hominis
atgaatgaatcattacatgttagggaaaaaatggaagtaaataaagaagaagatgaaaagaaaaaagtaataaatgaaccaataatgaaggtaaatgagagtcaagaagattctgtgaataagaataagaaaaaattagaatataaaaaattacaaaataagttaaaaaagcaaagaaacaaggaaaaccgaaagaaaagaaagtcagaacaagtggggaatcaatataaggatttgttaaaaacagatgagaaaagattagcgaataatattagtaatagagaagaagaagaggaagaagaagaagaagatatagtttttaaaattcaagaaaatgatgagttgaaaaagatgtttggagaatcttgcaaacttttgattggtttggatcacgaaaacatactagaggaaaaggagaaatatacagatgaaaacattgaagatgacgaaaatagtgaaaataacggaaatagcgaaaatgatgaaaataatgaaagtaaaaagtctgttattacctttcgagatggtaatgaaggaataaatatgaaactattaatggaagaagaagaagaggaaagggaagaaatagaaaaaagaagaaaacgtgaattcttgaaagaaatgaaaaatagaaataatggagtaattggtaaaatgacagttaaagagttaaaagaaaaaacaaatcatccagaattagttgaaatttgggatacaacagctggagatccagaatttcttgtatatttaaaaagttgtctaggatcagtcagaattccacatcattggaattctaaaagaagatatttacaaggaaaaaagggtttagaaagacccccatataaacttccacattttattgaagaaactaagattgctgaaattagagctttattacttgaagaagaaagtaaaatgacaatgaaacaaaaacaaagaagaaagatacgaccaaaacttaatagaatggatattgactatcaagttttgcatgatgctttcttcatatattcaactaaaccacatttaacacaatttggagatttatattatgaaggaaaagaatttgaattcaaatttaaaaatatacgtcctggaaaactttcacaacgtcttaaagatgctttaggaatgcaacctaattggcctcctccatggttggttagaatgcaaaagtatgggcctcccccttcatatccttatttaagagtacctggtgttaattctcaaattcctaatggttgtgaatttggatttagaccaggtgaatgggggaaacctcctcttgatgatcatggaaaacctatttggggtctattaccaccaattgaggatgatgattctaataattcaaaaaataccaataatttatattcttccacttttgattattggggagaagttgaatatgaccaatttgatgatattgaaaagtctgatgataatcaacaagttgaagttaaagaaaaacaaaatcattctacaaacattcttactaaaaatacaagtgttaatattactaatgaaatttcaaatatttcaagaactaataacactggtaactattcacaattggttgaaaatcatactgaagaaaataacaatacttcaatttttgttacttctaatcctttcttattcactcaaaatcaaaccattattagagataatcacaaaattggtaatgatagtcaagctgatcaatctcaaaaacaaccattatacacaatacttgaaagaaatgaaataaaaatggataataattccatctttccatcatcatatacctataattataaatag

SEQ ID NO: 783 - DNA, 912 bp, Cryptosporidium hominis
atgtttttacgtattcccttatttattcttgcattcattggtatatttaatagtaattcttcttttattaaaagtccgtacaaaaattatgagtttaaatacgtccaatattttgaaagtttctcattcttgaaaattaaagcttcagctcctacctcgaatttttgtaaaaactgtggttccagaacattcagagtaggctgtctctgttcttctatcgggaatcatagagaaagaccaggtcccagcaatctactggaagatagttgttccgcaagaagagactccaattctagaaaagattctaaatctagaaaagattccaaatctagaagagactccaaatctagaactacttctagatccagaagtggctccagatctagaagtggctctagatctagaagtcaatctcctaaagattccaaggaacagattactagtactactactcaacatccattatctaaaattaaagatcctgccgtgaaattacgattgaaatccgaaaaaactgtcgagatccagaattttaagagcgttattgctgatattaaagcttctattgatgatctactttcaatccttatccttgaatgtcctttattatttacccttcaattctcggcattaagtgttgaagaattgaaggaagaacttatagaagtattgactagttttgcaggcttgaaattccttagacagacacatgtaccgtttttaataactaaagaagaactggataaattacaaggtaaaaataacttaacaattgagaggcttgaggaaatgcttgaattatgcttaacaacatcccatagaataattgacaaccttgcatccatttttgataagaaagcaaagattaaagaattaaaacaagaaattcaaattttaatgaacttaaattga

SEQ ID NO: 784 - DNA, 1419 bp, Cryptosporidium hominis
atgatgaaattattacttttggtgttctttataatatatcagtttttttttaattcatttttttctaatagggtttgtttatttgaaacctttaaattaatagaagaaaaaagaaattctcaatttataggaatttctatactgaaacttcaagcaaatgctccttcgcctaatagaaataaaatttgcaattgtgattccagctctgattcggattctgctgattttacatgtaatattcatagacattcacatttaagctctccaaatacaagtgaaactggcagagatagtagcagagataacagcagaaataacagtagatccagttccaattctagttacagatctagaagtaataacttaggtgaaagccgagctgcaagcaatgataaaaataatcgtagagaaagttccttaaacgctgcccatcattctttaggaatagtgggatttcattttcgaaattactcgcccaagccttctaactttgaggaaagaggaagaagtagaactagaaatagaagaaccactactaggggaagtagcagtagagacaaaggtacaagtaaaaataaaactagcaggaacacaagtagaagtgcaagtaggaataggagtggaagtagaaatgcaaccaggtttaggagtaaaagtcgaaatgtaagcagaagtacaagtagaaacagggatagaagtacgagtagaaacagggataggagtacgagtagaaatgtaagcaggagtacaagtagaaacaggggcaggagcaagaatgtgagcagaaataggactaggagcaggactaggagcaggactgggggcagggccagaagtaggggtaggagtaggggtagaagtaggagctacaataaaaactctaacagtactagtggtggcgaaagccctagtactagtgcttattctcatgaagaaaaccaacaggaagaacaagcgccatcagagtcgttacttagccaccttgagctatcagaagaacaaaaattgtcttcgattgaagccagaatctccattattagaagttacaaagaatcttgtttagatattaagtcttcaaaccaacatttattctctgcatttgttagagattgtcgactattcttatctgaaagcttttctaatttacttgattcggagctttcggaacttttattagaattatggtcagatttggctaacagcaaatcctcaaataacgaaattattcctgaaattttgagtatcacggaagttttatcaaggaatgtcattgctgggttatctttggaagaactggaagaaaagcgtaaacattgcaaacaaattgtaactatgcttctaaataatgcagaaacctatattgaatcaaagctgaaaatcggacaactcagaaaagaaataaagtatctgagtaaataa

SEQ ID NO: 785 - DNA, 1587 bp, Cryptosporidium hominis
atgtttgtagattcaacaaaaacaagaaacaggaactcatgtagtagagatatactaaatggaggaggggttgttccattagatgacgataatgtgttttggatgaaaatagaggatgaatattttggcaaaattgatgatagaatgaaagatattttgaaattccatattcattcatccgaatatattctgaacataataaatgataattttttaagtcattatcaagaaaaagaacagagtaattttgttaaaacgagcatgactttaatggaaggacttaaaggttggaatcgggttcctagggagataaatggagaaggatttgggttatttgaaaataatggagaattacagaatatattggatggatacattcaagatcctctaaaagaggagcagaataaattattggattttgaggataaagataaagaaatttgtgatgagaaaaggataaagagtataagtttaactttgagtattccgccattaaccaagccaacagattttccaagagaattaattcattgtaggagtttgagagatattttatataatttagtaaaaatacaatgtgcatataaatatacacgtttaaataatagtagaaatttatacagtatattagatataaaggaaagccttgatattcaagacaatagtttaaatggtacatgcaattatatttgcctatttcctgatataatatctggtccaagcgttgagtggaggaataatttaagtgaattagacaaagagaagcttatttttaaggatgagaattattataattataatgatacatcagatgaatggatttttaatattaataataggattgaaaatatgaaacttagaagaagcctattagatactaatcatttacttccttataattattataaaagtgaattgaaagaagaaaaagatgagaatatgatattaaatgataatatgtcaaaacaagagggtaataataaaattaagagtattcttggaacaggagaaggtttgaaagagaataattacgagtattttagaatggaccctaaagatttagttccagtagttgacttagaagacaatttatatgaggaaagcattagtacagtaagtaagataaagagagccaaaagttttggtgatttctttcaagaaaatatacatatttccccaaataaacggctagatgaatataatctggaaataatggatgatttagagaacttgaataaattatcagaaaaaaataaatcaggatacttgaacctttcttcaataatggattcaaataagagaatagattttcaaattggtaatacgttaaataacagctattatattttacaagatatatgccaaaatagtttgaatgaatataataataatggagagtttgaccaaagatacttgaatagagaaaaagacaaggaattaagtgaagtatcaatttctttaatcaaaagacttagatatatttcaagtttaaaattaggtatttttcgtgaaatattatttagagtagaaaatgagcgtcaaccaaatccaaattattggtataggaaagaatatgagctaaaatga

SEQ ID NO: 786 - DNA, 531 bp, Cryptosporidium hominis
atgtttggtaatatatttacattaccaaatatagtcagacaaacatttttagcagatttgagagatgatacacgtactgtaatatttttaacaagactactttcaagatctaatactattaatggtattcaaggattaaaaaatcaagatgaaattattccattaagtggtgatggatgtttatcaatacaaaagattaattcagatcataataactctaaatctggggatgacaatcatccaccaatttctgaagaaaacctaatagttttaaatgggtttgcaaagtttcatttatatatgccggaattggtttatgtacaatcaattgatacagtattatcaagattagctacgccttggtcaggagatataattttttggcaaaaagtaatggcagaaaatgcttttgcttcatttggaatatcagatttgagtcatattaatagttataaatatttggataattctagaataattatagccagtatatttgggattatggagatattattaaatagaatgggctaa

SEQ ID NO: 787 - DNA, 1221 bp, Cryptosporidium hominis
atggagaactgttatggtgatataaatcaaataacaacaggaggggttggaataggacattcaaaaataccatatttattaaaatgtcaaatatgtaatgtcataatatgttcaatatgtaacaatatgtatcaatatggtttggtttatggcagtaataataataataataattcattaataaatgatggtatgaattcaaatttggtggatgagaataattttcagtgtcttgcattaattacaatgaaatgccaaagatgtatagattttgagcaaaagaattttgagaatgtgataatagatagttgttgttgtttatgtacaagatttgatggtattttattacctttaagaaaaggatatcagatagatttttctggaataaagacaagaaagacgcttttggttgatggaagtattccattagatgatcaattaaggttaacttgtgatatatggatacatccaatttgtttggaatggcttataatggcaagagttcaagtatttagtttgaataatgttatattaattgataagaagcattttggtaatatatgcaaatattgtggattttcaaatggagcaacaataggttgtgcattaagtacttgtgatacatattttcatgtatcttgtgggaaatctatcggatgtaaatttgattctagtagagtcaaatcaaaacagaatgatcattattacagtttattaaatagtggtgggtcatcaatgaatatgaattcttctggttttttaataggtggtggtgttggtattaatagtagtagtggtggtggcggagtatatagaagggcatggtgtataagtcataatcagtgtaataataataataattcaattataataaattcaggtattaacaaatccggaggaaatagtagcaatcagaatagtaatattaatgataataacaatattgataataataataacaatagtaataataattcaagtaattatggttcaagtttgatatcaacaatgggatcaatttcttcaagttcacaagatttgacacagcttagaactttatatagtaatataattaggaataataatgaagtacttgataaagaagggcaaggattggatattaatagaagtattaatgtgagttatgcactaaatcagaatttggaaacaaatttaaagatgagtttattaagttattatgggtttggttttatcaattga

SEQ ID NO: 788 - DNA, 1326 bp, Cryptosporidium hominis
atggcatcttctaatccatctttatcttcaactactggttctgagtctattttaggtaacagcaatacattgagtggaggatcttcattatttggaacttcatcatcttctctagcaagtactaatttaactagtggtgttactacttctttaacttctttatcaacatctccttcattagctaatgctaatactaatagtaatttgtttggtaatttctccacttctgcttccacttcatcttcattatttggagcaacaacaacaccagcatcaacatcaacaacaccggcaacaacagtaccagcaacaacaacaacaagttcattatttggtacaagttcagcaactgctccaagtacaagtactaataatttttccacttctccaacattatcttcttctacatcatcatcagcaattactggaggtctattagggaatactaatttatcaacttcaacaacaacaagtttgtttggatcatcttctaagcctgaaaataataatacaagtctctcattattaggaggaactacattatcatcatcatctactacaccaaatctatcaatttctaattcatctacatctccatctccatctccatctccaagtcttgaaacaacaatatctcatcaacatgaaagagttgaggatgtaataaaatcttgggaaagtagacttgcaaaacaagttaaactatttaataaagcatcatcagatgtactagaagtagataaagcaattattacatatactacaaaactttattccattagagcagatcaacaagaaattaggatgagacaagaaaatatggataatagaattgatcaaattgctcaacaacaaaatagtctctctaatactttaaagattattgaagaatccttttcaaaaaaactggaaggatcatcatctattaattctttttctaataataataataacaacaacaatagtaataacaataataataataataatagtaataacattaataatagtaatacaaataatatgccaagaattggaacaactggaggaagcttttctggtagtcatgataaacctaatcaaaacatgagaatctcagctgcaagggctaatgctttaagttctgaacttcaagatattgaatctcaagttgaaactttaatgtctcaacttaataacttacatgaaagaatttatccttcaccacttaatgaaattgttaagatccttaatatgcaccaactcactcttcaatccattgaaagtgaagctcaaagacttaaagaaaagatcacaattgctgaagactgtttagtaaggaggtaa

SEQ ID NO: 789 - DNA, 141 bp, Cryptosporidium hominis
atagaaaattcattcaataattgttttggtacatctttttataatttaattactattggatttttcatatttgctatattatcttattttatatgtttttttctatttatttataattggatttatcttgaaaaacaaaat

SEQ ID NO: 790 - DNA, 1596 bp, Cryptosporidium hominis
atgaaggatgaccaatcatataatgaagaggaacaaaaacagaaattattgacaacttataataatttaagtgattcagtaatttctgtagcaccaatgcttgatgttacaaacagtcattttagaatgttatgtagaattatctcaaaaaaaacagaattatggacagaaatggtagtagatgatacaatcatacattgttataatgatgaaaatagacgaaaaattcttcaagatgtacattttaaaaagaatgatattgaaaatcctctagtattacaattgggtggtaataatcctcaaaaaatggaaaaagctattgaaatagcttataaatatggttttcagaattttaatttaaatgttggatgtccatcatgtaaagtagcttctaaaggtagttttggagcatcattatttaaaaatccacttagagttgcaaaaattgttgatcaatgtaacaaaaaattaattgatttgggattagttaataaacgtatatcagttaaaactaggattggagttgatcaatatgatacatatcaacatttatataattttatatcattagtatctggttgtaatataaataatcaaaataaaaaagattattcttgtatatttccacaatctgatgatcattctgatcaaaatatattagaatctattgattatacggaaaataaatttataggagcaaatgtatttattatacatgcaagaaaagcttggttaaatggtattaatcctagtaaaaatagaaccattccaaaattaaaatattattgggtttatatgttaactcttgattttcctaatttaacttttattttgaatggaggagtaacaagtatacaagaatgtatttcaatattaactggtgattggtatattcaatggtatttaaacaactataaagatgatataaaagataatgaaatagaaattaataattgtacaaaaattaagaaaataagaactgatcatttgaaagatgatcatcatattgaaacattatcatctaattcttattttacattaactcaagaatatcaaaatttatatcaaatcattcaatcaggtaaatggattaataagataaaaggagtcatgataggaagagaagtcatgaataatccatttatattatcaaaagtagatagtatgatttatgggattagttataatcaagttagtaataataataataataataataataataataatagtaatagtaatggtagtaatactaatagtaataatactaatggtaataatagtagtattcacttaacaagaaggattgtattggaaagatatgtagaatatttatctaaatttaagccaagaaatattaaagatcaaggtcaatttactataggagaattaaatatgtatttaaaaccagtatttggtatatttcatgggttttctggtacaaaattttggagaagaacattgtcagaatttattcaaaaatcattgaaaaaagaagatgatattttaaatataaatagtcctgcagatattcttatacagtcaatgaatttatttagcaaagattattcaaacttattagattctattgtttaa

SEQ ID NO: 791 - DNA, 1791 bp, Cryptosporidium hominis
atgattcagctaattttagcaagaacagtatcttcattatgtaactgtgtgacatatttctctggaagtacgagatcaacaggtccaaattttcattatagaggatttaataagacgagaaatgatcaaacagaatatgaaatagattctttgttgatggaagatgatttagtggatgaattagctgctactccactttcagctgaagaaattgcagcaaagctttctaattcgaatacaaagcaaaatcctagtaatttattgggagtaagggatgctaatatagaaggtggtagtattggagcaagaggagctgatatttggatgggtggaggcggttcaagtatgggaataggagggagaatggaaagaaacgaaaacaaaattagcaatgattggtggtcagatggtgaagaagatgaagaagatgaagaagtggaagttaatggtggttttagtagcaataatcgtcataattttgctgttaatggtgatagaggagttggaacaggaggtattggatctaatcaattaaatgaaaaagtaataaatacaacatttttcaattcaaatccaaccctgattggtaatagtgtagaaaagaatatagaagaagatttatattttgatgagaatatggctgatataagttttcaagtaaacgattcgaataataaccaacttcaaaatgataattgggataaggaattctttgataattataagggtgaggaatcttttgattttgttccgattaaagagaatttagatgactttagtattggtaacacagatttgagattaaatcaagtaaataatgagatcgtttttggggatcaaaatgatccaatagaatataaagattttaataataataataataacatgctgtctcctataatagaaaataaagattttggagattttacaagtggaaattctccaaataataattatattataaataatagaaatgatattgatacaagaaataatgaatattatgaatcagaaataggaataacaactttgaaaaataatggaaattatttcgatcaagaaaatgatcaaattagtttcagtgaaacttataattatcaaattaacaatcaagtaaatcatatagataatcaacaaaacaatatcgagcaagttaacaatatatttgatgatttttctaattataattctccagaaaaagatgatagtgatatcacagggaagtttgtctatagtaataataacaaccatgaaatctcttcctctcaaaatcaatttgattttgacgattttattgatactagtaaaaacttgaatgatgattctattataaatataggacaagaatcagaaaagataccagtacacaattcagaaacagtaccagaatcaatatcagtgccaatatcagaaacagtatcaacaacgttatcagcgccaaagcaagtactaccagtgcatggaaagaatgtaattgatgattttgatgatatatttaattcatcttctacatctaatgataattttaatactaatattagaaacaattattatggtgatgattataacaataataataatagtattactgatgtttttgattttgaagagaaaagtttacaggccaataataacaactatagtgccagtacttatgaagatgatgagtttggcatatttgattttgtttcagcaaaatctccacctgctaatgatccttttaagtctgactttttatcatcagacagagatagtaataaaaataatcaacagacttctattttactttaa

SEQ ID NO: 792 - DNA, 3546 bp, Cryptosporidium hominis
atggttattagaaatggaacctggggaatgttggatttttcactcaagaagatgaatttaaaacttattatatatttaagtaatatttttgaatatagaaataatcaaaagagtgaaaatatcttaaagagattttttgaatgtattaaactaattcttaaaaaggaagcaactagaattgttaagattaagttcaagattcgggatatatgtatttggtcaatattatatgaaagaattaagcgtactactactactacttctgataatgataaaattacaagtaccgtagatatgtattttacaaagacttgttcaagtctagattatgtttgtttatctcctttaaagaatttattttcagaatattcatcttctatgttgccagaatatattacaattgatagaaagaataagaatccaggtcaaaattctatagatgatgagttatttccaagttgggagtatggcctaagtttacctttaccggtaccctttaatcatccagatttattattaaattcaaaaccaaagatttttccagtttttggaaaaagaccaatagaagaagaagattttgataatgaaaaaaaacataaaagatgttttaagagtgctggtaaagaaatttatattataccaattatcacgcttaagagtaatgaaatgaatctaggtacctcttcttctattatgggtagtccaatttctatagaaattacaatttctccaacatttttatcagtcattccactcatttttagacaatttatagatatatcttatatgtatgataagtttaagacaattcatttggatgatgctctaattggtttaaatagaaaaagatcatccaatcaaagctttaaattcaatcaagatcaaaatactttaaaaagtcaaagtatgttttttgaagctcaaaaaactaattctcaagattctaaacatgtagatactgttactagtttattaaaatctttaaagaatattcctattacttcaattgagatcagatctaaattcaatacaatggtggtgatctttccagaatttaatgatatggaaatgtctaataatgtttcttctagatactttgaatcatattcaaaaaagattaatagtaggattaaagaagattcaaattttctactgaattataatgaggaagaaatagaaaaagaagcaagagaacgacaaataaggaaatcagaatgtactaataagaataccggtaccgaaaatgatgattattatatttcagtattttcaaatacttatcatccagctatagcctttagtcataatcttaatttcttgtttattttagagactgaaaaggaaggaaaagatgagaaagttttagatcatgaatcattaaagattagtctagaaatctcacaattaagagttcagcttccatttgttaaaaatattggaggtaattatattatggatgaaattgataaatttaattcaagtaaagattactttaagatgatgagttctgaagataatgtacaaggtagagatccaatattggatgtatttattccttcattaaattcttgttttgttctatctagaaatattcagaatgaagttaatactgagattcatggatcagatacatttggtatcttatttggtatggttaatataccaatagtatttgcaattgatggagcaggaattccagtaatggatgatacttttatattaagaaactatgctttaagaaagaatggaggtgaaaacaatatgaatattttagttgaagatatggaaaaagttcatcaggaagaggggatgatggagcttagaggaggagatttaaatggcgaggaggatccttgttttacaaattgtatgatgaatagaccagaacttcttggtattattattaatgcaataggagatcattatcttcaaatacaagcaaatttgaataattttagattcatttttagtttagctactttttcagtttctgctccttatattcaaagaattaacagttggtggaatgatatatggttaattaggatgagatatccaagatgtgaaggatctacaatgagatacttttttgtagatacaagaagtgatggaatcaatatttcaagttatggattaacatcaaaaggtacaaaatttgattatattatagaagataaggtggaggaagaggatgaggaagaggatgaagatgatgatgatgaggaggagggaaaagaaaatgataggaggaaaaataataataagtatcatgaaaaagagcaaaatgaagatgagacaaagagtcttgatcatgggaaaggatttaaatggaaatgtattaaaggtacaaacgaagtttacagtgtgaatagttttgattatattaactttgaaattacaaatcctctattttttccacttgatgaatcaattccaatagttttagctcttccagttactgcatgtttggatgatatagttcgaccttggaattctttagagtttgagattaaagatggttcagttattcaatttgatgaaagacttaaaagttttaatatggaaatactaatagaagaaagaaggattggtttttcaaaatctaaatctatcgttactggatcaccgtctttaagattaaataaaggtaatgattcttatattatgaaaccccaaagcgtggtaaagttagatccatttttgatttgtcattgttcaaataaaagtaatttatcacgaattaattcaaatatctcagattcaaatcttgttcaaaatgaatttgctgagtttaattcggatgaagaaaatcaagcattaatggactttagattttctgtgaaaatgaatgaagaaactttaggaataggagaagatagtcatcgtcaattaaatcacggaggagaaggttcctttgagtactttactttagcacattcaaataagatttcaaagtctcaaaaaaaggtaggaggctttttaaatggatggaattctttcaaacatagactttcttcaaactcttcattagcattaataccaaaagatgatcattttcattctgatcatcaatttgaaatggttgataatgatgataattatatgaaaacagttacaagaagacatagtgcaagcttggacaatcttgtaagctcttcaagaagaagtttcagtttgtttagaagaagattctctaatgaggtaggaaatactcataatcatcatcatttaaatttgtctccgattaatgaaaatgatcatcatcaaatcaactctaagaggagtgacttgagatctggtaaagataacattaacaatgataataacaacacaaataataataataataacaatgttaataataataataactttaatagtagtgttgaagaagaaaggatctttaaatttcaactatcactgaataatttagagatttggttccatagagataacaaaaaggaaaacatgagtgtgatcagcaaaaaaaatctagacctcgagggggggggcctgttccccattcccaaaaagaggtattcgtaa

SEQ ID NO: 793 - DNA, 3255 bp, Cryptosporidium hominis
atgttaattgatgatcatttgggttctaatccttttgcaattgagattatttgtgatacatttaatattagctcaataaatgattccaagatactatcaagagaagaattgcaaggaaagaaatcaaatcttcttcagtttctttggattcgtttttatggttttagagttatttttcgtaaatttaatgatttattactaacttcggtacctaagaatgtagttacaaaattggtagatattgaaggagacacaactacagctttaggaggagatgatgatgaaactggtcatgcaagctcaaatactaatgattcatcatcttctaatagtaacaataatggtttcttctctaagataacaaagaatctacttccaatctttttctcatcaaataagactgaaagacaaaagattaactttatgagtaattttctatgtaatttgaatagacaagattcatctcaatttgagttatttagagaacttagtgagatttctgtgggctcaaaggagttttcacagtcagaacttcctaaacatactcagaatggtaatagtaagttcattaaattaccagaagatccttcttctagtattcaaatgactaaagatcaaggtatagaattacatatactttttaaaagatgggatattcgagctttaaatgcttctaatattatgtttgaaactatctttaaggacgaggagcagtatagtaagtatatttcttcaagggaatggaaagctagcaaattgatatttcttccaagctcagataagcatttagaaaggcctccatctgtggatgattatcctgatgagaattttgagcttaattgtacagaggatatcatttcagtattatacaattttattaattactttaaccaatggtcatcttttttgaaagcttctcaatatatttataataatcgtaaaactcataaagaccttgaaagatatttatcatcaatcatttcatataataaaggttctaaaatgaatggtggtccatcaaatattccaaaacatcttcttgcagaaattgagacggagatttctattagggatgtaatagctttaaatatgtcagcaaatgagttcttaaaagaaggttttttgtcaaaaggaggtggattttggggagctttaaataggaattctaaagttgatccagatattcttcataattttatagaagaaagagttttagggaatagtgctaagaatcgtgatcatgatcacgacgggaaaaaaggtatccgagatcaaaaattttggatcccagaacccaaacaagttgattcaatgaaattctctactttcaataaatggttttcaagtgaaggaaaattacaagttactattccaaaagcaagaatttcaatcattatgagtgatttatcatctatttcttcaaaaattataccggtaccggattggatgagaccattattattcacaaaatcaccaaatgaggctttagttggtaagatttctggattaatcttagaatttgatatgaatatgctttctgataagatctcattctatcatagacaaactttgattaatattttaagatttgaaacatttgaaaatgaatttggtttgatttgtggactatttaagaaatccggagctacaggaatagaaaagaataatcttttcaatcattctttgatgaaaattccatcacatgctattaagatctttccaatcacattcctcccaagtattaaaattcttgaaattggactaagtgataaaagagtgttgtctaaaagaaatcaagtaaaagatcacgcatttcaagatcttattgatacttttacaaaccaatcctttgtggaaattgaaaatatgaataaattaagattagttgatttggaatacaatgaaattattacaaatgattgtcaacaaaacaaagaaaagatgaaagaaaagattggtttaagtataaacattcatcagctttttgcatgtaccgtatttaatgataataagagacaagaaaatacagtaattccaggtttttgtccaaattttaattatcatataattcatgatgaatatttacctcattttaatttaaattcgttagaaatctctggatttaacttatatgatttaaagagtatatggaagattggaaatctggtaccttatgtaacttctaatattaattcaattatttcaagatctcaaaaagaagaagagattctattggtaagatctttgatggaaatgatcaatatttcatctaaagaaaatatgatatattcaataaaattaaacaaattaaaagtctcttccagatttccaaatactaccaattcgaattctaggtactctatcagacacttatctttgaataaacataatcacgatacattaaatacttacaaatgtcttggatgtaagattaatccaaattttagaaaaaaatccaatgctttaaataataactttgaattaactacatttaaagtaaatgataatacagatttcaaagaaaataataataaagttgttattgaagatattgaaaaaaaggtaactaggataatttctgagatcttaacatctcctgaggattttcttcaatcattaaaaacatatagagttatggaaagtagtcaatcaatatttagaggagttactggactaactttaaatagtagctttggaaatcttgcaagttatgattatgaagaagaagaaattaatcagattagtgaaagtcttttatataatgagatcttgagatatttacttcaaaatgagtactttgttgaagaaaacgtttcatttacaggtattcaaatttggatttcaactttatcatttcaaatatggacatctacaaagaatctatctcttgaaatggagggattaattctatccatgttagcaaataatattcaagtagtaaatcataatgatcacgagacattaatgttgaaaattcaacaaacaatgaaaaatgaaccaaataataagaaagagttgagaaatattattagaaaagaaaaagaacaggcacttgaattttttaatttaaagaatatttcattctattcatttgagaatcagatggatcttaacttatcaaaaatctctatgaatatatttcctgcaataatgactttgattaatggatatgaacttttgatctttccaaaaaaatctactcttattgatttaaaaagaacttttgaaaatattaaatcttttaatcagaaatag

SEQ ID NO: 794 - DNA, 2472 bp, Cryptosporidium hominis
  misc_feature (895)..(895): n is a, c, g, or t
atgtttattttcagctcacaaccttttaatatgagatgtaagaaacatttggctttacaaaattcttacaacaattctcctcaaacagtgtgtcaaaagttggttatagtcgatggaatatttattatacttgaaacaattctctgtagaatcaactgtaaaattcttgatattattgaaaatgataaatttttagattctgatacccagtgtggggttggcgcctcgtcattttttgatttgttaagccaaaatacagaatataaagaacaaaaaatatggatttcatcactgtttaaattaatgaatggtattttacagctttctttgcttgatttatgtgggagcttcttggaatctagacgacttatttttatttctcaaactgtaatgtgtatagagtggtatcaggaattatacaagaattcaagttcttccatgattaaaagcgatgagattttgagaatttatatgtcttacttattagattctggaggaataagaattcatgaattaagaaaaacagcatcaaattgtttgtcaagaatccttttaagctatccaaaattatttgagaaaaatcttttactgattattcaattaattaatgaaaatttgaataattcttgtacttgttttgaagagaagactgtcttgaattctgtattaatagctgctacaaatgcattaggggactttaataagatttcagaaagttgtgaaatgacttcaaaagcagcttttagtatgatttcaagagattcatttcatttctcaaatcaagaggaattattagaattcttatttaaagatcttattgaatctgtgaagatgtctaaggaaccaattgaatcaaattggaagaatttgatactattaaagaattctttaactntattatcttctatatttggaaatgttaaattaccagaagattttttaactctgaaaaatggaggatttcttaaagaggaaaattctcattttattttaagacatcctttagaaaatgtttcaagacaaatctttgaaacaatatgcttaattaatttgacctttttacagatttgtgatagccatttacatactaatataaccaataataaatcccaattggaagaattgaatataatttctcttttcaacgccatttcagatcaagaatggatgcataggagtggtattaagaaccaatctgataacaagattattaaactgtctcagattactagttataagatgattttttataatagtctttttcaaatcagaagaattactttttcaattaaagatattttaataagattactagtattcacatttacacttggtacttataaagatatctttaatgatcaaagtaataagatgattttaaatccaggacagtattttgacgaagttaatgttaatctgcttataaagacattgatagatccaatcagatctttaccaattcatattctaaatttcattattaaaaatggtttaactattattctttctcctcaatcgcttccaagatttcaagatggtcatcccacggatatatttttagaagaggtattttccaatagatttgtccctatagtacttgatagacttaagtctgagtggcaaaatttaatgatttcacaagcattcatcttatcttcatccatttcagaattaaaaaatttagacttggaaaatatatcttcatcaataataccttttcaagatccatttaaagtattattaaatttaaattttgataataatgaattccaaaataatgtaatccaagataactctctttataatgttatctacaattctcattataatgatttatcagaaacttgtttaaccattttaaagattataaatagattcattctaagtacaaaccgtcaatggcaaacaaactttaaatcaaaaaccgggtccaagttaattaattatccaaataaaattaaatcattatctaataataatgaagattttcaaatggatagtagttttagtggatgccaatacaatcaatattatgatgatcatgaatttcaagattcaattttaatggattgtgaagattcaggaaatcattcttcacaaaagaacaaagtgcaaccaaagcatgttgtattatctcaagttttccttttaaatcaaaatctgatgagatcttgcttggaaatattgatcgaatttttaagctttccagatccaaatattttagagacttcattacatataattcaaaggtaccttcaactatatattaactttacaaatcaaggaatccattcaaaatactctcatatacatatttttttaattaaaaatcttctaatccaactttttaaagtagggcccagagcattaccatttgatccacttaacctttctccaagcaaaaatgataatataaaaatagtaactcctttaaactcttatatcaagttagaccatccaaaattactttaa

SEQ ID NO: 795 - DNA, 687 bp, Cryptosporidium hominis
atggcaattatgtcatgcttctctccaaaagatgacctcaagatggtaataagtggagtagatgattatcttaagcagttagatttaaggttaaaagaaactaatcatggcaatggaggcagaggttttaatattccaactttgagggattcccaaagctatcgaaggtcggtttacaactcaaatggggatttggttttatcaatcaataccaaggataaatatgttcgaatttttgatactgaaagtctatctcctaaattaaagtttggatactttcacatgtttagttcacaatatgaggaagggtataaaagaaaatctcccactcgctcttatccagtagtccatacatttactgaaagtaatgtaaatagaaatgaagtaattcattctaatacacgtattgagagagagatagagggggaaatagactcaagaagttcaagccaaataactcaaattgaagaaacgagtgtagaaggagataatataaggatacatcaaacttcaatcaatgaagaagaaaacgagttagataatgaaaaaaaggattatagtttactttcggttagagggcatccaatatatgcagatgttggaggctttttaatttcagaatcaacaggaaactcaaagcttgcattgcttaagttcggaaagattttaaataatgaattgaaatag

SEQ ID NO: 796 - DNA, 1089 bp, Cryptosporidium hominis
atggcttttgcaatagctccaacacttcttaaaattcctaaggaaataattatgggaatatgttattttttggaaccgaaagatacaattaatctgagtttaacatgcaactctgcatatttaacaatacataataacccaataatatggagattctactgccataaatttggttttgtacaaaacaaaaaagggaaaaaatggtgttttgaaaatgctcaacaaattccagctaataaaaggaatgatttgggatattatcggtttgaaagaaatgggaataatataataagaaatctaaatagtaagagaaatacgcatatgcctatagaggaagtagaagcttactctatagagtttgggaatgaggataactttcttaagatattggagtacaattggtgggatgagaacaatcataaaataacattaaatcaaggaaaaaagccagtaacagagttggataatagtgaattggaaaatataagattggatatttcacttgcaacagaattagtaaattggaggttggtattttacatgaatatactaaatgaagatccaaatcatattttctggttaaggattggtgcgtgcatagatataatgactccaataacttcagttaagattgatccaaaaatatatcaagatatggaggatacagtaattagccgaatttttgattttgcaaagaagattaagtatttatcaactttacatacatgcagacattttattcggcttccatgtccaattaggattcgagagattttgataggagggagaattgggaatattattagctctgagcctaattcacatggtagatatcttctagaactaccaaaggagcttgtgcatatggtaaatataagcgatatacctaatcctaaatgtgatgatgacaatttactggggagcaaaaagctacaacttccaataaatattcataggaagtcgttcctaggtaattattcaaagatcagaactcaatcaaagatggaaggaaaaaatttagggatactggaagaggagaagatagaggaagaggaggaagatagagatgatgggtgggatcatgtataa

SEQ ID NO: 797 - DNA, 1485 bp, Cryptosporidium hominis
atggaaggagttaagtattcgagaggaggaaaagttcacataggtgaggaaagatgtcgtggaggcagaggtggaggttatgtggggatgttcgtggatggaaagggaaatggacgtggaggaggtacttatagaggaaatagatttagtagagggaataaaacaaaatcgggatcaatttatagagatcagaataccagactcgattttacaagaaagttgcagagctctacagaaacaaccgtaggacctgatgggctggagaagagcagtgcatcagctgattgtagcaacaaagttatcatagatactagtgacttgctagctattagctttcgtatttcaccggaaaagaagtgtgatgagaagattggggtaatacccaatggaatttcaagcaccgaagctagtgagtattgtaaaagccagggctcaagtcagaatccaagccccttaggaggctgccaagaaaagtttaatactagctcaaatttttatggtgattcaaaacatttctccaattataaacattacaagaaaaaccacttccaaagcgcctacaggggtagaaggaaaatgtttaataagactcaaggcgaaaaagctcttgaaatgaagagagaacctgaaaagcaagacttaactagtcctactcctagtcctatggagccagctcagatacaagaggttgagagtataaataccaagaaagatggaccaaaattaccaacttctgataaaaaaatcccggatcgggaagatattctagaaagcccaagcaaaatgcctgataagaactcgaaatgtacagagactttaattaaggaccaagataataatattaattccgattctcagatgattagggatgtaattaactggatgaaggaacgccaaggagaggcaattcattggctcaaagaaaatggtaagtatccacaagaagaatatgttcagaactctgttaggaagccccggaaattttcccaagatggtggatttaggggaaaaaaacaatcttggaatgacagcgagcgaaatatagaggagaaaaatcagaggttcccagcaaaatacaagggccaaaagaaagatactctctctttttcttattctcctaagaccctagttaatccaacaaaccaagataagagtagcaattcaacttcagaatgtttagaattgtcacaatgccgagaaactagtaaacaatttggcgccaatattccaaacaaagacttgggtcaaaagctagacttgcgtgcaaaacagaaatttgagtataatcgaagattcagcagagaaaaagctggtaattttcgttttcaaaacaaaaccaaggaaaatgagccataccgctctacaggaacaagaaatgactcaaaagatggagagaagagtactaacagcaatagtaactttaatactcctaccaaatacagaaatcattaccacaaaaagcaatctgttcaaaaagatctgtaa

SEQ ID NO: 798 - DNA, 1662 bp, Cryptosporidium hominis
atggaaactgaactcggactatcaaaagaggaaaatggaagaacaggagtaagaggagagttattcttaaactttgaggaggttgggaggattcaaaaatttttgatggagaattcggggagctttggatttgagttgtcgccagagcccgtagttgatagtagcaaaaaaaattcaaagaagaagtcaatatcaggaggagctaaagtgaatccttctggtattgtgataggagaaaagaggaaatctcgaagttcgcgtccatcttattcaagagagctaaaggcgcttttagaagatggaatgagtattttagaatcaagacatgacaataagggaggcaactcccaaagttcagtaggacaaagaggaaatgttgaagattcacaaaaaagacttccagattgggctaaaagatttcacagaattctcaaagttatttctcagcaagaagccttctctccttttgtttcagctgtcaatattaaaaactttgacttatatataaaaggagatgctcttttctctagagaaggtgttgaggaagagacttttgacggtataccttcaagtgaaaataagaaaaaagaaattgaccgactctttttaaacgccggacaattcttcaaatatatagaaagatgtagtccgatcaaaccaatttctctgaattgtatcattagtaagcttgaaaacaacgaatatttatcagctgctcatgtattttccgatatatattctgtctggatttgtggcttccgatcagtagaacctggaaaagctttatggactaaagcagtagatgcctcacttaatcttaatttaaagcttttaaatgaaccgctacaagatgatttcctgctcacttttccaggaggcattcctaaagggtccaccaaaaatgctaagtcaattatcgacgggtcgtcagccttggagcctccaaagaagatccaaaatactggaaaaaatataggttccttactctttgatgactctggaaaagaccctaactaccatacacttggtaaaaataaaaaatcagcctctaacaatcagtcgtcccaaaactcctccagctccaagtctgcaaaaaccccaaagaaacactcacaagcttcatcctcctcatatggtgccaaaggaattactgagcctgagagacacgagttccaatcccttcttagccaactttcacaaaacgaccatgttgaattattcaactccttcttctccactgctcactggaaagaagttaactccggtgaagtggaacttgatgaccagcaaaccccccctaatgttttccgtgaaatgattaaatggtgtaaactcaaacttaatattcctatactagaaggcacatccaaaaaagattcatcctcaaataaaaatacatgcaaaagagcccgccaacagaaggcgccttcaggattgcactcgtcacaaaagaaaaaatctcatttatcagctaagcaattcttttcatccggaagggcatttagttctccgtcatcatcatcggctagcgaagatgaagacgatatttccttatctggaaacttacaaatttcccaacagtgggcatccacttcttcatctggtgaatcggataccgagccagaactgactagtttttacccacattttaattctaaataa

SEQ ID NO: 799 - DNA, 969 bp, Cryptosporidium hominis
atgaaagataatgtaagagaaaggctaattttaagattggggattaccaaaaatgatggggaaaggagagtacacgcttcaggacatgaccgttcaatgactcacagttccaaaaaggcttatggcgattctacagacgagatacaagagcatgatgattttttattcagattattagacttgtctcaaaatgactcttcaaggctcaagtacttggaaaaattgagttatttgaaaatttgggttccttcagcacataggccaccaaagcaccaaactgcaataatttttgattgggatgataccttactttgtaccacattcttaaattatcagataactaaaaggaatagaattagtggaagctcaaattcacaacaagctgtgaatgattcagctcaaggtaaactagagaaggatattattgcatgccaaggtgagtgctctgataactttttgtctacttttccccaggatgtacaaattattatgaatcaaattcaaaaatgcgtagttgagttacttgtcaaagctatggatatgggaaacgtatttttaataactaatgcttcagagggatgggttgattattctgctaagatgtatatgccagaagttgttgatgttttatcaagattaacagttatttcagcaaggtcaaagtatgaacataaatatccaggggcatatcacaaatggaaatttaatgcatttctggagattcaaaaaaagctagattcagagactattactaatcttatttcaataggtgactctattattgaaatggaggcagttcatatacttggaagagagttttcagagtctttggtaaaaactattaagatgaaggagtctccaacaccagatgagttatttaaacaactttcactaattaacacaaaatttgaggatatttgtctaaatgcacgaaatctaaagattgttttggagaagagatcattgtag

SEQ ID NO: 800 - DNA, 204 bp, Cryptosporidium hominis
atggaagtagaaggtaagtaccttagtgtaaataccgaacatcaaagatcaataaatactgtctttagtaaaaacattgaattattaagacttgcaattaaaagaagtgaagatcaaggaatgttggtaattgtagcttctggtaattatgaaagcgatagaaacaatgatattgttccaactttcccttcatctttcaagtaa

SEQ ID NO: 801 - DNA, 2076 bp, Cryptosporidium hominis
atgaattctgaagaatacactgattggtattctttagagaatttagataatacaaggctaaactttgatgaacttaaagaagaatctggatggtttaatattgaaatagacaaacatgatggttcagatattgcaggttttggggcatccgaatctttgatatggagcctttctattcattttagatcaatcactttgcaggaccctgctactgtgatttttaaggctccaaattggtataaaataattaaaagcacaaatgagatatccccgtcaaaatgtccaaaaacaagcccaccatacccatgtagaagatctacgaccaatttttctgatcatgaaatagaaataacttctagaatagtctgctcctggaaggatatatttgacagattaaactgtgagcctttaaaaattgaggcttataaagttagtacttttggggaccaggaacttcattccatgggttatgttaatttaaagcatattttaattcagactgaaaaaaccaatccaactgtttcaggtaattatatttttggttcaaatacattcagaatttggccaacacgcatattactatatccagtatcaaaatctcaagtacccaatgaccataaaaacacttccaatgagttggattcactctctgattttgaattagaaccaaattctggcgaatcgaaaaataagaatagtgagaattcagtaacagaagaagaaaagagcgtgcctataggacttatagaggttgatatagtattacaggattgtaagaaacaaccaatttcagatggatcatcacccggtattagacagaagtcattaaatactaaaacagatcaaaactcgtctttattctctaggcctagatctgtatctagatctagatctaggccaaggtcaggaagtgctacaaatgaatctccaataaatgagaggactaggaacaatttgaggaacaaaaccaaaacccctcctgacaaaagagtgagtttttccccacaaagaacgtcaagaaatgctaagtacgaaccgggtaatgatgaagaatttatttctccagaagacttggagtttctgaaaattggaaatatgtatgataaattagactccaatattagaagccctggggtaatttctgattttagctcaaagataggatatttcactgttggagatgttgatttttcaaataagctgatagaaactatcataaaagaaattgataatgatgagttgtatgaacaagggcttgaaaatagcgatgattatacctcaaaggtgaacttcgagatttggaagaggtcagagaaagaaaggttcgtacaacaccttcacaatttggaagaagaattcagaaaattgactttaattagacaagaaacaatcatgaaggatttcattggggatattagtagaaaaagcaataagcttgcaagacttgagaatttagttagcaataaaatacttaagttaaagaataaagaaaactcaatagataatattaatgatgaaaacaatagaaagatgaaactatttcaatttgagcaaacaaaacttcttgaatcccaaaaaaatgagtttaagatgaaacttgagcttgaaaaaaagaaaactcagattgcagaatttgaaaaaaataaatggttcaagaaatatagcgaggaagaggaaattaacgaaaagcttcacaaagagattcagagtctaaaaactggtagaaaatctgatttgtattttaaaaacgaacttcttagaaaagatgagttaattcagtcatttgaagatcaaatcttacagctcaaggaaagtgttcagatattgagggcttccagagatcattacaagactcagtttgaacatttagctgctgcagtgcatttattccctgagaaagaaacacatcctacttccaacaaaagtaataacgtttatacacacaatatagagtctctagtacagtcaggactttacaatgaagatgatcagtttattcaacttttaaagtcgaataataacattcatagtagttttagcaacgaagatgcaaataatactagtattcctgaataa

SEQ ID NO: 802 - DNA, 1563 bp, Cryptosporidium hominis
atggaactcccaattcatgaacatagctataatcctccagaagagtacttatttgatgaggatgagatttctaagcttgagaaagagggagaactggaaaatacatttataccatctaaatttgattgtctaagaagggtaccagcttatgataagctcattactgaaaggtttgaacgctgcttggatctttatttgtgtcctagagctatgaaaatgagaatgaatgttgatcctgaaagtatcttgcctcccccaattgatacaagcgatttgaaaccttatccaacttcaatcagaattagatatgactttgatcaaattattgacagtaaaaatatacaaatgtctgcatcatctgatggattctggctagctgtgggagtaggtaatctattgatagtatttgaaatatctacttcacgaatagcttttaaattggatatatcaaagttagctcaacaagtaaatatctacgatgaaccatcttctagtgatgaaacacaagaatctaacacaaactctataacaactctagcatttcatcctaatttacctattttagcttgcggagttgaggagtatctctttattctagtactgaaacttccaagcatttgctttgcagaagactctgaagcttccacagatattgaagagaaagaaactttggattcagatgaaataattaaaaattctaaaaacaaagaaaaggacccaataaaagattatcaacattctttggaattatttgaggatctccatacttataataaagaatccagtaaattggagttactttcatggaatagcattaatttggatccagattctgaattaaataaagaattaagctcagctgttgtaattaaacatcaatctactattagacatttatcctggcataataaaggagggtatttagctgcagtatctccaagagctatttcaccttcacaaagagttgttattcattctatcaatagatgctcatcaattactgcatttaaaaaacttagtggattggttaaatctgttcagtttcactcttctaacccatggcttattgttgctactcaaacatgtattaggattgttgacctaacatctagtaaaacaggtaataagaagcttggtaaccaaaatactggtaaagctttggtcaaaaaacttattggtattgaagatccaacaaccatttctttagattcttcagggaaacatatctttgttggacaatccaatggaagaattgcctggtttgatctggatcttggaaatactccctataaacttttaagatatagtgaatcagctatcaaaaaagtacaatttcaccaaggaaagtctatggttttctctgctagtaaaaatggcactattaatattttccattgcagaatgcccacagatctaatgagtgatcccgtttttgtccctctaaaggtaattaaaggagagctttcttttattagctcagctatttggcatccaaggcaaccttggatattcactgctggaattaacaaagatggaaagccatccctagttctctggggctaa

SEQ ID NO: 803 - DNA, 1152 bp, Cryptosporidium hominis
atgaatcttgatttcgatactaataatggaactttacaaaattcaagttctcgtatattacctagcaattggattagagtattaatttcacagcgtgttttaaatatatataaacaaagagaattacaagataaaactaatcttatttttggattatataacaaaccaaatataaatttgattgaaacaaaattgaataatcctgatttattagcagagtttcttgtaaagaaatgtctttcaaatcagtggaaaactggtatagatttcatgtattcaaaatatggtcaatatgatctaatgattgcattacaaactttgattgagtcatgtgaattattaaagtttacagattatcaacaaacttttagagtttatcagaacttagcaggactcttttctttacaactttattttgctagttcttattcaagagttaagaatattgatttaaattccaatttggataactataaaacaatccaaaattgttcaagtaatggaataattaatcaagaaatgaaaaaaagtgtttatgatcggctttcttgtatagttaaaaaagaggaattgaatcagctttttggagatttgtgcgaaactattaagagtaataataatgatatggttggaaaaggaactttgactcaagaatatagatatagatttgaaacagaaaagattcgacttctcaatttagatctggttgaattatttgaagttgtatcagatccacaaatttgctataatccggctatgattatggtgatattaaatgggtacgagtctatttatggacctatagtacattcagtatggccaagaatattattcattcaatcaatcattataggtaggtttaagttcttggatgattataaacacgaatttggagctttgaacgaagagattttaatatctatgattagattgtataacaattcacttaatgaggataatgatgataacttggaaaaaatcaatggaatgactttttatgactttatcaagtctaatgatgatggcaataataataatatatttgaaagttctgaagaaactttaagagttgaatttgatactcaggacttgggattttaccatggctactcagatcttgatcttgatcaagatcaagaagaagatcaagaa

SEQ ID NO: 804 - DNA, 1923 bp, Cryptosporidium hominis
atgcttccaaagttgattcgttttcgtcataaagtactaattttttgccaaatgacacagttaatggatattttgggtgactttttagattatagaggtatcgaacatcatagattggatggaacaatgacaatacaagaaagaaaggagaaaatggatgaatttaattctccagattctgagaagtttgtttttgttttatcaacaagagctggaggattaggtttaaatcttcaagctgctgatactgtaataatttttgactcagattggaatcctcatcaagatcttcaggctcaaagtagagctcatagaatgggtcaaaagaatgaagttcgagtattacgttttgtttcaatttcaggagtagaagagttagttttaaagcgtgctcagaagaaattggagattgatcataaaattattcaagcaggaatgtttaactcaactcaagttgaagaggaagagagagaggataggcttaaagaattatttggtaaggaggagtataagagtgattcaagagtaacaacaccatcagagattaaccaatttttggctagaaatgatgaagaacttaaggcttttgaagagatggataagaaaacatttggtaagaatatatatcaaaagattcaggattggagtaagaatattacaaagaagtcattaacaaataataagaatattaaagaaatagaaaaggataatgaagatactgattcaaatttactaaagtatggccagaatatttcaaaatctcctttgagaccaaaaaaaccaggaagaagacagaaaagtattcaaatggaagaacaagaatctcaagaagttttaacattggaagatagtaagatttaccttgaatgtttggagaaatctggaagaatgataaagatgcaagaagttccagattggattgtaagaccaccaaatgaggtgaatgctgaattaggtattgaagataataatttgaatgaaattcgtgatttggacagatcagagagaaaatcaagatggaaatcaaataaggattatctttgtgtggaaggacttagtgagagagcttttctaagagtaatggaaaaatacgaggcaggagaaattactgatatttcaaaagagttactaaaagagacaaataaaaagagatctcttccatctttatcaaacgaaagtaattcagaatttattggaaaaggtaataactctcttttttcattatcatcattgagaggtaaaagaagctctttgagaaatatttcaacctttaagagacaagatagacaagagagacgaaaatcatcagcttacttttcttctaattcctcaaattcacctcctcctgacttgaacggatctttttcagataataagagtttgtcaaaaaagagaaagatcatttcttttagcgatgatgaagaagctgaagactttgagaactgttccagtgtgacaagaagagttttaagaagagatactgttactaaagggcgtaaacttcgtagtcagaaatgggaggatgagcataaggatgaggatgaagacgaagatgagaatgaaaataaggaggataaggaagatgaagaatgtggggaggatgacagtgatgtccaaaatgacgattatgaagatgactacctatatagtaatcctaatagtaaaagtaagaagaaccaaaagaatgccactactttacaacctgtgaagaagaaaggaaagtcaaattcacaggctcaaaaaaatatcaaaggtaatacctctaatcgtaaaatccaagaaaacaattctaacattaagtttgaggaagaatccaaggataactccaaggaaagtaatgattcagacaacgattttcccctttctactaactatatggactcccttccaaatactcctgaagctattgtaattaacaattga

SEQ ID NO: 805 - DNA, 1488 bp, Cryptosporidium hominis
atgtatttacataataaagaaagcaatgttgaaaagattagaataaattttaaagatgagctaggagtggttgcaacaaatatatttaagagagcatttgttagcatattgaaaaagcatgataaatttcataatgggatagtgacagcagaaaaattttgtaattcaattaaagaaacagatgaatgtttaagaaaagaggataatatttggggtgttatagtggattctgaagataaatgtaatgtatcatctcctattataacctcaataatgagtttagttcaaataacagaggataagtacgttaactgtaagcctttatatttagatgttgagagaatagtatcaacagtattggtgaagaatccatataacgagagtactattatggtaagtcaaatacaaagaacgtctttagaaaaggatcatgtaaagtactcagtaagatgcccaaaaatgtttttggaagatttgtatccaccagctttagaatcagcaaataaatatagtaataaaaatagacaaaatagcatctttgaaataaatagaaaagatttttcagaagagaatgatacagaaaaacaagaagaaaaacttcctcagttaagagctcttcctcctgataaattagatgatttcagaaagttatatgcgatgtggaatagatgtatgttgtccgatgaagattttataatacatatgaagaaagatattggaatagaacagattccaagagaatttttgttacaagttgcaaataaaggtccaagcagaactttatcttttagagatgcaatctgctccttatttattaatgatgttgattctttaagaaaatatagaccagattttttagttcctcagccaagtagaattccaattgaaagcatttataacccagtaacacatgaaaatactattgataaaagtactcaaagaattctggaatgctgtaaaaaaggttatggaaagatatttaactctattgattcacttaatgatgatatgcttaatgattttaaatcatttggaagaagacataaacaaaactctagtgaatctgccattcttaaaaaatctatagaaattaataatcaacttagtaacaaaaatgagatccaagtatctagttctgatataagttcaactatatcttcaaatcattcagaaaaacccaaatttgattttgttattaacgatattgattctgatgaagaacgtgcaaaaataagagggaaacagctttccaattatcatagattaactgtaactatgcctaatacccttcaaactcagcttaaaagatgcgctgctggcgaaacttctggtaatgccattaggcaataccttaaatattatggtatacctatttctgtttctatggatactcttctaagaagaagtgatgaagatggatctgtctcctttacttcattaatgaaagaagtctatcattctattaaaaacatgcaatcttctttatag

SEQ ID NO: 806 - DNA, 393 bp, Cryptosporidium hominis
atggcagatcaacaggatgtggagatggcacaaagtgatcatcaaaacgtaccagatactataaatgaactagttttgaaggaagagaaaaacatatcagaaaaatcaaaaataaaagagtattgtaaatctatacttgaaaaagatttagatcattcaattaattgtgatattattgatcaaagcgaggtttctgagtttcgatcacaagtaaataaaatgaaaatgtggccaagctttgatcatatttttaaagctgctagaagggataataaatggtatctgagatcacagcctttaagagctgtaaataagattttatttgaagaacagaaactaatcaacatttcaaaggtaagaaatctggtcattatttgttttttttcttactaa

SEQ ID NO: 807 - DNA, 807 bp, Cryptosporidium hominis
atgaagtccataagtttattagcttcagtttttgcttttcttgcacttttctctacttcagtggagtcagtaagagctaaggcaagtattgttccaattacattctattcaactaaggaactagatagcaatcatttgattagaactgttcttgtttactctggccttgcattcactgaaactagatttaagaaagattcagaatctcaggctaagcttttcaaggaaattatcaagtctggattccttcaaccatcaattccaatgatcagcgatactgcaaagaatgttcaatacatcagcactgatgaagcagttttaagttatattattctttcatataacaaagaactattttcaaagaatttgttgttacatacaatttcaatccagctttcttccattgctaggagttacattcagaaaactaccaggattttagattcttcaaagactttgacttgttcaaaacttcttactaatgagaatatttatcaaactttgaaggttttgaatgaaaccttcacttctacagaacacaaatttttgatgggtaacaaagtttcattcaacgatttaatagcatataatctgatccttttcattgaaaatgtatcttcaggatgtgtcatttctaactttaaaggtctcagagagctagctttcaacgttagttctatcccccaaatattcaaatttgagtcgagctcctacttcatgtctttattggtaccgggtactcatgcttttgctaagcgtattaacttcgctcacagctccgcaatgtttttatctttggctagctaa

SEQ ID NO: 808 - DNA, 1389 bp, Cryptosporidium hominis
atgttccgtaatcggaaagttttaacattctttctttatatattttacctgttgtttggatcggggattctaggtcaaatacagaaagatatgactgaattttcatacaacattttgaaaatttgtaaggatcatcgacggttgaaacaagaacaacaaaagttgataatcacatggattgacgaaatttttgaaagtaaatctgttgcatttaatttacgttataatttaaaaaaatgtaaaaagtcagtaagtaatatgttggatggcaaagccactatgaaagataaaatagtaaaatttttttttgaaagaagattaaaaaactatcaagaacaatgtagaaaacttgctacagcaagtgacccattaagttttaagaaagaagaacttgaagaactacggaaattcactgaagaaaccagttcagaacccaattctggattaaggctcaatgacttctattcctcaaaattcgaaaatgaagcggatagtattttgggtaatagctttaatttaggagaaagctttaaatcagttcttgcagctgctcaaaatcaaacctctcaatctgatgaagaatcagaaattgttaagtatattcttccatatagttcatatgatgaatacctcgatgaaaatgaaattccacttattgaagaaacagaaaaatttatattaaaacacgattcgcttttactcttagttccaaaagttcttcccatgcatatgaactatgttaaaatgccattaccacagatagaaccacagccaagagaaataagaatagactactctactaatgcacctgaaagtcaaattgttgcaattgatgaattatataaagaaggatcagaggctagcattaaaagtagagattcagtaattgaagatgaaattgttgatgagaaactggatatatttgattcttctgaaagttcttctggtatgttatctgaatcagaattcatagatattgaatctataaacattaaagactcaataattggtggaaagtataaagaaaaaaaaaggtttaaatctgtatctgtacttaatgaaccaaatagtacaaataatgaacatataagctttaatgataaaggtcaagaagctggcaagagtgaatcaaccaacagagcacagtcagataaagatgaagaagttgaaagttcagttggtagtaatctctcagaaacagatgaggaaacatcaagatacgaaaatagcaaatctgaagaaagtggaagttctggcactgatagatactatgaaactgaagatagtacggataattcccaaaatactgatgatcttcaagatcaaagtacctcggaaagtcaagatgatagtagtgagcaaagcgaaagtagtggagaacacttttaa

SEQ ID NO: 809 - DNA, 372 bp, Cryptosporidium hominis
atggagtcttccagtagagatattttagaacttgaaggagtattggaactttataattggattcaaaagtatgatcagtcaaaggtacctacaaaaagaagtatatttctcgtaataaaaagtaaacttaatttaaaagtagtaaataaaaatagtatttccacaccaaaagctattggattgtcaaaaaatggaaattctaagaccttctttaaacaaggtgaaaatttgagtgaaaaaaggtactttccaaataggtctcaaaattacatgggaggtataataggttctggaatatatgggtcaagtattggaaagaagatcaaggccatcaactctttgttcaatttatccaatttcagcgttttctag

SEQ ID NO: 810 - DNA, 453 bp, Cryptosporidium hominis
atgattcaagttgttggcattagtatcgttgatagaagtaaccaacctttattctttagaacattggaaaatgaatcactagattcacttcattttgcagtttattctgcattggatatcattgaaagaaaggccagcggtgatgcaatggaaggatctttggacccgtatttgggttatttaggacctgcaattagtttaagttatgaatatgaaatttatggcttcctaagtttctctcacgtgaaaattattgtagtactacaagatcatcctgaaaacgaaatcgaacttagaaatttcttccacaatgtatataaagcttacgtggattctatatgtaatccttttttattaagaacaatagaaacccctaaattgattggaaagattgataggttaatttcgaatgctcgggaagttaatattcatatagacaagagtcaatcatga

SEQ ID NO: 811 - DNA, 1131 bp, Cryptosporidium hominis
atggaaattttaaatgaagttgatatgagcgtagtaacaactactgcatcgaattctgagtttgtcgattattcagcttcaaataatgcaaagacatctagaggtgaagataacgatttgagtaattatttggaatcaaataaagaaaatttgatattagatgaaacaaatattaatgattctgacaatttgttatttgaaaaggattttctgagtgataataacagggagagcttttctgaatataatggaagtgatacagaaatggaaggttgtgaagagttagttatgatggttccagatttggattctacacttaagtttaaacatgatactgaaagattctttatgacgttatcaattgcagaggctgaattagatctagcaaaatcagcctctagaacatcaaaacttgctatgggagatgattttgatattagtagccgaggtggaacaaattgtttaaaagaaattagaaactatgtagaagagttgttggatactgtcaacgatgtcagggactctaattttggaattcaacgtattgttgaggaatgtaatgagattttacagcaaagtgtttctcaaagtaatctttctcagatcgatactatggatatgaacactatcactgatcagaatttagtttctattgaaagactaaaacttctttgtgaagcagtttctgaagaaaattcaagattaaaaaaagaaattgatatcttaaataatgaaaatgagtttttgattcatagagtagaccatgaagaggagtctagcttacaagaagagaaaaggccttataattattttaggaataatcctatcatgagattattcttttttatatttattttagcaatgtttagtcctgcaaatatttcaaatggtttgcagaaagcccaggtattcgaacagcaatctggtttttctgaaattgcttcagaattccttgatagggactacaaattttcaaaaatcaatactttgcaactactcgagaaatctcttaaaggactcaaatttgaggatacttcctcacaaggccatccagatactatttctatatgttccattctgtctgagttggatgttttagaaaaatgttttacaagaatcagactttcttag

SEQ ID NO: 812 - DNA, 1263 bp, Cryptosporidium hominis
atgaatagtgataatgaaaataaaaacaaaaccagtattaaaaccagaattgaagaggaatctgatgaatctttgacaaatttggagtataattccgaaaataataataccaattttatgatgcctttccaaaataatattttaaaactaattgaccatcttagcattaatattggtaagatcagttttgaaggacttaagaatgttattaaaggaaaatacgttattaatccaattattagcacagaaaaagaaacaactttggtagaccagaatactgtaaacgatggttttgaaggggattcatcaacttcttctaatggtactgctgagccaaaaccagaattatctaaatatcatgatgttactgtattaccaacagaagttttcattccagaaagtgccaaatcttttgaacctgctcatgcaagaggagctcttggtgttatgccaatgccaatggaactaccaccacaaccaccagtatctcatcctgaagacaattcacaaatttcaacgattattatcaatgaagtaaataaccatggcggagatattcccgagactgaaacagcttcagaacaaggttttggtggaagggatgataaatatggaccaaataataagtatcatcatcatcatcatcatcatcatccttcttataatcatcataaacatcatcaccaacaccgtccacaccatccaccatttaatggagacaattccagttcatcatcaacatcaacttcttctacctcaacttcaacttcaacttcaacttcaacaacatccacatcaacatcaacatcaacatcaacaacaacaacgacaacaacaacaacaacaacaacaacaaacgaagaagtgaatgcagttaaaaatattggtcaaaagagaaatttgagaagattaaagaaagtagttttagaagatgaggaagatgaagatgatgattatctagatgaaattgaacaagaaagagaagaatctaaagagggtaatcaagtaactgaagttaaattgcaaatgacaatgcctataataactttaattgcttcagaaactaaatattgcggaaatggagttgaatatttgaatgaattatctcttaaatttagagaaacaattggaaaattatttgatttatcttatgaagaagtatttattgttaaaatgacttctacaaataaatcatttgtagattgcaatgacaagaatgcagtacaaaaggacaaatctggagttaaattcacctttgtgtaa

SEQ ID NO: 813 - DNA, 315 bp, Cryptosporidium hominis
atgacaaaaggatttttggtatatttgctttttgcaatatttttggtaataaatcaagtaattgatggtgtgaaatcggaactttctcaaactgaaaaagagttttcagaatttgatattaaccatgatgggtatatagatgctcaagaaattcgaattataagaacttctgtaactttacaggagctacatcaatttttctgggaaatcgatcttgataactctggaactatttcatttcatgaatattccaattttgtaacaaacaactctcatgctcatcataacaatgaaagtaataatcaacactcttga

SEQ ID NO: 814 - DNA, 552 bp, Cryptosporidium hominis
atggaacaaaacaaagaaaatatgaataattacaagcataattggactttaccacttaaagattttacttcaagtaagaaaaaagaaaattttaaatcaaatgactccaatttgagtattggaaacaatcatattgctttttctactcaaacttgttcatcttcgttacctaaatctttgaactcacctatatcttacattcccattaccaaatctcctacatcatttacaaatacttcttatatatcatcttcaccatcatcatcttcatcttcatcctcctcatcatcatcttcttcctcagtttcattttcaacaccatcatcatcaactcagttattttcaccaaaaatatctttaatatcgtcttatattactcaagaagaagaagtattagaagcaggaatttacgataaagataatttaggtaggaatggttttagtttaagaagtattactggcgatagggaaagtattatatatgatgaagactatgagtcttatttagaaagtacaattaaagaaccatttttggaaccacaaagaagagaa

SEQ ID NO: 815 - DNA, 855 bp, Cryptosporidium hominis
atgtcagcagagatttataaagaatttgcaatgttaagagaaaagaattttagaccttctataaacactctgcaggaatggctctcaattacttggaatactacatataataatggacttaaagaaactaaagtttctcaaataccatctaattcccttcaacttttcagctttattttgaatgatattatttcctcgttagttgaaaatgcacttagaatatcttttttacagaattctaatattaatcttgaaaattcaaaaattccaatgcaagattctaataatctattacaaaactgtaatgatcttattaatgaagttaataaacacaaagaatcgatttttggttgtacaaatgtagattttaatattcaaaaggttgattttaatcagattattgatactttctcaaaaagccaagatgaaattcctaaactaaattatattcactatattcttgcaattatacaaagaattaatgaaatagattttaaactactagaatattcagaacagtcaaatcctaataatagcttaccctctaaaatcaatgcagacttaattattgagaaattatacactctttattcaaaattgacaggtcaaataattagaggtcaacagaattcttttggtggctctacaacaggaacaggcgggaaacgcaaaagagatagctttgaattatcatcagattttgcaaaatgtgcaaatagtgaccattttcatggtgctgaagaaaatgattatacaggaaatgaagaagatgatatgtttgaagcaattgtagaatctgctacaagtgaattttcaattaacaacgcattcccaagcgtaagtttatatttataa

SEQ ID NO: 816 - DNA, 819 bp, Cryptosporidium hominis
atggcagatttatcaaagtttcaaggcttaaatagttctcaaattcatgaggaattattgaaatgtccaaaaagctcctggccaaaaattattagtgagcttccaactggaattaagtcggaactgattgcaattctatcaaataaaaaagcaaatccaactcaaaataacaattctgttagtgaagatccaaaagaaaacactccaaaaaaatcaaaaactgaaattgttaatgatgattcgcaaatttcttcgtcttctcctataaagggtcaaaaccaaaatgaaaccccaattgttcatccaagacgtatttctttagaaatagaaacaaataaggaaacaactatagaatcagaaaaaggaaatcaagatgaaatttgtttgtcatcacaatccttatactcaaataagatatttcaagaattaatggtatctacattttctccgataaattctgtaatatctagaacaatgtatattgcaggtgatatcagaccttttttaaagaataaagattgtcaagaaaaaagtgtaaggttagtacaatcctatttgaatatttggatatcactattctggaattccctaattaacaagtcaaagaaaaaaaaagtttcaaataaacttacaaatagtatgataaagaaacattttagtgaatactacaaacaagaagtaagcaaatttgattatgacacattaattaataaatcagcacatagacatgtaggaatgaattcaaatactgaaaatggtatgattcaaggtacagatcctgatattacaggtatttcttcagtagttaaagaaagatga

SEQ ID NO: 817 - DNA, 378 bp, Cryptosporidium hominis
atgagcaaagctcctgatattatttcaaaaacttcctctttgttttcagatgcattcaatcatcatattttcacagaaaattcaaagaaatggttggaagaatttattcataattgtgtaattaataacaagaaaattattcattcaataaatcacttattaattcgaatttttaacacaaaagatattcaaaataatttgagtgatttatttaaagatgttattcttaatgaaagtactcaagattatattagtttagcattttggaatgtaataagaaagtctgtaatatttccaaaaaactggtttaatggaattaaaagtactgaaaatccacttaaaaaattggttaattctaaagaaaactctgaaaaataa

SEQ ID NO: 818 - DNA, 3459 bp, Cryptosporidium hominis
atggaaagcatatctgaggaactaattaaattgctttcaagagaagatttggaagatgcaataagaagactaaatttggaagtttcagagttgagagacgaggttaaattctggagatgcagagcagaagcaagttcaaaggaacaaggaaaagtacttattagaagtagcatctctgaagaaatgttaaatgagttaaataacttagcaggtaaaatggatatattgaagattgcggatgatgggattaacaaagaaaataaggaagattctgattcaattagtaacagaaaatccattccaaagccattttctgttgctactggtgttccaggtgttcctgctactgctactactactactgatgctcctgctcctactcctgctccttcctcttcttcagcccttggcgctccaagtgattctaattcacttccagaaacagaaaatgtctcaagaacagccataaattcaaagttgaagagcatgattttgaagaaggcaccacctaaaatgatgagtagggcagattttgtgaaaaaatcggaactaaagagtagtggtgcaggaattagagggaatggtaattcagaagtttcagcacaaagtcaaataagtaatgctattaagaaaggatcctctaggatatctcttcaatggggatgtttagctgaagagtatccaaaatttgatgttagtgttgaagaaaacttatttaaggattacttttcagagtttgaggaaaaactttcagtactaatcaataatgaggaatccaaagaagaatctaagcttgaactatcttccacttcagttttttcaaaagatttccagactgaggagttacagattccaaatgaaaagttattcgaatggtttattaagaaggaaagtataaacagtaagaaagtaacaatgattaataatcaaacaccttccaaaattgagcaattagttttagatcaaggtaaaccattaaatataggtgacagatcaataaataaagaaaagagtcttgcaaacaagaaagaccagaagcaaactgaaacaacaggaagcgaatcaagggcctgcattttcggatcaaaaactagcagaatgctccaaatcacaataaactactttaagaagaagttaccaaaaaatcaacaaaaaaatttagatttcttcaaaaagtctattctacagtgtactttagacaaagaaggagtaaatttattgttggaaacagttcctgatccttctgaaaatgctgccaaatatgaagtttggaaggaatgtgtaacaaatgttgaaaaatatctggaaaataattcaagagaaactctatttgaagaggaagagtttgtttactttttatctagaattccaaacctatctaaaagacttgaatgcatgattttgagatcatcatttgaacaattatacttagagtcacttaaatggattgaggaaaagattcggggactagaactcattttaaatcatcaaagacttcctttacttttcaaggctgtagtagattcaagaaatattttaaatagtaaattggggaaagagaatcagcaagagcctgacaaagtcaaatttatccccttatcatctttgaaaaagcttcaaagtttaaaaagtccaaatatccaaggaaagactctgcttaattttataagttctattgttggtgagatttttacaacagaggaaatttcaataattaaaaaatcttctgagaaaaacattactatggtttatacaatggtaacagacttaatattctcttggcttgaattaagggatggatcagaaaaccttgttttctctacagagaatcattctattaaagagggaataacagagtatagtgatgaattccataatattatgaaattgttctactctgaaaagtatagccaaatgattaagttatgcagctcctttagaaggatgctaaagctttatgttgcttcctgttactactttggggatatttccacatttcttccaattggagcaaagtcaattcagagaaagcatgatcttttcgagacattatttgagtttattaacaaatataatgtagccttaaaacaagaagcagccaaagaaggcgaccagatttctcctaaaagcgtagaaaatactcccagggaaaattcaaagaaactatttacttcaaccaataccagtgctaggagactttctcatataaacgacatgaagaatatcctaaatcccgaagttaactctaagcctagggaattctcttctaagaatataaatatcaatggaaaacctaaaactaatattcaacaattatttgcaaaatctattgtaagagagctgaatttaaagcctctattcaataagaataatgaaaacagaattgatagacatgttagtttttcggatggaaaatctgaaactttcggtaataatagcaacagtattgctgctgatttgacaaatgactctgataaaataacagaaaaagatgcaatttcaggtacatcaaaagcaaaagttgaaactagcaactccattttattggagaacattgaagaaacagtggccttatcattagagcctttctatggaaataatcaagaaaccagtaataaaagttcggccatacaagcaagcgagcagggccatttaggaaagagattctctattctggaactttctaaagaagctaaggaaattctttcaagaaatagtgataacaatttcaacatgaatttgagttcatctttcgatgatgatgtttcacttgatgatgatgataatgaaactattgcactttcatctccttcttatactcggattttagatatctcttctatgttagactctaaaattgctcaagatgaagaatcctgtaatataatttcaactaaattggagaaggataacactaggaagaaagtagtaattatggcagaagaatacgaatctcctgtcagaaataatacaaagtttaatagaaggcaatcaatcagaagaatgtgccaaattgcaacatatcttgataatagtggatataatgatgagattgaagaagctaatgatgatctaaataacaccttatccaaatataagtctccaatggttcctcgtaaaggatctaatcattcttatcatattagttcttctccattttcttctggaacagaaaatagccaggaagtgaacttggaatatgatcaagaatttgaaaatgataacagtaaaacatgtgtattaagtgatatacttgaaattagtaaccctttggatgatttaaaaaaaccaaatgttaacaaagagaataatacaattattcacagctctaatcacttaaaccagttacaaaatataaatactaattccaaaggatcttctgaatattcaccacagaaaatcactttcacaagaaaatctggaagatttggtggtactttatctcctccttacaattaa

SEQ ID NO: 819 - DNA, 1575 bp, Cryptosporidium hominis
atgccacaaagagcattggtaactcatatttctcaccaagatttggatacagttcaaagaggaacagaagaatggaatcttttggaacattatcttcaggtttgctgtagatcatctagatctctaattcagcagatatggcatgttaatataggtagtatttcaacatcatttgatagaaggactcaagacaagttggtattgtattgttgggtagatacaaatgaacttgatcagaataattcaattcaagatgtatctagaagggggtttaaaattccatccagtgggatgaagtttacttcaggtaatattagacttccaggggttcctcaagcctcacataatggaggaacttcagtgaatggtggggatttgcaacaagcaaataatactagatctaataatatgtttgaatctgattatactccagcaacaagaaggttatttgagttttttctatgcaaagttggcgtaggatgctcagttgtaaaaaatgatgagagtgaagcagatggtgatagatttccgatacccccagaatatgatacggtttttttgagaaataaacaaattaatcctccttctatgataaattcaaaagtagcaatggatagtgaattaaaagcaaatgaatttaatttatcatcagcattagcattatcagcaggcgtattacctcaacatacatttaaacatgaatatattatatatgatagttttcaagtagtaccagaatatttaatacaatttgaatacgattcttcatcaccagaactatttgctgttccttggtgtgatgaatgtcaggattcaccagcaatattatggtgtcaagctgatactgcaagattatgtgattcatgtgatgagagaactcatagacataataaattagtaacaagacatataagaatcccaataaatcaaatgccaagaaattcaggaaattgtccagttcatacaatggatagtttagaagagttttgtacattatgtcatgtaccaatgtgcagattatgtagaccatcacatacacatgcagatgaaaagactccttctatgattatgccgattagcagagcatatagggctcagttagagaggcataataaaccgcatccatgtttaaattcaagaaagatggaattattagaaaagcttgaatctcagcaattaattttcaatgatgttcgagctaatatgtttgaagtagaacaaagaatttactcaattttagagagctcaattacacagttacaaattgctacagaatcaaaaatgaataaaattttgtgtgaacaacttattttaaatcagttattgcaacaagttgaatggtctgagggatttcttcaatatttacaatcaattctcccgcctgcagattttttatttgcatggcttaaacattgtcattacagagaagaagtttttcaactttgtgatattttaactagtaatgaacaatttttccctgattcaagacttgttggaagagttgatattctttcagaatctgctcttaaacataataaacatcataaacacgcaaagagtgacttatttacttaa

SEQ ID NO: 820 - DNA, 768 bp, Cryptosporidium hominis
  misc_feature (630)..(630): n is a, c, g, or t
  misc_feature (636)..(638): n is a, c, g, or t
  misc_feature (640)..(640): n is a, c, g, or t
  misc_feature (643)..(643): n is a, c, g, or t
  misc_feature (645)..(646): n is a, c, g, or t
  misc_feature (654)..(654): n is a, c, g, or t
  misc_feature (656)..(658): n is a, c, g, or t
  misc_feature (660)..(660): n is a, c, g, or t
  misc_feature (663)..(663): n is a, c, g, or t
  misc_feature (670)..(674): n is a, c, g, or t
  misc_feature (676)..(677): n is a, c, g, or t
  misc_feature (689)..(689): n is a, c, g, or t
  misc_feature (692)..(692): n is a, c, g, or t
  misc_feature (696)..(698): n is a, c, g, or t
  misc_feature (700)..(700): n is a, c, g, or t
  misc_feature (704)..(709): n is a, c, g, or t
  misc_feature (715)..(715): n is a, c, g, or t
  misc_feature (720)..(720): n is a, c, g, or t
  misc_feature (725)..(725): n is a, c, g, or t
  misc_feature (731)..(731): n is a, c, g, or t
  misc_feature (735)..(736): n is a, c, g, or t
  misc_feature (744)..(744): n is a, c, g, or t
atgaaatgtttggagagaaaaagattatggtatcaggtttttcagaaatatttagtttttgttcaagttattttctcaagccatattatttacttctcttggattattttcaaaaaaatactatggacaattttctattccagctacagcaactgtacctatattttttctttaaatacattatttacttcagtaagtatgcttccggatgaacttggatatgttgtacaaggctttgtaagtttagctagaatacaaacattcttattttccagaatttatgattaccctatcttaaaagatagagaatttgtttctaaccaaaataacaatatctgttgtggtatcattaataaaggtaaaaatatgattaatcaagaagatattaatataattgaaaaacaagtcattgaggaaacatttcaaaaagttgccttgtggtatattaatgcaacttttgctagacaaatatatgatgatcctgtatacagatatcttcatcaattaggttatttgagatcatgtggaggaatggatcttgtatataaccccccttataatcagaaaaataaacaagaaaattgtattttaaatttccaccaaattaattctaatgaagaaaaaaaaaanttggtnnntntgncnnccttcccngnnntngcntcctttnnnnngnnttcttcttttgntgngccnnntnttgnnnnnnttcttnggttntttgncccttntcgnnttcctgcngcccggggggggccctcgttctag

SEQ ID NO: 821 - DNA, 252 bp, Cryptosporidium hominis
atgttaaaatttccaagaattatacatacaaatatatttccaaattttttgagtaaaattttaaagattgaagattatcaaagtattacaaatattatatggattgtcaaatcttcacttcctatttctgatcaaattcataattatccaaattcaagtattataccaacttatttctcatgtattagtattaataatctccaaaaaagttatcttgcatttgatgattttcatggattagtacttgtttaa

SEQ ID NO: 822 - DNA, 540 bp, Cryptosporidium hominis
atgagaaaaacaaaacaatccaatcaaaaccaaaatatacctgaaaatcaatatattcccattaataactataaagttattaaaatacttggaaaaggtgcctacggaactgtatatcaagctattaaaaaagataatcaaaatgatacagaaatggctttaaatattaatgaaaattcttgtcaaaattctcaagataaatataaaataaaaacaaaaacaaaaacaacaaaaaactattataataataaaaaatactatgctattaaagcttttgataaagatttatctaaaaaaggtattcatccaagtatacttagagaaattggtattcttaaagaattatctaatcatcattattttaatcaattattcattcaattagaagatgttatacttgaaaatgatcgtatatttgctatttatgaatatggtggtatatcattattaacttttattgaagaaaaatgttcacattataattataaaaataatcaaacttatttctcatccaatattaaacctacaatttggtattaa

SEQ ID NO: 823 - DNA, 990 bp, Cryptosporidium hominis
atgtttaaattagcattgagaaatattaaaatgaataataataatatgaataataatgataatattaataatggtaataatggtaataatagtaataataacaatgatttatatgaagaattagagaattataaatcaaaagttagtatatttggtttggatcaagatgaaatgaagagtgatatagaagaaagtagtaatagtaatagtaataataataatggaattgaagttattaatagtaaaaataataaagaaagtactgaattaaatgatagtcagatgttaatgatagttccttccgaattttcatttggttcaaatcattgtaatagaaaatcagatttatcattatcatcatcttcaataggaaaaaaattgaatgatgatcatttggttaataattatcatcaatataataattctgtggaaaataataacacgagtaataataatgaaattacgaatgatttgaaaggaaatatgtttaaattaggttatgataagatcgtttcaacaatatcttcagctttaatttcaaataatactagtacatcttcaacttgtactagtaatagtaatagtacaacaactacgacaacaacttcaggatcattaagtggaacagtttctagaataggatcaccaatgataataaaaggaaatgaaatgaattattctcaaatgaccaagaataatccaataatattacaattcccaatggtaagatcatcatcacaatctccaggaggagcattatcaagatctaattcattgagatatagtagtagtagtggtggtaataataataataataataatattggaggatattattatcaatataatatgggagaaaaagtatataaaataaatgacaataataataataatattggtaaagaagaaaatagttatcaaaagagatatagttcattaccaagacataatataagaactataccaccaccattttttccaagaaattaa

SEQ ID NO: 824 - DNA, 1257 bp, Cryptosporidium hominis
atgagaattgttagtttaacaataccaaacccagctttaagaaatgaagaagaaattaaaacaatttctttacctattaaaagtaaaagtaatggaatgcaaataattgatacttggccatatgcatttcctaggtataaatatgatattgatgatcaattagaaatatctatttattataaactgaaaaattcgtcaaataaaacaaattctgatgaaattcatttacattctgtaatatatttcccatgtatattattggatgaaattgataaaaaaggtaaaaaacaatggatacttggtttagataaatttcaagataataatacaaataaattattaatgaatgatattagtatagaaaattcattaaaacaaattaaaattatggaagaaaaagctaaaagaagttttaaaatctccaaaatttatctaattttttattcttgtaataaaaccgttttaaatattgaagaacaattaacttcaaattataatactcaaagtaattataacaacaacaatgcttgtgatctattattaactgaaaatcattatgaagattataaaaaatttgatgaaaattctatctcaaaatatgttaaagaagatatcaatcttgataaaagtaaaagttcttttggaattcgaccagaagattctatttcaaaaatatcagctaaaactactaattctaatactatttcaagaactaatcttattaaacaaaatcttacagaaaataatgataatttatcagatgcaatagaaatgattaataaatatagaagaaataaatcaaaaggattatcttatcatattaatatcaatcaaaattataaaacaaatattcttaatgattttgatcatcataaagaacaagttaataataatacaatcacaaaaatacaaaatattgatactgctagtataatatcaaaaactatttcaactaatacacaaaaatatttagaaaaaaagaaattacaagaaagattattaactttacaatattatttttctctatggagacaagaaagtagaaaagaaagaaattttaaagaatcaaaaaagaatgtaaaaattatgtcaggattaattaatttacttttattatttgaaaaaaatcaaagatttaaaaaaatgacatttattacatcattaaaaattaatcgtttttttaaagaaatgaaaaaaaaagaattcaatttagaacaaattactaatgaaaagaattttctggcccgaacagcctga

SEQ ID NO: 825 - DNA, 261 bp, Cryptosporidium hominis
atgaaaatgaaggtaacacttttatttggattacttggattatttagtgcagtgaaaggtgaaatgcaacaaattagaaaatacaattatggcaaagatttatgtgaatttgatatgaatagtgtattaaaaagaattccatcattaacagatttatcaactggagatattgttcaaacacatttatctaatgaagaatttgaaatttcaagtaatggtgtaagttttttcattctttctttatttaataaaattttctaa

SEQ ID NO: 826 - DNA, 3732 bp, Cryptosporidium hominis
atggtggcagagaaacaacaggagcgtcatactaatgataagaagcgaaagttcaggcgtccctttcaaaggtcaccaacgaatggagctcaaaagagcagtataggcaaagaaaaggataaaatacacaacagatatgtatccacaaatgcaaatactggcggaggtttgcatgataatcacgtgaatggcaatataagtaggaattctaaggacgtgagtgaaagttctcatgagattgtaagcaatcacaatggaaataaagaacacatgagtaacaacgaatcacgtctaaatagcaataagcatgtcaacaatgttggtagttctaacaaaaacttctctattaacaatggaggtgttaaggaccaatattatagtactcatagagataactctgataagggccaacactctaatgttactaataataatagcacttatattacaggaaatgatgacaattctaaacccagccatgcaaagaataataaacccgaaaagatacaaccaaaccatcatcaacaacagaatcatcaacaacagcgtcagcaacagcatcatcaacagcatcatcaacagcagcatcatcaacaacaaaatcatcaacaacaaaatcatcaacagcaaaatcatcaacagcaaaatcatcaacagcaaaatcatcaacagcaaaatcatcaacagcaaaatcatcaacagcaacatcatcaacagcaacatcatcaacagcaacatcatcagcaacaacaacaccagcaacaacaccagcagcaacatcatcaacagcaacatcaccagcaacaacaccaaggccaaaatactacccaacatcccaaacaagttagtcagagacagataccatctaacttccaacaaaagcaccagacatactcatcatcgagccataacagccaccacgaaggtagatacaaccaagatagaagaggaagaggatacggatactcaggaaatagacaacataatcatggaggttcttccggaggcggttatgatctgaatagaaaacaacctcccccatctaactcgggtggaggtgcaggagggactttgcacaactctcaatctaaacttaaccaacacaacaaatctcagcaacacttccaaaatggcccttccaataatactgctgttgaaaataccactagcattagctcagaagtagaagcgacatccacctcatctaaacccgcaaatactactgtaatatcatcaacaacaaatacttccaatattactaatgttacgcctcctactaccacaacaaaagatgaaggaggaaaacactattcttctcaaaacaacaatggcattagtacctctagaaaggatttccatgcaactccaaatagaagaggaggggattctcactactatgggtatggcaggcaacatggcgctcgagagcactcaaactaccatcagcacaaagacagtattggtaaaggaggaccacatggaggtcaccaaaaagacaataatgacgcatctctcaaggaatcaagaacaatttcacacaagaatttttcaaatgggaagccagggtctggagcaacaacaacaacagcagtaataggctccgaatctgaacataatcttacaactaatgttgagcaaagacaaaagaaccagcccataagtcaacaacagcctcaggctcaatcacagaaaccatcccattcacaacagagcaataattctgattttattgcagaacataaggatgtgactaaagatgactaccctagtactcaaaaagccaatacagatcataatttgagatcaaatattccttcaaatagtcacaaccaatacagtcataatcacaacttctctaataatggttcatggaaaaatcaaaatggcggggaccacacatatgggcgccatggtagatattctggaccaaagaatgtgggaaagaatacaagcgcatgcaatggcgggccaaaccagaattttgttcatccaaaacattcaacagagggtagcggaggtcatatgtatgggcagaatgcagtaggtggtacaacttcggaagatctaaaaaagaagaagaacaagaagaggtttaataagaatttgaggaatatcaacaaccaatcaggagggactaatggaggtcaaatgtccactggtcaccaagttggcgggcatcccaaagaaagacctaaatatgtaactggggatcaacagaagacacataacggagatgtattttcatcagcttcgccaaatgaaaatgaatccaagaacatatcaaataaggcccaaagtggagttactcagcacccctcaaatatagaaatgagtttagagaaagggaaatcagttgattctagaaagaagttatctacagcttcaaatgaatcagagaatactggttctgcaaaagtgacaactggatcaaattccatgagtaataagttatcttgcaagggatctgaatacttggatggaaataacaaatccgctgattttaatatcaatatcaatattaatgaaagctctattgttgcagagaagaacgacctaaaaacaaacagagatatcgaaggaagagagaaattagaatcgtcaattccagcttcagagaataatgagggaagttctaataatactggcggtagtggcaatggtaataatatgactcctactagcagcagtagtagtagcaatagtaatagtaacagcaacagtactagtagtagtagtagtagtagtagtagtagcagcagcagtaccagtggagtagttggaccatggagacgaagtttacatggaggccagactgtcgactccttagaaactgtaaggagagctgtgaaaagtctactgaataaaataactgtggaaaagtttacagtaatagcagagaagcttgctgtatgtattgatgagattaagaatgtggatgagctagaggaattagtgaagcaagttttggataaagcaataacagagcctgatttctcagagatgtatgcagatttatgtcagatacttaaatggaggagtccagtactcgtgaataaagatggaaaatcaacaattgcttttagtaaagccctgttggcaagatgtgaacaagaatttaagaatatgcctcgaaatatgactccaacagatgaagagcgcgagaaatacgattcggaggagctagcaatattgtataggaagcgaaagttacatgttttagggataatccgactgattggagaactcttcattagaaagatgttcccaatgagaagtttgaatgaactagtatttgatctagtaatgatacaagagaatcctgatgaatatgctgtagaatgtctttgccaattgattatgactacaggatattacttggattctaatgagaaatcacagatgattgtggatcaatggtttggaagactaagagaattacagaatacatctatttccacaagattgaattgtttaatccaagatgtttttgaccttcgaaagcataagtgggtcaaaaaagttcataaacaaaaagccaaagcactggcagatattctgaaggatattgatgtagaggatgttctaggtggagcagcaattgctgcacagtatggctcagttgtagttgttggagaaagatccaacctcgttgggaattctgcttattataactatatgacttctcaggaagagctttacatttcaaaacaaaagagcttgcaaaagcaataa

SEQ ID NO: 827 - DNA, 735 bp, Cryptosporidium hominis
atgcattcttcaaggaattctggagatattccagatatggctaaaaatagcgtgctattacatagcgaaccaattgatgataatagtaggaaagtgttgggtccgtctaaaaataaatttacagatattacaatcaaagaatactgtaaggatattaaaaagatgggattccaagctacaaatattggaagagcaattgatgagattaataaaatgttaagttggcgtttatcagatgaaaatattgaaccagatgaaatagaaccatataatgatttagaatacagaaagaatgtgaaatgtacaatttggttaagttttacatcaaatatgatttcatcaggacttcgtgagatatttgtgtatttagcaaagaataagttgattgatgtaattgtgacatcagctggtggcattgaggaagattttattaaggttttagggagtacatttcttggtgaatttaatcttaaaggtagtgaacttagaaataaaggttggaatcgaattggaaatctactagttccaaatcaaaattatgtagattttgaggaatggatccagcctctatttgatgaaatgcttgaaatgcaaaataaagattccataaactggacaccttcgaaaatgatccattttttgggtgaaaaattaatcatgatgaatctctctattattggtgctacaaaaataatataccagttttctgtccaggaattactgatggatcattag

SEQ ID NO: 828 - DNA, 375 bp, Cryptosporidium hominis
atggagcagttcttacagaaaattggtgttggaatgttaaaaagaaaagtaattaataaaggcagctacaccttaaaagttgaaatatctaatgaaaaattacttcttattaagatagagccattttttgggcctacacaaattctgaactgggatttgtcaggagaaatttttatagaaaagaaccctgaggtgggaatatggagaaatagagttgagtttattgaatttaaacatgaaaaaaccaataatcaacttgttactgcaatttgtatgactcgtgaaagtgaaaatctacctggtaaagttattgaaacaagatggacacaacctggggataaaaatactaaaattaagtttattagatacaggtaa

SEQ ID NO: 829 - DNA, 276 bp, Cryptosporidium hominis
atgtgtgattgttttacatttttgagacagaaggaggattatagcgagtttaggacctatgactttggagaacattttgagataagtattacatcagttgaatctcctggagatggccaaattagtttggatggtactagtacactatatgatgaaattatgttttgttattcccagttattggagaatgatgattataatttgtatgtacctattgaaggaaatccaaattgtaagttttttatacatctaattcttattcttcaagcttattag

SEQ ID NO: 830 - DNA, 423 bp, Cryptosporidium hominis
atggaagcagccaagaaagctatggaagcaaagaagaaggcattacaagataagaaagcaaaagaaaagccagcaagcaaatcttctcttgttttggatatcaagccatcatcattagatgttgacttagatgctgtggctaaaatgatcagagcattaaaaattgaaggtgttgaattctcagagggtgaaaagaaagttcctgtagcttttggtcttttcaaattacaaatgggtgcaactattattgatgatttagtcaatactcaagacattgttgattcaattgagactctcggtatgactgatgaacagaagaagaagttctctgagaaggatgatgcatgtggtgatgatgatgaagaagaggaagagtatggacttgtccaatcttgtgagattgtcagtttcaataagctttaa

SEQ ID NO: 831 - DNA, 1482 bp, Cryptosporidium hominis
  misc_feature (107)..(107): n is a, c, g, or t
  misc_feature (151)..(151): n is a, c, g, or t
atgaggtctacagagcaagttaagctcataggtaaattagcatcttctgagcatacttcaacagcagagaaacgatctaggatattgagtcatgcaccacactgganaaagtatgaattagctggcgcacttcctgttggttcttcagtanaattaatggcattacataatcaatcgcttttggtaagaagccagttattaagctcagacaaacaattgcgccaattagttttgaattgtttaggcataacaccagatttagaaccagctcagtatattcttactatgatttatgaacttgtaagagatgatgctgggcaatatcacggttttgtggaaactaccaaaggaattccaatttttgaaaagtttatgcaatttttagaacgtcccaaagttgatagttacctttctgataaactcttattcttcttgtctggcttaattagccattccaatgatggggcttacacaaaagagaacattacagaacttattgatcatttatttaaaacaccagaaaatagaagaagtctttcaggagccagtcaagatgattcttcatcatcctctatagcatcaagttctaatgttaacagaatggaaagctcttattctactttaaatggaggctactgttctgttataggtgcattggatgttcttggaaatttagtaaaagttgactcatatagaatgcttgttttatctcatccaaatgttgttgaattcatttcctcaaatctatcatcaagctcacctacatcccatatatacaaagcatgtgttattgtatggttactttcttttaatgaagaaactgttcctattctagtttcaagagaccttattagacagattgctaatactattattgattgtagatctgaaaaagttgttagagttactcttaatttacttaagaatgttatgaacaatgatgcagctattgagagtataattgatttgggattattacaatatcttactattttagaatatgaaaaatggctagaccctgaaatctacgaagaaattcgtcaaggacaaataatgatcgaccaaaaactcaaacagttctcaaattttgacagatattgcattgaacttgaaaagaaaaaattcaagtggtcatttttacatacagagaagttctggcttgaaaatgttatgaattttgaatctgatgaatttgctgctattaaaaagcttgcacacttattgaagacttctgatgatcctgttactcttgctgttgcatgttttgatattggtgaatttgccagactctatccaatgggtaaacaaattcttggaaagttaaatgttaaggaggtattaatgactcttatgacttctccaaatcgtgaaatttctaaagaggctttattatcaatacagaagcttatgcttaataaatggaaccgagccaacattggcagtaattctgggtctaatacaacaaccacagtcaaatcctag

SEQ ID NO: 832 - DNA, 96 bp, Cryptosporidium hominis
aatgaaacttgctattattaccttttcagaaaaggtgttacagataatgcattaagatcaccacacgttattatgggaagagaggttaattgcaga

SEQ ID NO: 833 - DNA, 1758 bp, Cryptosporidium hominis
atgttgaactatactgtaggatctgataatttagaaaatggtatgatctgctactatggagaagatgaggtaattggtgggtatccaaaaagaaagtttgaagaagatactgaagaaggatttgaaaaaggaaatagaaagaaaaggtatatattgggccaaaatgtgggaaaatggactgatgaagaacataatagatttgtattagcattgaaaaaatttggaaggaattggactttagtacaacaagaggttaaaactcgtactcttgtccagattagatctcatgcccaaaaatactttttaaaaaaggttagagggattgcaccatcaactttgactatggattctaagctaatttctacagcttctgatggaattgttccaacatggcttcttcaagatgattctaattttgctaataaaacttcaatcagtgcaagtagtaacatcaacccaaataatacaatggtcaataataatggagtgagtaattctgggaaaagctcaaataatattggaggtatgaatctatatatatataatgaaagctcaaatccagatttgtctataattgatgaaccaattaacttagtaaatgtttgtaacaacaataatttagagacttcaaataataatggcaacaataataacaataataataataataataataataataataataataatcacaatgacaatagctgtataaacgataatattaataacaatataactgggaactgtactagtatggataactcaaatctggtaataactggtggaatgattggtggtatgaacattcttggaaaccctattttagaatcgggactttctccagatgtaagatataataactatatgggtaatagcttattggttgatgaccagagagaccagtgtatttatcatgactatagaacaggtttaatagatcttaagactgatgtgacgcctaggcttgactatagtcctcagggagggggaggtttaatttctaaacaaattgttaatgactgtatttttgatgatccttacagtgataaacgtgtttctgtagattctacaagtttggtatcaacagcagtttctagccctgcctccattagtccagaaaagaattacattcctgcctcatcaatgggattggatatgctacttatgcctcccacggtggaaatggagcagaatgatagcaaccatcagaattcttttaaaaaaggttccaatgtatattcaaataacaaaacatgcaatactaacaataataatccacgttgtaacactccaaatattacaagtaatggaaataccaataataataatacattgagagaggacaacttaggaataattccggaatctttaagctatggactcaactataactttgaggacaatgaaaacattattaatccttccatatctttgtcaaactgtgatgtaccctggccattaacaggaggtgaccaatttcttcatttcaacgagagtgacaatgctatctcatcttctccctcagcctcttcttcaatctcttatttagacctggactcatcatctgaagctaaacattattcaacaagagtatcagcaagcccaaataagcaacaatatgacatgggaaatacgttctctgactttgtttattgtggggactcccttggaattgacctcttaaatgtatacaccaatttgagagactcttcaagtcctatcatagataatgccgatgtcactgaatttatttaa

SEQ ID NO: 834 - DNA, 1350 bp, Cryptosporidium hominis
atgaagtctttaaaattagtattaacaacatttttagtattaacattatctcttcttgcagggttcgtatttgggactaatgaaaaccctaattttttgaggcttgtttcagataaaaagatgtatgatgaatggctcaaaacaatgacagtaagcgaggagataattttggaaagatttggaagccttcttgagattattgacctagacaaaaatggccttttagaaaaggatgaactgatgaagtggataaaatttgtatcagaaagatcaagtttaaaagaagttgaagcagaatttagaattttggacaagaataaagatggtaaattatcaaatgaagaatttatcaaccattttgtgtctgggaaagatgaaagttcaaataaagaaataacagagttgaataacttttaccgtgaattattcaaggaagtagatactgataaagatggatatttaacagttggagaatattactatttgacaaattactatagcttatcaaaggaattatttgttaagataaatagctttttatctcagaatgataagaatggtgatggaattattgatattgaagaaattaaacagattcaaaaggataatgctgaagttattaaaaatgactctggtaaacttgttgtctttggagttgatatgtctggtgagaaagagctttctgttaagaagattatctttttattaagatcccaagagatacaagatgcaatcacagatgcatataaccagttgatagacgtgtataatactagaaaagatgcaaagccagaggattccaagtcttcttcaatccctatagattttgtaagatccaattatgtcatttatattcaatcaatattaacagattatggagatgttttcaaatatccacacgatatttttgttggagttgataacaaggattatgacttatcaaaagaaaaatgcacagaattatttggtgaaaatgaaaaatttgctgaaaagtctgatgaagaaaatgaatttgacactgatgaatttgatgctgatgataacaatcctaatgacgatgttgagatctcagatgatatgattcaaaagcttatttctttaatgggtaactctggacttggtgatatggatgataaaggtggtagtatgtttgatgtatttgctagtaaggcagaaggagcagaaggtggtgatctagcaggcatggaggagattcttaaaatgctacaatcacttatcggctcgaaaatgggagagaatgaccatattcctgatgaaaatgaaactttaattccagatcatgaagataatcaagaatttccttcgttagaagctagagatgagttataa

SEQ ID NO: 835 - DNA, 441 bp, Cryptosporidium hominis
atgcacaatactttaagctattcaaaaaagttgacttctggttcaggagcaaatgtctatcatgatgacagaatcaatagattaagtcagagactaaatagtattcataatggattagatttagacagatctacaaaacattatgataaattagcagaaatggaagctagtatgaaaaaatttgaagatgatatgaatagaaagtatgatgaaggaatgaaaaaggtaaatgagttaaaaagtactttaatgagcctaaaatcagaaaatagagagatatactcgtcttattgtatggatcacgaaactaaagctaattctattgaaaatcaaaattacttgaacccaaaaagtgatattttacaagcagaaaggcgacttaatgaactacttcaaagcgagatatttagtagaaagtctatggagcaaagactgattgaa

SEQ ID NO: 836 - DNA, 732 bp, Cryptosporidium hominis
atgaaatttaaacaaagaattttacttatattcgtttatttatttgtgattcttcagatttatattaaattcgaatttgccggtgctaattctgttggaaagcttggatactatgattacaatgattctaatgcttctgataaaaaacgaggaaagttcagaaaagatcctagtattgaattaaactttatgaaatattttttgaatgtaaataaggaaatggaattaataaaaaaacaaaacaatacttcaataaatactccatttatggactttctacatgttcctttatctcagagaactattccgaaatctgaagaagtttgctcttctattcaattgatgtcattctggaagctttataatgatgtttttgatttggttgaatcagagtttaataatatattagacttagaactagttcaaaagaaagcctcagaagaattatatgaaaacagcttaatattaactcaatctgatgaaatcaaacaagatatttccgaagaattaaaaaaaattaaaaatgagacttcatctactaacattatcaatgaacacagaaatcttatggaagatcatgtaaaaccacaaagaaatgctaccaaaactaacaaaaaaccaaataaattcaaggatagttatataaacaaaaaaaaacaaacaaaaaattataaaaataaaaagataaaaacttttgaatttggccttcacaagtattttaacttgaattaa

SEQ ID NO: 837 - DNA, 450 bp, Cryptosporidium hominis
atgtttagacaattaagacaaaatccatcagctggaagaatgggtaaaagatttacaagtttagaaggttcaaatacattaatattacaaaaagatgatgcttccaatcttgatgatactccaaataattcgaaaaacaagaaatctcaaggcaatttaaattcatcgcttcaaattatgacagatttgaataaaataccaataagatttccgtggatattagaagaattacctatagctcaatcttttaagaatcagtttctattatttaatgaaaattcatctttaaataaaagtgaatcaaaggaggaaaatgttaagaaaacattttatcaaaaagctaagggattatctaattctactttaaggcaagaaaatatagttaaagcgattgtaagtaatagaggaattgcaatggtaagaaatattacaaatgtaccagcagattaa

SEQ ID NO: 838 - DNA, 639 bp, Cryptosporidium hominis
atggaaaaacatggatatattccaatacatgttaatcttaatatttcaaaaaattgtaattcaaaaaagaaattatattggactaaaagaggacctataaaattctgtattgtttgtggagaaaatatacaaataaattctgatttttttgatagacttcaagtgccaattcaaatttctcatattgaattaaagaatgagaattctatttcaaattcaggttcaggttcaagttcaagttcaaattcaattccaaattcttgtttaatatcaaactataaagaatataataatattattccattatttaatttcccattaataactcaattaaaaattttattaacaaaaaattataaatccaatgaaattgaaaaaaatatattggaattatatcagaaatttacagatattactgttaataatattaataattacctttataattatattcattcttttggcaattcattattaccttttattgatacttatcaaaatattccattaatttcaattggattaatttctttatcaagttcaaaattaagatatattcttcattgtattttaaaagatattgaagagaatccaaagattaaaataatgattgtcttcaagtttatggccaccaattag

SEQ ID NO: 839 - DNA, 2466 bp, Cryptosporidium hominis
atgattagtacatggttggtaatattttttatccatttgatattttcaacaacttttataacaacatttgtattattgattttaattaatgcaagaattagacaatatgcattaatatggatgacatggtgcttatggttattgggctcatttctattttcgtttgggagggtaatgctgggattatatcatatatttagaatatcaataaatattatactatttatatggtctagtttattattaagattaagtttatggattagaagtttccatacagcaagagatgaactatattacaaattagaacaatcaaatagttatgatgaatggtttaatattggtactaaattggatgagatttgtggtggatatgaatggagatcaattgaggagactgatgattatcaatggatttatttaaaggagtatataattaggttgaaagaagcaagaaagaacaacaatttgaagaaattggtatttctattaagatggtgttgtgataggaattttgcgtcaatatcaaaacaagcattatataacaaagcgttttctggtacaaagattctaatagatgaatttgaggatgagattgagaatgtattaaagtttttgacaatgtgttcaaaatctccagaactttcaatagaacttgagaatgctttaagtgatagaaatacatataaactttcttccgatcaggattcaagatcaaattcaatagaaagattgataagcttctcaaaacaatcaagtatttattcaagtagttcattattcaataaggaaatagaagaaaattcaatgaatttcagtatggaagacggtgatgaaagttttgattttgatgatatagaaaggcttttagaggaagaaaaggaaaactcgaatagtgattcaattaaagaagagacgaaaaatctttacttgactagtaatgagcaagaactttcaagcacaggaagaataaataataaaagttcaactggcagaatatctttaaaaaatagagatttaatgaatacttcaatttcttctttatcagagtttagaatggagaatatgtcaaagaatgtttctattcaaacatgtgaaaaatgtttggcaaataatgaagaaaataaagtaaataaagacgaattaaattccggtattaataaagaatgtcattgtagggaatatgataatgatttacaagtgatcgatagtgggtttaatatttcaaaggatgttagtgatagatggaattctgattggggttattactatgaaaataaagtaagaaagaattatataaaccaatttagctttgaaacaggcactggatcagttctaacattttcaaaaagtgaaggctcgttagcaagtaatagcttaattcattatttagaacttttagggcattcaacaggtaaaactgctttatgcttaagtggaggaggagctttagcaatgtatcatttgggtgttgttaaagttttattagaacaagatataatgccaaaaataatcaatggtacaagtggaggttcaattgttgcagcaatacttgcaacaaaaagtaatgaagagattttaaacgaatatattaaaccaacagtttcaaatatgcatggtcatcgttggtttcctccattattagatcagatccgtcatttcctagtaaaaggttatatgatagatccaaaagaatttattaagacttgtcagacttactttaagaattatacattctatgaagcatataaattaacaggaagaatagtaacaataacagtgagtccaacttatgtaactccagaatttactgagccattagttttaaattgtattactactccagatattttactttggagtgcagtttcagcttcttgtgcattaccaggattaatgccagtagcagaattatttgcaaaagaaaatcataccaataaaataatccgatattttccaccaggaatgaaatggatggatggatcaatttctcaagatataccacataaagagttatcaacattatttaatgtacgacaatttattgtatcacaagtaaacccacatcacgtaccttttgtttcagtaaatccaataaatacaagcataattcacccagagcgtacatttttacataatgttttaaattggttaactttagatattaaatataggtatactaaattagcaaaattgaaattaattccaaagttatttggaaaagatgttagcaatttttggatgttacaagaaattgaaggtcatgttactattactccaagagtatccctttttgattggtataggtgtattaatcatccgtcatatgatgatatgcttcactttataactgaaggtgaaaggagaacatggccacatgttatgagaattaagcatatgaattttctagaaaaaacgatcaaggatactattcgtaatattaagtatgggtccaggagaaaataa

SEQ ID NO: 840 - DNA, 585 bp, Cryptosporidium hominis
atgccacatctttcattgaattctggtgataatgttaatgtagagaaagatggcgaaggaaatttttcaagccaacttaaaataattgcgaatctattagaaaataacgcaataattaattggcttccagaaagctggagagcttactgtttattcattggagaaaatatgatgaataaatcaagtaaatttaaatattggattttggttgcaattattctgataggtcaagttccacaatggattattttgctatttccttcttttatagtaaacttgattggatgtatgatatttggatatatttatccattgataatgagtttaagaacaagcagtaatattggaattagctattattctctaaacaccaaaatgggtgaaaagctacaaacatggataatttacttgattatcttcaatgttttgaatgagatattctccatgagtagtatcccatatgtttggaataattgcttggatacctttcaaaatcacatatattatttgattatccttcttcttcaactcacttcctctataattccaattcttaccaagcaagtcaagtttaagaaaaaatag

SEQ ID NO: 841 - DNA, 645 bp, Cryptosporidium hominis
atgggcgagcttaataatgatattgggattatttgtgtagtatatacagaaaatggagtattttccaatggaagattgtctgaaattctcaaatcaaaattagaatttgagtatttgaaagcaaattcaaaagaacaattagataataatgaagacgatcttctcaatattttgcataataaattgatgaattatgttaaggtctacaaaattaacacattggaagatttgaatatttttctacaaagagttatacccggtatttgtttaaatcacaaaattgatgcgatcttcattgactcgattacaaacttataccgttcaaaagtttctttttcagaaaatagttcagcatctacaagcctgatacaattttcaaatgtattcaagagaatttctgtagaccaagattcctggctgattgtaactaaccaaactacaacagaacttaatgaatttcacatacctgggagtaatatatttggaaacaaacaaaaaccaagtttaggacttatttggtccaattctattaattggagaatatttctctcaaaaagcagatccccttctttagagaaagatttaaatatatcatacagagaattaagagttgagctttcatccgagatcccaaaaattaagtaa

SEQ ID NO: 842 - DNA, 1089 bp, Cryptosporidium hominis
atgaattttggtggaaataataaaccttttggaggatttggaatggacgatttgaatgaatctggtgggtttatgattgatgggaatgatagttccatgcaaaatggtaatgaaagaaaacaaagtgtaggaaacgaacagaaattagcaccattaaaagttggtatgattcttcgatcatatagcaattttgtaacattaagcagatttcaactttttgacaaagatattaacttgttcaagttagtaggatttgttagaaatgttgagcatgatgattatccacaaagactacgtttttatttagatgatggatcaggattaatcctaatagactggctagtagataatacagggacaaagtacaaacaggatttggtaaattctatacacgagggatgctttgtaaagatatttggggaattgactttaatggtttcggaaccatcagtaagagcttttgtagtgcgcccattagtatgtactgatgagatttcattacacgatattgatgttgcaagctatatagtaagaagtatgtatggcaatacttatgattcaggaaaagtacaactttctgactctaacgtaataattaacaaacaaggatcaatgaattacggaggtgcaggagattctgtaaaggattcaaatcaaagtattgtatcttcaatgtttaacttaagcggacaatttggaagtaatagcaacaataatacgaataacaaaaatgaaggtaactttaataattatggaagtaataacaactttggtaatgaacagaatatctcgatgaataaaccaccaatcagggtagtttcagctattgcaccaaagtctaatcaattcagttcaggagctggagttcaaagtaaccctctaaagttaagagaaatcatttcctctgtattagaccaagcatcaaatgaaggtaacccagaaatgactattgatggaatctttgactctttattaacaagagatgttcatgccacacatgatgacattaggaatcagcttaagaatttggttggagaagcaaaagtttatcagaccaatcctcatacttggagagctactggatattaa

SEQ ID NO: 843 - DNA, 1815 bp, Cryptosporidium hominis
atgacagatttagatgaatatttatcaacatccctgagagcacaagaaaattttgaggaagaaaaggtaataaaaattataacttcacatggagtaaatacatccaacatgaatttacttttaaggaaagaaaaaatgcttgatggaaaagtaattaatttaccaatacctagacgtccaatgatattagtaggaccaaattgcaaaactaaaaaagctcccaatatggaatatttggacaacttggaaaaggaagcttttctaacttggagaaagtcaatagcagatgaagaggaattaacagggttatttgtgactccatttgaaaagaatttagaattctggagacaactatggagaacaattgaaagaagccacgtagttgttgagattattgatagtagagatcctttatttttcagaaatgttgatttggaaagatacattaatgaaatagatcctttaaagaaagtagttttacttttcaataaggctgatttccttactttggaactgagaaagcaatggattcaatactttaaagacaatgctccaaatctcaaagtttattttttctctgctttaaatgaaattaataaaagagaacatcttgaatcttacatacctgaggactttaatttgaaaaatattaatgatactgatgtactttcaactcatcaattaatgtataaactttatgagcttgcatcagaagttttccaagcctccaaacaaagatacctagaccaaaaagagtacaatagtgaagaaactaatgaaaccactatatctagtattcaaaacgatgatacggaaaatggccaaaactccaatagcagcgatgaagaattagacagtgggaaaaaagatgatgatgatgatgaagaagaagaggatgactttgaagatgaggaaagtgatgaaaatgaagaattcaaagaagatgaagattttgaagaaaatgagaatattccaaatagtattttaaagaataaatcaaaagctaaaactgactctgaaattttcaaccatgtaaaattagacccactgaatccaggagagttgacgataggtatggttggattcccaaatgttggaaaatcttcaattgttaatgctctttttggaagccaaaagtcttcaataagcagaactccaggtaaaactaaacatttacaaactcttagattaaagcctcctcatttaaatgataaagaggaagatcaagattttattactttatgtgattgtccaggtctagtcatgccttcttttacaagtacaaaagagcatcttctaattaatggtgttacacctattgatcactttagaggtaattttctagatacaattcaactaattggagaaagaatcactgttcaactttataaaacttattttgatggaattgactatcaagtgccaagaatatttaattcaactcaatttctaaataagctttgtgaaactaggcatctgtttcaacaaggtaaaggagcaattccagattggagtaaagctggtagaatgattctaagagattactggtctggaaaattgttatattgtcatactccaccttctaatactaagaatataataggctcagatcctattaaattaactgaatcactggacaaagttagtattcatgataatgacgaggattctgatgatgatattgcaatgctaaaatcatcagtattaaataatgacattattaatccatctgacaaagagaaaaagaaaactaaaagacaaatcagaatggaaaataaaaaacttattaaaggaagaactgtatgttattcataa

SEQ ID NO: 844 - DNA, 348 bp, Cryptosporidium hominis
atggaggattcattaaaattgcagattttggatatttatgccaagttaataattgtagtttctccttttggagcgattttctttatattgatgggaattttaatgctcaggtctacattgattatagaaggaattcctgtaggatcagagaattattcagattctacactagcatcattgatagcaggagctagctttttggtgattctaattctagctcttatttatagatcatatagagcaaaatcggctgctaaaaaagtagctaatgcacaaggaaatcaagaaaacggttataactacattacgggcaacaacgagggtgtagtcatctcgagctcggcatag

SEQ ID NO: 845 - DNA, 237 bp, Cryptosporidium hominis
atggatgaatcgtctatacatttacctgtaataaatacatggaataaacaaatggagaaagttaaactattcataaagcaaaattctaacatagactttgatgatatagaaagaaaatttcttattttacaaaaggaaatgactgatgaaattaaaggaatgctctttgcaaactataaaaacattgattttgctcaacaaaaagtaagtccatccaattttttcttattaaagtaa

SEQ ID NO: 846 - DNA, 276 bp, Cryptosporidium hominis
atgaatagactaataacagagaacagattattacttaatcaacttaaagaaattggtaaggaattgttattaaagagtgaacaaattcaagaaaaaaacgcaatgatagacaaatatcagaaagaaataaggaaacttgagttagagcaaactgtgaataaaatccaagaaaatatggacaaagatcaaaacttggagcttgtatccaaactcgaaaatcaagtttttgcacttaatcagaaattaaatattattagggatacagttaacaattag

SEQ ID NO: 847 - DNA, 2295 bp, Cryptosporidium hominis
atgattaatggcttatatggattaattaacactggtacttccatattgaaaggaggtaggaatccagaaattggattggatgaaattcacaaaaatcgaattaaaaatgaaatagaacaacttaaattaaaccaatgcaaattggaaaaatgcagggacaatctgacattcgaaaataaccgttaccatacgcaatattgtcattttcatgtcaataatgtaactatgtatgataaggagagtaggaagaattatgttctaattgatatttcaattatgatagaagatgtagatacttttcttaataatgaaatccctgtacaaataatactatataaagactttccatttagccctccagatattacttttccaagtacattttgtttcccaagtctaagtgatgggcgcagttttacagcagaaatccttcatgaatggtcaccaagtattaatttattgactactgttgattcaattataaagtttttaaaaagttatagtactcatattgcagttgtaggcccttctgatatgtttataggaagctacagaaaccccatatcatttaactaccaatgctacaactctttggtatacccaattctgggtaccaaaatcatctttgaagatgacgtttttaaacacatttttgaaaataactctattaaagaacaaaatgtgatatcccaaagaggaagaaatctggtttcatcattcattccaatccccttaaatactagaggacttagacgagaaactatgaattggagaattgaaaagccatgtattaatattgattttgtattcaacaatacaaatgtgatgttattcgattccactatgctgattttagaagtttgtcagaaaaccaagcaaaatgggatatttcaaacaaacaatccctccaaaacttcttcatcttctgatgaaatcatatcagactccactttgcaaggtaatgtagcatattggttatatatgcctgctataagtcacattatcgattgtaatggcaagcttatttttggaaaccaaggtactctcccagaatatatttcaaataaactaagtaaacacgaatattcagaatgcctagttatagtcttaggttatgacttcctttttgagaaatctcctatattgttttatcaaaatgaagagttaatccaaactcctaaagactcaactagacctatcatcatagaactaaagtttcatactaccaaagctaatcatgaaagctcttgttgccactcttttgccacaaacttaagagagaaggttgccaaattagattctaatttcccaaaaaactgtcataatccaaaatggaactcctacttcgagtttgattgtctttctaacttgaataagaaatatcaacaagcaataactggaaatcatatatatctttcatctgaaattatacagagatgggttgttatatgttctaagcttattgaacaatcttcccttctttctgaaacagacgataaatacatacaagaatcatcttcattggtaaagcagatgcaagacatactagttagccctgttgtaaaacacattctaaactcgaatacaagtaagccaagcaaggtcagtagtattgatgaagaccttcaaaatgataccttttataagtatctcgaggaatactctcctgagaacccctccaaacatgaattatctcaacaagagtctcaaaaagcggaaaccccacaccaacaggatatccaagaaaaccaaattctccaccccattcatgaaattcagccaatacaaaataatccgaattttatgaaaatcacacacatagatggaatttcaccaactcaagaaattctacacattgaaggtaccacacatactcaagaaattcctttatcacatgaaattctaaccatccaagaaacttctccaatacaagaaattccacccatccaagaaacttctctaatacaagagattccacccatccaagaaacttctccaatacaagaaactccacctatcaatgaaccttttcatacccatccacaactaattaacctcgacacttcctcagaaactgaaaatgataaccatcttgatgaatctaccaacaactatggtgaaacatcaaaatcatgtgaccaaaatatgcagatcatccaaccatccaattatagtagttctctacaaagtgatcatcccacatctacagatccaaaccaaacatatgttaatcaaaactacataagtctctatgaatctagtagtgatgaattcagtgttcgtgaatttgactaa

SEQ ID NO: 848 - DNA, 519 bp, Cryptosporidium hominis
atgccaaacccagttgtatactttgatatctcaatcggccaaactccagccggtcgtatcactatggagttgtttgcagataaagtaccaataacagccgaaaacttcagagcactctgcactggagaaaagggaatgggacaatcaggaaagcccctttgctacactggatcattcttccatcgtattattccccaattcatgatccaaggtggtgattttactcgtggtgatggtactggtggtgagtcaatctatggctccaagttcagagatgaaaacttcgtctacactcacgacgccccattccttctctctatggctaatgctggcccaaacactaatggatcccaattcttcattacaactgttccatgcccatggttggacggaaagcatgttgtatttggaaaggttttggaaggaatggaagtagtaaagagcattgagaagtgtggttctcaaaatggaaagccaaccaagtctgtatgcatcactgcttctggagttctctcttaa

SEQ ID NO: 849 - DNA, 1023 bp, Cryptosporidium hominis
atgagcttgttatcaattcagaaacctcagggtgtattggaattaggaatatcagagattgagaattcaactaggaagttagtagaaaatgaaactcgaaaatttgaagcatatattgatatattaagggaccagatgatgggtatgggcgaattggagcatgaaaatgagatcttgcaaggggaggttgcgagaattactgaacaattaagcttgagagaattagatatggaatccaaggaaaagaagatttttgaacttgaaaaatctgcaagagattttcaacagatgaatcaagattatgaaaaagagttgagcgagctcaccgaggaaaagaacaatttaaagactcagttaaatgagatgaatgctcagattgaaaagttactgaatgaaaagattacctctgaaaaagtagttcaaggtaatgatgaaaagcaaattgcatcaaaaagcaagtcaaagaaaagaacacaggaagaacatgcagatgaaaataattcaacgaataaagtttctaaagaggctcccactttaaaaaagagtcgtttaaggcgtccacaaaatgaagatagttcagaatctaaaaagagtattagtaaggatactgagtctattattcaagaagagaagttggaaaaggaggaaaatcctttgaaaaatgtgttaggaaagactaatttgggtagactaagagctcctttacttagaaatcgtgttgtgaaagcagcagaagctgcaaatccagaagttgagaatgctcctgaattgaagactcttgagaaagaaaagtcagggtcaggaaagtctagtaaatcatcatccatagaatcaaagaaatcaggtaaaaagacgagcaaagtagcaaaaattgctaagattcctcattatgatgagaatatattaaattctatgaaggttattgagttaaaggatgtttgcagtaaacttcaattggagatcagccagagggcaagaaaatcagatttgattcaatcaattctctcttttcaaggagaataa

SEQ ID NO: 850 - DNA, 492 bp, Cryptosporidium hominis
atgagcgattttaccagagaaccttttccaggcagagtatttgaagaccttggcggagcctttagtatgggatgtattggtgggtttattacaagttttttcaaaggtatgaagtactcctcaaccaaaaaggagatgttttctagcggtatgctttttgctagaaaggcagctccttctcttggcacgagctttgccatatggggtggaacattttcttgctttgattgtttttttgccaaattaagaggcaaggaagatcattggaatgcaattttttcaggaacagcaacgggcggactactagctattagaggtggtcttaagacttcattaaagagcgcaatggttggaggaattcttttaactattattgaatcagtttccattggtattaacagaaagacaattcaaacaccaagacaacaatttaaagaataccaaagatttgttcagatgtctgaagaacgagacaaaaaatctaagatctaa

SEQ ID NO: 851 - DNA, 1179 bp, Cryptosporidium hominis
atggcagaggtacctgtatctgaagatatttcagcctcacaacaaccaccatcatcctcatatagtttacctccacagttctcaaatgaaccagatgtaagaactatggcatctattaaggcgaccctttcaaaaaaagctgaggagcttgtcaaggcagggcagccctatgtaatgactagtttaggcccaattccattgcctgataatgtaagaaaccagattccagagaaatttgttgcagctccagttctggaagaacgtgaagttattgttgcaagaagagaagtacaagagagaattattgaagttccacaaattcaatatgagcataagtttgtggaagtaccacaaaaggttgtggttgagaagattatcccaatcccaaaagatgttgtaagagaagttgaaattcctcgttatacagcaactgttgaagagaaggtcattgaagttccacaaggtgtcaaatttgttgaggttcctgttgaggtccctattgcttatcctccaagaatagtcccagttccaaagccatatattgttgaaagaactgttgagctttctcgtccagttattgaagaacgtcttttggaggtcccacaaaaagtttatcgtcaagtcccatactacaaggatgttgaagtaccttttgttgttccaagatatgttgaaaagcttgttgagattccattccatcctggaatgatgtatgacgaaaacatgctcaatcaatctatcccacctattccacctcaatcacagccacctttcatgatgggaggccccggatctgctccaactagtgctcctttattatctatgcctccaccaatgtatggtacaaacgatcctgaagatgtcgcatctgatggacttccatcgcatcctgcaatccctccataccatatgttgccacaaccacaaccgggtgtaattcctcagatgatcccattggctaattcttatgcagctttcccacttccacaaggtgttggtatgtcccctcatatgttgaactctggcaatactgcgcatatcccaggtaaaacgcctgtaccttttaatccgcctcaacaacctccacagaaccttctcaatggagttaatattaatcaaatccaattccctcctaatcagcgtcagcagtttccataccaattccctcctcagcagtaa

SEQ ID NO: 852 - DNA, 690 bp, Cryptosporidium hominis
atgagccaaaaaatagatttgaatcaaggtgaaagaactgagtcaaaatgtccggaaacgcttaatgaattttctaatatgtacaagcataaaaaaatgccatgtaaatcagcgctgaactttggtgaaaatattataaatatgggagctccaagttttataccagaatatccaacagcttattattcaaacccagaagttatgaatcaaggaataaattcattagtggatacaaaacaactatatgactattcatcccctgtaggtgatcttgaaaaaaccattgaacattacaaaatgagtcatgaagtaggatggaatgcaagtaattctttcactcctacaaattctggttctttggaacttttccaatttgaaagaagagatagtcctgtcgctgttgatgctttaaaaaattacccatcttttgagagaatgaatagtggttttcttggattcggcagaaaaccctctaattcaatattttctattggacaaaaacttgaaagactctcttctaatgaaataatcaacaatatcaatacccttcctgaaattgaaaatggtattgagaatggtattgaaaatggaattgaaaatggagatattcctctcgttgatttggagcaatatacacaattatcttactttgaaaaatatatcaattttaacattgaccaaattaagtga

SEQ ID NO: 853 - DNA, 360 bp, Cryptosporidium hominis
atggaaattagccagagaaaacatttcgaagttgacaaacacgagaaagtacgtaaagaagcacataatgggccgtctttatctaagaaaaaaattggatttttatctcctaaatcattcaagacaaaaagcggattacctttaaagccaattttcctttcattttttctttttatagttgggttatttttcttctatatagggatggctttgttcctttcaaaaaaatattctgattcaacaccatctttgcttttgggaattctttgtattattcctgggagttactattccttttcaatattacaaattttacgtggagtatcaggctattcttttgaacagcttgatatttcctaa

SEQ ID NO: 854 - DNA, 468 bp, Cryptosporidium hominis
atgtcagatcaaaatatcccaatgcctcaatacgcatcaatggttgcaccaccatctgtagtattgcctcaaagtgatgcagcagctccttctacatcgatcttgaactgttgctcagctccccaatcaactgataatggagcagatcccgcattaagtgtaaactctacccctcaaattggaaaggtcagatttgcatcaacaggtacaacaattgtaactagaaatggagttatctcgtttgaagagttcctaaagaaaggtgctccagtcgatcagatgttgattcctcccttcccgcaggtctctggaatcccaatgtttgaagatggaactcctgatatcgctacaatccattcaacatgcaatgttgttaatctttcccaaactaatcaaactaatactattcctcattcagatattggaacagaaactagccttccacagcctgaggattctgctagataa

SEQ ID NO: 855 - DNA, 3462 bp, Cryptosporidium hominis
atgaatcaagaattgattgaaattcatgaaataaaagaattattggatttagatttacatgatagtcagttattcagcgaaattcaggaagaagatgaatctgtgatagaggatttggctgggatgagtgaccattatgaggagagtggagcagaagatattagtaatattattcaaaatttggaggaaattatgaaggatgaattgattggttctaacttggttagtgatgatacagagatcctggcagatctcttgaatgagacaggcgaagctaacatggagcttgacgataacaatttctttattcaaaataaagtagacagttttgaaaatcaggtaggtaattctttgcaaagtttaggaatagatgaaagattagtaaaatattactcagaaaaaggcctaaagaatctttatgattggcagtatgagtgtattacccagcctggagttctacaaggcagaaatttggtatattctgctccaacaagtggaggcaaaactttggtaagtgagttactaatgtataaaagagttcttgaaggtggaagagcagctttagtagttttcccatttgtatctttggtgtcagagaaaagggatagttactataaggctggaggagaagtgtgtggacttagaattagtgaatttcactatggaagtaaaagtccgctttttgaagaatttgacattggtgtagcaactatagaaaaggcaaatgcattgattagttattatattcagcatggaatattatttaagagattgggaattattgttgtagatgagttacacttacttggggatgagcaaagaggatatatactcgaggttatgctaacaaaagtgagactattgagtaagttacaaggcgagggaagaacaatacaaatagtgggtatgagtgcaacattaccaaatctaagagatattggcctttggttggatgcagtagtttaccagagtaattttcgtccagttccactcagggaacatataataatcaaaggcaaggcatatattaagccaggaaaggatcaaaacaaaagtacattaagatcttccgtacaagatacattaagcaaggtaatgagttgggactttcatcaggttaattctaagtttaattcgacagattttgatattgatcaaattggttctagtagatggaaatacccaatagtggatatgagtgagttgttggtaataggatgggaggctttgaaaaaaggagaaagtgtactagtgttttgtccttcaaagtactccgttgagtctacagctttgttttttgctaattgcataaaaggacaattttgtgaaggaattgatatagaaaattgttctaatagccaacagattatgcagtctttaagatctgttgagaggcagagatatatgctagctgaagaaattaggcaaaactcctctctttcaaaaagatctattcaaaataataacactcttattgattgcataatcaaagggataggatttcaccattctggtttatctcatattgaaagaagaatagttgagaaagggtataaaaatggtatcttgtctttactaacagcaacttcaactttagcggctggagtaaatcttccttcaaaaagagtcatcttcagaggtatcaatattggaaaatcttttttaacgtgtgttgattacaaacaaatgtcaggaagagctggtagagctggccagaaaggagcttttggtgagagcttcattctcgtaaatgagactctatcacaaccagggagggaagttagtgaggaggttgaaaatgcattagggcttattactgcagatatgaaacctttgatgagttctttctttactaatactaatggaattaccaggttaatcttagaaatacttgcagttctatttgagtttgatcagaatatatccgtgaataatagagaaaaaattccagataaaggatcatatactggctcaattttggacttgttgacagaatctactttaatgtcttaccaaattaagctttacaatgacttatctcatgaataccttaagaatattgatgcattagaaagagctttaaactatttacttgaaaagaagatgataatgaatagggagaaaaaaacaaacccaatttcaattggaggttatacactaaattgttgctgtactcaattggggaaagctattgtttcttcaggtttatctccttccacaggtttggagctatatgatgaacttagaagaaatatggaatcaacttttttaggagatttgacttatatgtcctacttggtgactccttttcctccaaatgaaatatcaaatggatccaaacccacatctactagtactcagccattttttagattggattggaaagtcctttatgataatattaaagaaatgccaattttagaacgtcattcgttgattagacttggctttgacttagagcagatttcttgggcttctcaactatgcgaagataatcttccaccaaagcttaaagagccagagtttctaagaaggcatcaaagattatttgcatcacagattatgaaatcaattttgaatggattatcaacggaaattattctttcaaagttcaagtttatatctgttagagatcttcaacagctccacaccggagttttgtcaatgtgtatttcatgtatatcattttgtcagaatatgaattggtccaatatgcagattgtttttcaaagttaccttagacaacttcaaacaattacactattagaagaatattctggaactttgacaaaagatcaaaatttggagaagagtgtcaaaaaactaatttctggagtgaaaggtttatctttcttgtcagcattagaactaagatcaacactttctgtgaaaactcccaatcaatttttaatgataccaaagaaaattcttacacaaagtatcaataatagagtatattctggaggaatcaaaacaatgcaatttgtaaatcattttgttaacaaagtttttattgacatgcaaaattctaagagaattcctttttataatagatctttaggattttcaaatatttctccagatttgatttttcaaactattcataccattccagatcttgaaaaggatgagaacttaaacattttgaacttcagtgaaaaacagctgaatgagattgaaaacagttgcattttagaggctttatcagaatgggattcatttagccaacaatccaaggcagatgataataatcacatatcttacattagtcaagaaattcctgaattaacaagatgtgacatgaacaatctcgacttagaaaatgatgagattttagatatgctacaagacgacattcaagacaatattgacttagaagagagacttttgctttggtcaactccattacaacaatcccaagattgggaatcacaaggtaattggaaactaaacaataaataa

SEQ ID NO: 856 - DNA, 1320 bp, Cryptosporidium hominis
atgagatggaaatgggttgtttctagtgtggccacactattaacattgattatctctgtggttaacattatgcaccagtatttgaatctatgtaagcctaaattgcagttatgcatatgtagaattttaacaatgattccagtatatgcaataatatcatatatatcatatttgtttgtggattatgcggcaccattgaatatagtaagagactgctatgaaggatatgtaatgttctcatttttgcaacttttgattttttatatgggaggtgaccaagtcatcttgtcagtattagagagtaacaagattaaggctgaaatatggccacatcatcactttaaccactctctaagtatggttggattggcttcaacagctgggagtattgaatcaaatgaggaagaaatttcagtaaatattatggatatttgcccagattacttttgcgagaaggataacttagatgaagtttctattgatagcgggctccgaggagatgaaccagcaaatcatcatctaaagatcgcaagattctactcttttatcaaattaggagtccttcaatttgtgactttgaagccaatttcagcgcttatttcactttttctggaatctataggattgtatggatctggatcattttcattcaagagaggatatctatacattacagctttaaatagtatatcagtttctctttcagtatactctctgttcctactatatatctcaatttcagagcaactagcaccaatcagaccagtacttaaattcttttgcattaaacttataatttttatgagtttttggcaatctatcatcctctctgttctcagccacttcgggatttatccagatgagccaaactataccattaaacttcataactggctccttacaatagaaatgacagtatgcgcaataatatatggtattgcatttacaatcaagaaagacttcaaaaactacgttgaaagcaggcaagggtacagccaagacgattataacacagataaccttcaagattgtgaaaaaactggtcacaaggatttatttgctggaaaagatagtggccctatgcgcaatgctaactttcctccccaggcttctaccgacaaaccaaacctcacccttaaaatctcacattcgccatcctctatttccaaaaatattaaactttatatatacaggtttacctgcatagtaaaccctaaggatatcatccaagatattgtcagtgcctttaggtttcttaaacaaattaataagtctcctaatcccgaaataaaacttggaaattctggcgccacgttttga

SEQ ID NO: 857 - DNA, 1314 bp, Cryptosporidium hominis
atgcagaaaagaaagaagaaatggaagctggcattttgtaacgctcaagaatgtgtgaatgcattggattatatgcttgaaaatagtttagagactcttctaaataagcaagaaaaacttaggattgcggaaggattatcagaaagagaaaaggagttgaatattaaacaaaatgagttaaactcagctctaaatgaggtagaggaaggtttgagaaaaaccatcgaattgactttacttgagatgaaagaattgtcagaagaatgcagacaccttgaaagagaatttactaaaaaagcctcgaatattccaaatatcattgaaaatttgaatgacaccaaatttgattctgaatacctaggtaagaaagttacagtcgaagatatacaaaaactacagaataaaagaaaacaattactagaagatcttgaacaattaagaaaagatgaagaaactctcaataaagagatacaaaacttggagattaagtggaatgcttatagaaaaagaactcaaagacttgagactgaaatatcacttaaaaaaactgagactaatcaccaggctattcaggtggatgctcatattaatcgtcgtctaagtacttgtaatagtattcgctctgataaagacaatgatccaaatataatggaagtagacgctatacaagaacaaatgggaacaaggaggaagagaagagatagtgttgtaaagtggattggaagactctccatgaatagttcatctgaagagaaaactaatcaactttctgaccatgaattagttacaactaatgttaaagaaggcaccaagattgataactcagataataacaatatagaagatagagacgaagaagttcaaggggagttacaagtgttaaacttactaagtctagtcaagattgagcaacctgaatccgatgaaactctgacctcgaaagctggacctcccagctctacattaaaactcaaagttgatccttcccccttactttcccaatttttggacccaaattttgtatattgttctgatctagaaccaataaatgtagataaagaaaactctagaaaatccaatcaaggacttttttctaagggagctttggatttttcattaaaagtcagaaatcaatgtgatgggagtaaaagccttgaagaaatttctctatgttcccaaaatcaggatgcaacagaaaagtcacttaataatgaagatattgcgctctttaacatttttgttggtgaacttcagagaaatgaaaacatacctgtatcatctattggaaagttactatgcagtacacttaaatag

SEQ ID NO: 858 - DNA, 1935 bp, Cryptosporidium hominis
atgaaatttgatagtagtattaggtccccaattgaggctagacgagaattaaacgaatctataataaaaaagaaaaagtcactaaatattacacagcctaacgagaataaagataattttgagctaaaatcaaaatctgatattcaagcaaactcttcaggtatagttaaggcttcttctaaaataagcgatttcactaaaatatgcggaccaaaatctttgaatgacaattcatcaactgaaaatcaaattcttaaagctaagactcttgatactctaaaaaaagatacattgttaaatgctaaaggaggtatacctttaaaagttgttgaaaaaagtagcacatctttattgggaaaatcaccaattttaaaaaaaagtagcattttgctgaagaaagatactcttactaaggatttttttacaaaagatacccctataaaagaagttattaagaagatgatttcaaaggatttgacaggaacacaaagtaaggatctaccagatttagatggaaaggcaaagagtagtatatcaaaagcatcagagataaaaaagagccctcctgcaaagaagatgaatgatataccaaatactgaagatttggatcaaaataaagaactgactaaaacattttccaaaaattttccaaaagcagtgactacaaaatcggatatattagcaaaatcaaatttttcgaaaaaagtactaccaaaacagttgggaaatgcaaaaccaatgatcattgctaagaaaaaaagtgatgaaaatcctatatcaaaagttattcctatgtctcttccaaatactttagaaaaagatgattacaatttattgatttataactcggacaaatattggagtagtaggctttatgacctatatagaaggatgaagggagaaagttctcaaagagatattttcacaaaaagatatttaaagaaagaaagaagaagactttccacacaaagtgggattgagaaaagaagaattaagacttacacaaggcttagaataattaacgaggcaaaatcaaaaggaagaagacatacactgatatcaataaaaccaggaagcataaaaaggtatggaattccagcactaatgaactattcttatagatatacaaacaaggctttgagctcagatactgagcaaaactatttagttcgcaagctctctccaaactatacagatagttcacatattgaatacatattagaagatacaaatacttatgtttttggaatacatagacaccatgaactcctatctatagctagaaacacttttaatgaggattttagattctgtagaatgagcaaattgtacaaatatgcattaagaactaaaatgagtgatcttgaacagtttgttgaggaggtaatgggtgagatgatcattaatggagatttaaatcaagattcacgtgaaaatgtattggaaaataacattatgagacttaggtacttaatcaatactgacaaggaggagaaacaatctctttctggttgcaaaaacaagagtgatgaagccaatcaactttgggacaaattggttactagatttgatttaaacaacgaattgaatacttcaaataaaatcttaagtactaataatttttggaaagaaacttccaagtttatttacgatgaagaaatagatctctttaaaaaggtttattatttatcagatttacgggaacttggaagtattgatattgatgaatcagtgcttgaaagtatatttaaatctatcagagtatcttacaatagtcaggatttcaagtttccctttattttttcaaaagaaatcagaagttccaagaatgtagggtaccataggaaagactttattagttatgtaggtaaattgtctccttggactaaaatagctttgattcaaaagataaaaaaaaagaacaaatcgatataa

SEQ ID NO: 859 - DNA, 222 bp, Cryptosporidium hominis
atgggcaggaggaataggctccttgaaggagcaagacagcttcatatccgcgaaattaaaatcaaaaatgaaaaaacaataagaaaaaaccagcgtatcaaacaaaagggagaatttttaaaggatgttctcaaaattaataggattgagttaattaccagaggggagaaagctctaagagaaattttaaagaaggaagtagtaaagcaagagataatgtaa

SEQ ID NO: 860 - DNA, 447 bp, Cryptosporidium hominis
atggagaagttaaagttagtagtaccaataagaagacaagagaattctgcatttaagcatatacataattatgatccagaaaaagtagaaaaaattaaggttaaagatgatgtaaatcgacttagttgtgtgaaggagctggctaatattggtaatgatttaaatgacttagttaaaaagattaaaattagaaggtatattggtttgatataccaaatcactattttgaagatccacttatccagacttttaggcaaagtgagaaataaaaaaaaggttagaattttgaatttccatatggtacagcgccattcacataagaagactgatattcattttggctcagctcaaaatcaaaattctccaccaaagtctccaaatagaatggacttgaaaatgcttccaagaaaaccgaataaccaatattttcacgaagggggagtataa

SEQ ID NO: 861 - DNA, 4449 bp, Cryptosporidium hominis
atgagctggtgtgatccatctcatacaattattagtttggaatttgcatatggctacttaaagtttataattctatactttttatctttggtattatggggtctctataggcattaccttcatcttaaggtagaggctgagattccctcatctacatcagaaaaagaagctctgattggatttagagacagcattattggaatttcactgaaatatatctactctgtcttaattttactgtcacaaatctttttgtgcattgtagtttggaatgttgtttgtgcaacttcattcgaagtccagccttattggaccactagagcaaaaacatatattatattctatatgtcaggattgtcgatgtgcctgatactttactttttggaacctttctttgagacatttttttatttaagagagactttggacaagtgtgcttatgtaaaatctaaaaagagacatggttttactcaaactctcagaagcactctcaataaagccttgcagagagaagcttcgagtgttcaacttgaatctaatgatttaattctacctctgttaaaagtccaaaagagagcagataagactagattcgtctgccataaccaagttacatatacatttttagaatctgaatcaggttttgtttgttgtgatcaaagtaatctgaatgaacttgtagggaaagaagggctccttaataatggtctaagttctgaagaaattagtagattgtcaaatattattgggaaaaatactatagatcttgaaattccaggaatatttcaagcatttgctaaggaactactccaccctattaatattctcagattaggttctctttggcaaggaatttttttgagattctatatctgggcaattctttgggctataatgattatttttactacttttaaaactcttaaagtgattatatctaaccaagaaaacattaaaaaggcacttgaaaattacattggacgtcccatctcagtcttgagaaacggaaaaaaggtcagaataccctcccacgatcttgttcctggcgatttaatatttttgtcgcaagacttaactgctccttgtgacatttatgtggtttcaggatgtgttgtagtcaatgaatcttttatcactggtgagtcaaaccctatattaaaagtacagatcgatagaaactcattttctaatattaccagtactcaaccaggtaataaatcctcgagcatgacaaactacgaactgaaaaatcgaacatgttctactttggattctatcaacttggataaattggaaattaactcaaaagatgaatgtaaccctatttctcatgattctaaggttttacatgaagataaaatcatacaaaagcccatttttatgggtactaaaattataagctcattttcatatggtgactactcaaaaatagcaataggaattgcattcagaactggaatatactcttcttatggtcaattgctttacaagactgttcactcattctctaatataagccaatactctgtctcaaacgtaaagtatatcagaaatcttaaagcactatggattattatgctttcatctgcatttgctgcaattttataccagaaccatttacttggttggagtactggatcattcttctttgctgttggaacctttatccagctgttacctctctgggcaccttcatgtattcagttttcccttaataaaagtgtagaaaggcttgtaaatctgttttcattgtcttccacttttccaatggatattcctttagctgggaaacttaaagttttatgtctagataaaacaggtactcttactacaaacaaaatggtctttattggtgcagcaaatgctataaaaaataatagctttggatacccgaataatattgctcatcttttagagaatagcaatccaaatatcaatcttgaacttcaaaaaaataaagaatccaaaagtgttcaatatattgatcataatagaaattcacttaatatttacgttcattacgagctcgtctgggaaacatccaccgtatcatatgaagaagaagatcctctaattaataaatctactggaattcttgtaaacccaattagctctgaacccaagttccttcctccaattattagttccgattctttttctccagacgaccttatttacataggactttgttgttgtcacaatattgttccacaaattaccaacaatggaactattctaataggtaacgatatagacaaggcattattcacttcaactaatgccaaaattaaaatatgcaatgagagaaagttcatttcactcactggagcaaataatgaagactcaggttcagttgataatatttatgaatacccaatcgaagttttgagaattaatgagttcgattggaataatccttgtatgtctgtggtagttcaccaccgaatatttgacagatattacattttctgtaagggatcctttgatgttttgactaaattctctccaaataaagaggaaatccttaccgagaaacataaatatctcaatacttcaaatagtttagaaacagaggatgaacaggagcttgttgatgcttttgaagtccttaactcctctggtgaaatggacagcgacctcttaaataaatacaatcactcaagatccaacaatgttcaaaaacctttaaatcatatgaatgaacataatattgttgacggttacagtaaattgggatactatgttatggcaatgtcttatagagaaattaaagacaaagttttgattgatgcacttctaaataagccaagatctaatgtttccagaaatacacttgaatctgatctaacaatcataagttatcttcttctgcaaaatgatcttagaccaaaaactagagaatttattgattctatcaaaatgtcaggaattaggccagtcatcttaacaggtgactcagcattcacagcactctctgttgctcgaaaagcaggaataatctctaataagaatcctgttgcaattgcagatactattattgacataactggaaaggaaacaatcgtttggtatgatgctattgctggaaataacatggtgatctctccgaacaaaatctatgagtccactgaatataactctttagttgttacatcacgagctctaatgttattaagatctaaaaagtactttagaccttctaattttgaaatgggaaatatgatgggtcctttatcaaactttagttttttaaagacatattgtagacttgagaaattttcttctgaagagctttcttctcattctttgtttgacctagtctttgatagaatcaagatttttgcaaggtcaaatcctgaacacaaaagaatcgttatttcagaattcaaaaagagaaatattgtgacaggaatgattggagacggagttaatgatttacctgcattcaaaatggcagatgttagtatttcagtccatgagaactcgtattattttaacaactttataaataataataattctattcaagaagaatccattcaaaatcatgacaatttcagtattaacacagaaaactctccaatgacattggcattttcttccttctctattgaggctgacaatattatgagagttcttgacctaattcgagaaggtagagctgcaatggtcactacaatttctctttttatgtttctttcctctcaaggtgtattttattcattttacaagaatgttttatttgctattgctcaagctaaccttcctgtaatgatctatgtatttattgacgtatttctagtatttccttctatttggttaatgatcctctgcaaaccaaagaaatacattaactcatacaggccaacaggagctttacttggtaaacgaactattatatcatttctaagcttattgggaacgtgtttctcattttattatattgttatgacaagactactcaactctccttggatgattccttcccttaatcacaatgcagagataccagttgaaagatggtttcaacgtcaagataattttgaagcttccgtaacttccatttggatgggactccaactttcttcattgtctctcattttttcctttggaggtaaattcagagagagagttactaaaaataagcgtttagttttatgggtaatatgttgtcatattttccttttatatttatgcataagcagtccaaatgcccttacttgtttatttagagtaaattgtactgaccaaattgatagattttgggagtttcaaatctttggttttaatattttgaaaattacaggagggaaatttcaaggagctggatctcataatgtatttccattggcttggaaagtggaatttattttttggaactacttttcaattttatccatgtcacttatttattggtggatatcctcaaactctaatttaaaaaaagta

SEQ ID NO: 862 - DNA, 1441 bp, Cryptosporidium hominis
atgaaagaatctaaaggatcagaagatttaagggcaaaatatggtaaagggtttgatattattaggaagatgggattcaaaggaggaggacttggagtggatggaagtggaatatcagagccaattcaagttaaaataagaccagcaaatcttggtattgtggttgaacgcgataatagttctaataaatctgataaatttgaaaataaatcaacagaagtgaaaaatattgaggaaaaaaacaagaaacaaaaaacaagcataaatgaactggccgaggtaataaatcaagaccccgaagcaaaaatttatcaaatatttccaaaaaaaacatttctaaacgatattatggagtctgtttctttacaaagagaagcctgtgaacaaaatagaaaagtattgcaggattattttaatgagaagcagttggaaattgaatatcaaagcaactccttggataatttaaaagaaaaaaaaacaataatggagaatctaagtattaccactaaacaaattcaaaggatttttcttaaacttcactatgatttagaaaagattatggaggatgaaatagttaatttatttgaagagcaaggagacgtctcttcagttgagaacgaagattttcaagaccagatggactctcttgaaaaagttgtacaagaattctcagaaagctttaatagagtgctggactcttgtggtgatgcatcttcaagagaagtttctaaatcgtatttaccttactgctcaattgtaagagatattcttaaagtttcattgcaaaagttatataaaaaagaaaagaatatggaactagaccctgattttggaatttctgcttggatagctataaaggctttatttgtcaatctagaaacttccaggagagagaaagagtacgattccaagctatgttttgaacaacttttattagatactgtagggaagtatttggaaatttattttatctgttcatgggatccaattaaagaaaatgaatatggaatctcattattgagtatttgggttcatttaattcctttagaattcatcaaaactaatctaatgcaaaccatttggaataaacagatccatcaacttcaactcaataaaattgactcaaactcggaaggaatttctgaaagttccaagtataaatggttatttagatggcttccttattactacaaatttggaatgggatatcaaatatcaaaagttatctcaaaacacattgatgatgctttggaagaatgggagcctccagaagaatggcctttatcactattaactatttggaaacctatattagaaactgaaaaagattatgaagctgaagattttgaaactattggattttttgatcatgagacataccgtagcaatcttataaaacaagaatttgacaatattattttgtcaaagatatttccaaagt

SEQ ID NO: 863 - DNA, 666 bp, Cryptosporidium hominis
atgaaattaaacattgctaatccaacaacaggacttcagaaatgtattgaaattgacgacgagaagttactcttaccttttttcgaaagaagaattggttctgaacttgactgtagcttcttgggtgaggaattcaagggttatattttgaaaattaccggtggtaatgacaaacaaggctttccaatgatgcagggtgttttgacaagtaatcgtgttcgtcttctattcagaaaaggtatgaaatgctatcgcccacgtcgcacaggtgaaatgaagagaaagtcagtccgtggatgcatcgttagccatgacttatctgtattaagtttggtagttgttgagagaggagagcaggatattccaggacttactgatggtgaaaagccaagacgccttggaccaaagagagcttctaagatcagaaagctattcaacctcagcccatctgatgatgttcgtaaattcgttgttcgcagaaagattgaaggtaaggaaaagactaaggcaccaaagattcaacgtttggtcaccaaggaacgtttacagagaaagaagaaatatagacgtacactcaaggagcgttctgaggcatctgctaacgccaagaaggaataccagaagcttcttgaaactttgaaggagaacaagactaatactaaataa

SEQ ID NO: 864 - DNA, 3741 bp, Cryptosporidium hominis
atgcatatcaaaaaggtgaatccgtggtttgcggtaattttatgtatatcattattaaatggaataagtatttgggaccgaattcaattaaatttggataggggagataatacaggagcaagtatttcatatttacagctggaaatacaaaatcaaaatggagctgaacatatttttagccccttaagaattaagaataatcaactcagctctttagatcaacaattttcttctcaagtcaaacccaaagcatacacaacctcgaaaggtttaaaaacattattggtttctgacaatactatgttagagtcagctttttcatttgggattggatgcggatattatcaagatcctgataatttggcaggtttagctcacttgatggaacacgtcgtgtttttggggagtcaagaaaatccaaacccagtaggctgggatgagtttctattaaaaaagggaggcgctgctaatgcttacacatcagcagatacaacaatattttatgtgttgtcacctccaagagagttagagtccgtaatgagctattttaccaagatgcttgttaaccctgtaatagatgaaaggagttcagtttctgaaatcgatgcagttaaccaagaacatgaaaagaatatcccaaacaaggtcagagcaatgatagagctagctatgtacttagctccggaggaatgccctgcaaggaaatttggtacaggaaacaaagaaactctttatattaattcaaaaaagaataatataaatctcaaagatgccttgaaagaatatcacacaagttgttataccagtgacaacgcttcaatagttatcatgggaccccagtctaacgaggaactagtcaaaatcgctgacaaaattgacgaactttttacaaactccggaaaagctactaaaggaatttctaagattactaacaccgtaactagtcattctgactcgagaacatttaaaaatcagcattctcttgccccagatattttaagcatttttgaaagctctggtaatagaaagtctaatattggaatcagctctacaggtaggatcacttcaaaacaaacagaatcgaaaaataaagagactaaccaagattcaataaaaagtaaatcaccaaatacagagattgaggtagtgaaaatgccaagaggaagctcgtctcctccttttgtcataatttattgggattcagtttcagattcattaagcatcttaaaggagaatgctgaatggcaaatgttaaagctaattcaatacttctttgaagaccaaagtcaaaactcgattgcaactgagctacagaaaagaaaattagctactgctttagaatactttgataatactagtactcaatactccgtctatggcttgctatttactgcaacagatgattctgatcaaacaacttcagaaatagcaaaacttacgtcagcttacatggaaagtttgatagaacagataaacagcaaagatgataagtggattcagtcattctataagaactatacaaatatggcaaatattaagtacgagtatgacgaggaaagagacacagcaggaatagcctctcaggctgctgaaagtttattaatcttcccagatgagccagaaatggcactttctgcctttgtaaaacccgtttctatgagcaaggattctgaattaagtaatgcacaaattacagctttaaaagaatttgttaaacacttggagccttcaaaaatgaagataattaaactttcagattcattgaatagttcttcagaacataattttagatttgagccctacaaaactgaatactcaatctccaaaatttcgcttgaaaattcagaaaatacttctaaaacaattgaaacattaagatctacaaataagattggagagttgttgacgtgtgttcctggagatcttagcattatttcgttttcagaagataaatgtcccggatataagagctttgagaaggaaattcaagagagaaaaattggaaatgagcttcaaccatgcccaatattagaagaagaaggattaagtattttctggaaaggcccaattcatacggtacctacaattaatttgaccctagtccaaagattaccaaacaaagatgtctcaaataatgtcagagtaagcttaatagcaaatttacatgctcaattacaaagcagcaaaatggattacatactatcaagctttaaactatgtggcttggaagcagatattagttacagtagaggtagatttgttatcaatgtccagtcatatagttctaattttgaggatgttattgagaagttgtctaattatctcgtaaacggaagcagattaccaactaaaacagagtttgagactgccttaacaaatttaaagtctgaaatattgaatttgagcgatttaatggcctatgatgttgcaaccgatgtagctcaaagcgtatatctttcaaattattattccagattacaacttcgtgaatctcttcaaaaaactgatattacttttgatgaatatatagaaaagataaaaggtattttttcggtaggatactttgatgctcttattgtaggcaacattggatatgaaaagagtatcaaacttgtctcaagaatggtaggctctttagtaaacaagaagattccatattctaatgcaattcatgatgggattttgaatgtttcaggagacatacatattaaagctaataatccaatttcttcagataagaataacgcagtagtagctcacttcctaactccaccagttgatttaattgacgtatcaatatactcttcaataggagaaatacttaattcacctttttatgataccttaagaacagaatggcaagatggttacgtagcctttgctacgacaaaatatgaaactccaataatttccttaataggagcggtacagagtgcagaaaagttatcagagactttagtatgccatatgttttctgctctgaaaaaggtgtccaaagacgttgaggaagatttaaaggagatttccaaatcagaatttgaagataaaatcagatggtttggtctctctaaatattcaagccaaaagttggattcttttaccaaatatattgagcactttggaaaactaatcgttagtcatgaactttgttttgagaaaaacaaattaattgagaatgcaacacaggtgtttgtatctgaaccaaatatatatatagaaaaactaaataagttaataaaaccttcaagttcaaggaggttagttattgttgagttaattggaaataagagtccagataataaggaagatgaattaaagcttgtaagtattgctaatggagatatacctcctacaaatgaagaatgtaaagaaattttgaattcagaaattggaaaggcaactatgatggatgccatttctttcaaattaggttctagtggttctagtaatggtaaactcagagcatccagaaataacacctcaaaagaagaaaatagttatgttgtatacgattcagatattcaatgtaatatttccgaggaaaatgcaagctttgcaagtggaaaagattcaaaggaggtgaagactatgctgaacgtatttggaaagagaatgtcatcaatgaagttttccagtgaaagtaaaataaatgggaataaagaaaattctatcggaaataaacagaattcaaactcaacaaccaaaaacaagagatcatcctgcgatcatagcaagctttaa

SEQ ID NO: 865 - DNA, 699 bp, Cryptosporidium hominis
atgaaatctaatatccaacttcactattgctattttcttctctccgaagctaaaaagaaagcaagttatattggatattctgtgaacccttgcagaagactcagacagcataatggagaaataaaaaaaggagcaaaaaaaacaaaaagtggagttccatggaatcttggaatttgtgtaggaggattcccggatagagttgcagcccttagattcgagtgggcgtggcagcatccaaatatttgtaaagttactagagagaatattgagtcttggaaaattgtaaaaacaaagaaaacttcagaaaataaacgaatattaaacaagaggcaatggagtattcaacaacgagttagtattttactttgtatgacaactttagaaccatggaagaacatgaatcttacagtatttgttttcaaggacgagcttgaaaatacaattaaggaagttatagaaggtataaagaagataaaaatttccccaaactttacaagccctaatattttaaataaagattaccttttaatgtttttatattttggagaagactctttttacgaaaaaggaattaaatttcttagatgcgattacgaaacttttaaggaattccaaaagccgtcatttgattgtgattctgattctaatattgaagataactccaatgtgtttaacccagaagaaataatttctcatgaa

SEQ ID NO: 866 - DNA, 825 bp, Cryptosporidium hominis
atgagtagcctaaaagattcggtggtcagttttcagaaaaaagacgggaaaatggaagaattagagagttttgcaaaacaaaaatctcaaaatgtgagtaaggtaattgaaactaaagattcaaattcccctcaagcaggtgcaataattagatttaagtcaaaagaaacaatctattgttcatgtgaatttttagatttagaatcactttatgaaacagaaagagatcaagccgaatcgagtaaaattacaaaagaagtgaagctgatatctaattccaattctcatttagatgaatatttggatacttgtagtaagtcattgattagtagaaatagtagtctttcatctatagaaagtataacatttatggacaacaatgaatataaatcccaaacaaatcagataaatactgtgagaaatgagaataatgtcaaagtttgctctgaaaacgaaatattcaacgacaaattagtcagggaattttcagaaagtggcgaatttactgaatatcacacaagatcaggatttctaagtagtttatcaagaagattgtgggatcttgaggaaactttaagtttcacgaacttagactcaatcagtggaataaagacttttctattgggaaaaattggtcatggcaatattggaagcaaactaaatacctcagatcatgtatttttaggccctaaactagatgatgggcatgtattttttgccaattctagaggtgggtatgaatcacaaagaagcgaatcagatacaagcgaagaaagtgtaagatatccttcattttgtttagaagttaatgaaaaagaaatttaa

SEQ ID NO: 867 - DNA, 636 bp, Cryptosporidium hominis
atgtacgaaaatcacaactttcaaaaagattataaaatagtttttggatcaacatcagaaagtaggagaatggttttctctaaggcaaatataaagttgtcagaatttgtatcagcagacatcgatgagagagtcattacagatgatgatccaaataaattggtaataaaattatcagaagctaaaatggatgcagttcttgaaaagcttccatacaaaaacggagaggacaaagtaattgtaatttgtgccgatacaattgcattaaaagatggcgaggtgaggaacaaggcgaaagatagtgatgagagactcagatatgtaaaatcatatagtgaaagctatgcagattgtataacaggagtaacagtatataattatttcacaggaaggaggctatctaatgtaacagtttctagagtgcactataaaaaaatgcctgatgatgcaatccaacagattgttgagaattccgagataattaaatactcatgcggcgcacttgcaatcgactgcccatttatgggaaagtttgttgatgggattcagggagatgttgataatgttatgggaatatcagtttgcaatactgttgagctgatggaaaaatcgattgctttgggtgtagtaaattga

SEQ ID NO: 868 - DNA, 510 bp, Cryptosporidium hominis
atgagttcattttttcatgactacctatctggctctgatgatgattgcactgcttttgaggactcaagcgtgtgtaaagaaggggctaatgaattcaaatcaagtattgttgtgaattcaggacaacttcagagtgaaaagagtgataattttgttgcttgctacgaaggcagtcttcagaagaaagatcaaatcactcctgaaacatgtattgaacctaatttgataaagcaaatttcatccaaaattggagtaaaaaaaaaagaaaaaagaaagaaaaaaaataaatatttgaatgagttttacgaaatttcatctattgaaaatgtcaaaacactagatttagatgatctcaaaaagtcaaatcaagaagttggtttcccagataatctatcaagagaaaaaaaattagacggagataaagagcttagacaatcttgtaatcaaaagagaaaacatcaggtaagtataacttttatattcaagtattttcctaatagtatattttag

SEQ ID NO: 869 - DNA, 1566 bp, Cryptosporidium hominis
atgaaatttacgctagtcacaatattgtttttaatatttatgaaaaaggcgaaaatagtcatggctgatctaacatttatgtatgatttagttgtaattggtggtggttctggtggaatggcagctgcaaaagaggcagctaagtatggtaaaaaggtggcactatttgattttgtaaagccttctactcaaggtacaaagtggggactaggaggaacatgcgtgaatgtgggatgtgtaccaaagaagcttatgcactactcagcattaatatctagtagcattcaccatgatgctcaaatgtttggacacaaaactagttctagctttgaatggggaaaattagtagaaactttacgaaatcatataagaatgcttaactttagctaccgtacaggactacgtgtgggtaatgttgaatatatcaatgcactggcaaagttaattgacccccactctgttgaatatgaggacaatggccagaaaaaaacaatcacttctagatacatcttattagcaacaggaggtcgacccagcatcccagaaaccgttccgggagctatccaatattcgattacctctgatgatatcttctttctctctaaaagtcctgggaagactctagtcattggagcttcttacattggattagagacagctgggttcctaaatgagttaggtttcgatacaacagttgcaatgagatcaattccattgagagggttcgacagacaatgttctgagaagattgttgaatatatgaaggcaacgggaactaagttccttgttggtgttgtaccaattaacattgaaaaggtaaatgagaatattaaggtgtctttcagcgatggttctgttgaagagtttgaaactgttttatatgcaacaggtcgtaacccagatgtaaagggacttaatctgaatgctgtcggagttgaagtttcggattctggtaagattattgcccccaaagatgctacttctgttccaagtatatttgcagtaggagatattgtagagggaagacccgaactaactcctgttgcagttaaggctggaattcttttagcaagaaggctttttgctgggtctaacgaatttattgattatgattttgtccctactaccgtatttacacctattgaatatgggcatgttgggctttcatccgaagctgcaattgctaaatatggggaggatgatattgaagagtatctttccgaatttagtacgcttgaaattgctgctgctcatagagaaaaacctgagcatcttcgcgaaaatgagatggactttgcacttcctttaaactgtttggcgaagcttgttgtagttaagagccaaggtgaaaaagttgttggattccattttgttggtcctaatgctggagaaattactcaaggattctcgcttgcagtcaaacttggtgcaactaaaaaggactttgatgatatgattggaattcatccaactgatgctgaagtatttggcattttagaagttaccaaaagatcaggagagtcattcgtttcttctggaggatgtggtggcggaaagtgcggataa

SEQ ID NO: 870 - DNA, 1701 bp, Cryptosporidium hominis
atgatgaaatacccagatggagattatatgacaacgattaatacggttggagaaaggtcaaagctagttagtgaagtttctatgaatgtagcaaatccaaatatttccggaagaatgggagagaaacaaaccagagttgttcagattgacaattcaagagttacaagtgtagggatggaacctgagatgaaatctgacttagattgcaatggcggctacacgtctgctaactgtacaaatatagtcaaaggaaaaaatcaggaagacagagaagtcacacaaaataaaccattagaaagaataggtccaaataatacagattttagaaatagtaaatcaacttctacaacagcatcatctcattcaggctcttcactttctcaccctcataataaatggagtataccttcaagatatcaagtaagacacttaattggtacaggctcttatggccatgtatgcgaggcatatgatagtaaagaaaaccgtttagtggcaattaaaaagattcatcgagtttttgaggatttagttgattgtaaaaggattttgagggaaattgcaatattaagtaggctgaaccatgatcatatagttaaaattttggatatctgcgttccagaagataccgaacactttgatgaaatttatttggtattggagattgccgatagtgatttcaaaaagttgtttagaaccccagtatatctatcagaattacatgtaaaaacactactatataatctcttagttggacttaaatatatccattcggcaggaatttatcatagagatttaaagccagcaaattgcctagttaatcaagactgtggagtaaaaatttgtgactttggattagccagaacggttaaaaggcctacagatacgataaattataactctgttgcaagcaataataataataataataataattcagtggtgaataggagatctataatgactggtactagtattaagagtgataattcgcaagaaaatggaggatttcaacagggagggaggtttttgaaacgtcaacttactggacatgtagtaacaagatggtaccgtgctcctgaacttattttattgcaagaaaattatactgaagctattgatatgtggagtgttggatgtatttttgctgaacttcttaacatgcttaaagagaatgtagcatattatagtgatagaagtccgcttttcccaggtagcagctgtttcccactttcacctgataataaacaacaaactgaagattatcgttttaaaattagaggaaatagagaccaactaaatatgattttcaacgtcttgggttctccattagacgaagatattgaagttctagaaaaagaagatgcaaaaagatatattcgtattttcagtaagagaacaggaattgacttacaaacaaggttcccaggtgcttcaagccaatcaattgatttactcaagaagatgttggtttttaatcctaataaaaggattactgttgacgaagctttgagtcattcgctctttaaaaatataagaaacgagatgctcgaaattatatctcatgaaaaagtaacacttccattcgatgattggagctctatgacagagcgagaactaagatatttctttttaaaggagatacaaagattttctcctgacttggtcattccagattccattaaaatggatattgattaa

SEQ ID NO: 871 - DNA, 3846 bp, Cryptosporidium hominis
atgagagaaggaaagcatgatcaagacttgaatttcactaattcaagagaacaaaatagagataaacatggtattatggagcagggaagagagatacagagagagatcgagttggagagagaatattttagaggtactgaaagaaacagtgacgaagttaaaattgcaagaaataggagaaatgatttgaataaggagaaagaaagtaaggtttcagtaaaaaaagttggagtttttctaaggcaacttgcaaacgtccagcctgacattgttgattttgttgcaactagatttggaattttgggtggaataatttatgagaggccttggtactttattttgggctcggttttattaacactaatatgctcaatagggtttatcccgggaattccaaaatgggtggattctgctgaacatttatactctcttccttatagcttggcaagagatcacggggaattgcataaccagttatttagtaataccaaaagtagatcacagctaatagtagttacttcacaaactcctggagaaaatgtctttacttgggagtttttggaaattgtatcacaagttaataagttaattagaggagaagctttggatgctgttggagggagaagagttggagttaaagtgggtccaggctcaagtggagataagaatttagatggggagcatacaaaagatgaaactttgaaatcaagtaaaagagaagagtacttttctgatattacagaggataaacactatgataataatgaagttgatccatttaaactttcccacgaaacatttctgacttataacaatatctgcacgatgacaccatttggaacttgttcagttcaaaatgtaattgaagcaggagctttggaaatgaaggcagttttaggagatgaggatcctgaattatatatgctagatgggcttgtatttaacttaagaaaacaaggatttcttccagattatattctagggaaaatgaaggcaaagccttgtgttagaactcttccaacagaactcatctcaaagattttatcaccagacaaatactcgagttcttcaaaaggtcctggattctctgatgctaagattgagtgcattgtaggagctgaagcttttctgatggtttacgatatttttgatgatggtactcctgagaacttgtcaagaaatcttctttgggaacaatctcttgtaagtatattaaaagataatagagattgggggcgtgcaagaatttcttttagtgcatttcgtagtagagacgatgaactaaaggcatctacttcggaaaattcagatattcttttggtaggactcactttcacgcttttattcttctatgtgggagtggctaacttcagttttgacctatataaaatgaaaacttatagtggattggcaggactttttgcagcgcttcttggtttagcttcaggaatgggtttaatgtcaatttttggagtttcctttgttccaacagttttagtaactccatttctaattatgggagctgctgtgaattatttatttgtcatagttaatgcttattcgacaggttatactatcccgagtacaaaagaaagatgcagattagccttacaagacagtgtaattggaattacaataacaatgtgcactggattggtttctttctcaattggagcagttggtgaaccatatctttcaattcgtaacttctgcctattttctgcagcatccattatatttacctatttatatgtatttttatttatgtttcctatactttgtttagatgcaaaaagagaagcatctagaagagtacatttttttggacttccaaaactaacatcaaacgatattaaagcaacaagagatgtagatcttggtagatccattccagttgataatattaattcttttgcagttgttagttataatctttcaagagctctgaaggaatataatatcgagctatacccttttggagaacataataaggaagaaagcaaccaagggttttttgatatagatgatgatagtgatacaaagctcgacctttctaatattcaagataacaaaatggattttcatttagaacgagaaaggagaatagctgtaaatagtaaaatgggcttttttactaagttaagaaaaaggattttacatgtaccaattttggctaaataccagtatagcgacagaaaaactgcatcagaaagtacaataccttcatttaatcaacttagacatgaaatgaggctatcagactttgatcttgttagccgtgatctggatccaaatatcctagaaaccgttaaaaataataatcaaataattcaaagaaaagatgattcaaataatataaaagcattacaaaacattagtattgaaaagttagacaaagaatatgacttaaatcatgttgatgatcttcttcaaatactattagcagaaccttcaggaaatgttggaagaactacaagaagactaatgctgcattatattgggccagttatggcaactcccattgtgaaaattattgtaattataatatggcttggattccttggggtgtcaatatatggttttacaaagatggaaagtggtttagatcttagagatttatctcccccatctagttatcttcaagcttttgatcaagacttcaccaaatacttcaacaaatacgatgttccaactgatgtttattttccagagaagttagagtggtggaaaagggctgttcaggatagaatttttgattttgttgaaagacttgagagacttgaatctactcaaagagtgattgatccattatacaatttaatgaaaaacccagaattagcagcagctcttaggagtggaaataagaaattatttcaagaaactctatattacgagctatataataaccctgaaagtaactataaacaattttcttttgattttgtttggaaagaaagagaattaataacgtacagaataaaattgctagcaaaaggaatgccaacttctcaacaaaaagctgattggatgacttcaatcaggaggctatgcaatgatgaagaaagaagagaaaaaataccattcaaggttgttgcttacaactatatgatgttattctatgagagtgaccttagtattctaactgaatgtttttcaaatatgttaagttgtggaattgcaattgagcttataacattaatgttgattccagaacttatgtctggtctttttgttattattttaatggcatgtatagatattggcctatttggatttatgtattattggaatgtgaaactcaacatggtcagtatgattaacttgttactatctatggggtttgcagtagattattcaacattaatgacgcatacattttcacattgttatggtaaaactcgaaatcatagaatgattgagtcactgggtcttatgggagcacctgtatgccacggagcaatgtcaacttttcttgggattgttgttctttcaggaagttcgtcatatattttcactgtattctttaagatgatggtcatggtagttgggtttggaattttccatggagctgttgttctgcctattcttctctcgttggttggaagaatgcctagtcattcttcaaatatactttatcaggttattgaatggatacaaaatggccattcatattctattaattctatttctaaaggaaatcttccaatgatcaaagcaccaccagaatcaagtatcgaattagacgataaaatgctttcagccgatctaagacttgaaaagaatgtaatatcgaacaatacagtagatttcttaaaagttttaaaagatacaaaattacaatattag

SEQ ID NO: 872 - DNA, 993 bp, Cryptosporidium hominis
  misc_feature (928)..(929): n is a, c, g, or t
atgcaatataaagaaaagagcttcagctcaagagagtcaattaaagtagaaaatgatgtaccctctataagccttaatagcgcagagatcgatgtaatcgattcacttcctattttaaataggcatggatttggccctctcacgattgtagcaaccagtctaaacaataaatttcagaaacgtgtatattcgggtacttttgaaattccaatctatggtagagattctcacttagttttctacgaaatcgagtcaaaaaatttcatattgatttcaattgagaaacattttgttggagacttaattgggaactctggaacagtttttattgaatcaggtagtgacgtattttgtttgaatgaattagaacttagaaaaagtaacggagatatcatttcaactgaatgtccatggggagcgcaaatatttctagaaagtgaaataattaacttcaaattctctccggagtcgatacgtcgtttcaagccacaggaacctcctgctgattggaatccaattacttcgactattttcccgtcaaatagaaattatgtagaacttattaaactacttaaatccaatatttctaaatcaagtgaagctgcattttctaatattcaagaggatggaacacctacagctcttctttttataattgataataagtatatgtctttgtttttaccagaaaacttttcctattcatatgaaaaacgctcatgtactgtttttagatctgatggttcatattatgatgttcagaagggtatttttagaaccgacagcggactcaaaattataaccaacgccccttgggggaaaaaactaacttttgatgaaagtcttgtcagaatttctaataatatcaacaaagagctcaattcatttgtaatcccttctattggtagttggtacctatgggagattnnttcggaaaaaaaaagccaaagatccatttccaaaaaaataaagaatgtgtatcacagattataa

SEQ ID NO: 873 - DNA, 1137 bp, Cryptosporidium hominis
atggtttatttgttcgttttggccattgttttactttacaccaatacgaattatattataaataatcgtatttccacacagtcatccttactcactattcaattgtcatcctcttcttcacggcatagttcaattaatctctcgggattaactttggaacaaaagtacagaaattgtttagatgatcttcaaacattgaaagaatcattggcagcgactattgaagagtataatatatgtaatgctgatgaaggtgaactagaaagtagctataataaaaagtctaatgtttgcaaacttttggaggaggattatagaaaatattgcaagagccataattttaaacctccagctttagacaaagattcatgtagaacgctattggagagaattaaagaatgcttagaacagaaacgtaaacttggagagaatttaaataagaagattagagagtgccgagaactgaaaaagaaaattgatgaaagaaccgaaatgtatgataaagttgataaaagatgctcaaagattgaacagcaactgttcaatgaacgttcttacactagaattcatgttgttgaacaagaagatgttatggataaacctacttcaaggttatctagcgctgatgcatcattgttacttgaaattgttaaacaaactgaaataaaattccaactatgtatagaacaactagctgaattatctgaaagacttgcagataaaactaaccaaatgtatgaaacttcagaacaaattacaactgctctaggtggtgcaataagtaaaaaagttgttttaggaaaaaagaaaagcaaatcaactgaaattagaagccttgagaataccctagagctcttgaaagaacaaaaaatgggcgcattgaagcttcaactttctaaagagaatgaatgtagaaacttgcaaactaagttaagtcaagctttggagagacttcaaatagctgagtcccaatccacgacttctgaaagccgtacgggaagtcgtggctgttttggtcgatttactagttttgtttcaagaacgtgtaggagatttacaagcagattaacaagtcgatttacaaacagatttacaaggaatagtaatcgtcgtcgtagaagagaatcaaggttttga

SEQ ID NO: 874 - DNA, 507 bp, Cryptosporidium hominis
atgaaaaatattttatatttcactttattattattttcactaaatgcgcttcgtatttttgaaaaaataggtgcgagagcttttgttttacctaaaagaatcataactggatcgaggaatattaaatctagctatgattatatagtagttgggggtggggctgcaggatgcgcattagctagaactcttgctgactcgaattactctgttttgcttgtagaaagaggaggtgctaggttagatgaatcaatactcactcgtgatataaaaggaatgggaagtgttgtggatgacaaaagggttagcgaacttgttattactaaacagggaataagaactcatattggaaatgtattaggaggtgggacagcaataaatatgggaatgatcatggaagaaaatccagaatatttcaaacttttagaagaaaattcaggagctagttttaacaaaaccattttgaaagagagctatgattggattgtgaatagagttagtaataaaggg

SEQ ID NO: 875 - DNA, 830 bp, Cryptosporidium hominis
atgtgccgccccagccaaactccccatctgactatgtcttccgcgaagatcagcaataataattaattaccttaaatcaaaaactcttttaataaaaaaaagaggctcaatataacggaataagtaaaatgacattaaaagtagtggtatttcaagatcgccgtagctcccacttatgctacaccttctaagccatttcacaaagtcaaactagagtcaagctcaacagggtcttctttccccgctgattattccaagcccgttcccttggctgtgggttcgctagatagtagatagggacagtgggaatctcgttaatccattcatgcgcgtcactaattagatgacgaggcatttggctaccttaagagagtcatagttactcccgccgtttacccgcgcttgtttgaatttcttcactttgacattcagagcactgggcagaaatcacattgcgtcaacaccattttctggccatcgcaatgctatgttttaattaaacagtcggattccccttgtccgctccagttctaagttagttgttcaatgtatatagatgaatccattaattatatattttgccgttttaaattcaaaataatccaataaagattataaagtcaaaaaaacagcttaatataataattgatgggtctatatactcaacccttagagccaatccttttccccgaagttacggatctattttgccgacttcccttatctacattaatctattgaccagaggctgttaaccttggagacctgatgcggttatcggtacggccagatatgaaaataaatctatccctctaattttcaaggacaat

SEQ ID NO: 876 - DNA, 66 bp, Cryptosporidium hominis
atggtggtgagggaagggggagaaaaattggttgaatctatttttaatattgaagagtttctataa

SEQ ID NO: 877 - DNA, 197 bp, Cryptosporidium hominis
atgaaaattaatattaaaattattcaagttaaataaaggggaaaggcgggaagaaagaaataaaggaaggggggttcaatattataattttgcatgcaaccaaatttataattgcgtggttttttttttttccttttattctttgttttatttgggttttgaatagaaaagtaaagggaagaattcaggataaaata

SEQ ID NO: 878 - DNA, 3168 bp, Cryptosporidium hominis
atgaagttaaaattcatttttttgtttattattgctttaattatttcctatttgttttgcgatatttatgctgcagaagctcctgaggaaaattctcctaataattctaataatcctttaattgagtattcacaagatgttgacgtcacagaagcaatattaatcttagtaactaatagatttgaagctaattttacttcagagattcttttaaaagttgtatgtatttatattctcaatatgttgagatttattgcaataatcaatcctgaactatctagttctctttttaagttattagatttggtatttgcaacactgcataattattcaattgaagataaaaaaactttgtatattactcaaactaaagttggccaacttacatatttgtgttctaaagcttctgaattgtctattttttctgagatcaatggaaaagattctaattacgctcaaatgattgatgaattatatagtatttcgtcaaaaatcatctcagttttaagtaggttattaaatttacttaaattattggctgtagttgaagtttcagaatatattcgacatttgttacattcattaattgaactaggcgaagatactttaactgaatttaaaaaggccattgaagcctatggttctataccaaaagaaattcttaataaaaaaattgaattttcaaaagatatatctaaatcaatatttttgtccttaaactttgatgacaaaccagcaaatatgcggaaattaatgtcggaaaataaaattaaatttagtgctagaaatgaagagtataaaaaatatttatcgacaggaaattcgaatttaaaacctgaagatttagaagaagctaaaattgtttatgaaaatatttttgattctggaggtttatctgttgaacaaattttttactttgaaactttaattttacaagcagcttcaattttatttattatagtagccaatacttataagttttatgaagaaagagtttcacctatccaagaaaaaataaattcatttcttaatactgtgtatagtcaaataacattgagaggaactgagttggatttatctgagcaaacatgtttggaaataaagcaaaaaattcgtgaacttcttaatatagagttacttactagtaatgatattttagcatcatctcatacaaaaacgaaatcttctaaagaaattgttgatgttttaaagaaaatgtatctacagctaataaagactcttgctttgcttcataaagagaaagaaaaaatggcaagttgtaaatatttgacatttcttttaaatgaacttttgaaattatttcagctttttggaaattccgtaaagaacttaattaaagactttgaggaaactaaaagtgaatgggaggtaaaatcaatttctgatctcaaaaaatctcgaaaagaaactctttcttatttaagatcctctttaacaaaatatgctgaattaagtaaggaacaaacaaaaaaaagagaggaaagagtcaagaagctaaaggagaagaataaaaaagaagaagagaaaaagaaacaaaaagagaaagaagaagagcaaaggctgcttcaagaaaaaaagttacgtcaagaagaacttaaaaagaaaaaaaaggaaaaacccaaaaaaactaaaacttttccggaagccactcttcaagaagcaataactattgaacaaaagcaggaagttactgaaacatcaattaaagcaccttctaaagtaaagaaaaagtctgaaaaaaaggaagaagcattaaacaaattgaggttaaaggctgagatttctgaaaaatctgagaagattagaggtgttatcaaatcagaaagaaaaagtaatgtttctgaaagaaccagaaaaatgaatgaaagaaaggagaaacaaaaagcctgtaaagaaagagaaaggagggaaagagaagaggaggaaagaagaagaagagatgctcattaccaagtaaaagttttagagagtgaggttaaagtatcagtttccatgttaaaagagcacttttcatccgtaactaataaacaaaatgaagaattacaacttttaattggtactgtttttggaattatgggtgaagatgaagctactggaggtgacgaagattttaatttgactgatcaagaagaagaactatcacagccatcacaaccattacaaccatcacaaccattacagccaccacaaccatcacaaccatcacaaccatcacaaccatcacaaccatcacagccatcacaaccattacagccattacaaccatcacaacattctcaagatacacaactcagacctcgcgctagaagaagagccgacgaatctttacaggatgctcctactcgtccaaccattgaactttttgggcaggacccagtatttgcaagttcaagagatgtaggtaaagatttaacactatttggtttgtctcacactttatctggtttaagtttagatgatatgaaagatacgtctgaagatcaagcttcagaacttacttcaagctatgacttaatttcaacatctgaatcaaagtctgggcaaaaatcaaaatccaggtcaaggtctaagtccagaacaagatctaggtccagaacaagaactaggtctagatcaagagctagatctagatcaagaactaggtctagatcaagaaccaggtcaagttcaagaactaagtctagatcaagatccaggtcaagttcaagatctaggtctgggcacggatcagaaccatggcttggaggaactctacaaaaccaagaaaataccatggaggaagttattagtaaaatgtatgtttcttccacacacgaagaattccaattatctagttcttcagaacattctagatttagtaaaatgttctcaaatacagattcagtggatcctttatcatcacaagcgatgctgattttcaatgtaaaaatgccaaatttcaaacatattactgagtcctcaacagaagaggaaataaagaaagcattagatgtttgtggaagtgagatttctcgcttaaattctgaagtgtcaccgagtgttagtggtcaagatttcttatccgtgaaatttgtccagaagtcttttattagtaccttcattaggttacttttacttttaaaatcaaaaagtaattccactagttaa

SEQ ID NO: 879 - DNA, 1131 bp, Cryptosporidium hominis
atgaggctaaggatcaaagtatacctcatttttttagttagcatatttacaacaaaaatatgcagctcgttgacgataaaagaaatagaagctattggtaataatgatcattcaagaacgcatagttcattcactactgactctgaattaatatcatcagatgaagaatcaaatttgacagatgaacaaactatgttaaaaagttattcctcttcaaaagatcaatctctttattcaaatagccaaattatagaatatgatgatgtattaggaaatcttggtattattgctattattacaaataaaagacagacatgtagaataatttcgggtaactttaataaaagaaatgaaacaaaaaatacactttatttattattcgatactactaataagaattttgtcagcatttttgttccaagactaattgactttaccctcaaaggtaaacaaggtttagttactttaatttataatgaagaaattttcttattgaataagctacttctgattaattcgaatggggaaatttctacaacaaatcatccatggaaactagttattgaggtcaattctgattataataaacttcaaagccttccttatgatttgagaaataaaaattatattaaattacccccagataattgggatgcaaacgatgacagtgtatatcctaaaaatattaaaagcataaagccattaagtatattgacaaaaaatatgaatcaaatcaaagaattaaggatcccccatttctctgttggagttaccccaactgcattatttttaaagttaaatacaggtgaatatatgtccattattgttcccaataatacagtattttttgttgatattgatgattgtagtattcattcaaaggatggccactattataatatttgtggtggttatgctgtttactgtaatagatggttatttacaaacaggccgtggaaatctagaattattattcaaagtaacttcgaagaattactagtgataactaaatcaaaacttcaagttcttgaaaatgttgaacaattatcgaataattcgaaaataacggagaatttcagaaataatatcaaaaacaataaatgtgggaaatgtttctgctctagaaattaa

SEQ ID NO: 880 - DNA, 1329 bp, Cryptosporidium hominis
atggagaaaataattaaaagtgattatgattcattattagagattgatttatattctgaggatgaggttgatggagacttaactattactgataatatttttatgtatgatcagatttgttacttaaaaaactgtttagttgttcttttactcatatggcactttatgcatgccattatatttgggggcgatatatctccatctatcactagatttaaaataggggataatggaatttttgctttagtactgaatattttggttccatgtatcttctttgtgcagggttggttaaaagctttggagatacataaacaaacttcattcattaaacgacttcatattgaatttataataccaatctttatctacgtattattttatttggttagtattttgttcaaaaatgatactaatttagaaaatctaacgaatgaagagtttgccaatttgttgtctgagtcagaatattttaacccaggatttctttcaacgtttttgttattatttctgataaatttggttctggatcctactgcattggtaatagttccacatttttatattaacaactctttaatttcctataaagtgaataattcaccaatagcgaggacttataagagtggaaatgtttcaaatgaaatggataggaaatatttttcagttttaaaaaacttttcattttacaaattaatttattgtttattaatggtattattatacgattcattattagattttttgaataatatggaaccaaaaaatttaatttataaatcaaaaatttctaatattttttccgttttaattttattaattatgtgtaagattttcaaaaatagtcccagaatcttctattatgtttgttttattggatcttttattaacctaattatctgctcatcatttggttcatatattaattgccatttttctatgagtttgatatcttcctttcactttttattaaatgtattttttacaggaactttaatttcttgtatgaacttggaaatttttaaaaaatggaaattttccatattttttacattatgttcagtactttgtcattttaccagcgcagactattcaagagctataatttctccactcatttttccttcaatttttagtataaagtcaagattcattacagtttctcaaatattttcatcaatttttgccattttaagcatttcaattcaactattcaagtgtttcagttctaaaagtaaaacaaaaagcttaagaacaataaattctacaatattactttgttcttcattaatgctatgcatttcatctataaagttgtttttcgaataa

SEQ ID NO: 881 - DNA, 1482 bp, Cryptosporidium hominis
atggtatcacaaatttcatctcctttatcaaataccactgtatgttcaatatggaagatagagcgattaattggagggggaagctttggagatatatacttggcagtaaatacagaaaccaatgaggaggtggcaattaaggcagaatcaacaatgtccaggcatccgcagctaatatatgaaacaaaagttttaaagcttctacaaggaggggtaggaatagccaatgtctatcattgtgaattagatagagaagtaaatcatcagataatggcaatggaacttttggggccatctttggaggatttgtttaatctatgtcatagaaggttcacaatgaaaactattttaatgattgcagatcaaatgttgcaaagggttgaatatattcactcgaaaaatttcattcatagagatattaaacctgataactttttaattgggcgtgggagaggatctagaaatatttatgttattgattttggccttgctaaacgctttcgagatccaaaaaccttacagcatattccttacagagaaaataagaacttgacaggaactgccagatacgcttcaattaatgctcatttagggatagaacaaagcagaagggatgatttagaggcaataggttatgtattaatgtatttttgtaggaatggaactcttccatggcaggggatccgtgctaataataaggaagagaagtataagaagattatggagaaaaaaatgggtacttccgttgagactttgtgtaagagttatcctccggaatttgcaacatatttacactattgtagagtgctccgttttgaggacagaccagattacacttacttgagaaaactttttcgtgatttaatgcaaagagaaggttatgttgatgatggagattttgattggactaaacttgactctaatggcagtaaaaaagttgagacatctagtatgcaaactaataattgtgtcaaaactactggaaaatctctaattcctcaaattcagcctaatgtttctctggataaaagcgtatttgaccagaaaaaacaatccaaaagtaataagagatacatacactcatcatcctctaggaaggctaataattcaggagctcctgctaattcaaacattattcaacgtgaatgttctcctgttgaacagaaatctaatatggagaataaaggagataaaaatccaaatgaaacagctaatagtaatatttgtaataatttaacatctgcaaacagtggcaagagaatttctgatattggagatcaggctcaggatcatagtatgagcttaagccccaacccaactttaactagaggaaaatcaaaagctaagaataaagatatccatgaatatagaaatacgaaatatcaagacacaccctctaaaaaacacaatatgaaagctcataatacacaaaagccttccaggctgaaaagaggcttttgttcttgtactaaggttgtatga

SEQ ID NO: 882 - DNA, 3627 bp, Cryptosporidium hominis
atgtcgttatttgcgacagtgagttttgctttaagctttgggaagtttagaaatattgatttactacagagtgggttttatagactaaggagtagattatactttttaaatgacggcgtggcatataacgctattcccagaaatattatttattctaaacaacaaaagctagatctaaagtgggaaggaatcttagaagacgggtctgttttatctagacccttccagatcaactatgtagatgatgtggcagatttaaatgagacaatcatatttactagtgatgtgaagctgcatgttcctagtaccaaacctttttcatctttttttagtgactcaagtcaaacagattcgaacgaaatttttcgaagtacatttgcaaacagtcaagtaagtattgctcctttttttcttgaggtggatttgttttattcagaaaacttagaacaaattcttccccctgattcaggatctatgtctgaggagtcaaatagtgaagattcagaacattatcaaccttcagatgaaaaattttcatctctttgttataatgtctatagaattaataatgttgcaaatggtattgtggaatatcttccaataatatttgatgagtttcacttttgtaatacaagctgtttgattctaagccagattactagaatctttgcttcttttgactctcattattctgaaaataaaactcaatatattccaagattttcttcaacaaagccactcccagtaatcccttcatttctactgtctactagtaaaaacgaagaaaattcagaattaagcgataaggatctgtcaaaaaattgtaatagaacttttaaatgtgatgaaaataaaaattctcactcaataaatgttagaagcaaggtacaagttggctcatttactattaggggaatgcttatccaaaaaatggctcagacttttgtaaaatcttctaaaaaatcaacagaagaagataatgataaaacttcagatgatttaaaattaaacgagaatttagaagtttctacaaaggaaacaaatgaattacttaatttggctaataataaagagttaaatgatattcaagatacctcagaaatatgtgatgatgtaaagggtaatgcagaaaaaaatcaaaatactaaccaaaatgccataattggtattgacgaagtatttccatcaatagtaactagagatccaatgtttattgaatcctcaaaatttagactcgagctcatatcatccttgactaatatttatctccaattagctgctaatatgcactatattacaaagaaatgctgtagttcacaaagagctaaattaatgggatcattcttggttatccctagtttagaactaccaggtggatccaaactaaatgttgagcctcttattaacctttcagaatccaattatgaagaaaatggtgcttctatcccgttttgtgtagtaagagaaaaaattgatcagattgatgaacataaaatctctagaattagctctgaaattcagcttaaagaagcaaatgaattcaaacactctcttacaatagcaagcgatggaagttctataggaattcttccagaacaaagactttctgattctgctctatgtttagttaaactaccaacaacaatatgggctttaactcctctaaactggcagctcaattatattagaggtattacgcctcccatattcagaagaagtccaacctcgcatattgttacttcagatccactaatctcacatgagccaattttaccattccaaaatgtgattgaggcaccttttggaattgctcaatatagtcgcaagattaacttagaattggagaaaatttcatttcaaatttttgagacttggaatagattagtctctattctaccttttgtgctacacaaactcgaacagacatgtaaaatggaacacataaggaagaccatgttcttatggaatgaaaccattttttttgagaatctttcaattaatgaattatattctccatcattaaagccagaaccatcaacaaaatttccagaattcttaggaaatcgatcatttcctattacaccccctgttgtactttcagttaattcatctcctccatacaataacttacctaataatggagagcttaacaaaaaaaatagtggttttttctcaatatttccaatattaacaggcggagtagggctaagctcacaaaattcaactgcttttgtactaaaacctattgattactactcaagagtagctgatttacttagaaatgatatagtttttaaatcaataccaactccaaatgcaattgaggaagtgtgccttcctcccttacatgaaatagcatcaaattcagataaccagtcaaacacaaaaaatgatatatttgatgagaatatgttaaataatatttcaactgagcacttaaaaagttctaaatataatgaatggcttcctattttatttattcaaagatatacaaaaccttcaactttgattaattgctataaacacccaatttcacctatatcaacgaattcagaaattaacaatttaatagttgaccattctaaagctataattaataatggagttggtacaattactcattgtggacaactttgcagacttggaattaataatgatcctgcaatcaatgctagaaatatagttaataggaaaattgagcaagaatccaataaaacctttagtagtcgctgttttgactatgatcaaaatgtagaaaaggaaactaatcatgacaatgaaacgcctaaaatacctatgattaagacagagacaccatttttagaaagtagtaaagaattaacaaaagatcttcatataatgatatttgtacatggattacaaggctctgcatttgatatgagaaatgtcagaaatataatttctctatattacccagatgtactatgtttacttagcacatgcaatgaagattatacagatggtccaatagaagaaatgggaaaaaggttaagcgatgaagttattgcagctgtatctccattttcaaaatctttaaaaaaattgtctttcgtaggtcactctcttggtggaattataataagagcagctctcccccatcttcatatgtttagttctcaattttatttatattggtccttaagcacacctcatttgggatgtatttcaaataactcaaagcttattaatgcaggtgtatggataatgaaaaaatggagtagttctcaatgtattagtcaacttgcactttctgatgctcctaattatgaagaaacatttatatacaaacttgcaactgaacaatcagagttattttcaaaatttaaacatattgtattttgttcttctcatcaagatatgtatgctccatatgatagtgctagagctgaatactctccagatggtccttcagtttacaaagtgatggtagaaagtttgctaaaaaatgttgatccttctcgtattgttaaagttgatgttgacttccaccttccacaaaaaaacctcgatacttttattgggagagccgctcatattcaagttattgaaaatcaattctttgttaagatcctagtttctagatttccggaatggtttattgtctaa

SEQ ID NO: 883 - DNA, 750 bp, Cryptosporidium hominis
atgttaagcaaagaagagattttggatgaaataattttggaaaggttaaactcagccatttctagggtttcaaggtgtatgagttgcaagttgaataaatcgaaatactttgatatagttgaaaatattttaatatgtaaaagacgtttaaaaaagagtcaaaaattcaaagttgtgggggcacacaaaattacctccaaggagatagatttacttgaaaagaatattgatcagctaagttttaagactaataaaagagcagggttttcttttaaaaactttttttcaaaatattttggaagcaagaaacatagctacagttctatattaaaagaaaaagaaagaatggagacttcaagacttgagtcagaaaattattctgactttgaatggaatcttttctctaaagagcagaatttttcaaggcgtaatacattcgatttttgttctatttatgaagatgaaaaattggtctctctaccttttgcttcaaataaaaagtatgcatctgtagactgtgatggaagatatgtttttaccaatgaaaatttgaattataacttcaggcctttagatgaagatttaaactgtagatataaaaatattgggtatgaaagcagtggagggttgagtgtgaattgtaatgacaaaacttatgaatacaacgaagaccactacataactcaagaccaccttaatactaacaataaaccaaatgtaacaagtaaaaacccatttgatttgttctag

SEQ ID NO: 884 - DNA, 654 bp, Cryptosporidium hominis
atgaaggcattggatggacagatacttaaaggtggagtggtttcttttagtaatgaatctaaagggaaatcagaaaaactgcttcctttgaagattgttcaaaataaatataataagcataaaaaaaatgagcctaagaggaaattattaacaccttttaaaaatgaaagtataagtgacttttgtaaaagagtagattctgatagcagacaatatttaatggagaaggatagagagactcttagaatgcaaaagtctatgaaaaataaaaaaaagagagaaaaaagatcgttgaaaaacttggaaaaaagtcaggcaaagaacacaaatttgaacgaaattagcgaactagaatctaattttagcctaaataatacgaatcgaccttcttttggagatgtaattgattcccctcccttaatttcttcaaaaatcaaggataaattggaaaaatctaagaaagaaactaagacttgtagtgacctttctgaatatgttaatcaagtaagaaaggcatattcagaaatcaaaatgaaaagaattaatgagagtaacaagttatttcagaataagaagaaaaatccagagagagtattaaatgattttggaaatggttgggtaggaataggtaaatttaggaggcaagaagaataa

SEQ ID NO: 885 - DNA, 1482 bp, Cryptosporidium hominis
atggaaagtagaattaaggatattagtcttgccgagtttggtctgcaagatatggagatagccaagactgatatgatgggactggtagaattacaaagaaaatatagggattccaaacctttaaaaggagcaagaataactggaagtttgcatttaactatagaaacgtcggttttagtcgagactttatatgaattaggagcggaaatacgttggtgtagctgcaatatttactcaactcaagatcacgcagcagcagctcttgtaaagaaaaatatagctaccgtttttgcttggaaaaatgaaacaattgaggattattgggtttgtttgaatgatgcaatgacatggagaaacccgagtgataaagataaaatctgtggtccaaacttaattgtagatgatggtggcgatgcaactctaatacttcatgagggagttaaagctgagatagaatatgaaaaatataataagattcctgaatatttagaaactgagttggatgaaaatggaaggcaattatctatggatttgaaatgcatgtataaagtattaaaaatggaattacttaagaatccttttaggtggagaggaatgctcaaagatttatatggtgttagcgaagaaacaacaacaggagttttaagattaaaaattatggaatcagaaggtaaactattacttcctgctataaatgtgaatgatagtgtaacaaaatcaaagtttgataatacatatggatgcagacaatctttattacatgggctctttaatgggtgtattcagatgcttgcagggaagaaaattgttgtattgggatatggtgaagtaggtaagggatgtgctcaaggtctctcaggagtgggagctagggtcatcgtgacagaaattgacccaatttgcgcattacaagcttcaatggagggttatcaagtgagtgtattagaagatgtagtttcagaggcagatatatttattactgcaactggaaataaagatgttattacagtagaacatatgagaaagatgaaagaaaatgcttatattgcaaacattggacattttgatgatgaaatagacgtttatggtcttgaaaattatccaggcattaaagtaatagaagtaaaacaaaatgtacataaatttacttttccagatacacaaaagagtgttattctattgtgcaaaggaagactagtgaatctaggatgtgctacaggacatcctcctttagttatgtcgatgtctttcacgaaccaagtgcttgcacagatggatttatggaaaaacagagaattagtagacaggtctaaaaatacaagattttttgttaaaaagctttcaaaagagttggatgaatacgttgccaggctccatctagatgttcttggtattaaggttacaaaactcacagaaacccaagctaaatatattaatgtttcaataaatggcccttataaatcagaggattataggtactaa

SEQ ID NO: 886 - DNA, 2220 bp, Cryptosporidium hominis
atgggaataaataagttgctaccttttttgataatttcattactttctataagtgaagtttattctgaacaaaatgatgaatatattgcaaaatcgcaagtagatgaagattatttaatcgaagattttgatactgaagatgaagactctcgttatttattttctttaaataatattcagaatgacatttggagtgatcgttttgtgaatggattttcatctatcgaattagaaaataataactctggagtaatacatttattgaataataactcaaatattaaacttggaagcgatgaatatgtaattacctcttctaacatgccaaattatgattccctaattgtttttgttgaggatattagccaagcacttagttcaaataaagaaaatagagaaataaagaaccaaaatcttttaattgttacaaacgacacagaaaatgaaattttgattaaatcaaacagactatcaaatgggtttgtatgtatgggaattttaaatggaaccgagatatggagtagagaattttgtgagattgttcaaggttttaaaatagatgaaatttcatgtaattgtaaaggatcatttatttactcttttgccgaatcaagagatcaaaatagagctttacagatgcaatatagcaaatttaacttcccagagtttggtagtggtgggaatattcaagctcatcatgtaaatgatgcatacttgagtagagtctcaagaaatgatgatccaaattctaatcatggtgacaaagtgccatttccacctttacatggaagtataggaggaagaagtggtaatgtaaatatgcaaaaaaaagaaacaaaaaaaagccccaccaataacgaaataacttttgaacagaatgaattaatgcaatactatcactctggttcaactaataagtatataataaataatcaagatggttcacatacatatgacaaatcaaaattaaatgaacttaaccatcaaaattcaataaataaagaaacaagccaaattaattcagatctcattgaaaataatagcatccataaaaatccatggaatgttaataactacaatgaactgattaaaaaaagttcctcgatttccaataataataataataataataataataataataagcttcataccgacttttcaacgccaaaagtggattcaattaccataaatatggagattaagaacattagttttgactcacttaataatttgctttataaacaaagttttataagtaaattcatcaattcgctttcaaaagcactgaacttaatacctaataagttccgaattgttaatatttggaatgaagaaaacccatcattaagaagaggtaattctggttcaataggaattacaatcaatattataacttcttctccagatgaaattattaccaaagtaaaaaatttgaaaaatcaaatttgtgaatttagtaaaatctttgatttttatctaatttccatctcaaaaaatataggattaaaatctgtcagtaatgaaataattacggataaaactaaggaaaagaaagaaagggaaattaactctgatatagagtcaccccgtacattacccattatattcacaatgaatcttagaacaagaaaaccatatattaatcaaaaagaagcatttacactgctcgaagatgagctttcaaaatctatgaaaattccaaaatcttcaatagatatcccagaatttacatataaacaactaaatgatccccttacaaatgaatcatatcttatgatacatacagaaatctgggtccatcctgaaaaacaaataagagaagagtatacctcattactaacaaatatatactcaaatattattcataataaaagatcatctttttcaagtatatttttgtgtagcaaacacgaaattaaggaaataccacatataagagctcatccaattgaagatgaacaaacatctaatcaagttaataattctccagaattctcgggagaaaaaataggtataagtaaagaaactgaaccaattgatgaaggtagaattagtaagattggaagattctatctaattaatcaaaatcgtcaagaaaatcaaagtaaccctcatagcaaaaaagctgaatctattgaaaatattcaaaatgaatacaaccaagatactaatgaaagtaatcaaatcaacccagttatctatttatttaaagaatag

SEQ ID NO: 887 - DNA, 1194 bp, Cryptosporidium hominis
atggttgcttggaaaaaaactatattatttcaatatatttatgtaactatattactaggaataagtctaatttttgtttgtgcagaagaggtacaaaatgtttccgagtttagtcaagcattacctaacacagaactaaactttggatataaccaaggccaagctttggttgagtccagcattcgatttccaactattagatcgtttttctcctggtttggatcttttaatagcttatatgttaaatatcaacacacttttgaagaaattgcgacatcaatcccaccaaaagaagatctcgaatcgcaaatcactcttatgacagcctattcttttctattgcaatgcttaaaaaccatgggagaattaaattcaatatacgaaacatcaattgttgaaacagattctgatatgctttctgatgattcattatcgagcgttagtaatcttcttaaagaatgtttaattccactcaaagatctattgctcaaatcgtttatagctttacaagatcaggcatttgatttaggaaagacttattcacctgctctactcaagtcctctgaattaattatggaatcatacgaaacatgttggagtatatttactactatcctgggatacattacaatgtttcaacaatctatgaacatcttgctcagaaaccgttcagaaaaccaggaaaagcttaaatttcttgaaaataaacaagaaaagtcatctctggaacaactccaatctaatatttatagtcgtaggctggttgatattagtagagaagaaaaactaatcagtttaatattatctctttttgaaggtgacttcagtgtttctatcaacatcctagagttggaatctttgattacaactgagaataagagaagtatattcgaattggaagaatctatcaaaaacttggaaaaatccatcaaatgtgatgttaattctgaagaaaatagtaatatgcttctcgttaaaactctaaaagaagaactaaattcaaggacaaatgatttaatacgtcaaacttctggatcccccatgtatttacaaaaatacgaccaagagcttacagaaatattcatgaaacttaatttagaaggctctcagtcagattcaactaatgaacagaacaaagcagttgacgagactaaagttaaagttgaagaagcagatccaaaagaggtgcaataa

SEQ ID NO: 888 - DNA, 1356 bp, Cryptosporidium hominis
atgggcatgcttttttcgggtggattggactctactgtattactttatttgttattagaatggctattctcaaacttggaacatttaggaagtaatatttttaagagatttttttcaaataatcaattttctgaaattcaattcagtcaagataatttgtttttcattattgaattaatcaatacaagctttgcaccatgtgaagcacctgatagattaacaggcttagcaagctactatgaaatattggaattatttgagaattacctaagaaaatatagaaatgtttcaatcagattaatatgtgtagataattcaggtgatgtattgacaaaggaagaaaaaaacatattaaaatgtatagctccatgtaaaactcatttagattttaacattggaggtgctttgttctttgcattaggaggaaaagggactttagttgataaagaaagttttaatgaagaatggtggcaagaaataatttccgaaaatgaggattcaagcatttggaatgggatttttgaaaaaaaagctccattttctgaagctactattgagtccactaaaaataatgaatctacagaacatcccaaagactcaaattttcaaagaaaatgtccatactgctcttttagagagcattcaaagtgccaaaacaaatgttgtaaatcttgttgtagaaaaattcaacaaaatttaattaagccaattggcgaaagttttcctgcatgtagaattcataagatgaaggcagcagatttcagtaagatcccatccacccaaaggtttattgaccccaaaaattactatttaagtgaattaaatattgatggagttttgtttccacaagaaaaagagtatgtcaaaggattgatcgttgttttagataacaaattgttatatcgttcaaaatctaagttcctaattatagggagtggagccgatgaattccttggaggttatggtagacacattacagctaaaaaacataacggtttacaaggtattagaaaagaaatgctttttgatattaacagattgtggatccgaaaccttggaagagactgcagacttgctttattcaataataggacgctatttgcagtatttttacaaccaattgtgattgactcaatcggaaaattgagttttgaaaatatctgtgggtcaagatttgaagttaccaagcctttactaaggtttattgccaacaaattaggagttcaattttcctcaaaattcaagaagagagcagttcaatttggaactagatcttctagacaaactaaccttaagcattttgacagtaatagaaaagctactgctgatgccacatatgttcctgtcaatatttag

SEQ ID NO: 889 - DNA, 687 bp, Cryptosporidium hominis
atggaagcacattcgattatatctaatgaaattagtgaagaaattcaggatctgaagaataagcttttagaatggactagtggaattaatgggatgctagaactaggagtagaaaagcttaatgatcaggtttctcgtgatattaatatgatcaaggactctagtattcgtattgatggattggaaaaacgaatcaaagatactcgagaattatcagaaatcaagaaagtagttgagatcgagaaggaagaattcaagaaatgctttaatactaatactatagccctttcggagaagttgaaaagactagagaaacaacttcaggaagatagacaacgatttgaacaagagaaactggtttacgaggcagatttgaaggtggctaagcagcaatctttagagagagaaaaaagttgtagaatctatagtgaaaatttgggtctgaatattggaaaggtgaatggcaataatagatttacttttacctgcatagacgaaaactttccagaaagagagtttttttttgatttattttataatgagaaagctcagctttatgaaggaattggttgtaacccacaagttagtgattttaaacccaatattgagctgttgaattcaaagtcaatcacattcagacaatttatatgtaaaatgagaaagtcattcaaacaattaataaagtag

SEQ ID NO: 890 - DNA, 1107 bp, Cryptosporidium hominis
atgggtattttggagaggattgcagatatagaggccgaaatggccagaactcagaagaacaagaagactgagtaccatttaggacgtttgaaggctcagctggcgaaactaaaaacagaactaatagaagcaggaagtggaggtaaaggtaaaggtgaagggtttgatgttgctaaacaaggcgatgcaagagtaatattgatagggtttccatctgtgggtaagtcaacattaatgcatgaattaactggaacagagacagcagtagcagcctacgaatttacgactttaacatgtgttccaggtattatgaaatacaatgaagctaagattcaacttttggatctaccaggaattattgaaggggctgcaactggacgaggtagaggccgccaagtaatagctgtagctcattcagctgatttagtattaatggtaatagactcaacaaaggatgattctcaaagaagaaagctagagtatgagcttgaagccattggaattaggttaaataagaaacctccacaaattgttgttaaacctaaaaaaattggaggagtaacttttaattcaacagtgcctttaactcatttggataataagatggtagttagcatattgaatgagtataagatctataatgctgatgttttaattaaggaagattgtacagttgatgagtttattgattgcatcgaaggcaatagaagatatgttccttgtttgtatgttcataacaaaatagacaatttaaacttaagtgagattgatgagttagcacgccaaccaaatagtgttgtgatatcatctcaaaaaagatggaatttagacactttagtagagcagatttgggggaaactaggactggttagattatacactaagaaaaagggagaattcccagatttttcagagccattaatcatgactccacaaagaggagtgataaacgtagaaactgcagtgaaattaatccacaaggacttaattaacgaattcaagcatgcactagtctggggaactagtgttaaacataatccacaatgtgtaggattgtctcataaacttcaagatgaggatgtaatccaactagtaaaaacaagatga

SEQ ID NO: 891 - DNA, 609 bp, Cryptosporidium hominis
atgagttcatcatcatcatcaattaatccctaccaagccataaactatgagttaaatgtctttttgaagtcaactagtgatttctctgcagctactgtttcaattttctataatattgaaaaacttttaaggcttctttctacatgcaatcaagatgccgcctttttatgcggatgcatgactttgcatgtactacaatttattttagtattgcttacgtgggaaattttcccgcaagaaaaagcagtcatgagaggaattcttactacaattttacaggttctaggaaatacaaaagattttcaaataattaagatttcttctgcggttttggtacatttttcgtttagtatacaagtatcagaagatgatgagttggctcagaaagcaatggaatctctttcagacctagtttcccatcaatatcccaatattagggcatacacaactgactatatttacaataatgtgtgccatattcagtcatcaaaaaagattgagtctatacttgagtacattagagaaacaaactggacgcaaagttatagcaaagaagagttggagaagataaaaactcaatttagagatttatgccagctagaaaattaa

SEQ ID NO: 892 - DNA, 1479 bp, Cryptosporidium hominis
atggtattatttcaatggcaaagcgaatatgagtaccttttacatcgaatatgtgacttgctagaccagtgtaaacaaatggggtttctacacatttcaactgattatagaaatgtttttacttccaattcaacattccagaattatattttaattgggagtagctcaatgaaggagtttatgaaagaaatgattgagaagatgacccctttttataccccaggaatacttagttatttagcagcttgctgcgtagatgatattaacttgtcacatctattttctctccttaggcttcacaatattatggaatactacccaaaatcagtaagcgaacacaaacaaagagcaaccattctaacggcaatttttggagagttatatgcaattaaaaatgattttgaggaagggaaacttaagctcaatgattttaaaagaggtcatgtgaataactcggaaaatgaacaaagtattgaattactgaaaatgacaattaatcaacttggagggctgatattggattcaggaagagatagagcaacatttattaaagaggcattttgcgctccttcttttgctcccccaaagtctgatattttttcaataaacaatgatgaattacttaataatcacctccaaacacaggtgatggtcaacagagtttccaatgttaataaaggtgatccattattagtttctgctctgctttgcggttcatcattatcaatctggcaaagaattcacctattatatgatcctgatagaaatcaagccaaagactctattgtatatgcagttatttatgcagctccacttatggatagaatgagacagttagtattcacatctcttctccaatcattttgtagacctcagtggtgtaataaccttttacctcagctttcagacaaaatgagaaggttcaacaatcagaacactgaaattattcagcttattgttcgtggatttctactttctggagtgactatttggtcatatgaatctcctcagcaaatttatgatatcagtacatcatgtgctcttactgcgagggaaaaggatgcgcttttgaaaatctttagactggttgatgaaaaagctcttgcccaagaatctcttgaagagtcatcaattgccccctcttttgagtctgtcattagggaactttctagacagttttatactaattcaaattgggatatagatgataccgggtttgttaaatctctaaatgaaaggcaatcatataataaactaggaaactctattgagggcgctctcaaactcgctgaaactgactacgagtttatgcatcgtcctctcaatattgtctccgacagagtcaaattctatcaagcaatgcagcacttccaagcaaatctaaatgaccccctggcatcatttgagtctaaatcagatgcattgatacaactttcatcatttgaagatattgaggctaatttatttaatgttaactga

SEQ ID NO: 893 - DNA, 1731 bp, Cryptosporidium hominis
atgtacgcaaaagaagattttggaaatgcgaatataagtcaatttattcgactaaataaccggctaagagctaatgggtttttatctataccgtttcttcctgacttaacttctcctgctagatctcttatactaaatagaaaccaagttgaagaagataataatgaaggtacaaattatttaagatacgcaaacccgggagtgagattatcagaaaaattggttcaaacctcaatgatccctcagaatctaaatgatgtaactacgcctcagaatctttcacaaattggagaaacagagaggcaaaatgataagttcgaaatcactccaggtattcgtaagtatactgattctgaatattctggtttgaacacagatgatttgagaactgtaggttctatattacatggaatttgtgctgacagagacaattcatttgaaaatgaacaaaatgttaattctataacagaaattgcaagagaacactctgtatctggaagaaataagatggattttccttttgatatgccgtcaaattatagttccaaatatgggatgaaacctgatggtgattttagattagggtcaagtattgagctttctttcactactgaacaacctgaatccttgtctatggcagctaaaccagaatctattgaaactaaccaaaggttaatagttgatggaaacaaactcatttcaactattcacaatttactatatgaattagaatctcgaggtgaacacactgttgaaactataaactctgaaaggtcacaaaaaaatggacttatggaaaagttaaacctcttgagaaggaaatatgaagccttagagaaagagaatgaatctcttagaatgataaatagagttttaaccgaagaagaacaatctaatagaaaaaatagggttcaaggcagggaaaccccgcaatgctctacaattagcaagttagaaagagagaaacagcaacttcttgttgaaaatagtcgactaaaacaagatattctaaagcttcaagaggatgatgataagtccagagataaagctgatcaatttttgaggtctgttaaaagcaatctggacagtgaaagagattctaacagagccagtaccttcaaccacactggtacgagcagtaatattagtggaacaaccttaacaactttagaaaaaaagaaaattcttcaatcacactacctttactcaataattgtaggatttgaaaaatcgatcagctattggaaattgcaagccaacggtcaaaataacttagattctaagaacgggcaagactcatttgagggtaatgaaactaatctaggaaattcaaatgatactatttctgaaaaatccttctttgaattttgtcaagaaaataatatctccacaagtgagctaatgaaaagagacaagaatctttggaccagaggtctttatatgttacagaatactgatagatctgaattagaaagtatagttaggtggtcttgtaggctacttaatatatcaaactttagaaacattccaattcaaattggacagctattagccaaaaagagtacttcggcaaccccaaaaatcactcatattttcgaaagtgcttcatccaagaaaatttcctcccagaataatagccaagaagtcatatcaattgaactacatgatcgtttctacaaccactttaaaactttatttgatgtacttgatgatcaagatgttatccaagca

SEQ ID NO: 894 - DNA, 801 bp, Cryptosporidium hominis
atggattttgaagatattccttttgaggaaattataagaaaagaaaagatagctgagtcattcgaaaaaagaaaaagtgctgaatcagaaaaaaaaaatgccaatggatcctacaaatcatgcaaagaatctgagaaaaatgatgaaatcgatcaaaaactcaaaaaatatggaagaattacttcaaagaactctccaatggaagtatcatctagaagacaaactttaccagaaaaactagaaaatgaaagaaactatatcagaaataaacatgaaggttcaaaaaaaggcaatgatcctagatttaatgactcttgtggaaagctcaacactgacttattccataaatcatatgacttcttagatgacatgagacaaaaagaatttaatcaaatcaagaatacattagatttatacaaaattatgaccaagtctaaagaacttggaacatggaataaagttaagaaatcatcaaaatttaaaaactctgatgtaaatcatcttactcaagaccaaattgataatctcaaacttaaatatcagaaacttgtttctgaaaaagatcatagaaaaaatctttaccttaaacagcaaaccatatcgcaacatagaaagcaggaacaagctaaaattgaatcaggaaagaagccattctttcttaaacaaaaagatatcaatatatctattcaacatgataaatataaaaatcttaataaaaaacaaatatcaatgcttgaacaaaaaattaatagaaaaaatgtctccaagtttaaaccactgacttctcttagaaaaatataa

SEQ ID NO: 895 - DNA, 513 bp, Cryptosporidium hominis
atgacgttatctaagaattcgattgaataccaatcgtatcaaagatatcagagagtatatgaagacatatataggaagtttgacacatatagagaggaaagcatggctagtagttactattttaataaagagttggatatgagtacaaacattagtggtaatgacggccagaattatttaaaaccatctacaaaagaatataatatgggagtttctacggaagatttgatgaaaaggaatgaagataatttaagaatatctgcaaacctagctcaggaaacacaacatataggattatattctttgaatactttaacagttcaaagggataacttaacaagaagcaaatatggtttgaataatatagattataatatcatggagagtcgtaaattggcaagtacattatacaagcagaaagtaattgagagactgatgctatatttcataatatttgtactattgttagcaaatatatatgtatttttcagaagaattttcggaagaaaataa

SEQ ID NO: 896 - DNA, 207 bp, Cryptosporidium hominis
atgttgtcagcgtccgagtattttgtgtcatatgaagaggaatttttgtctgttatacaaggaatagaacgtttagtgctcaaatgtgtgaatattgaagatggaggaagaggggagaaatttacacaggatgaaatatctatattggaacgtcgatttcaggatgcaaagaagtgcttggatcagctgaaagatgaagtaagttaa

SEQ ID NO: 897 - DNA, 1293 bp, Cryptosporidium hominis
atgaccaccaccacaactggaaacccaacaactactacaactaaagctccaaatgcaacaacaacttctacaacgggacatccaacaaccagttctacaactggaaacccaacaactactacaactaaagctccaaatgtaacaaccacatctacaacaggatatccaacaaccacttctacaacaggatatccaacagccacatctacaacagtacatccaacaactacttctacaacaggatatccaacaaccacttctacaacggggcatccaacaaccacttctacaacaggatatccaacgaccacatctacaactggatacccaacaactaccacaactacaacagttccagatataacaactactacaactgagtatccaaatactacaacaaccacaagcgaaccaccaaaatatgcagtttcgttagtaatggatctgtctaaagtaccaaatattgatcaaatgaaagaaattaatttgtccgcaaatgttatttatagaaatttggtcgagagtggaataaatactgaaattttgtcagttccaattaatgaaccaaacaaaacccaaggacatacgagcttcatatcaacattacaaggctctgataataatatgagggttgatagattgttaagtatggttgcacagcaagactcagaaagagtattaaatgttattgcacaacaaaatggtactgattctcattcaaatcaaagaggctatcataataaggtgctattaaagagaagaaagatagtatatatcactgcaggttttaatggttgtacttctgtaaagacatgcccaggaatcgttagcttgaaaaaagatattgatatctacttcatttcattatcaaaagatgcaaatatgtatcgtgagattgaatatatttcatcagaacccgtcttattgcattctattatgatgaataaatcagatttaagcaatgaagcatctcacatttctaaatggattagagatgaatatagattcaataatccaatgtttttgataccaaaaaaagtcaagaaaaactttaagaatgaagtctgtagcaaatgttccaaaaatgctgaatgttacgtacattcaatctttgaaacaacgcatgatttaagtaaatttgagtgcgtatgttcagaaggttatacaggagatggattcacatgtcatgatatagatgaatgtaaagtgggtaattattgtggtaaatcacagtgttgtataaatacacttggaggatttgaatgtaaggattctaaagatggaaaatgctaa

SEQ ID NO: 898 - DNA, 408 bp, Cryptosporidium hominis
atgtttggagttttaaataaaaaatttgttctctcaataggtctcctattgataaatttaacaattatttttgcttctgatattaatgaacaagatacatgggtttcaccagaaaatcaacatgattataaatataatgcaattttgacagatgaaggtacgtcaaatttaaatagaaaggtggcagaatctcagagtcataagtataaacacaaccaccatcaaagccaccataattatagatattataacacttattataatacatatactcctaaatatatagatacaaccgatgatgaaaggtcttatactaatagtcattttaattatataccaaaggaaaaccatcattatcattacaatcatcatcaaaaaaatgtttaccaaatgggatggaatggccac

SEQ ID NO: 899 - DNA, 1209 bp, Cryptosporidium hominis
atgagaggccgttggaagggaggcaaaggtggacatggcggctcatctagtggaggaagcaatacgaaagtctcagagatttgccgacattttgttcaacaaggcaattgtaaatttggccagaattgtaattactcacatattttaaggcaagttgcacaaatacaaaaggctcattttggaggtattaggtgtgcaatttcttctcctttacctacaggagagcttgaacttttcacaggggggtgcgatggtcaattgaagagatggataattagacctgcagataaggatgttatgacaaccgagcctgaaaggggaagtaatcatcgtagaagaaactatcagaacaagtttcagaatgatgttagtggagcaactcagctttcagtaaaaatggattcagcaattaattgtagtgcagaggtttgtagttgcttgatttatggggatgtactattttgtggactaattaatggcacaattagagcatttcacaagcctacagggaattttacagatttagttgggcataaccaagaaatacatcaacttttaataattgacaatatactcgtttctgcttgttggggcggaaagatagtattttggaaatttgatcaagcttctggtacttttataatttctgcacagattcaggctaaagagcatataaagtgtcttaaatattttccgtataaaggtaattcagctggcgcaatgggacaacctcaatgccaaattcaggatgcatctcctcatctttgggtttgtggaggcggtattgttcagattgtggatctaattactttacaagtagttagggaaattatatttgatggaggacctattatgtcagtactcgaatatgaaaatcatcttgttctatgtagtttgcaaggcgtaattcgtgttatttcacctacaggtgaggaaacttttagaaaatctctaggttctcctgcgctttgcatggatgggactgttactgcagacgctaaacatatcttaatgatgggccaaaataatgggcatcttagatgtatcacccttcctctatttgacagtgtacttgaatttcacactcctgataccagatcagaaatcagactagtttcgaatctagggggatctcctggaatcattctcactgctcaatgggatggtgctttgaatttttatcaatggtgtcttccaaaaagttcctga

SEQ ID NO: 900 - DNA, 1329 bp, Cryptosporidium hominis
  misc_feature (172)..(172): n is a, c, g, or t
atgataagtatggaaattcagtttagagatataatacagaaatcaaatcttcctaaacctgtctcaaggaatttgttgagcacaaatacaggagaaaagaagttatatagaatatcagtggaaatagaaagggattggtttcaaatatacaatgttgatatggaagtaactntgagttttcaagagtctgaaactgaatcaatacaagtatttactgatgaagtggaattagtacagctagatggtatggagtccagaattattttaaaaccagaaataaatcaaaaattgattaaacttccgtctttttcaagtgagtgtataattcaaacaccaataatgtttgatatgtctccgatgaaaacgtcaactgaagtaaattttagtttaaatttaattgcgagtattaaaggtcaagagaaagaagtttgtactagacataattttgttttccaagtaggaccacaagtagatttgaaaaatattcaaccagttccgaatctagatcattatagcttaccattttattactttgaattactttttgaagcaacttgtaagagagttttggtagaaaagataattaccatgcttccaaaagatctagaaagctcagatttatttggaatcatggcccccgtagaattaaaaccaagaacaattgaaaattttcaagatttgggagatttatattcaattcgtgaatatactctttctcatccattgattattgaatctaattcaagacctctaaaattgatatggatagttccgaaaactgaacttcaaaagatgtttactcctcaaattttaatatcaacaattagcctaccaaaagaagaaagaacaaagttatctatttcaggtcctttccaaattccaatggaaactttgtacaattttatttcattgggaaaatccacacattccacagacaatttattagaaacaagcctagatggattaagtttagaccatgttgaacacccctcgtattcaaaagttgactcggagtttccattggttatttacctgaattatacatttcaaaaagaagaaacattttcatattgcttaaactactttggagatgaagattcagaagataagggatgctggtggtttattggagctagaaatggttatatagaagctaaacctgggtcaaaaattaagctagagttcagggtagttcctctaacaaacggactgttaaagcttccaagtattaatttcggatgctctaactcccatccatattcttatccatattttacactatctgataatagtagaaaattttaccttggaaaacaagtagtaatctag

SEQ ID NO: 901 - DNA, 498 bp, Cryptosporidium hominis
atgtcaaacttatcaacttcaacagtaacacaaggagcgcagacctataaccaaggtacaggtacacaaactcaaacctcaccaaacacacaaacaaccacctcaaagaaaacaatgtaccctaaaccgcaattacaacaaagttctatatctggatatgagcaggttagttcaggagtttctagcccctacaatgggtcagtaggatcaattccagtagttttgcaacctccatcgacttcagtttcacctagcaactattatgcagttcctccagctcagtacattttagatacttctatttattcatctgcaactccttatgttgcggttcctgcaacagtactgtcacccacagttatgacttcaagccctcagatgagtgctgcatacgcaagctatggatttgttccaagtcagaatttagggtacacaacagtaggagtctcccccacaaatacttcaaggccatcaaaatactccccaggatgctgttaa

SEQ ID NO: 902 - DNA, 1827 bp, Cryptosporidium hominis
atgaattgcaatatgctaggccggatgttaaacttcacaagatcaccttggttgaagcaactattttctattgaaatagtttctagaacaattaagaatctaattcccaagttgattaaaacgttatttttaccaggagcaatcagttatatgaagaaagaaagtggaaatttagggagatattgcccttgccatagctcgagcccaagtgtgtctatgttacatacaattttcaagatctatataacttcaacaaagaggaggatagggagcgaacgtattatgattaatagcagagctaaggattcaagatcacagttattttcatcacagttcctaaacacagatgtagttgcagatcaggaaaaggtgattcatagagaaatgaaaaacgaagagaaagatactgcaaataacagtaaatcactaatgactcaatctccaatctattggaacgagatttttaaagctcttaatgaaaacaattgggatattttaaatgttcacaatataaagatcagtgaaatatccaaacttcttgttgattgggcttcacaattctttaatgttgatgataatattttaagttatacaaacagaggaacattaaactctagaaaaaaggaaaatgataaattggaatcagaaaagtcagatttacgtcggttttctagagagttaattcaaatgaataagatgacccttccatattgggttttggaatgtctatttagcttaaaccaaaaaagtttaattatgcttagaagacatagatttcaccaaattacaattttacaagtaatgttgacaaatttattcaacttaattttaggagactcaccaaattcacagctattttggtcaacatgtatctcaaagttatgctcttgggaattttctattgctgaaactagcatttccaagaacaaaataccaataggagctttattctatgctttagaccatcatacaggagtcaagtttttcttggatattaaaaagttgaaggaaaatctccaggatgattcaacttttcctatcaattacgatgattttgattcaattttgcctaaagcaaagagaaagagtgaacattacttttctgagagtcttccaatttggggaattttagagactccagagattattaaattgccaagatataacagcttttctgttatttccaccccaactatttcacagaagttaatagcattaagtataaaactttcagcaagctattttacaaatattcagttctttttggattatatgacccattcagagcaatttcaaggtgctgaaagacatcttgttagacaggattggattgtacaagaatcctggttagagcttctgggatatttctcatatcttgaatatgacaaaaaatgtattcaaattcttaataatgtaatcaacctctttcctcaggatcatattgcttcaatacaaatgagaattctacaaatgtggtcatattcaagattaaggaacattgaaatattcaagaatactgattttaatgcattaaataacaattttgatcagataagcatatcagaaaagtctataccacatgaaatcagtgtctcaactctaatttttgaaatcattgatttacattggtcagttattcatcctataattattgatgtatatacttcaacagccttgatacatttcttaagaggaaactggaaatcttgtgaagaaattttggaaaaagctattactaagtcattggtaattagcagttgttttgacagtaatagtgatgtttttaggcattatagcaaattattgtctagtagaaaaaactcttag

SEQ ID NO: 903 - DNA, 363 bp, Cryptosporidium hominis
atgattatcatttcagcaaagaatatgaaaaaagagtcttctcagtggaatttaagaaacatcataaggttattatttcagactaaggaaagaatggtatatttatttatgaatgcttgtaatggtaatcaataccataaaagactttttagattatttctacttgcttcttatttaaaaagaggagataaacttgtaaatctcaaagattgggaaccaattctttcacttaacaggaattctaaggacgtggataaaagtagacttggatgcagttataatgaaaaaaatgcatctggattactttttagtgtcatttacgaagctaattcttggctttatgagactgaagaaccaatctag

SEQ ID NO: 904 - DNA, 1020 bp, Cryptosporidium hominis
atgggaagaacaaaaagtagtagtaaatttaatgaaatggatttctgtatgtctggaatgatggtaattaactcattaaacaatactacaggagaattatctgaaaatattaatcaaagttacggaacaatggacgaaggttttggtaatcttagacaatttgaatttgataatggtgaaaataataaacagattagctctttgagtattaatatagatgaaacaaaatctaaatcaaatcctagatatttagtttctcatatcaaagaaagtgttgaaattacagctatagagaatttctttattgatcttatcaaagaagcagaagatgatataaagtttatatggaaaagtatgaaagagcaaatcagattatttaagacagtaaaaaaggatgaattagatgagataagtcgaataaactcaagaattcagtatgaacaaagaataagtaggctatcaaagattagaattaatgaaattttgaatgacagtggatcaagtgaaattaaatatttggatttagatctagaaaggagtaatttggttaagaatattaatgaatcatttgagctttcaagtatttcagatgagagtttttcgatatcttttccgatttataaagctagtttgattgctacagataatgaatcgaagaatttattatctaaattgatggtttataattcaaaaaaagcaacttttgacgatgagtttgaacagattggtaatgattcaagtattatatacaattcattattgaagaagaatactggaatatatgataaaactcttattcaaagtgattcagaagaaagaaagatgattgatggtgtgaaattgaattcggaaaatgctttctttacagaaagctcagaatttgataatgttgaggattatacaaaatcttatcctttaagttatagaagtaaagctttggatattttaatttctctaatatattatactacagattatagagactacttttcgaattggaaggataatcaaaagacctga

SEQ ID NO: 905 - DNA, 660 bp, Cryptosporidium hominis
atggaatcaatctccactgctaaagatacccatgataccgagattcttcatttcaataatcaatcaaattctttccaagatcttgatcatgatcacaaaatagataccaaaaatattaatactggtaccgataatgttaaaattgattcaagagaagaattaataccaagtttagattttaatgatcttagtatgattgagagagtatcaaaagagggggttaatacaagttttaatatgaaatctaatgtagatgagaatgaaataattgaatggaaggtcttaaaaaaagccttaaggaaagaaattgttctgaaaggtaaccaaatgtttgaaaaatatggaggattagatcagtttgactatttaccatataattgcaaactacattcaaatttagaaaactctcatttagatgaggtttctccacgccacaaaaatattgaatattcctgtccagattgtggaaagtctattttggagaactttttaatggatattctcgaagcttttgactgtcatactgattttcctcctacaattcaaagaatttgtgaattgttattgttcccagactgctataataacacaaaaagctttctttatgctcttgataaggtatgtttagctcgaatatctttcagttctttcaagaactga

SEQ ID NO: 906 - DNA, 2325 bp, Cryptosporidium hominis
atgagtgtgccaatatgtggaggaaggactcctgggagaagatatggacatacaatggtctacagcaaacctaatttgatagtatttggaggaaatgatggacagagaactttgaatgatgtatggtttatgaatgttgaagaaagcccgtttgtttggacgcaagtattatttgatagagatgagagagtgccatttccaagagtataccatagtgctgcattgtgtacggaggggccagcagcggggatgacagttgtacatggaggaagagcaagcgattcacgatgcttaagagacacatggggtcttaggcaacatagagatggaagatgggactggatagaagccccatgcagaaagggaggacctcctgcccaaagatttcagcacgttgttttatttgttggatctaaaatgttagcattaggaggaagaggagatgatgtttcaaaagtgttaccaagtatgctttatgacactgaaaattgtgagtggagagatttgcctggtattgaaaggtttaggcattcagcatgggcaataaaatcaactttgttcagttttgcaggatttgaccacaagacccaaactcatcctactgttgatttactttctatggattgttctgcagagccaaacttctataatgaaaaggaaaggtcaattagacgaaagagccttgttggagttccatataacactattggagttcagccaaaggatcaattagttgttggaactggtggagatcctaacaaaactacgagaagtgatctaaccaatgaagatctcggctcttcaaccactaatgagcaaaatactgtacaggagtataactcccctaaatcaaatgatattccattcaccgatgttgagagagcaatagctagggcgaatattcagctacaaagtgactcgaagagatacatacccaaaatggaatataagactactgcgggattaattggattaactcctgctgtgaccaaagtcagctctagagttcatattactgttgactctatgaacaatgacttttctacgcttgtccaaaaggtttcgattgaccaacttggagaggaaggaaggaaaattgacaaagttgcagcaaagcacgcacttgcagattctccttggatgttaactccaagttcaatgggagtgccaggtactggattaatagaaaaatgcttaaagttatttcttcatccaactattactcctgttgaactatccgctagatttaatcatatggcagcattctcacttacttggccagaagtcatacaactttgcgaaatggccttcagtattgtaaaacaagaggatatggtccttaaactcagaacgcctgttaaagtttatggagatatacacgggcagtattatgacctaatgagactctttcataattataaagctcccatcagtgaagagttagaagatatttttgaagcaaaaggagatattgattccactgattacttgtttttgggggattatgtagacagaggtagtcatagcttggaaaccatttgtttgctttttgcattgaaaattcgatacccaagacaaatccatttaattagaggtaatcatgaagatcctgtcgttaattcactctatggctttaaagatgaatgtaggagaaggttgagggaagatactgatgatcctgattcatgttggaattggtttaaccgtgtttttgagtatcttcctgttggagctattattgaagatagaatattatgtattcacggtggaattggaggctctattcataaagtcgaacaaattaaagaaattcaacgtccattaagaccttcccaaactccacaaactgagtatgaacagagaatacttgatctcttatggtctgatcctactgataatgactcactcgagggaattgttcctaatgacaccagagatcctgatggatgtggttttatcgttaagttcggtcctgatagagttatccagtttttatgtgaaaataacctggatctaattattagagcccacgaatgtgtacaagacggatttgagagatttgctggtggtaagcttatcactttgttttctgccactgattattgtggaaagcatcaaaatgcgggagctctactatttattaagagagacttaacagttgtcccaaagatcttgctcccttcagcttcaaaagacccgagaatgattcttaacaatagtaattattgggaccaaaacattctttctgaaagacctccaacccctccaaggtctgccacatactttgacaaaattaattcagaattcattgatattgcttcatga

SEQ ID NO: 907 - DNA, 3543 bp, Cryptosporidium hominis
atgcagagcactaaggatggagaggaatcgaagaataatatagaagttgaaacatcagaaagcaagctgagtagagattcatcagtatttggactctcaaatcaaacgccaaaacctccaattaagagagactcatttgtggggaccagctaccttccaattcaaaaccattataaattgggagagaaagtaggagaggggagctggggagcagtttatattgtggaagagcgatgttcaggaatactcagagcagcaaagaagattccgaagcaattttctggtgaaatattccggtttagacaggaaatgcagcttttaagtattttagatcacccaaatatcgcaaagttattcgaatcttttgaagattataactctatttacttaattatggagctttgcactggaggagagctatttgatcgcctttctcatgttggaaggttttcagaaagagtaactgcccacttaattaaacaaatgttgtcagcaatttcttattgtcactctaagggaattgttcatagagaccttaaacctgagaacttcttgtttctgcactcaaaatccaatataaactgcaagcactgcctttttgaacagaaaagtagccagttattccaagatgaagaggctgctctatcaaaatacttgaaacaagacagatttaggatttgtagatctttaccgtctagtatgaacaaccaacagctccaatccctaatctataatatcaacgataacacaataaatcctagtaataataacgccatttgtgatattacttccaatcacttgttctctgcttcaaattcagagatttgtaagaaaaaccgtgataaagaagtgggtgaaaggcatgaaagttatgatcaagaaactaacaatggagaactaagccatacagatatacctattcctaactctgagccatttggaattccaaactttattgctaatatgtacttgaaaaagggttctatatctaattctatttcaaattccaattcttcttctattaaatatccaataccttcccatcaagataaggagtgtgaatgtaactgtaattgtttcgagttgaatagtcctcttaaacttatagattttggattggcaaaaagaattaccagaactggaactcttagaactagagttggtacattatattatattgctccagagattttattagggaaaggatatgatgataagtgtgacatttggtcaattggtgtaatggctcatattctattatgtggagtgcctccatttgcaggaaatactgatactgaaatcattgagaaagttcgaagaggaagtgtctcgttctcagaatctatttggagccaagtctccactcaagccaaagattttcttcttcaattattgaataagaacccatcagaaaggatttctgcattccaagcattacaacatccttggctgagatcttgggacacgccgaatattcctctttgtggtattggaatgattaacaagattgttgtttggccatggcatcagcagagaatgagggttactaagtccagagcttcatctggtattagtagccttaagatcaaatccagcatttcttccccaagtttatattctaatcgagaacgaataaatgatattctttctgaagaagatcttaataatttatcaggatctggtgataatacaccagttgttaccagttccccagaaactggaggtttcttcaaaacacaaatagtaaatgttccgccgaggttagactctagctcagggcaaggatctgtagcgggatctatgatagggttcttagagtctcatggtttatcaactggaagtcaaattagaaacgtgaatagaaattcaatgctgaaaagatcctgtagtactccacttctctattcaatgaacaatgcttatccaaatacagacgctaatccaagtcttgtaagtattccaaatagttctatatataaccctggtttagttcaaattgcagatcagcaaatagccactcctcgaaccaaagcaactatcaatgctttattaaaccaagaagattccattttatctcctcctggagatacaagatttcactttggctgccattgtgggaaccctatagttcttaatcacttttgtcaaggcaacgttagtattaattcaatagatcatggaagttgtgatgggtcaaaaagctactctggaatttcaatacccaattcaatatcgtcttcttcatcttcttcatctacattcactacgtcatatagtatttcaagatcctcactttctttttctaatttactaacaaataataatctaaaacaaggaaatatagatgaatatcttgagaattcagacgagaatgcaaatgtccaacgtatatcagtcataaataacgttacaattccaaatatcgtctcaaaagtatgcgataaagaacaattattccactgcgttatttataataagacatgtaacgcttacaaacctctccttaaacttatatcatcttgggaacggttttgtaactatactcttctgaaaagagtcattttagtttcaattgctcttcgaataggagaaaactgcgaatttaatcaactcagagatcaattcaacaggtttgatgttgcagcagatggtgtagtttctcttgctgaactacaatgtgttctttgttttatattccatgttgaaaggatttcatctagcaactacaagaacaagcaatgccaccctaaacaaacttcaaatgataacttccaatctgtatcttctcgttcatctcctcttcctcctcttgcaaattccccaaaccatcaacctagttttgaagattacatagataatgccagtgaaattgaagaggaccactttgatgagatctatgatgaaggatttcgaagctctgcaattgaaagcccggaaaaaggagcttttaatcattccaatcagattggaaaccgcaaatctatgtccatcgatgattacttgaaatcactttcaaatcaaagcacattcaataaagaccagcttttaaagtttctatgcagcttcaatattgacgacatcatcaaacttaatgaactttgtaacagaatagaaggtatttttggtatcatagaccaagatcaaagtgggtcctgggaatattctgagtttattgctgcttcaatggagcctgaaatgtatctgaataatactagcgcattaaaaacagttttcaggaattttgataaagattcagatggaaaggtctctgttcaagacatacttgcttctttcggatgggaagatgatatcattctatgctcagaaactatttcgccccaacaatatgaacaatacctcaagttggggaactctcaatcatatgatcagcaaagagatgagcgtttcttgggagttgatcaaagcaactccgtccaatactgtgctcacatacactggaccgagatctttctaaatgaatgctgcaaaccaggtaaaaactatttagatttttgtgatttttatgattttctacgtaattag

SEQ ID NO: 908 - DNA, 261 bp, Cryptosporidium hominis
atgggaacaaaattagtaagtaatattaagaatttcattatatctggaagaaatcagaatggtattaaagggttggttaaaggttcttatcctaatggatataggaattttggtccagatctagataggatgatgctaccactaaacaagaaatatgtagacgagagtaaattagtggatagtattaatgaagaaataatagtattggaggttgtagtacaagtggaggaggaaaggataattattacctctcagtattga

SEQ ID NO: 909 - DNA, 1851 bp, Cryptosporidium hominis
atggtttcaatttcaggaggtaatgatgagattccaagatcaatattgtattacgagacaccacaatattgttatagtttgttacgttgtttacatagggtattatgttgttgcccaagaattgttggtatttcaagattagtttcaactttaattaatttgattgatgtaatattaccactttatgatttaaatggtacattatgttcaagatcaaagaattttgatggccagttaagtactatagggaataatagggggggtatgacaggaggtgatataggcaaatgcgcattattaatgagaaatgtggcatttcaggtagtatttgatataatgtgtatattaagtgatacatctcaagtattctatgttattagagttttagttaaagttcgagattggtgtggatcatgcttattagatttaataagaaggtgccaaagacttgcatcacaaaatagtgagacggggaatttaaataaaaggactttaagtacctataatagccaattaaagagtaataatattggtggagtaaatggtttgacaacagcagtaaatcaaaagtatgataagttggatttaaggacaagagttggcgcaacaggattattacaaacttcaaataaaaagattagtgaattaggtaatgttaataatacttcagaaggttcaaaactagtacagaattcaagcttagttggaggaactagtggtagtgttgcatcatataattcaggaattgatttatcttcttatcttaatataggaggattaagagagtttgatttggaaatagtgaacccatcgttttggagtgcatcaaaaatattggagattgcaggtataaatagaaaatggataacaggtcaaattggtaattcaggtaacaattatataagtatgaatttcactggtgtaggggttggcggaggtggaatcattaatggtttgaatgataataatagcagtaatatgtcaataagtagtggaatatcttctggattatccagtgatataatagtatcgtcaaaaactactcaggtaatttttaacagaagcgaaaatatgggaagcaataatagtgggagttctggattaggtggtgcattgaggactgatgtaataggaggatcaacaaaatctattccttctactaacactaatattattactgctacgaccaatgctactgctaatgctactgccactactagtgctactaatgctgctactgttgtcacatcttctacaacagcctcttcaccttcagcaatagcaataggtgtagggaatatatcatcatcaggttcatctaattatggaagtatttcatcgccaaaagcagtggctcttccttcatcaaattattgttatgattacagtagtgaagatgaggagaatgaagattatgattttgatgatatagacactagtagtgatgaagataaaagtatagtaaatttcaaaggtagtgaaagaagaagagggagtggaaggtataagtttggcggaggatatgctgaagaagataggagaagaggagaagaagaagatgatgatagcgataatagtagcggtgaggatggtgatgatgattactgggaagcagatcagaaattgctagaattgataagacttcgtccaaccagttcaataataaatgctcagcctccaaccgctggaatacttcgtaggactgtttcatcagatgtgagtataagtaaaggaacattttcaaaaataggaagtatatcatcattatggacgaaacataattcttcccctccaaaggctttatcttcaatgaaaagagtatgttttgctgaagtggcgcagatatattaa

SEQ ID NO: 910 - DNA, 4266 bp, Cryptosporidium hominis
  misc_feature (2642)..(2642): n is a, c, g, or t
  misc_feature (2656)..(2656): n is a, c, g, or t
  misc_feature (2683)..(2683): n is a, c, g, or t
  misc_feature (2716)..(2716): n is a, c, g, or t
atgtttgctaatcaggatgatttttggacttcagatgaggaggaggaagaagaggaggaggtagaagaagaggaggtagaagaagaggaggtagaaggagaggaggtagaaggagaggaggtagaaggagaagaagataaagatgaagaaaagaatgatcaaaataatgatttggatatggttgaagaaaaagtttccagaatcagtctaaaagagggtaaggaaagagaggagaatggtgaggaagaggaaagaaagaaaaagaagggattgatcaggaagaaatggagtattgaagatgaacgagatgtttctgatttcagggaaataataggttatgagccttttaagaaagaagatttggatgattcagaagatttggagaatgtggtattaaaatatccctatgaattggatgattttcagaaaagagcagtaattaatatacataatggagaccatgttttagttgcagctcacacttcagcaggaaaaacagcagtagcagaatatgcaatagagttagctaataaaaatggaaggaaggcaatatatacatctcctattaaagctttaagtagtcaaaaatatcgagaatttttgaatagatttagagaatatcctgcacattcatcatttactcagagaaacaggattggaataattacaggagatgtgagtattaatcctgatgcacaatgtgtaataatgacaactgagattttgaggacaatgctatatagaaatgatccttgtattgaacaaattcagacggtaatatttgatgaggttcattatattaatgatttggagagaggcgttgtttgggaagaggtattgatattattggatccaaaagttcaactggttttgttatcagcaacaattccaaactatatagagtttgctaattggattggaaggattaaacaaaatactgtttattgcattcgaactttacataggcctgttcctttgaaacattatctttacatttacgagaaatgtttccaaataatggatgagaataataagttcaatataaatggatacaaggaaatgctggattttattaaaacttcaaaatctaagaagagtattagtagcttaaaaagcaaggtcagtaagctcagttcgtcaatatctaaggcaaactcatctcaagaaattcagtctcaagaagacccaaatcaagaggatcccagccaagaagaccaatcccaagaagaccaatcccaagaagaccaatcccaagaagctaaagttgaagacaacaatattgcaatgcttaggatctcaacaattaacaagcaaatctcgtcttctgcaggagcaaagggaggatctgggggaattctttctagtgcagaaaccaaattcaagactgaagtttacagattacaagtgttcttgaagctcttggagaaaaatgatcaattacctgtcatactatttggattttctaggagaaaagtggaacaattagcaaccaatttaccaaatctcaactttttatacaatcataatgaaaaaagtaatgttattacatttattaaagaatctacaagtaaattaaatgaattggatcaaaaaattcctcaattattacaatgtaaagaattagctttaagaggaataggaattcatcatagtggaatgcttccaattatcaaagaaatgactgagatcttatttactagaggattaatcaaagtattatttgcaactgagacaatatctatgggaattaattgtccagctagatctattgtatttactagtattaaaaagtatgatggaagaaaaaatagaatacttctttcttctgaatatacacaaatgtcaggaagagctggaagaagaggtattgatacttttggtaatgtatttatatttaattcatcgcatgaaacaataccagaatgtattgatattgtaaaaatgatgcttaatacttatttaccagtacaaagtaaattcagattaacatatcagatgatacttcaactttcttgtagacattcacttaaaattgaagatatgatgactaaatcatttaaagaaatgttcagatcaattaatcttccaatatttcatcgaaatttgaatagaaagcttaaaagacatcaaatcatactttcaaaattacattctatattagaatcatataatagtaatttggttatttctaattataatcaaagaaatacaaatcaaaatataaatcaaaaagatgaatttcaatttgaatctgattctgaatctttattaaatattattaatggtttaatttcaactattgaaacttcaaatttaatttctggtcaattatttcaaaaactatgtaattcttcaattaataagaatatactttctcagaagattcttaatcctggaagattaatattattcaattctttttatttgactggtaaatctttaccaatgtttgcaaatattttggaatataatccaacatcaacactttcttctattattgtttattcacaagaatttattgattttcaactttcatcaaataattatctttcaaaaaatattatggatggtaataataataataataataataataagggaattggtgattctaataatgatattcaattttatgatgttgntgaagaaagtattnaaaattatcaaaattttaataagaatngacaaataagtgtagtacaaaacttgatagatnttgatagatctaaaaagaataataatcaaagaaattcttcttcatcatattcttcaaaaaactctacaacaatcaatttgattcattattcaacatttaattctcagaaattattgatttcaacatctttatataatgatacaaatattattgaaatcaatccattatttaaaaatattaataattattatattttccaaaatgttccattagaactttttatgttcatttttgattttaatgcttcagctacaaataatcaaacaaatcttcttaaaagtattaattttaaagatatttccatattacataacattgcaattttacttaaaaactctgttcaagactttttatcaaatcagaatagtatgaataatatgaatggtaattgtaataattctttaaaaaataataatttaggaaattctggtataaatcctaatattgctccaaaaccaaagaataagaacaataaaaaaggtatgaaggtaaatctttttgaattcattagtcatcaagagcaacaaaaccaacaattaaatactaatcgtggaaatattaccgaatattcttcatcatcttcatcttcaaatataccagaaaactggccaaaattattacctatttccaaaacacttaaatcaatagaaattgaatattatgaacttttacaaagatataatgatcttttcccagaatttgttaataatcatatattcaaaaattgctattcatttattattgaagaaaataataatcataatgataataatgataataatactatgattcaacttgttgttgaacttaataaattggatcatgaaatatcaatttataaacatttcataaatgatgaaagtttggatgattatccagaaatgaaacttaaaatacaattattaattgaaaaaggattccttaatgaaaatcttactattacaactaaaggtagaattgcatcagaattacttacaagtgatgaacttactttaatagaaatattactgaatggtatgttacataaattaaataatattcatgaaattacggctatattgtcttgctttgtatttcctgaaaaaatggaatcattatcaaattcaaatactaatacaaataataataataataacagtattcttggtatagatagaccttcattaccttctgttgaacttttgaatgctcatgatgagcttattaatattcatacagattatgaaaaaactcattataaacatcaaataaatttggatactgaacatttttggtctttatgtaatgataaatttatgttaattgcttataaatggtcaaataaagaatcacttaaagagattatggaatttgtacataattctgaaatgaatttacatgaaggtacaattgttagaacaattttaagacttgatgaacttgttagaaaacttataatagcagcaaaaatgatgggagataaaatacttgaggaaaaattatgtttaatacatgaaaatattgccagagatatcatttttatgacttctctttactttaattccaattag

SEQ ID NO: 911 - DNA, 1305 bp, Cryptosporidium hominis
atgttactattaaaaaatcaagacaataataataataataataataatcttaaaaagaagatgattgaattaatattaatcaaaaaatttaaagatttttatatattaataatgaagaattatggaattaaaatgaatcatattaataataatatgattgaatattattatgaaaatttaaatgatagatttcaatataataataataataataatataattgatgaaaattgttcaatattaaatgaagaaaaaaatgaaaaaatgataattaataataatatattattaaagaaaaataaacaaaatgagagaatttatagaattggaaatatacatcctaatttaagaggattatcatcaatgataataaataatattaatgataataatataaataaaaatttgatattattaaaaaaaaattcagataataattataatattaatgatgaaaataataataacaattattattataattataataaaatacaagtattaatgataataaatgatatgatacaaatattattattgaatataaatcattttaataataataataataataataataacatgttattattattaaaactagtggataatatactaataagaataatattattaacaatagaaaatattattgatattaataatgaagatgatgattataatgaagattatgatgataataataataatatgaataatatgaataatagcaataataataataataataataattattattattataaaaataagattaaaattggaggaaataattataatgaatataatggaattaatttaaatatagaattaattggagaagtaataattgaaataatgttatattttggaaaatattatcaaaatgatgaagaaataaaagaagaaattgatttaatgattaatagaataaaagaaattgatgaaattgaattaataaattctgatttattatcattattaattttaaaaatgagtcaaaaatataagatatttaataatgaacaattagataataataataataataataataataataataataataaaattattaaatataatagaattgaattaattatgtttaaaaatgaaataaaacaattattaaatgatagaatgagagataatgaagaaattataaataatgaaaagaataaaaatgaaaataaagaggaatatgaagaaattcaaattgaagaaattcaagttgaagaagagaaagttaatgatgattatgatccaattagtaatgcaatgatgatttgggaatattaa

SEQ ID NO: 912 - DNA, 720 bp, Cryptosporidium hominis
  misc_feature (694)..(695): n is a, c, g, or t
atgaaagagttaaatttaagtttggttgcttcaaaaataagaaagttaaagaatgaatcagaaaacagaagaaaattgagtaaagaagtattaatttcaatgaaagatgtagtgttactgaactttttgagtgattatatgaacgagatagaagaaaattctggaacttacagtaacagaaaaagtttactttctgttaaattggtgaataagttcttgaatgctgcaaataaaagactagaaatatcagaatttagaatgaaaaaagaagacccaaggttcttaatgaatgagttaagacttgagatagaggagtgtctaacaattacatcaaattttatttttcaagtttccaagtgtaattattacagaggattgctttcaagagagtttccaaatatatttgaagttatgataaatatagcaagttctaatttacttggtattcaattgagatgtcaaattttggaggcaatattagaattaatgaaaaatcaaagtaatgataaaatttctcaaagtatttctttaagaaaatgtttatcggaagaagatgatgaaaaagcacttagcaaattatggaaatctttattccaacataagaatatgtatcttacacaattatttgatcaagataagatgtttgatatttcatcttctataaaacaagaaaaatataatgggaattcatcannaactattaaccaccttaatacttaa

SEQ ID NO: 913 - DNA, 1464 bp, Cryptosporidium hominis
atgacagaaggtacaagtaatagcagtacttgcaatgcatcaaagattgcagacttttttgtaacagagttctacagtcgtctgaagaaggacccctcaaccctatatgaactttatcacgactctggatatttagcatgggtggggaatcgttccgaagtgatggatggctcttttaacccacaatctgcaattagagcagagacaaaagaaaagattcgttctgcaataaatcttttagacttaagcaactgcacaacttatgttgaggtgcttgaatgctcaaaatccatcaataattctttctgcattacagctaaaggaagaatgtatattggggggggagagagcgttggaaaaagttttgttcaaaacttccttttaactgaaattcgcccaaggtggtattttattaggaacgattgcctcatatttattgattctgagttaccacttaaacaaagcgttcagaatacagctaaaattgcaaataatgattctggagtagctaagaatagtgggaagaaatctcatgactcgggttttgagactaataaatcccagaaagaacaaaatcattcaagtaaggtgcaatgcaatgatgaacataacaaggaagtcaataaacatgccactggacccaaagaggatgatgataataaaaatcaatcagtggtaacagtgggtgcccatgcaaatactgattccaatgctgaatctcagaaaaaggtttccagttctactgctgctaatactagtaatactagtagtaatcatgctagtacttccgctcctacaacatccaataatgctgctgctaatacttcatcggcatcatctccttcacctttggatccagtaaactatactgattcacttaatgcaaagaataacgctaatattaaccgttctaatccccataaatatgaagtcacaagctatgcaggaaagcttatggggggagcattgaagaatggaaataaggttaagggatatgcaatccacgttccaactgaggataagaataagacagcatctcaaaatggttctacaaaaaaaacaagtactcaaaaagatccgaaatctctaaaggaagcaaaaaataaacgcaaaatctttgtgcactcacttcctactaatatatctgatgatcagatcagagaggcagttttgaaccaacttaaggtacatggaggaggatatgtaattgatattgagagagcccgagttagcggtagacattggggtattattgaattggattcagagttttcttgcaaaaccctcttaaataatggcctttaccttggaggtacggaaatctctattgaaaagtggaagcaaattaatcagcctcaggcacagaacttttcacaaaattcttcaaagttcaataataagaattccaacaggcaagcaggcaacaattaccaccataactctagtagcaattctaagaattag

SEQ ID NO: 914 - DNA, 5637 bp, Cryptosporidium hominis
atgtatgcaacacaggaccaaagccaactaccagatgttcctgatttcattaagaatgaagtaaaaaagaatgcttttaaaaaacagggaggagactcactgggaggtcattcatttacaagagcagcttcaagcttgaatcattattttatagtagcaaaattaaaaaacaaaggccagctttatgcttggggtgtaaacacaaataatgttttaggtttgggtatagaaaatggagaatttaattttcctatgaaagtgaatttcttttcagcgttggaggtattccaagtaagttgtggttattctcacactgctgtcctagtaaaaggaatttcagaagcatcaggaagagtatatactatgggacttggagatagaggaagattaggatacaccagaggccatacagaatttggaaacgagcatgataagaatgatttgaatgagtcttggtacactccaattccttgcattgtaaattttccattcaatgcaaagattagtagaatttcttgtggagcaaaccatagcttggctttatcagattcgggactagtatttgcatggggaataggacagtatgggtgtttaggaactggagaacttaatgatgtatattctcctgtcaaaattgaggctggaccaacagataagaaagtactacatatagcagcaggagcaagacattcattatgttgtaatgaagatggacaagtttttgcttggggaagcaattcaaatggaagacttggtactggtggatcttatggaatgaagactgtcccaactcaaataaagtctttgagtcaatatcacataactttagtcgctgcaggagagtcacatagtggatgcattgatagttttgggtatatatatacttgggggaatggtggaagtggtaaacttggtcatggaactcagtctgattgcaatattccaagaagaattgagggaatcagctcattaccttttgtgcagttaacacttggagcatttaattcaatggcattatctcaatctggagaagtttatatttggggagcaaaacaacatgaaatcatatcacttcctactaagatagatgcttttgattcacacatttgccatattaattctggtccgtatatttcctttgccatggatgtaaggcataatatatatctatggaataatagactactagtcaattcaaaaaaatctgaagcattgaatgccaatgaggaacaattatataagagaatgaatagtaaaaaccccgtattacttccattttttcaaagtaaagcttttgttgatgattgcattttttatatgggatttaatctagttgattataaaggaaataaggtatcttatgaaccaaagtcagaaggaggcttgttttcagtgaacagaatatataaatcaaatggatcttcggaaattggatcattagttggttcccaaattccttcgtggtctgttagacaaatcgcttgtggcacatcgcatactttgctattagtttacggtggtaccatatttgcatggggagataataagtacggacagcttggaattgatacaagaaggagaaaatctcaagatggcgacaaaaatgaatcttttctgaatgaacccactgaaatcaagttttcagaacccattagaagagttgcatgtggatcatggcatagtctttgctgcgatatcaaaggtaattgcttctcatggggaagaggtgacagaggccaactgggaactggagctatacgtaatttgtacgaaccagcaggaattgtcactttaaagaatgttattgaagtagctggaggagagctttatagtgcatgcattgttgcatgcattactacaggaaataaggatcttgacacgattaactcaggcgacctctggatttggggtgatggagatcttggaaagttaggactaggagatcatgtattaaaatcgtgtattgcagctccaagacatttaaatctgggtactccaatcataaaggtagctttaggatcttcacatactttggctttaacagcttcaggagaactaattacttggggagctggatattatggacgtcttggaaccaacagtaccaaaagtcattcaaatcctattaaaatcaggtttccaattaaaggagttcaaattgttgatattgctgttggatcttatcattctatggcagtttcatctcttggagacttatgggtttggggtaaggcagaaaatgttctttctgagaaagacgttctcacaccctatatttttgctaaattagaatcaccttcaggaattccgagaatatactctattcatgcttttggagatgtttcctatgcaattactcaatctggagttttgtggatttggggacccgaaaattcagaaactgaaaatattcaaggcttagaaaccagcattaagatcaagtctcatacaggtagagctgaaatgatagtactaccaggaaatgcaataggagtttctggaagtacaacacaccatgtttgtttgctggcatcaggagaggttgtatcttggggagatccctccagaggtaaattgggacagcaagatattagaaataaaaagtatattgaagatcctacgctagtaatacaaaagtggaatgacgcaaagaatatgttagattcggtaggcaaaggagattcatctgctggactagcaactgataagaagaagaactatacaaaggatgagggagttactacaattgaagagcttgaagcatttatgggagagttaacgagtaaatccgtacatttttcaaagaaagcaaaatcattcgaatatgtacaaagtttactgcataaagaagatcctcgtactagaaaggattctatttctttgcttgaagaagacttagttgtattattttcctctcatattgaatacttcaggaaaatgaaggaagaagaagagaggctcagatatttgatttttctagctgaagtacaaatgagaagactcattaatatgattcaatcagcaaattccaacagctttatattcattgaagataactactataggaatatttatggggattattttaatagcttcatactcaagtatatgtcaatgatagaatatatatttacgattctaagaactcagccattatatattattaacttaatgctggaatgcagttttggagaggagtttatctccattctaaattgtttgtatggattatttccccctcagttagaatatgttgaagtttttgaaacaaaaaatttccatgggttaaacgattctttgattatgctcgaaatcattggagaaatattatgtaaaagagaattacaggaagcttttagtacaaatgacgttttttggcctgggaaatcaaagtttctctactatttaagttctgttgtattaagaggtccagatctaagaagcctagtacagaatctacttgatatatatactcctacttctttggtttctgttattgcaaagtttccaaaagaggttctattggttttggactcctcctgccttgctcaatatttaggaataagtccaaatgatgagtctttgccaaaacattatttaaatatggtcaagtttgctgaagttgctttattggtgggaatatctgagaatattaataaaaatataaaattcccaaggatattggagagattgttgtataaggcatgtaaattagtaaatctcatggaaattccatcattcaatcctcttttagattataaacaacaaaaagaccaagcaatacagcaacctcttataagattacttttatatggaataatacttccaatattggaacaatgcaatgcttattgtacatatttctattttcctctaattacagatatgagaataatgtcctcaattcagcttttggctcattctatcaaaatatttcttgcaggatacttaaatcaaacttctagttctcagggatttttatggatcaattccttaatcagcttctctagttcaattactattaagatatcagaaatggttaatgaacaaaaagatttaacagatttatctttaacctatctctcatataattcacagtattcattacactctgataattaccatgtagtattaaatctggttgacatcatggttatgattaattctattcagaagtataagaatttcctaagattaaatttaatggatcccgtcattaattctgttgaatacttttcaagaagagacaaattatcaatacctttttttcctttagagtttattaatctggtaaaaaatgtgaatctactgccaaattctgatggaggaggagtttttgtttctattcgaataagtccaagatggattataaataatgatgtacgccaaagcagaatttcaaattatctaagagttagtaatatttctagtaatatagaaatagaaaactcgaatagaagagcaaacagaaaattctatgatttggatgaacaaaactatgatgaaataagagatgaagaaaatacatgtcttcctccattagatacttcgatgatgttttgtccacttacaaaaattgggatgtcacaatctttattacctagatttgaagcaaatgttagaaaatcgaatggaatatcagagtttggattatttattaggtattttgagatacctgataaaaggagagcgattgagaaaggtctattaatattacctataattacagctagaacaatgtttgagttacttgaaactgttgatgaatatattgaacaatttaaaagaaaagaaaatgataaaaggcaatatgagcagttatcattcatgttagaattcagaaaagttgttgaagagttaatgcttaattatcaagattccattacaccattattaatatggattactaatgaaataatgaatagaattaaacatagagcctatttagaacatttacttgaaattgaggagaaactaagagataaaaggaagtggtataaggaccaattaaatgaatgggaagatgctatagaaaaatcagttataaacatgacattatgggggtacaaagacactgaattgattaatttgctaaatatatattacaaaaacaatataaatactacgatgaagcaaatggaaaatgttctgtataatacaatgataagtgggtactatgcaggcgaagatgacttaacaatgattaaaaatggaaattatattacaactgatattattaaaaaaagtataacattaccattcttatgttttccattaagtatatttattatgaataatgtaataaagattaagagtgatgagaaaatctttaatttatttgagtcacaaagaaaaactatgatgaatttcttcagaagaacagctcaaatgaataattggacaatatttattacttttactcctacattgggtcttgattgtataatcacaacaagtagatcaggctacaaaatccaaagttcatttgaacaaagaattatttgtaagttctacattactccagaccaagtaaagaaagcaaagttttcaaatttcctttatacgagactttattctaatggattagttgaagtaaatctaccaagttttgtttcctatgtttattcccaaatataa

SEQ ID NO: 915 - DNA, 1401 bp, Cryptosporidium hominis
atgagtggtgaaaccccagaaaaatcagaatcttccatttcaaataccaagaagatcacaaatcttctgaaagaaatgagcttaggtagctttatgaacactgctgcaaatgcaatcaaaccacacaaattctggaatactcaaccagtagttcaaaacgatgattcttccactgaatattcatttggaccaattgaaattgaaccagattcttttagaaaagaaatatataagctaccagatggattctcttggtttgattgtaatttatgggatatagaatctcaagattttgaagatacttaccaattattaaaagaccattatgttgaagatgacgattcccaatttagatttaattattcaaaggagtttcttagatgggctctttgtgtccctggtcaaaaaaaaaactggcttgttggagtcagagttaatgaaacaaagaaaatggttggatttatttcagcaatcccaatcaaagttagaattcataattgcattatgaatacttctgtagttaattttctctgtgttcataagaagcttagatctaaaagacttgcacctgtacttattaaggaaattacgagaagaattagatgtgaaaaaatctttcaatcaatttacacttgcgggaagaatattaccaaaccttttactattggaacttattggcatcgtataattaatgtaaagaaattattagaaactggttttattggaatcccaagaaatatgaccatgagctctttaatcaaatatcatcgtattcctgctgataaaaggattgaagggtttagaccctccgtagattctgatgcagaacaaatatgtaaattattcgaaaattactttatgaaatataaagatatcagcaacgaaaccatgaataataaaataaactatgatgaaattaaccactcaaaagagcttggaaaacaagcatatatgaagctggataagattgaagatttgcaagacaaaatcataattcatcaatgctttaatgttgaagatgttaaacattatttcacgaatattgataaagttattgtaacttatgttcgagaaaataaaaataaggaaattactgacttgtttagtttctttatcatagaatccactgtcatcaataatgaaagatttccaactattaatattgcttattcatactttaatattgcaaatacctgctcattaaaagaattgttcaatgaaatgattattactgccaaaaataataattgtgatgcttttaatacattggatctgatgcaaaatttacaagttattcaagataataaatttattatcggtaccggtaaattaagatattatgtgtttaattggaagatacctcaaatttcaccttcaaatgttggaattatattattttag

SEQ ID NO: 916 - DNA, 855 bp, Cryptosporidium hominis
atgaaaatagaagatagcgtgatagtggttacaggtgggatgagtgggttaggtaaagcagttgtggaggagctgttaaaggaaaacccaagaaaggtgtgtttaatggacgcagtactaaaagaaggtgaattagaagaagaagcaataaataagtgtgaaaagtactgtgtagatgtgacagactataattgtataaaaagtgcagccaagtcaataattgataaatattcaaagatagacgcagtggtgcattgtgcaggtattactcattgtccaacaccaatagtacagaaggatgataatggaaagataatggagaataatgaggatattccggaaatttggggaaaagttgtgaatgtaaatgtgattggtacattgaatgtcattcattgtttatctccatttttggctatgaatcaaggaaactcgcatgggtttgaaaaaggagtatttattttggtttcaagcagtacagcaagagatggtcctgctcaaaatcagggttatattgcatcaaaaggagcaattaattcattaactttgccactagctagagagttgggcccgctgggaattagagttgtcacaattggtccaggggttttcgatactccaatgtcaaagcatgcaatgagtgaaaaaacttcttatactttgttaaagtcgatcccattaggaagatttggcgttccaaacgaatttgctgaaactgttgtaaatgttgggttaaagtctgaatacatttcaggagaaattatttatttggatggcgcctggaggcctccatttataactagtgggagtgtgagaaggttatcaatccaaaaatcatcaagtaatgacgaataa

SEQ ID NO: 917 - DNA, 1125 bp, Cryptosporidium hominis
atgttcaagtcgataaaaaagaagagagatgaatttttgtttaagtggaatagaaggaggtatagttatagaatgggatggtattattcgatgttgagtatcgtttctggattgattattttggttagctttatattatttttcttattaaaaatgaatagttgtactggtaggaaatgtgggatttttcgaacattttcatgttctccaactagtgtatctcttttatcttcagcgttcatatctttgggaagtatttactcaataaaatctgcttttagttatatgctttccagattattatatagttttgcaaattatagaacaacagactttatggctcttggaaaatttgcttcaatactcggagctttggttaagcatattccatttcttattgctttatgtacaatttgcaatgggataatatgtataactggggtaatttatatattaattggactttgtagccattcttattcttcagcaactcagataattgtagacaattgtcgtctatatttttcaaattgtgaaaatcccacagtcaattcaatttttgattgtaatgatccttctcagctaatttcatccccttttctacagctaaggtgtttgccaggctcatctgaaatttgtagatattcacaagaacttaagtcaggcagtaatccgtgtacaaaagatatgctaaagagctatttaatgtcgacaggagatagcgaaatcattgaagagttggaaaaactaacaggcaggaccttatcaataagtatgcctgatcaagttgacaaagaaaatagtaagaaaataattgaaagaaaacttggctcaacatatatttcaacattacaaggcgttagcaatcgagaattactgaatctatacctattaccgtcctcgccttcagaccaaagtgaattaataagcagctatggcttcagcgatctatatgcagcagctcgtgtttggatagctgctgcatgctatacttatgtctcgacgaccattttattcttcttcgttaaatacttcagccctcaagattcgtgtttttcttttgttagaagtccaaatgaattctttcttctgaaaatactaaatatatttactccttggcagtaa

SEQ ID NO: 918 - DNA, 210 bp, Cryptosporidium hominis
atgaaagccaaaaataaacatttttatggtgtatatcctaagagctttttattactttatgaaaaaagagatgaaagtaattgtctccagtcctttaaagttatatatattttgctttattttatttactgccaaggagtaaatatatttagtattttcagaagaaagaattcatttggacttctaacaaaagaaaaacacgaatcttga

SEQ ID NO: 919 - DNA, 234 bp, Cryptosporidium hominis
atgaataatttcttttttaaaattttatacatttgtaaactttctttttctcttttttttaaaaaaaaaaaaaaaacttcgatacctcctcttcctcattcttttgaaatatttacatacaaggcatcaggaccatatgcatgcaatttcccgcccaaatttaggcggggaatttggagaattagtgataaagacatgaagatcgctttatttgacaatagttggagttggtaa

SEQ ID NO: 920 - DNA, 834 bp, Cryptosporidium hominis
atgaccaattatgcttataacaatgcgacagtggcttccaaaaagggagttatatatgaagtctggcagaataatattaacgaggcattccagatgatatcagaaatcatggatgactttccatatgtcgctatagatacagagttcccaggtgtagtggtgcgtcctacaaataattattatgagtattattaccaaacagtccgatttaatgtggatttacttaaagtaattcagattggtttaagcttccgaaataaatatggccaagcacctacgaatatttgttcaacgttccaatttaattttaagtttgatatggaatgtgatatctattctcaggaatcaattcaatttcttcgtcactctggtattgaatttgataagcaccttaatagtggaattgattttctatgttttggcgaatatatgtatggaagcggacttgttcttaatcctaaagttaaatggatcagcttccatggatgctatgattttgcttaccttgtaaagattctaagttcacaaccactcccagaaactgaaacaaactttatagaacttgttaaagcactttttccaacactttatgatctaaagtttattttgaaacaactttctagccttagtcacctttcctcactacaaaaactttctgaacatcttaaaattcaaaggattggaattgcacatcaggctggttccgacgcacttgttacatgctgcacattcttcaagttatttaaactccatctcaactcccaagttgatgataacctctttaatggacagatatatggttttggcttaccaactccaactattgtcaaataa

SEQ ID NO: 921 - DNA, 405 bp, Cryptosporidium hominis
atggatcttttaaagtccactatttatgggaacatagaccaggagtttgtaattgacaatacgttagatgcttgttgttttcaatttgagacagctcaatccacattatcaatgggttttgaagatgatatatatttacgtgactctatacaaacttttcaagatgatccagaccatattgaacataccgaccataattttaatttagacttggatgaaaactcctcatttgaccaaagaaaacaaaaggaactaaaggaactcactttcgagctcgctactgatccttctccaaactctgagtttcttgttagagtgactgaaaccttaaattctattttacagaacgaatttaaagctcttgattttcaaacctctccattagttaagcataatggagaataa

SEQ ID NO: 922 - DNA, 3189 bp, Cryptosporidium hominis
atgtctaataaaaaaacatccaccattatatgtggatttaaaaagaaaaatctggaagccataaaaacctgtctcgagacgcatttaaacagagagaatatcttagataatgcggtaatacaagaatgcttcaacaaggatgtgttgggattttctttggactctgtatcaaatttgcaagaattaaaggaagtttggtatagtttatttggaaaagatccaaataccaatagaaaagagctaatgcatgcaatcagtcttagtgctggaatgtctgaggttcttaatctttcaatatacacacaatacgggaatgaaatgaatttaggtattttccaatcaaatgaagagaagaagctgaatgaagaggaatccatgaatgttttggttgatacttcaaaattgatattggaatttctggaaaatgggtgtgaaaaggatatttatattaagccaattttcaaagctgaacgcacgactctaattttgcgtgatcttgagaatgatgttatagagaatgagatctttgacttacttagtaaatgccctcattttcatacaggagaaacttcttctgaaaataaaacaaatgagtatagtcttgatgctgttaagaaactggtcgtcaattttcggaaagaaattcatggtacctggtttatcactcttaaaactgaggatttgacaacaaaagttgccttatggttacgtgatcaaaaacttagagataacaatagttctttattacgagttggaataaaatcagagcacccaattgctagtcttttatcagtattgtcgatgaataagggtatccaatcaatacataatagaatgagcaacttgcagttatcaggaactgaaatgggaattgggattcctccaatcttatcaactctaaatgctccgctttccaacttacctccaaatgtatcgagtagtgagcttataaacgtgagcgctggaaatggaccaaacaatgctgttttagatggtccctcttcaaatagaagaactgcgttgggaaatgttagctcaaagatgggttatatggtgaatatccctggttcctcaaatagtggactcattcaaactcaccctcagataaataggcccaaccaagagaatgatcaatcgactaaggatacaggaaatgaaccacaaataggtatggacaatttgaatagtcagaatcctgagcatttaactgcaccgcttcctgtaatgtatccatatcatagaggtattggaagggccattggagttccgaaccatacaactcctttaaatgtctatgggccaataccaggggctcctaatggtggaataattgctccaattattgttgttcccggagctacaataccaggaggtgtggctacatctccactctcttctccaacaccggaagtaggctcaccaaatgcatcgaaaacaggtgatacggaagctaccaagtcaccaaagaataaccgcaagaggagaggttcaaagtcgtcatatattagtgattctgatacaaaaagcttatctccaaatatttccaacagaagaaatagcccagatgctaccaataatgtcaaaactgcaagcgaaattgagaattgtggagctttacctgtagctgatggtatgaactcagtaattagaggaattcctcagggagctaccacaatgatacatggaataactcccttttactatggaatctcaggactttcagaggtacagccagtcaatttacaatacttagggggcggaccgcatctcgggcctcatccccacattttcattcatgggaatccacagttccattatcatcatcagatcgaaataggggctcctggagcagctgttcaaggagattctggagacatggaatcaagcccacctaatactatatcgaattctgaaaccaacaaagacaacatacagtatataaaacctcaaatgccaccaatgttccctgccggatattatcataatgttcattatattggagacgaatctttaggagctattggaaaccatggattttctgctgatagctttgcgatcaataatattggaggaagcggtattgttgtacctgggaatttgaatgctcaggcccggagtttttgggttagaaatccttcaaacagtactggaaaccaaaagtttaaggctaatggacgaaagaacaataattctagtggtaatcgtacaggtaataaatctggccatagcccttccaacccaaagaaaaataataatcaaaaatcgtcttttgtgaatggaactaatccagaaggtacatactctgaaccaaaggtaggatcaaaaatagcaagtatttccaaatctccagtaaatgacgctattacaaagcatgatgaaattgatcaatatgaaaatgcagaaatgtgctcaaccaatagctctaaacaatatccgagtaatgagagggaagaaatcgagtgttcgccatccgaagaagcacatattggagacaactcatctataaccaaaaatacagcaaatacttgttcttcctatgcaaatgatgataaccaaaaccaaatttccaagaaactcccgaatgaatcttcaacattaccaatagatgagcctcaagacaagcaacaaacatttaataagaccttcaaaccctttttgaattctgctggcaagtcaagaggccatagaaatagcaaaaactcttcaaatggtggtgggaactctgaaggaaagggaaaccttgaatatagtgaatatagatccaatttagccaatgataaatcaaaagtacctgatggtactaaaggtaataatggaccaaacaatcaggctgctgagactggatcaaattatcatcaaagaagaagagcctccaggcaaattaatactggtggtggtggtggttttggtggaagagaaaatgaaaaatttacacatggaaagtataatggatatgaaaataaccattttcgcttaaaacgtacaactgaaaatgaacagtcacactttaattttaacaatcatggaaaaaagtcggatggatattcgaataacaatcatttccatggtaataagtcaactaaccataaaggcaaaggaaatgcagccaaaagcaattaccaagaatcgaaagaaattggcttggatcattttccatcattatctgatgcaatggcaaccaaaaagtag

SEQ ID NO: 923 - DNA, 1794 bp, Cryptosporidium hominis
atggtaactgtagtagtcagtcctttgattgccttaatagaagatcagataaactctctaagaaagtggggagtaaaatcaaatggtctgagctcaacaattattcaaaaaagcgatccctctcaaagtattaataaagcattggaagaattatatatagatttggagaaaaaagtaccaacaaacagtattatatatgtaacacctgaaagttttgggacagaaaaggtacttggatgtttatataaattgtatttgaatggaaatttatattgctttgcaatagatgaagctcattgtataagtgaatggggtcacgattttaggacagcttatagaaggctcaatcaaataaaaaacatcttctcagatatccctgttttagcatgtactgccactgcctccccaaaagtacaaaaagatattaagactgtattgaatttaatagatccatatatttccgtaaattctttcaatcgaccaaatatccactatactgcttataatatcgatgacaatgattatttggtagacttaagccttgaagaaatagttcttaatggagttttatatatgcaggaatactttaaaagaatagataatcaagaatctgctgttggaattgtatatgttaattcaagaaaatctagcgagcatatttcacagtatttatctaataaaggcgttccaagtaaagcctatcacgcaggattatctctaaagattagaacacaaatacagaatgaatggcttgagaataaaattcaagttttagttggtacaattgcttttggaatgggtgttcacaaaccaaatgttcgctttgtgattcactcctcaattccagatagtattgactcatattatcaacaaagtggaagagctggaagggattctaaattctcgaaagctatgttatttttcagtaaaagagatattacttgtttaaaatgcattaagagaaagtctttgcagtacttatttatgaaatccaaacaaaaagctcaacaagcatatgagaagtttcaagataacttacaatctgtcatagaatttgctcagtgcaataattcagaatatcaagaaactgacgaatgttatgaaatggattatgatccggaaaatcgtattgagaatagtaataataggaagagatcttctattgatcattatcctgggtctattcaaaattcaaaaccccaagatccaaaccaataccaaatcagaatcaataagtatgggcaatgtagaagaagttatcttcttggatactttggggaaaagtttaacagggaaaaatcttcctctaattatctttcttgttgcgatgtttgcgactctaaaagcaaacagcaagataaaaacaattcttttatgtcttatgtttcatctaaagtccatttaaaaaaatcttcaaatttattaaacaaggattacaatattaatagttacaagaatcaattttcaaaacaagaggaatttaattttgaatttaaccaaatacaagacccagatcctgattgtaatcagtccaataaagttggttcatctggattttcctctgtatttaaaagtgctaaatcttttctggattctaatcaaaaggcctctaaaagcagcttccaaagcgcactgaaaatgaataacttacttaaaagcaaaggaatgtcatatttagaaaggcttcaaacattggaggaacaagaaatgaaaagtgaggaaaagtcaaacactcaaaatagcaagtttaacattattagaaattcattaaaaaaaaaaaggaattgggtataa

SEQ ID NO: 924 - DNA, 2736 bp, Cryptosporidium hominis
atgcaaaaaattaataccccaaattatgataagataatatctgatgagcttgaacaccaaaatttgacttttttggacctaaaggaattaaatgataaatttttagagaaaccagtatttgagcttgagaatgaagaaattaacttaaaaataagagaaatactaaaaaataagaatattgcaaaaccaataattttgttaattgttgtaaataggctaataaaaattggaaacaagacaatttttctaaagcctggaaaatgtattgaagaaaatgtattcatccctgagctggaattacttgcttttttacttaaagaaggaaacattattagagattgttgtgaatatgccaatttttcaaatttacagaacataagtaactcatttactattgaagttttgaattccataattaaaattcccacccttgcaattaactcaatactgaccttgaaaccaagtctaaagaataatatgaattttagaatacttgataaatacattccgctggaactacatgattccaactactatgaaaatatttggatatgtacattatatattttaaacgatataagactaattgataaagccacttacaatgttttacaggttattttcagcagattattcctgagaggatacaaggaaattttatgtaggattatggttggatggtcgaataatattgataaatctttatttgaagactgtaaacttcttaataatggagaattatgcttaaatcgtgtttttgataatatactaaaaattaacaaaactgatgataatttaatcaagtcttttattaaacaactattcaaagaaatagagtcggtaagagtgcagactaatcaaggaatattactcctcaagctgaaagatcggaacttcgaggaggaattaagagttgaagatataagaaatgacgatttctttttatttcttaaatccattgttgacttttgtgttattgaagaagacttgaagaataagggatttctcaaaaatgaattgtttcagattaagaaacaaaacttttccattaaaacctacttgttatttctggatatttgcgtccttaatgttatcaagaatgatgaattcagtaaatatttcttgcctgagcagagctttgactatttagaaatgattagatcagaaaaattggttgctctggaagaatccaacaaattaaagatttatttaaattttcttaaggaactgacccaatgtttgactaagcaatggaattcttatcaagattcaaaggcttattctcttactctttctacagtaattattcgatcagtctctattttaatatacttaaatctgagcaatttatcaaacttaaagaaagtattacttgaattttatatggatatcacagaaggtatacaatttagacttaagaatattgacccaatcattaggtctagtgctatgtatctgggagaattttactttaacttactttatgaattgttcccgtctactaatgaagctgatagcggatatttaatgagcgaaaacccaaaatttgatgaacttaaattatttaatccagaaattaaaaaccacttatcctgcatttataattccacaaaattctttgcaattaacaccttttcatatgaaagtgagatccaaatcagaaatgctactgaatccattaaagatatgtccttgagcaaggaaaaaaaagagtttaatgaagatcaagaaaagaagatcatagatgaggatgatgaattttggaataaggcaccctcaatcaaagcaaattccaaaaatgaaggaataatacaatcaaaagcttcaaaaagcttactttatactacaggaatagagcaaaagaagcaagagccaaaaaggaagcttgtgaataaatcttttgacttgattaatctatacacagatgaaaagaaatctaaagaaatacaagacagatctgaaaaactgttaaatgtattaaaagagttagctgaaaatatcgaaaaggatgattctaattatgaccacctaattcttcctcttattgataagttaatttcattaaaagaaaaagatcaaaagatacttgtgctcataattttttcaaaactaattcagtataagacagacaaagtttcagtggaaatgattaactattcatgcaatatgaacaacgggattccaatggattttaggatcctcgtactaaactctctggcatctgcatgccaaaacatggcaaatacacaaagtaatactcaatcaactattcgccctaataaaaaaactataatcaatctatttgataaatattcactaatttggtcgtcccatatagtcaaatatatcatggaactaattacgcactctgaaaatcaagaatgctttgagaagattcctaatatattcttcatctcatctctagaactatttaaccaaattatcgttaacacatcctccaacaatgcaaacattggacaaattgcccattctgggctagaatttatcacatccatagatttaactaataatcatctattcaaagacatagctatcagaaaatccatttatatgcttgcctttaacattattctcaaaattaaatactcatcatattttctggccctaaaccaaattttacgtcaggttgtcacatggatttccaaagcagagatatctgaaacagatcccaattctatccggatcattcaagaaaccaaatcatttatttcttaa

SEQ ID NO: 925 - DNA, 4947 bp, Cryptosporidium hominis
atgctcggaaaaactcaagatgatgcgtctttccacaaaaaaattagttttcagaaagaagagagcctaggaattccatactcgaaagaaaatccaattaaaaggcagaagaatcaatcattttttagctttgcacactcgtatattcagtttacatgggttacaaaatggatatatttaggatcaagaagacctcttccagccaaagatttgccagacttaccagaaactgatagtactaactactggtccaatttgtttgaaaatttcattgaacaggagagattaaaaaacttatcttcttttgaccgtaacgtattggtcattagagctctttggaaatgtttatatggtcaatttattatgctgattattcttaaggtatcttgggaagcttgtttatacttaaacaactcagttattcgtggatttattcagtataaagagatggaaagttctgctgaagttagtggtgttagtagcgaaaagtctcaagctttaggtgttggattatggaatggtttattgttggtactcttctatattgtacacgtttatatttcaactcaattcaatttttgggaatctagggttattttaaaaatacaaacatgtctaaaaacctctatattcaagaggttaatagaaagtaaatcttgtgcaaagaacctacttcaaaatggcaaagaaattgttgattccaagattaaggaggataagctaaatattgcagaagatttacatttagatatagatcctagtctttctaatcaaaactccaaatcccaaaataatttgaatgaaattggacaaaatacaaacagaagtttttatgacaaaaagaaaggatccgaagatagatatactatctcaactaatgtgtttaatctattaatggtagatgttgaggatattgaagactttattatggctcttatccagtttattttacttccatgcagaatttttgtcgcatcattgcttatgtacagaaatattggagagtctgccattcctggagttgttttaatgatctcaatgatcgtctttatgatcattctggatattatttcagctttacttaaaggcccactactctattggcgtgataaacgtctagcaaaactacatgaggttttaaataagattagaactattaagatacttggatgggctccatttgctgaagaaattgttcttcgagataggagaaatgaagtcagctatttgtataggatcatttcattctcagctttatcatatttgttcttcaaattggcaatatctggttctgttgttgctattatggtttattatacaaaaggaatgctcagcagagctggtaatctttcttcttatccaaatggctttgatttgaaagcctcaaatattatccctctaatccacgtaattaactatgtggctggaattctcagaactgttccaaactctttgaatatgcttattgagggttggatatcactaaaaaggtttagtcatcacttgggatattctcatttcccttctgatgaaaataaagtacttgagaatcaccgctccctaggcgacgctatagtttgtaaatcgaatatatcttctgaaggcagagtagagaaacaacaaaagcaggaagaaactcctttaatttcaaagattcttacctttgatggcggaaatatgctcgaggtaaatgaagtaattaacaaaaaaaaccaggataaattaccttcacaggtatttcattcttatacaaatcaaaaaatggactacacattcgatgaatctattctagtttatcttcaagatctagagtatattccagaatctgatgatgagaatttcaagaaaacaaaaaataactttactttgattatcccaaagatgataattaaaaagaattcatgtcatttaatagttggtaattcaggatcaggaaaaagtactttgctatatggaatattaggtgaagtttattccaaacgaggtttaagatttattagatctcaaaatagtacaatagggttctgtagtgaagacccatggattccaattggaactatacgatcagtaatactctttgaaagaccatggaatgaaaagagatataatcgagttcttgaagcctgtttactaattgaggacatcatgcaatggcaagaaagagatttaagggttttagatgatggtggccatatactgtcaggcgggcaaagatcaagattaactttagccagagctttgtatggctttttatcagatcaagaagaatataactcttttgatgaagatagcattgaagaaaatagctattacagtgtatactgtagcaatgacagaagttcaaatagattcgatactcaactattcctgtttgatgatacttttgtttctcttgaccctaatgttgggaggagaatcttttataatttgtttaatagagaaagtggtttattaacaggaggtaattattctgccgttattgtaattaatacaacggtgttattgtgcttcttagatgaaaaactttcgcaagaggaaataaacgagaaatttggggtcgaaattaacatttggaacatcaaatcagaacctggaagacctaactataatattctggaacattccaaatatgaaattttaaagaatagtagtgtggaaaaagatcacagctttaataacagtgaatccaactccagaacagtttctggctatattgatgtaggacccggccaagtaacaaaagaaaaattcgaactcagaaagaggaatttgtcggctgaaaaggaagccaagtccaatagtaatttaagctcatcaatagtaacagattttgagcatcagaattcaacaattaaagctagagggactgctagtagctactcttcttcagatttttacaacgaggatattatttgcattcaatctgaaactggtcatagagtcattcccttaagtttgtatggatggtacttatctaaggtaggaatagtcttctttatatctgtttgcctactaataatgacaagtatcatcttagatagcggccaagacttcctacttgtagaatggacaggtttcacttcagacggtagggatttgaagactggtacggagttttatgatagcaattcaagctcactcaatactttggaatctcatatgaattatatgtatggactaattataatatttatatttgggatcttgacacatcttctcgtacaagtaacacagatttacgcaagtcttagagctgcaaagaaaattcataatgaaatgttgagtaaattacttactacttctcaggaattcttcgacagaaatacaattggacaaataattaaccgtttttgtttggatatggtttctatagacagaaagactatgttcaggatatgcaattttgtctcaatttttttggagatcttaatcagaggcggattcatcattttcgtgtttccatggctactgttaatgataccaccaatttgcctatttgcttggttttggctattccaatactatagacatgcatcaagagaactttttagatccaatctatcagctcatacaccagtatgtaatatttatacccaagcattaatgggaggatctattattcgagcatttagatgtgggcatgtatttctaaatagaaatatcaattacattgataatcttcagaagatcagatttatgagatctgcatctgctcagtggattagtgttagaatgcagcttctattgcttccatttacagctggtattacattggcgccaattctgttgaagtacctgaatttaagtacagcattctttgcgtcatttactattattaagatgactgcagggttatggggtcttgctttggtttttgtaatgtcctatgctctcttaattaatgattttttcaatatgttcacaaccgtagagaagtctatgtgtgctgttgaaagggtttcagtactactaaatgatttggaagattcaaaaaagaaagaatttaatgaggaggttcacgaattgaaatacaaagaatacatggtatctaaccgtaattctccccaaaataatttccagggcctttatatttatgagttaagggtagaatatggaaaccagtctcttggaattgagcttaagaatgagtacgtaaaatatggggaatgtataggaattattggcagaactgggagtgggaaaacaacatttttaaattctttattaggtcttactccaatccaatccagtctattatttttggatggaaaatggctatttaataaagatatgagaaagaataaaaacgattacattggagttttacctcagaattcaataggttttgatgggtggacaatcagaaagtttttagatccttttgatgagattcatgatgatcaggttatttgggatggaatatatgcttgtggtctcgagactaccctccgttctataagtaacttgaaccccttagatgcagtattaggaaatacttcaggtgggatctcaaagagacgtggttctaaggacaaaaatgagcataaatttactcagaaacatttaagacagcttgctcttgctagactagtaatccacaggttaaaatataagattattcttgtagatgagcctccagaggaactttctagcgatttgcagaaacaaaatggtagcgataattatgtctctatgaactcttcttcaaccaggaaattaggaagcaatattttggaaaatcagtacctttctgtagaggaaatcgtatccaaatttatgaagcactgtgtagtttttatagttgctcacaactacaagtctttaaaatcctgtaatcgaatttgggttttatcaggaggagttaaagttaacgagtgtgaattttctcaagtgaacaaccaacaaatgcttgcagatttcttacttactaacacaaaaaatcaataa

SEQ ID NO: 926 - DNA, 2676 bp, Cryptosporidium hominis
atggagaatataggtctggaagcggttgctgggaagattaagaatggaaagaatgatggggttgagtttctattcttaacaaaagcagttgagggttgcttgatttcccaggaaataatttctgagctgttagattttgatattttttgtattgactggcaagaatacaataaggatccaaaatatacagtggggaattttgataaggtaaatagcataaactttgtaatacaagaaccactgatacaggttttgagagaaatattggttactttggaagctactttggatgcaaatcttgatctgaaaattaggatatatttgccttattcttcagaattacatgtagaatatgcaaggaatattggattattgcaggaggaaatctgtactattaacaagaaggttcaattaaaaaggtttgactttataagcataataaacgaagtaatgaaagaatttgagggaataaacatttctatagaaacagtgaattggatatcaatattttattgtattgcaaatttgatatgcaataattcttgttcttcagtttatgcaacttgtattgagaatagaagtttaccaattcctcttttagaggaggatatagagagagtatataacagtgtagtgaatgaaagaaagaaccaacatttaaataacttcataatgccagatttgtttagcaaagaaaatgtaaaaaaagatatggcacttcttaacttggtaaaccttccatctagcctgagaaaagcttattcaatgcatatattgcagcttatgtcatttcttcaacaagtaacaggaaccaattttgtagaatcagaaagctgttctattaaatttctatcaatgggtcaaacttctaatttaatttcaaaagctatgcaggaaagctacctcgaaatggttaatactagctcaaaaacacaaatcaagccaagcaatacaaaagatgatattacaatactaataatggataggactttagattgtatttccccaatttattcaccaatactaaacattaacttgtcagaggacgagactttctcaagatttgacgacggaattattgaatttttagatgaatttatcttaagtagtactcaaaatcaagctattgggaatattagtactggtgatagtcttgaaaaagatgatccagaattaaactgtaaagagttagaagaagatagagaatcttatcttaataaaaaagttgaagattccaataattcagacgaaggctatatacatgaaatcacaaatccggtgtacctttcaataatgctggatcctgagaagctccaaaaggatcttgttatttctcaaaactacccaatactctcttacaggttcatttcagctctggaagatcttaaagacttgattttatcacgagagaagagtttttccgagtctttgaaaaaagatataattaacagacttgactctataatgaatattcatccaatatatggccaaaattcatggatgtttttacttttaagtctaaaccagtctcattataccagaaaattttggactgaggtctgtgatgtttgcaataactatgatttaaagtcaaataagaggaaagttatggttttaattatagtatacagatatttggttattatccagaatgatatagcatcaaattctaacgatataaacatgaaatcaccttctactcagacttcatcatcatctttaactccagtaattttccaggatcaaattgaaaaggaggaagatattattgggaaaattgtttcaattttactaattattagagaaaaacttttaccagattctattacaaatatttcaaaaaagttagaggatttgagtttaaatccatcattatataatacatatgacttgaaattggaattatcagctctacttcaaatccttcattattttttaataccaatgtttccattggatttagtatcattcaactcaatatttgtcagaaatctcagaaaaaaatttacaaataattcctttgaaaatatatctgtaaatgatcagaccgaattgcagagttattctttagaatgcattaggaagataatttctctagcaatctcttgttcaagttatgaaggtccagattgtaaatttacatcctttaatttaaaacaagtgttggattgcttccatccagaaggaggattctctagttttggtgatcttgaaaaattaggaagaaagcttaacaatattagaaatgcaagaagtaaaataaagtacaagttttttcgtaattttcagttatctccatttttaccagaaaatagtaaaaaacaagaatttcagatattgtccttagtatctcaagtaattctttatataattcaaacaatatttattgaagaaagcaaaacttccaaggaatggttgaaagttgatttaaaaatgaaaagtatttcatccaattatgatgaatcaagcctccaaagtttgagaaataagctaaaagaaacaaagaagactttagttatcaatattattggcaatatttcaatgtttgagatcaacgagattgaaaagctttcaaataaatttagagattatgttaatattattattctaacagatcatataagctcggcagcatctattactaattccttaatcaccgatcatcataacttataa

SEQ ID NO: 927 - DNA, 13242 bp, Cryptosporidium hominis
atgaggcgagcagtgtctcgtgtagcaggctttgtgtctaaatgggctactacatttataggaaagtatttagagaatgtgtcagaggatagttttgagcttggattaaattcaggcaagctacaactcagaaatgtgaagataaaagaaggatttttggagcaattaaggcttccaataaaagtcaagtacggctgtatagagacaattaacatatcgattccttatagtaatatattgagacctggtagcagttctccattagttgtagagatagatgatgtgaatttatacgcaagttttatagatcataatgagtttaattcagagaaaattgagagtttggttatttcagaaagacttcggttaatagaacactggaatattcactttatggcagagctggcagaggatgagtactttagcgtcaagggaagcagtaacaaaggaggaagcaaaccatttttgagcagaatagtctctgttttaattcaagatgtaagattgaagtttagaaggattcatattaaacttggtgattcaaccaacaaagagttgaattgtgggttagtattggattctcttgaagttaggtcaatcccaaatttgagtcaggttttagtagaccaagatttggttatccccaaactagttggttctggtataaatgaagatactaatattagtggtaataattcagcatcaggggaggtaaatagtgaattgggtccggaccaaattcatgggtacgaggaacatctggggttagtgaaagaaatattttgttccaggagtgaatgttctgacgaaaagttgtttgagccattctttcagaaaaaagattccagtgaattttcttatagaatactggatttggatggtctttcaatctatacggcaaaggaggcagcagatggagagactaatttaaaggagaccccaaaagagttggaccaggttgtacatccattctgttgcaagctccttttgagacagagaaaggatttgtttaacgcatctaagatgccaatatacacaatatatggagtattggaagagatttatgtaacagtttctgaacagataatcacatactgtggaggaatattaaaccaaattcaggcatttaataagcagattgaattgggaaagacaatgttggagaggaagtttttatatagaccaaatgttcctgtaattggtaatgcaaagctttggtggagatatgcaataggatgcattataagggataggagagctgatatttcttcaatttctggttcccatcgattttctaggtcgagttataactcttcactttatattcgcctccaggaagactttactgaagctaagatatcaatgtattgtagggattatactgtggaatttcacaaatactttgaggaaaagatgacttttgattccattggaccgtatttcgatggagggctctttaatgaactgcttttagacttttccagacagttttcagaatattacatacttagggttcctttctctagatttgtatccttgcatacatctctagtacatcaatgggttggaaagaggttggaaattcattctttcagaaggacaagccatagcgattctcaagctgctggaggagggtctggaagttggattcaatggctttttaagttccataggatctcttctgttcctttgaatagtgctgatgatgttttttttgatgctcaggagagcgaggatgagcagaataaacaggaagagtatgagaattttaatggatctgtggagttagatgaggcatttcttgctcaacagactatggaagatctccaatttttcgactgtctttctgatcattctttggaggatggggataaaaatacttcggaatctaagcagaatttgggatcttttgataaatctcaaagtgagaatcctttatatatggaatcctctccaactgtcaagcagtttggggctattagctctgagactcctttcatggctttcagagttttgctccgagagacaaaacttgaagtagtacttagagatgagtttgcattagagacaggaggaagtaaaatcgatggacaggaagggttgaggatgatcaaaagaagcgctttgatgggaagtttgagaagttttggcctggaattcattcaatcagattcaagaatttctttattatcggttttacaagagtttaatttggattactcagatccagatggggagaggtttcaaataatttacgaggatgaatctctcgtacaggatgaaaagatgtggttcacattctactacttgaataaaaaaagctcaatctgcgacgtacaaggatcttctagaaggagaagttctttgagtatgagttctgacttctctatggatcgaagcatttcaaagagattagaaacttcatttccagaaagtagcaaaactactattaagatcaacgtcgagaaatgctatgcaatcttttactccaacgttgtttctgctttagttaatgcaattaacaagtacaataagagtattggaaaaagtagaggagaaggtattaaacataaatccaagactagaatagataatcatatggcctgtactgaaagtggttcaactgacatttcagaaaaaagagatattaatagtcaagaagatggatttcttcaaaattcaggtttagtggatgtggatattcaaattgaaactccaatcttggttttctgtcataaggtagatccaagactaggaggtgcgatttacaatgtaataagttttggaaagatttcaatatctaacaatgattcagagatcttgagaggatatgaacttgaggagagttccttagatatttcaagcccccaaagtagatttgaaaataatagctttgaccttcagtcattcattaataaaggagtagggggaggcattcaagtatctccatattatagatatgttctttctgaaaagtcaacttattggtttaaatgtattcagagtctctgttattatgccaagatcgaggaaatctatttatctatttatagcgattttcagtctggaacaactgggatagagaaagatgaacaaaagatcagagttagaattcaagataccagcaatattcacaggagagagtcaggcaagagtgaaaaaaggtcaccaaagcttccaaaaggagtagatatggttaattcttatagattatttagcattgactatattgatatcaagttgaatctcttatcatacaagaggtataatatgttggacgagacatggatgaagtatattaagctatttggcgtactaactcagctggatccattttcacaggatttattcgaggagagatccttcatgaatttggtactatcaacaaattctgtttgcttggattcaaagcctactggaggaggttcaattggtgaaattcagcttggggatgtacttaagaatatctactcatccattcaaattaactcaattacatccaattttgatcctcaagtttaccagagtatatacttgaacatgattcaatggatggatgactcatgtttaagtgagtatttcaatttgggaagaaaattgacgagagaaaaggaattcaaaatgtttaagcttggattaaatattcagttattttggtttttaaggctaaatagtcttaaatttgactttgtatcagataataattcttggatgaatgtgggaacacgagacattcaagtcctaaactttattcacgaccattatagactggttaacttttccatttctcagctttccatggattattttttgagaattaaagaggttgaaagagaaggaggctatcttaaatctaaagatgaagcccaggaatgtaaaggaatcaagagaattcctctctttagtctcagtaacacttttagctttgttcgtttcccaacatctcaatatcatttcattgaagaggagctttcacttgagaaagctagagatgagaaagttaaatggttgaatagatccagatcaggttattctcagagcaatcaggtacaggttaggacggaaattgggtctattattatttacttgagaccattaattcttcaagagttactttgtttgtttaaaaggtctacctcaccatatataagtacagaacaagagattaagtccaaaaaggaccaagatctaggctcagaaataggattaaagacttcagataagtggacaaagtacttaattgatgctaatgtttgcaattctgaattggtagcatttcaaagagatacggaatttttcaagttaatatttgaaaatacggtatcaatctgtgatcacgatacgagaagagatgttattgttagggtaattaggatgaaaggatacaatatggttaatggtaggaaagatttgtgtttctttaagatggatagctcagtggaatcgtctatgatggaggtgaagatgatttctcaccagagagctcaagatattgaagatttgattcatggaaggctgtcaaagatgatctcaagttcagagatgcttgtcgaggctgaaaacattactttagttttatttctggatgcatttttacacaatatttactacttttcgtacttgattgataatattcagagctttgtttattatttagaagaagataatgtgaaggattcagaagtagttaaatcatcaaagtcttcttcccttattcttccttctcaggaaaaagttggaggagaaatagaaggcagttcagatgtatgcgttcctcttagaagtatgaacttcagaaacagtaagctaattattccatcagtatctgttgatgatgcagatcctgacaaagtttcctcagttgagatgtttattgaactctttaatttcaataacaagtctttaattagacaagtatcggatccttccatgatttatctttacatcttcaggatgatgaatgtgaggatgagacaagtttggggattgtatctcgaagaggaaaactatgagataactgaaggaagaagttctattccttttgggataattcctgacttaaactttcatttaaggaggtacacatgcagtgaaggaatgaataactcatttgacatgaattgtttcatcgaatcaaagcaaaaagaagcggagttaaatctttaccctgagactttgagtctactaattaaggcattttctgagaacttaatgaattatgatcctttcgtaaaacaactcactaatctttcatctggaactatttcagatccagaatttatgatctccttaaaggaggagaaacttcaagatgatcaatttattataggtaccaaaaaaaaaagatatgttccccagctaattcaacacagatttattgggaggagagcagctttgagattccaagaaagtatacagggaggagagagttcaagtattattcctactgggaggtttgaagatcaagatattcaaccaagtaactcaatttctgtcagttttcctttaattagaattaatctaattaaagattgggattggaaaaataaacaattaacgggatttgatggtaacgtccttcaaatagaaggaaaagagacgaaggagggctctatacaaacggtttccattgtaaggattaaaggaattaacttgtttatgagcaaatttcctcaaaaccaaagcttcacattcaaccttctactcagttctttaaactttaatgacgaacagaacccttcattcttaatttcaattcctgattcttttcactactctgacgttaattcaaatttcggtaccggatattgcattcaagatcaaagtcaagatcaagatcacaaacaggaaaaaggagatagagagtcaaataaaggattgaagaaaaccaactttgaggatcaacactactttacagtttacacaaaggaggcttactttgagaattatttggaaagctactttaatgctttgaaaccaattgttgaagaggaccagaatctacaggagaaccagaatccgaggagggaacgggatttagaacagcctattgaagttcaatactacagctttaaagaagattctgatgatattcgagataataaaaagacaaatacgagctgttcaagctggcggattcgtattgagtctccagtcattaatacggattgtgatattcagtctttgtttgggatttatgattggtacagtgattactctagggttttttgtctccctaattcagatataatagagcaagagaagtctagaaaagatgaaaataacagcagatttttagtggatttgatggaggtaaacttaagcctaaagaaattcaattgcatattggcatctaatacaggcctaagaaccaaagtaaacttgataggtacctatgatctgggttacttaagcaaaaaagaaaagaatcaagatggaattcaaggagaaaatgacttggaacggctttgtgaatccaatctaaatatctccatttccagctcaaagttgggatatcatatggtagatttcgggagttttgtgatttgggatggattggaatatcagatcatacataatattatctcaaaagggatggaggcggtactcaaaaccaatcgaagcttaaagttaatttttcaaccaataactttacaaatacactatccacatgttctagacctctatgatgttttattatcaatgcaaaagtctctctcaaaacgatcacaactctcaaggaattcagatctatatagatctcttactaatgggatttctgaaaggtttacaagtagccaggaattccttggaatagggagtccaaaagctaaagaagagttaagcataaacgtaatcatacaaaattcaagactgattcttttaaattctattgaagatttctcaggaatcccattattcatgatctttgtacaatctaatagcttgattcttagctctagaagttatcttattgatcatcctatatccattacaaattctggagatttctcactttggataatgaacccaagacatggatactttgagccaattattgaaggatgtaattttaatctggctttagataagttagtacaaaatgatggattttctccaagaaataagtcatgctcaagcaaggtcacaaaaagacttaatttccatcttctttctgccttaaacctcaatatttctccttggaccattagaacgatcttgagacattatggagcttggaatagtagaggatgtctactttctagctctgttaaaccattcagacctattttagttattaatcaatctggttatgatattcaattaatagggtaccccaattttgacacctttcaaaattcaaaaaataataattttattgatcttggatctacatgcaatattattaaagacggtaccgaagttgttcttgatcaaattaattactgtttccaaccaagtaatattcagatctttcaaattcatataggaagagccagaattaaggaatattgtaaaaatgaagatcaaattaactttgaaagattattttcaactgaaaaggttattaatttggacaatactggaagatttgctatatttatccgaaatcttaaagatacaaaaatgggctatgaaaataaaaatcttcagaatggaatcaactcaaattgccttctttttgaaagtccttacttgttttatcaagttgaacatagaaatataaaagatcaattaggagttgagaagattttaaggatattaagtcctttagaactaagtaatgagatttctatggatcttcaagtattctttactgatggacttttttccagtagagtccttccaaattcaaaaataccaattccattcaatcttgagacaagtaactatttatgttataataaagtttccaaagatcttaaagaagataataatagaacaaatcctgtcaagtataatgagtattataagcttaaaattaataatttcctaagggatataatcaaagaaaatgagaatctaaacaaatacagaattacagaaaagagagaaaagagacggatttactttgttcaaaagggagaatgtgcaggagttggattctatattacaattgaaggaataatgtcaacttttggtcaaggaaagtatcaattctataaatatatcctaaagtttaaaccttttttgaccctcatttcaactttaccattggatcttgaatacagattctttgcttttactagtggaaaagaaggaaataataaaataaatgttataaccactcaaatcaatgatcaagatttttcaagtaattctggtattttggaatatatgaaaccaaaagctctatatttaccttgttctttatttgatgaaaatcctcaagtaaagttagaaattggagttaaatcacgaaaagattctaaaactgataataataaccattttgaaaataatagtcagaactttacggtgatttggtcatgtttaattgatttaggaaatgaaattaaattaggtatttggaagactcaaaatacacttaatgacttaaatggtggtgatgataatgaaatctacttacaaagacttggagaaattgttcctggaaaaaataaaatttccatgttttctgtatataatttagaaaagaatccaaaaggaggatatccattaacttgggtagtacattctaaatattggtttaatagtgttggatctgaattaaatctttcaaatattatactttcagattttactcctccaccagattcagtaagtaatttaatgaagactagcaatacttggcttaaatcaaatcagaacttatttggccaatatggagatttaattaaacattccattatcccattagtgaaaagagaaggttcaattcatattgaaggagcttttgataaaattaaatcaagaaagatagtttttatggctttaattaatggaaaacaacatatatttgactttactaaacctcatataaagaccaaaaagggaggaatatataatttgggtatccttcaagacaaacttggaatggttggatataatttcttttatagagatatttctttagaacttcaactaaatggaaacattgccagggttttgattggtcatttaattttatttccccagaaaatggttgtaaataattccaaaattactatagaaatgcagagtcattcaaactttattttaaatcccagtacttcaattccagtaattccatattttccagatactatcagattaaattataagaatctatcagatagagtaaaaagtggaacagtatcttcttaccatattggaaatgatcaaacaagaagatcacgagtgatttccataaaaagtggatcaattatatatccaaattttgttttaaataagaataaatcttggaaaatccttttaaaaaaaccatcgggagataaatttcaagttaaaactgaagttaacgataattttgaatcattagaagaaagaccagatgaattatcttatttaaagattagatccattttagatgagaatcttggatttgagatggtactaataacaataaaaaagacatttaatcaagaattttatactcgtaatgtttcttcagtcttcatttttaattgttcgaataaggatttacatattagccaaaggaatgatgatagcaagaatagtacatatataccatcaagttcaataataaaacaagtattccgttcaaagtcaatatcagaatttgtatgggaagattacttcagaccaagggatatctttattcataatgacttgaatataacaaattcaaattcagccaataatattattagtggttataatgtgaataaaaaggccaaatatataagtattgataattatagcaataaaagaaggcaagaaaagaaccatttatttgaagtttatgactttggatcaaatgaaaagaaagattggattatttataaagtttccaaaatatcttcaaaagggaataattacatcttgggattgttttcatatgaagatttcatggattggcatagtaagaaaggattaacaagaagagcattatctttacttcaaccatcaagaccaacttcaatttcttctccaagttttaaatcaggaaatagttatggaagccctgtaagtgtggtatcatcatctttaactaaattttcttctttcaatagaggatattcaagttctgaacaatatatatttgatatattttgttctcaagtgctagtttcagtgatttgggagaatccaagtagaaatacacctcaagagctgtttctagtagttttggataacttacatagtaaatactgcttcttcactcatttgaatgctcctcaggatttccagatttcaataggaaatatacaaattgatttacaatataaagatacactttatccagtacttttccaaagactaccttcaagttcatcaaggactctgaataccctagaagagaaattcttggcttcaaataagacagattttgcttcattttcattttcttcaaatcaaaataactttttggagtcttcaagtcaacatcaatattcgaattcatctttattatcaaattctgaaagatcagtacttccaatgttagtaatcgcatcaaacttttgttgggattgtataaaaagttcaaaaggaaaagtttcagatagtagtggtgaggttgatttggaggaagatgttaaagaactggaagtaaacttaaatagaagaagctcaagaattttgatatcacagaatctttcagagaattacttttcagaagtttctgaatatcttaaaagcttgaatattccaaatataggacttccttcagagttgttaatttctcaaggattcttgagaaaccaaaagaatagtaatggagattcgttacaactaattaacgtgaataaactgttaattagacttcttggaataaatatatgttttgatacccactttatatatatccttacaatgtttattgatcagattaaagagatttcaagatcaattggtaataatgtaaagaaaggaagatcaggaaccaatatttcaatttatgattatgataagaataccaatttggacggagaaagcagatctcctaaatgtgatgatcttggtttgggtgatggagattatgaattatccaaaaataatgataatgaatatattggtggtaatattaattttggatatggtattgaggaagaacaagaagaagagaatgaggaagaagatgatgatgaatatcagtttatcgataaaaaggatataattaaacaattccctcttaaacaatcgttttttgataaggtttttattaagaatttcaagatttatcccatggtaatccatcttaccttcaacttgaaccttctaaaatcttcaattaactcggattctttatcatcatcatcatcatcattatcgtcttcatcatcttcttcatcatcgtcatcatcattatcgtcttcatcatcttcttcttcatcttcgagcttccaaaatccaacaaataattatgaaatctcaaatattaataatagacaaagaaatggtagtatcattggaaatttgaattttggaaaagtccttgaacagtttgctcacacttttggattggtattttcatcattaattagatcaattacaaccattgaagatgctcctttgtggatgaaccaatttgagtctagagatagtgaaagttgctcaaatttgattcaaaaaatcagaaagcattacgaacatgaactatatagccaattatatgtaattgcaacctctctaggatcagttggaaatccagtaaactcttttacaaatattggagctggaattggagatttgttttatgagccaatttatgctgtgacttctggaagaaatgatagtaataataataataatggagcaaatgtggtaactggagtcaagaaaggaattgaatcctttatgaatcattcagtttttggaacattccaagcaatatcaaagatggctggaactgcaagtcaaatagctggagcattaacaatggatgaaaaatatatggaagaaagaagaagatttgtacatggacaacaacccaaagatctgatggacggaatcagtattggagctcatgcatttggaaaatcagtgactgatggactctcaagtcttgttggcgaagtcctagatggagcaacaacaggtaatcctaattccttagcaattggcattactaagggacttgttgcagcagtagtaaaaccaattacaggcgtattggattttactcaaaaaactgctcaagggatccaaaaagcttccacagttgacagggttggtaataccaatagaaccaggcttccacgtgtattttattccaaatctcaggttttggcgccattttcaaaagaacatgcatttttgcatgacattgtgacatgcattggcgggcctgaccacatagtaaaccagaggatatcatcaagtagggatgatataggaaatagtattcaacttggacagcttttcaatggagttttatatatgacaatttgtggggacggatcaaagatagcagttgtaacaaatgattcattattggtcttgcaaatgaatagtggtattttatgttctgaatctgaaagtgagaatgtaagtgttgaacatagtatccagcttcacaatattcaatatgtaataatggggagcttatccaaatcaaattccaggaagataaatgtatgtagatcagtctttaataatgacgaggactttaagagtgtgatattgaatcgaaattcaattaagggccatggctatgctttaaatattgacgatatttaccctatgccttgtaataagaaggaggaagctggacttaaagagactctattcaatgataaaatgatgtcagagattgtaattcaaatgcaaagacagagtgaatgcatttctccgtctccacgaactagaagttctcaaagattgcgaccttcgattccaaagtcttcttcatcctcttcctcctcttcttcaaacaaacgagaatttccagattactttcaagtaagggaggcagaaactcctagtatgattattataacccatccatcaacaccacttccgcattataggtggattgaatgtagtaatcgttcaaatttggaaaagttgaaaaatgtgatatgttctttaatatga

SEQ ID NO: 928 - DNA, 1347 bp, Cryptosporidium hominis
atgaagctcattggtttaagcgctcaaccaacataccatcctttggctagaagctcatctggaagttttgagtctgatagtacagaatctgggcgtgtgaatgaagaaagaaacgataccctggaggaaatgatctacaagcagagttctgactctattgaagatatattggttcctattacaaaacctattttctcagactatgcttcaattgggagaaattcaggagttgaagaagtttattcaagtaatgtttcaaccatttcctctaaaggagtagtattcccgaatactacagcttcctctgataatgctttcactaagaataactctactaacagttctaaacatacctccacctccaccactacaaatacaacaacaacaacaacaacaacaacaacaacaacaacaacaacaacaacaacaacaacaaccacaacaaccacaacaaccacagcaacagaaacgacaaccacaaagaaaaacactacaacaactaaaaacacaacaaccactcttaggccacgattctacaccacaggaaagtcactctatactccaaagacagagaatgtgaggactagcgcctatgtgaaaaaaaactcaaattctttgacaggcaataacatagtcaagagggactctgggattatagatatgaattctgacaaagaggcagaaaattcattattgggatttggagcaggagagtatgttaactctgaaagcgatgatccacaagaaactcaagaattgagttatttgaatgaagcagggcaggtaaagatggaaaagtcaatagaagggcattttgatgtaatagaacgaacagtcaataaaaagttaatcattggggtagttattggaattctattgattctgcttatattaatgttttgttgtgtcttctttttgagaagaaggtcagatgatactgaatctgctcaaaatgtggacaattcaaacaaggaaataattaggaacaaactaaatagtttgcaacttgcttcaataaaaccaattctagcaagaaaagggtcaaaaattgtacatatgagccaaaaaagtatcagttatgattcaaacatagctccaccagagaaaaaaagtatagtttctgtggaggatacaacgttttctcctgagtatatgaactcaggtgaaggcggagaagcagaaaaaactataccatattatgtagctcagtcacaggcaaacactcttcaacttcattctggaagaaatattaacttaggatatgatacgaggcctcaaactcagaaacaagcagtattaaagagtcctaagtatcatgattttttctactcagaaccaagcagataa

SEQ ID NO: 929 - DNA, 996 bp, Cryptosporidium hominis
atgtgtttgctgcttccaagtgaaaaggagttttcctaccgtttttctcctggtttggaaaagtggcaaatgacaagtgttgtagaagaattaagaaaggattttgacgagtcaaaaatcccttatattatcaaaaataggaatacaaatgactactatattcataatccgaataaatcggaaacagaagacaaatcactaattagattaagttatatttctccaaaaaatcaaaaagataaaccaactgaagcgatatggaaagaaaagattgcagtctttgatttttgctctccaggccagtctggagacttggagaccaaacacaatattgagaatggtacattgcttaaggatttcagaattgcgatcaaccttgaacataaggagaatcctatcgaagttgccaatactgttactggtccaattgaaaattcatgtgttttggaaagaagaagagaaagagaaaccgtagaagtttcaaattttgttctagactctactcatgtggtacagattgaaagtcgcaggggattcaggcaatgcgaaacttatgaattagaactggagcttaagccttcccactttattcctctattaaagtcttatatagaggatacaaacaatgggaaattgaaagtaataggaactcacccttttattaagctacttactaattttgttaatttggtgtttggaattactctatttctcaataacaaaaaaccaaatgaacaaatcgaatcttctattcaaaactcatctggaaacgaaaaccaaattatggatttaacaagttgtactcaatccaatgaaatagtccaagccttcaaaaaatatgtctcacccattactcctatactcggagactatttatatagagccgtagctagtgagaagcagaaacttaacagaccacaagatattatttgcaaagatgatatagatatttcactcggaattaagcctttacctcctgatactaaagaaatctaa

SEQ ID NO: 930 - DNA, 603 bp, Cryptosporidium hominis
atggggaattttttagcatctacaaagataacaaccgatcttgcgagcaagtctgtgtactcttatacacttacaactctcgaaggaaatctttttcctatggaaagcttgaaagggaaagtcgtaatggtaacaaatgttgcatccaaatgtggctacacaaaatcttattataaacaaatggtgagaatctactctgtgtttgctcctcttggacttgagattattggtctaccctccagagagtttatgggccaagaatttgaagatcctaaagagattcgcaaattcgcagattctcataatgttaaattccctctgatggagatttgtaaagtaaatggcccagatgctttggaatttgtacaaaagctgaaaagagagactcctgagttatatgatgagaaaagtaacactttatctgcaataaaatggaacttttcaaggtttttaattgataaaaatggaaaagttgttgcatttagaggcactaggaccgagcctaatgagcttattccaaaaatagctgaacttcttggtgtttctgattaccagaatctttttaaaaattatgacaagctccatccagaagtcaggttatga

SEQ ID NO: 931 - DNA, 1605 bp, Cryptosporidium hominis
atggaggctgcaaacgatagtttcaagtattcaagtaaggccttcgctaccatgacagctggttgcataggctctggtgttgtatttctgacatatggtatgaagatggcaggtttggctgttggaatttcaactttgatcatttgtgccattgtttcaatagttacccattcgatttatgttgtagggtcattacaacttggagcagtggatttatccactcttttaatgagagtttctgcatataagagtattcgtagtttcttagctagaagagacgcaaagaaggagaataaagaagatgtagagaagttacagaagggtcagaagatgatcctgacagccagtgaggttgaggaaatgaaaagaaatatgaagtttcattttaagtctatctccattatttgtttcctttcaatggcttatgctgttccagtatacttcattctattgcgttcatttactcaggatctggttactcatgctgtattttccttccctcaagctaaatttttggagtatttaaaggatgaatactttttgtctgcattatactttttattggtattaccttttgcaacaaaatccaaagtttcagaattggattttcttggctggttttcagttgcatcattcttcactttggctactgttattgtagttagatctgttgttttcccttattcaggacctatgcctcctgttacaggagaagtacatatttggccagctcatggaccactatcagcctttaagatgttcacattcgcaacttatgccttcttatgtcattgtatggtagtcccagccgttttaaatgttagtacttgtacttataagagatgtattaaggttatttcagcatcctttacatttttattggtattctctttggctctaactatttctgcatatacaacttttggtgaagctacgagagataacattacattaaacttttcaccttgtgatatattcatgggattctcaaggatactgagttgtatttcattatgtgttattattccattatttaccgtttcgatttgtaattttattgtaaatgatattggacttatcaattacatgtcagaattagcagtagaagacgttttccaagtaatttttgatggtaatgatgatgatgataaaaaggaatccagagcccttaaattaacttatgtcccatccaatcctaatattgtattggatgaattagtaaacctattagctaaaaataaagcaagagctattgaatcagatggtcaagaagattatagtaccgaagcaaccctaaaatccatgaaaaataaagaaaagttcaatatttggaggtttttactttccacagctattttacttgtctccatattcctttctcatgtggcaaaatcttgtactcaatatgttgaattattttgtggttatattgacgcttttactgcgtcgatttatcccttgtttgtttattctattatatggggaagaaaaaaatcttttttcacaaatttctttgtagtattgtcttgttacatttcggcaattggaccaatattatcatcaatagtaactacctatgaattaattactggtgtccaaacctaa

SEQ ID NO: 932 - DNA, 1101 bp, Cryptosporidium hominis
atgagaaatataaggtttattccccaattgggaatatttgttttgggtctaataataatatgttttggagtctcagaatgctaccacgaagaaaaaagcttggagagttcccaggtatttcaaaaagatcctcaatttaaattagaacagtctggctcctatagagaagacccagagaggatgagaaacttagatgagtttattaagtatttggtgaatgatgttctttttcctttagaaggaattgtaaaagggtattgcttatttagatctgtatcagatgaggcaaaggaggacttaggactttataacaaagagagcattgctgttgccaccattttgttaagtggcaaatggaagaatccaataaattttatattacgttgtagagaaagccttcgtgtcgtaagtaatgggatgaaagtttcttcatttgaacattcaagtgagtcctggtcctccattacgagtgctcgtaggaagatgaaagcttctcgaataaaaatttgtttcaaggccagaatatgctcaagaatgatgaagaaagaggagggaactgataatcttagaagattcttgattgacagaactcagtatggattaatttatccggatcaaggctctgaaatggcagtatggaatacagtaagagaatttaaagatatattatcagcaggtattctcaagggaagtattaagaatcatatcagagtgattattatgttcaattacatgaacaaaatcctaagccagatcggaaaacaacctgttactttgtttgtttgtattgctcttattaattccatggttagggaaagatccctatctgaatggctttcattttcaaggagtaaaacttcctccagaaatagattaaatgagcctggaattgatccagtaacaaacctaagatacgataccagattgaatatcaaggagaatataagtaactttcaaataagaacatgtaatcacgtaatttggacatctgaagtccttttaagtgaaaggcaagttcaagttattggggtgaattcaaatcaaatatatacattgaggaagagaatttcgtggatgtgtaataagatgtttacaatgtaa

SEQ ID NO: 933 - DNA, 1170 bp, Cryptosporidium hominis
atggcaggtgatttcggaaacaagtcaaattcccaagaggaagtaagatactgctttggtttaccaaatgcagtcgctgctcctattgccatgtgcgcattcattgtctcatctattggttgcgtatactacaacaagaagtgctaccaaaaggatcttccattcccagtcttcatgtcttgggctcaacaactcattggtatggctatcatgtcaactttcttaactattagaggtattctcagtggaaacgaagaaatgtctgcaagtatcccattgagcaagagactctacagatataagtatgcagttttcgtagctttctgcttctgtatgaacatttctttgaacaatatgtgtctcaaggatgccaaggtttctatgtatgctgtcgcaaagtcaacaactgtatgctactcactcctcttacaatacttcttattgggtattagagctaagctctcatctgttttgtcttgcttcgttattattggtggtgttattgttggtatctcagataaggaattcggtcttgagccacgttcattcttcatgggtactttatcatcattcttccaatctctctactctgttgcagtcaaatacactgtcccacactgtgacaactccactactgaactcttactccacgtacaagagctctcatgtatcattcttttggtcctctctgttgcctggggtgaaacttcgaaggtcttatcatctaatgtatttgctttcgtctctgctccactcagtgccctctggttatgggttttaatggctggttctgctatcctcgctatctgcttaaaccaatgcacatacttggtcgtctcccttactactccagctacatacaacgttactggtttagttaaacaagctctccaaactgccggtggtttcatcttctggggtgacaagctcaagccagctccagttggcggtgcatgcctcacactcactggttcagccatctacacactcaccaagctctgggatagcactccaaagaacaccaaacaagaagaaaccatcaaggaacaagctcgtctctcagttggtactggttctgatgcctttgaaaacccactaactgagaacggaaaccaaaacgagaagcagcctctcatcccagaggacaaatgcgagaagggtcaagcttaa

SEQ ID NO: 934 - DNA, 2052 bp, Cryptosporidium hominis
atgggaaaatcttggaaacaatttaaatacggccttcttgctttagcatatatattaacaattgttaaatgccaacgaaagattccagaatattttaatgatggtccatttccatctttaagtattccaactagtagctttggtaattcaactacatttgttgcagatatcttagatggtgcgttgagcccattttcataccttaaacttgctggaataagtgcttgtggtaagttacaaactggaactcctttaccaagtgtatgctatatcgattttgagttgaaatgtaataacccttctgagggaggattaaagattagaggaaaacctgttgtgactcaccatggcgttattgatgttactggaggatctttcgaattaaataatggaaagagcaaagcagggggatggggatatggaattttcccatatctaggcgaatcttcctatttcgaactcactttagttccagttttgaataagaaaggagaatatgtctttgaaatttatggagttggctatgaaaaagctcatttgactagtgaatctattggaattaactgcccattctctattggagaggtaattttcaaaaatgtccattgggcccgaacatacattgttggggttaattggattcgaaatcagcttccattccctaatgtaatcccaaaaacaaaaaataaactcgtagaaatggatgcaccatttacccctggatcctcttggagactcggaggaatgtttctttcttctttgcatgttcctgtaaatccaagtattccaattggaaatactgatatgagagtaatcttatcatgcccaaaaaataataataactttctcatttcccttaatagtacaggagatgttactgtttctcagttatatacaaattacacaaatatgcaattatttgatcagtttaaaccaaataatgaaatctttacgggaaaatatccacatgttatgtataatggattaattgttgagttggttatagctagatctttatatgctgaatctggagtaatttatctcaatgatcttgccattcctaaattctttgaatgtagggataacacaataagagtatctgttaaacacgatacttgggcaccattatatacttcaaacttcactagtaattgccatgaatacggatcatcatttacaggagtaaatctattttcgattccaacttttctaagccccggacaatgtcagaattcctgtattcaaacaagtgattgtgaattttggacttataataacaaagataatatatgtaatggttattctagcgaaaaatatagctttaaaagagattcttccacttattcgatgattactgggtcagtttcttgtccatgttatagtcataatgtaaacttggttactccattgcttgatggaaatgataaagttaaagtcactaatagtgctgttagcagcccagcagaatgtcaagctcttgtacttgaaaataatggccttggaagctattttgtttataataaagagaaaaaagaatgctataaacaaggagtagtgaaatccaatactgttccaatcattgatacaaactctgtagttggaccttctatatgttatgaatatatatactccaatggtgttacacggttttctgacaaacttcaattaataaaatcgatcaaaattagtacaaattcaacagaccatcatggagaattttgtagatctttgtgttctatggaagaaaaatgccaaatatttgaacttaacaattcatatgaatgcatactatacagtattaatgataaaagaggattgagacctttatttgacataattgaaaatagttggccaacctctggggtaattttaatgggtattagcactcctttagttgtatcctactcaaccagaaatagagaaaatattcttcatgctgaagttggaagtctatcattggatctaacaaggagctcagatgcactaaattctagccttactatgaaacaactctcaatccttctagcaattctattactgctaattttgtga

SEQ ID NO: 935 - DNA, 2583 bp, Cryptosporidium hominis
atgactctttttgccaataagatcaaagagttatgctacaaagaacctcatggatctttcctctgtgagattaagactcaaattggacttccgcctttgaagatttatggaaaaggatcaaatatgatttcaacttctatttcagtcatgaatcctcctaaagaattaggacaaggaaatcttttagtgttaatgattgcaactccatcaagatcttcaatcaagtgggaaaaattggaaccacagtctctgcttttcttaagcgtgttaatgggtccaaaatgggaaagagagcttaaaagatacactcaactttccattaagtatttcccatactctggagagtatattagactaactcctccagtatttaagatagaaactaaggagagtataattcaagaaacttcagatttgttggattcatcaatttcagcttctatttcgcgctccccaagcaccaaaatgtctaaggcttcagtacttccaggagtatggcatgaacacttaggaaatatttcaatccaaaagctcgtggatttctcaaagtttgttccagataactcaaacttattgattaacattgtttggacattagcttctgcttttaattcattatgggtaggaggagtggaactttgtcaaatagacttaaagtccatatatgtttatttaggaagccaaaaccaacagagcttgaatatgggaaagattttagatgaatttcttgaatttgggccaaatgaagaaaacgtacattcactaacaaactttgttctccatacgttatctcctcctttgattcggtttagtgaacttgggagaagtagagtacactctgtgacagaatcgtcaattgaagcttctcagtccaaaataaatgaatgcaatgatcaattggaggtcatgaacatctttaagaatatattaagctcaacagacttatctggaaggattaaaggccaaaatcttgaaactatttgtcgtgagatctctgaaatagatcccactaagcttgactgtagctctttggcttgggcaagggaaaatagtagaattcctaatgatcttgacaaatggccaattacagatattccaatagtttctccaactctcaaacagcaggaagttgaaattccgacttctgttaatccaaatgaagagttttcaaaccttgaatctaaatattcggaacaaagcagaagcctattagagtctgtaccaccaattcctgtctatattcctccatctaatccatccattcctccacccattcatcaatctgttcatcaacctactcccccatctattcctgcttctgaaccaagtgcaaaggaagttgtgacagaagagtctcaaaagaaagaattctctccagaatcacctccatccgaagaatccgaggttgaaggaacatccacaaacgaaatctttgatcaagcctctgtggatcagggtgattcttcggtatttgttacaaatcctatactaccaccaccacctcctactagtactatagtaaagccttataaaccggaggatctaaatgaatttactctagtcaaggttccaaaagggcaacttatgaatcttcatatctatccaaggattacaggaaatctttcagagcagaggaaatttgagattaaagaattactaacagcattaaaaggagttgctgaggaattgatatctaagttcacttcctggtcagcttctatttcaagaaaacactcttccatagttccagatgttaatttcaagccatcctttatttttgttcctcctacaccaaataatagagctgactctccgagaatcttagagaaagaattctatatccatgaatctgtgttcttattcgccagagaggaacttcagagaattgagcttcctatgcaacaaattagaaatgaggacctggtagaggtgaaaatgagcagagcaagtcttgcttttattaacaataataaacaagttcctccaagtattacaatacctcaagctcctagttttccagatattagacccaatatctctccaatctcccaagctccttcctctattggaggggttaatgataatgaaatctctcgtttagtctcaaatattgagaaagaacccagtaaatacaaagagtctatagaaaatactcagagaagctcagaactaagtaattctcttgagaaaaagtccgatattagtttatcaagtggaagtttaggtcaaggaagtgagtcttctcaaaaagaaatgagttctgagtcagttataaaggagaattcggaagcaaatgtctctgaatctcagagatcaatatcaacaaagccaaattcagagtcagaaaatattcagggattatcaaatggacacgaacatgggtatagcacagattcaagtattacaaaaggcgaacaaaataattctaactctctagcacaagaaaatagtccgaatttagactccaattctcaagcagaaatgtctagcctcaagtctgaatcatctttggattttggatccaacactgacttatcaagttcagactcaaggtcagtctcagggtctaactctggagaataa

SEQ ID NO: 936 - DNA, 1476 bp, Cryptosporidium hominis
atgatggaaaaaccatttacttgtgagaatcaaaccaagtcgggattttccagtaccacattattattattttatgtggtttccgcaccaatggtgggagcaccatatttattgccatctgctgtaaaggaattattaatgaataacgatgcatattactggctagatcctgacttcaagctaactacaatgaatagtctatgttctcttggtacatcttcacttctattatcaggagttttgggtgcttattttgtggatttatttaataataggaatacagctattctatcagcagcatttcacattatgggatggattttctgcttttttttggataaaacttggttctactttccatatattggaatatgtttgtggggaatttctacacaacttctaactttaacaaagacttctatttctgtgttttatgattcaaagaaacatcttgttgtagcaatggtgggaggttctgttggaatgagtttcgcttatatgcaaatcatggttaatttggttcgttatatttcttctaaaggtattgatttccattatttaggagttaatcctacacaattcattataattattaattgtttcttttcaattctctggatgattggattctactttattattcctaaacatccttttgtcactccaactgttgactattgtacaagagtttctatttccagatctcaaatcatgaactctcttactgaatttgatcatgaggagcgcctttcattaattaatagtcaaatgattgttgaagttaatagatgtaaagaagatattccttatcagtggactttaacattcaaagagcagcttatttctattccaaccattctttttactattatatactctttaatgtggtttgtcaggctttacttcactgtgaatatgaaatcaattctacttgatcagacttctggagacttacaatactctgaatctattataaatatatttggtcttttgcttggaactacatttattgcagctattttagtgggtatctttgtagatctaatgggaatctatttatttttggttttgtttgttgcatcttctctattaattttggtcctttttgccaactttattccgtactgcttcttatcacatttatttggaattgtcatttgtgtattctgctattcctactttattggatgttccttcagtctctttacttccgcatttggttatactcacttaaattcaattcaaggtatttcttccacaattgcaggattctttaccttagtatacaatctttgggactcttttattcatagaaactacaaagataacttcttctttccaactattattgcaattattatcaattccttcatcttaatcctctctatatttatactattatacacaaaacgttggaactcccataactctacctacttcttctctattaacaaaaagacttctttaattaagtga

SEQ ID NO: 937 - DNA, 1482 bp, Cryptosporidium hominis
atggctagctcagaaacggataagcgtagagcttcaggacgaagaggaagccttgaaagtggcagaggagattctcttggaaaaaattcaaatgagtcaaatccaggagtgttcagagagatgttcggaacaaaggaaaatcctacagttattccgtttaaatccataattaagaatccaaagatttattttccaattattgcacttacagcaactttaacagcaggtcatattcaaaatccagatgcaaccagagaactattctttaaaagtggtggattttcttttgctcctgagatgcttgagtcaggagaagctttctttactattaacaatgttatgtccgttgctaatggagcagttttcattggtcatatgattgcaggttctataattgatagatttggtttactcccatgtgcattgataggtcatattttgtctatttttggatacaccttaatgtttttattacatttctcttcctatgcatattattttgctggtatatgttttggtatttctgtatcatgcacttttgcatccagatccagatttatgcagatgttcccaaaggtcaagaacactgttggaatgcttcttacaattggtatggatttttctctattattccccttacttcaagataagctttcagaacttgttggtggtaccaagactgtaatgactggtatggtaattatccaaacaataatactcattcaccatgcatttatattcccatatggtaagctacctgatagaatggaatataaaaactccaataattcgcgcaatcttgaagatgaaaccactgatcttattcaaaaggatgaaactgaagaaattgaacaagatggaattcaaggttacagagaactttcttgcattaggaagattttctcgctacctttcattgccttctttatttatatgttattctttgccttatccagaattcattaccaactcttcttcagaagtacttgtttgatgaacattagtgaccaagtgagtgctaagaaagctgcagattatggaaatgttgtatattcattagcatcttacttatctcttgcttggggttacattgtagattataatggacttattatcacaatgcagtaccaaattgcattacttattggagcttacttctgcgcaggattcaagtctgtgagtaacattatccctcaaatcttatccaatgtatttgctggtctttatacatgttttgctaattctttaacttatagttttgtagctggtgtgtttggctacgaaagctttggtgttgtccagggtttagcttctctttcagcatttgcttcccttatgtcaatcaattactggcagaacttcctggagaacgttttacaaagagattacaatcttgcgaataaacttatcatgtatgccgccattgtaatccttgtaattttattcatattaagaatgatttacgttagaaaaaacaagtaa

SEQ ID NO: 938 - DNA, 1653 bp, Cryptosporidium hominis
atgaattttgtgaaggaattcggtttggttctgttattgctacaactgatactatggattactttaattcaggaattatcaatagtcaaagctgccgattctagatctggaaacaaaagtggtctaagaaaaagatctggattaactcctcaaggtacttcaaaggtctcttcagactcctcgaagaaggagtccaactctgctggagaagaaggcataaactcggttgaggagttgagaggtatcaatccaatgaaagcacatagtataggtagagttgtggagatttgtaatggacaaaatgttcttaaaggagaaagcaaaaagaaattcttcttcttgaaatgtgaaagtgataagaatcagaaggttgtatctgttccacaaattaatcaaattaccaaaaaagctgtagagggtagttctgagaaaactgttttggtgaattggaagttgaacttggaaggagcaaattcagctcttgtatatgcaatactctttgttacttcaacattacaatattctgttatggaaaattgcttagtactcccacgtaatcaagttttaaagggggatccaaaaaaccctgatttagctcaaaaattatatgactgttctgtgggaagcaaagtacaaccaatcacatcctttcatatcttggcaaaaattgatacctactttaaccttcgccctgcaagactttacaatgaactggagagagctatgaggatttctcaattaagttattcctataaagcaaattctaaaactcctgaagtcagagtgagtctccatcccaagtattatgtcattaatgataaaaatgggaacgaagtatttaatgaaatgcttttcattgaaaaattggatgccattccttatattaaggttattgttgttttaaaggatgaaaacttattacatgatttattaattgggaaggaattccaagagcaaaaggcacaggtaggtagatggtatagaagaatgcttagaggaatatggcttcctttttatactgccgctatgttcatgttacaaaatggtaataaagtccattgtgatttgcatactagaaatattatgatttccattgatccaaactttggttctgataaatggaagactattaatacaatgcttgaattagctgcagttactccaacttctatgaaaattattgatatcggaaatacaatttctatgaacagtcatgaaatccaatatgaaaatgatccatgtagaaagtatgagagaagaccatatgaagatataggtctattagattttagaattttagacccgcttactgctcctgctaagccaccaacatttctaccggaagaagaaaagatttttagtgaagatgttaagcctgatgatataaataatataaggtcgctcattaagtattataacatgaagcttagcaaactaaaggcagctattagaagcgtccatcagtgggaatcatgtagagttaaaagagttaacaaaaaaactagaagattacatcaggaaatcgacaaatatccctgtagatttatcgaccaaaagcaagctttattagaagcatgcaagatacttaaacgttatacagccgagcagttcatgggggttccatcatgtaattttagctcaagaagaaagtaa

SEQ ID NO: 939 - DNA, 2067 bp, Cryptosporidium hominis
atgattaaatcaaaatattggtattggacattaactttggttctcctgattattcaggtggttttgggtcaaaatgaaaagtttagtagattagtagcttcttatgctacaggaatagatgagatattctatccatttattcctcaattatttctgatgatgggtagagagcaggttatctcaagtttatttaattcttttgatgttgttattgagaaatatccaggaacagcaaatttgtggatgtttgaaagtattaaaggagaaataaatgagataaagaattctatgaaagaaaatatattgaatttgggagacaaatacaatattaaatttactggagacaataaatttaaaagttttcaggattttcaaaaagatcttttgatttattttaaagaatttggtttagaaagagcatttaagatccataatgaaattgaggaaataagaaaaaagctaatggattataaaactttaaataatgtaaaaatacttgaaaaagttgaatataggtggaactttttaataaatatattagactttgtagataagaacgaagggaataaaaatggtgagttaagaagaaaaattaatcaaagtataacaaatcactttattatgatggagaccccaaaaaaaactgagtttgatgtgaaaaactttgattcagatttctcaaacgaattttgggatggtcatttaagcaattataaattattggctctttttcatgaatatagtattcaacagataaacttgttatataaacagaaattgatttggctgagaattcatttaacagtaggaataatagattcggaaggttttctgaataaagtacataagtcagcaagtaatacaatggtacactcaatttcattaacttctcttcaatacttataccagattaaggatagaatcgacttttttttattaaatgaatcttatttggatcaactactggatatttacgataatttatcaacagcaatgaataggtggatgggacagactttggttttggatgatttgcaatatttatatactcatttgaagattgaatgtttagacattcgaaaaacattaataaatttttttgataggataaaacaatatggagagacagatctgatagtgttggataaaaagagcaagaggagtaagaaattagggaagaagaatagtggatttttaactcgtttaccaatagaatgggatatttcaacaaagctagagaatgatttattatctttaataaaagaaattgagatttggaaagggaaaaattatcctaaagtaaaaaaatctggggatattttaatttttagagatatgattacttcaagagtaaatatggaacttgaggaggaaattaaaaagaacgatagcttatatgaggatcatactgagtttaacctttatttagaaaggatagaacaaagatatatgacttttgtgagaaagtcaatcgtatttttggatgaacttaagagtacaagtaacgactgccagactttgtatttttcagcatcccaagctggaaccttgatttatgagatcgtagcaagtgaaatattaaaaacgtcaaaccgttcgggaaggattaatatgaactcgagcaaacagctaaaaagcttaattaaagatttagaatttgtgaaggaatcaatagatacagtaaagaagactgaagaagatagcgatgctactaatattcttggagaatcaatatccgatgaagactttatatatgttcctggaacagttgggagttttaaaaaatcccagaccactagtggttatttgatattcaggatttcagtgattgtgggtcttttaattgtggcaatcatattgtatatttacaaggataaaattttggtgaaaaagtttgataattctgaggaaagcgagatatacgaaagatattgttcaagggtatctttggacgagatagagtttaattcctcgcaaaatggtgaaaataaaatggttatgaaaaagaataagtattataaggtagataataagtctgggaatataattttaaagcagcaaaagtga

SEQ ID NO: 940 - DNA, 3519 bp, Cryptosporidium hominis
atggacgtaatagaagcaggagatgttgtggaaaagccatctccagatgttttccgctcaagtaggcaatttttggactctgaggtgaagttaatagaagagataaaacataattttttggatacagtaggttatatggaatttcgaaagtttagcagaaaacaccagggagtatttagagatgttgcaagggcttggactttgattttgttagtactttgtggatttttctcaaatctgctatttttttcttcatgtccaaatttgggagatatagcagcacatgggttattttacaagggatataatttgataatattgtgcgtggaaatcggaatgatagtgactacatcattttggctgctaatgactcagttccagactggagtagtttactcgttcagattgagcattttatacacagctattacatttctattatttattttgaggacaacaatttcagattcagaaaactcaacaattctacaaaaatgtgactatattttgagtaatggagagttgatcgtttacaatataattccactcatatatattacgttacagttcttaatttcttttgtttcatttttttactcaaaactaagaccaatcatagctgtatattactttaagcatccttggttcctcaagtcttggaaatttgtaaatattgagcctgtagagttgaaattactttcttttggaaagaggtttgatgggagcagaaatattagtccgaggaatacaagttcaaagtactgtgaaaaaagcgagtcagaggacaagacgagctctgaaggtatgaaaggatattcaagcgatacaaaaatgttttgggatacggaaagtgataaccagaatatcagattagcttctggttatttcattgagattaaaaggtttagtgtaagaaagctactgaaaaagttgaatccgataagattggatttgcttttaacttttagaacaagaaaggatagaggtagaagaccaaattctttgaaaaatcagggatgcagcataaatagttggtatttgggagaaattaatgaggaaggaaggcctcatggttttggaagatggagggaggatgattactacggtgagattctcgtcgggttttggaagaatgggcatcctgttggaccatttaaaacaagagagtgtagatcagggagtggctttatttgtttgaagctaggattctgtcgaacggaggcaaatttgactcctaatctatatggttatgcagatattgaatgtagtgtctctggtcaattctttagagggtttcctttatgccatatttatccggctccgtcaataggaatgaatagaagcggatcaatctttgcgagaattggggctaaaggaaaggcagcattagatgatacaactcaaaagggcaagaaaatggttggcgcagtgtttaatagttcttggtttaagaaaataaggaaaaaagacaaagataagaagaccacactagagaagaaggagggcattttagattctaaaaaggtggttaggcttaatttagataatattgaaggtaatagtgataagatggagtcaaatgaattaaatagtttatcatttgatataccgtcaggaaatgagcaaaatttaaaggaagtagaacccaaactgtcatcagggatgtgcaaaagtgaaatgaatttaagcttacagaaaaaaggagttcacatgattcgtaaagttagacaaaagctaagaaggaaccaaaacagacaggacaaggagcgtgatttgtctcttctgtgggttttccaaaatttatccccacatattccgatgtttacaatccaccctaagaatgaagtcactattttggttgatgcagaaaggggtttgtatattgccggatactttccagtatcagaagtattacgttatacaaaacaaacaggagcgaggctggctttgaacaaccaggatcctgagagtttactaagcgaaaacaacctaaagagtacaattttgggcccgaatgatgccattagtgggcttattccgttctcaagctcattttcgagctcctccattatcaaagcttctcagcatcctctaaataggcctcaagacaataggtacttggaatctgttgaagttagggtagttgatagatattgcaatgattccgtcttctcaaaagatgttttagatgaaaaccaggataataccatatactatccagagttggaagtcaagaattggattcatagcgatggacttcatgcagctgaggcactgatatttattcatgggtataataacacaataatggatgctttaaggcaagttggacagatgattgcttttggcaactttccctcgtatatcaaacctatggtattttcttggccatcaggaaattccttcttagagtatttcaaggctagaaagagtgcagaaagtcctcacactcataattcactttaccaactcattttagggttaaagaatagaggaattcgacatatccacattatgactcattcaatgggaactagattattcatccagtcgttccctaagcttttatcggagaatctacttgaaagatgcgaacagcatgatcatagatcaagcattgatcctggaaattatttgggtcttcgtcattctgagactcagttcggagatgagattaatccaattattaatgaaaaggttcaaatcgtttcaatgactttcttaaatcctgattattacttggatgactttattaacaaagctttcccaatgttaaggcaatactgtaatttaattactatgtatggtgatagccaagatggtgctctaaagtggagtgaaatcattcagggtaggagagctctcggctgcaacgtttttggattacattacggagctatcgggagctttagtaagagaatgaaatcccaaatcaacgatcttgaccaatatagagcttctgatgtggaactaacaggcagcttgaagaagacagtttctacatcaaacatggccgtctatggggatgaaatcaacttctcttccaatcagaaaataggagcaacaggatcaaaattggatacagaaaatcaccctaattctgagaatagagcttcacaagaatcaaaaccaagaaatgatagcgcattatctctcatttacccttctaaggtcctaattaacagtttcaacgcctctcaaagtcccaggcaaggttctccaagagcaagtagttccggaattttggatacttccagtccatatgcaaatagacatactcctgaacaaagattcaactatttagatatggatgtaattgaccagagtttcattgaacaaaatgttgggacaatgcgtcataataactggaacttaaacagagaagtcattgaggatttgagggaactggtggtgagcaggaaaagagcttaccagagatctaccaggctagacaaacgagaaggtaatgtttgggtctacagaattgctccttcttgtgtcacctccattttcgactag

SEQ ID NO: 941 - DNA, 4290 bp, Cryptosporidium hominis
atgaaagcgttattcctggcatttttaataatttttatagaaggatggggtgggggaaagctggttagagtggaatctctaaaaacaagcccaaaaaggtatcaagaaaaagaaaggattccatctcgtttgtctccacctagagaagaacctccggtatttgaaagatatttatattcctatccaaaagattatggtcattacttttttaatcgaattagtgattccaattactgggatcgtattaatggagaaaataagcaaattccaattgagggttggcaatgggacaacacatctaataattggttatggggtcccttaagaaaccaggatggtacaccattacttcctttgagtccagaattagaggctccaagagcttatgtaggccctactcgtatttatggtccaattcaagtcgatgatttaccaattccaagagttttagatataatttgtaaaccttatgagagtttaataggtattagagcatggtttcccaatcctgaaagtaaaggaaggaaagatctacgtggaattcagttcttatgttcttctcctttagatacaagagtaaaaggaggatctaaacattcaacatggagtaggattatgggaaatgttggcccaaatttgaaaaagtacactgttttgacgcgtccagaggatccttttgtcaaaattagggtttttgttgaaactttaaacccagtaaagcatcagtcccagagagagttagttataccaacctatcaaggtccaagattagtgtatatagataatcaagaagaagcattggaaaaaggtccaatatacctcattagaagaataactttgagaaccaagaataatcatctgagtttcttgggtaaggcaggaggtaatttaccatcagttgtagagtctgctccagaaggatatgagctttcaggattcagaatcttgatttcaggatatccaagaagtaaatggaggggagctgacttttcaactttggcatacagaaactccatatctttaggatttctcttctcaaagactgaggatatactgtctcgtcctcaagttatttatggtagaagaggatacgatttccaagatattaaatgcgatgggaagatcacaggattacaaggattttttatgggaaatagaggcctggtcggtattaaagttgaatgtgacagagtatggcaggaagttattttgggaattacagaaggaactgattataaggccttggttgggagtatgattagtgctgtgactttgcatttatcaccagaaaagtttattcaaagtctggtggtattctctacaacaggtagacaacagaagttgggtgatgactgggttactcctacaataagatcctctaaatcagaggggggaggaagaggaaagattctacaaggaatctttgccgagttggacaaaactggagctatttcaggaattggtttccattggaagaagcctccaaagccgggtcaggcaggggatagggaggattatggtaatttggaggtttctgaatctcccttggaaggaggagacactggatcacttgggaattcttcaaagaaggagattgttccaagaagctccttctatggtagagttgctaaggattgtccaatcctggaaaccaaatgtcccacaggtgttccattgacaggtctacgtttaattatgagaaagggtgagactcagccaaaaccctttaaaatgtacttagtttctttggcaatccaatgtggagatgagttctttaagccaattgggaatccaaatctaatagaagcaggtaagaagaggacttatgatattctgattcatgaagaggatccagttgtggatttcagggtttatcttggtgatcttggtcttcctcatctttttgatcttcgtttcaaacatgatgtattaagtagttatgaattatatggattcagagttgctatgatgattagaagtgagagaattggtgcgattgctcctctttatagggttgcaactcctattgatttacctccaattactgcaaaagacattagtattcgtctatttggagctgttagacctgaatctgatccagatgtggtagtacttgaaacatcttgtccacctggaatccctattacagctgttaggatgtggtttgtaaggaagattgagggaaataatattttctctaggttagttggtcttagaattcgttgtggatctaaatggaggaagactaaacttggaagtagtatgggagatagatttgaagctgaagtggaatctggggacttcttctcgagatcttttgttgagaaccaatctgagaagcctttctatgtgagtgggataatgctggttactttagaaaatagaaagtcatcttttggtgagacaggaacagaaatcatgaagaaattggcatcaggtgatgttgaatctgaaatatatggatttattggacaggaaacaccagaaggattagtttccattgggttccttgagagaaaagcaaattacgatgattatccaacatttaatgatattgaagtagctccatatcaagtttctgcttcagatatccaaggagaatcagaagattctttgaatgaggaaaagttaatagaaagtggaattgtgaacttcaggcctggagaggagtggtttggacgtagaggattaggaggatctcatgcagaagagactttctgtgctcctggaagcaggttaactggtcttttggtacatacttcaacaaagattcctcattcaattattggtttgaccttaatatgcgatggtaagccattaaatccagttggaagtactttgggagatattgccaggtatgagattccaatgaatgagccaatagaaaaggttgaagttgtattgaataaagaggatagatcactaagtagattaaaacttttcaatagaaaccatatgaagaagaagatgggaaaattacatgatagattcttgagtggatttgatgtagagataagaaaaggaatgataacagctttatcagcaatatatactaactttggggattctggtcctcctccaaaggtaagaacagtacttggatcaaatcaagtagggccaggttcagccccaataactgatagaaatactccatggggtcatgcaaatgcaaatggagatgtaagtactggagatgagtattcgtgcgaggaaggaacaaaacttactcaaataactatggcttataagaggaactctgtagaacagaaacaagaattaataggtttgaggattacttgtaatgatgaagattatgagcaagttggaatgtgggatgtttcagataataattatattcttgtagaggagacctttggactgagggaaaaagagtttataatagcaataggaggaaccagaattgataaaactcatagtataggaaaactttattttgagacaaatcttctaagacagtttggggaatggcagcattattatgtggaagcaaaaacaagaggagatgggttgtatggatttgaattgttatttgagaagacaggagattatacaactccaatagcaatgctattaccgttgttcagaccaacttcaatggatacaaggagtgaagatttggaagagaagaaatataaatctccatttgaattaccaaaaggagtagcagagtcatcagaggaagcaaatgaacaagaaatgagaggaatgttaagttctccaacaattgttacagattggattggattagatgttggaagcttagagatggatggaatttggtgtaagacttcaaggctaaagttggatggaaggatgacttgggaagattggaggaactcaagaatgacaggattgagagtatataatgatggagaccacattaaaggaatagctcttcaatgtgggaattcttggttagaggaggcaaatcttggtctagttggtccgaagttccattttgatgaaattagtgattgtttggagagtgatgctgattatatagagaatattgaagttgctattgattctagaggtattccggcagggtttaaagtatttagccacgttaagaggcagaagaaagttttaattaataataattctatggtaacttggcaatcaaatgttccagattcaggaaatcactatgcttcaggcattcatgttgaatacgatcctgatactaatattatattcagagttagaatagtctatcgtccaatttcaattgcagaagaccctgaggaaaatgtcgggtttatattttaa

SEQ ID NO: 942 - DNA, 1089 bp, Cryptosporidium hominis
atggagcaaaattcaattgttccataccataatggtaggaactatcctgaatatggccagttaacaaattattatcctaataatacaaataataatggaaatgattcaaagtctgctccatatgagattccaggatgtccagttttcagtgttttcatagcaacagttgttggtattttatggcttttctttgcattaacattaccagcataccattatgcaagagtagtttttccaatagataattatattgacttaaatttcggattatggacagtacatgtttcttcaaactgcgattcatttgttagttttgatgcaaataagaagatgtgtagatttatagtttcaagaatggataatttaagtatttcggatgctacaaactttatttgtagtcttgaagctggtacattacaacttttaaatcttggttgtaataaattccacttattaagaattggttcatcagttatcatgacaatgtttattttatcaatcatattactattctttgcagcaatctttttattaacattttggttctgttatcgtacaagacgtgtgagacagagtatatttatgcttcatttcatttcagcattaacatgtgttcttggtattgttgggtatcttcttgttggtggtcttactatacaaccatttagagattcttcaatgtttggaataggtagtagtatgtttgcaagactattctttgttgatatttcaagaacatttgatttgtcaacaggttttgcttttgctgcttttggtatgatttggattgttttattacctctatggtcagtttgtgcattaccatcagatatttgtgtggatgctattgaagttattgaggatacaacatacgaggaggaggagttaaagaagcttttgggttattcaggactttttggacaaaactatggtaatggacagtctgctgttaataactcctattatcagaataatcaaaaccagaattattataatcatcaatatcctcaatattatcagggtcaacagaatcataatccatatgggcaacaatatccttattacaatcaacaatatagaggttattag

SEQ ID NO: 943 - DNA, 1407 bp, Cryptosporidium hominis
atgaccgaaaaggtggaaaaaaaagaaaataaaaaggtggaagaagaaaaggacaaaaaggaggatgaaaagaaagaaaaggacgaaaaggggaaagatgaaaaggacgagaaagaaaaggagggtgagaaaaaagaaaataaggacaaacaaaaagaaaaaattgaaataccaaaaattgaaatcaaagattcaaattcttcaactggtaactttaccgcaaatacaaccattcctgcaaatattggaaatttggtcaatggaggaatacccttggacaaaaataccagaaaaaattcagaatttcttcaaatcaaagattcacaggaaaaagtgaccaatcaaacaaaagataccccatctttaaacaataatacagaggaatatttcaaagaatcaaactttataacaaatattacacaaaattctacacaatttgatagctttaataatactattctttcaaatattactaatgattcaaacaactctacgatcataaaaaataatcaacatgaaatagaagaacaatccaatcaagatcaaatgaaaatagattcagtaaataatactggaatcattacaaaaaatctacataaaaaacgtcatcatattttaattgatgatcattataataatcaaaaacttgaaagtattaacacaacaaaacaagaacaaatttcttttgatttagataattatcttatcatgtataatataacatcaagtgaagatggaacacagagatatattctaatattaaatgaagacgaaattattttggtaaataaattattagatgatatagctccacatattagtcataatactaatacaaataaattaccattatttatggaagctactttagatggaattaataaagctattaatgtaaataataaaaaaactacaactatacaaactagcattaaaaaatattttaataatcaaaaaggattaattggagaaaataaaatagtaaataaaaagaaaagtaatgattttgtaggtactatttcaaaatttaaaattccaattgaattatttcctttaaataaaaatcaaattattattgatattgatctagtacaaagcaatatctcattatttgcatatattaaattggaaactgcttctaataatccaaatgaaattttaagactttccacaactttagctgttagttcacttggagttgaggatactgctaatactgtaaatatacaagtaaaagatgaaaataaagtcaatgttttaccaacattattcactttaaagaaggagaatcttgaaaatattgacgataataataataataataatagtactatgagtcctaattatcaaatttcgaaacatccaattcagaaatctttctggaaatcaattctaaagactcattaa

SEQ ID NO: 944 - DNA, 2058 bp, Cryptosporidium hominis
atggaagagaaaatcgacaggaaagattttttctcagtggagcttgaaaatggacaagtagaacctgaatcatctccaatatatagaaatcctaactattctaaaggtgaattatcaaatttacaaggtttaaatgcaaataatttatgggaactatttgtaaatgctgtaaataaatataagaataaaaaatgtcttggaacaagaaaactaaatagagatggaacttatggagaatatatatttaaaagctatgaagaatcgaaagaagaggctttaaatattggtattaatattttaaagatggatttatgcccaataagaaaatatgaagataatgaatatcaaaaagaaataagtatgatgggtatattgagtagaaatagagaagaatggtatttaacagaacatgcatgtaatgcatttggaatttgtttagctcctttatatgatactttgggagaagataatttgaaatttatactggtgcaaacacaattaaaaagtctatgtatatcaaatgatagtttagaaaagattatatcaatcattgaaagatctataattgattcaacaagagattcaatattaataaaaaatttaatatgctttgatcatccaacaacagaaattaatcagagagctaagaatttagatattaatttgattttattcaagaatttacaagaaaaagtcagtaagaaagataaagaaatatacaaacccaaaaaaattaaaccagatgatatgtgctcgatacattttacatcaggaactactggatatccaaaaggagcaatattaacacatcgttgttttttagcatgcgtaaaaagttcatatgaacatttgttttcagagaatgaaataaaattagataatgaagatgcacatttatcttatcttccaatggcacatatatttgaaagattaattgtaatgaatgcttattatttgggaataccaattggtatatttagtggtagtgtaacaagattaatgagtgattcacaagaattaaaaccaacaatattagtttgtgtaccacaagtcttaacgagaattattcaaacagttaatgataaaattagtcaatcaaactttttagtaagaacagtatttcataaagcattgaaacaaaaagaaagtattattaaaacaaaaggagatccaacacattggttatgggatagaattatttttagtaatacaagacagatattaggtggaaaattgaaagctataataagtggagcagcaccattaggtttagaagtaaatcataaaatacaagcaattttttgttgtaaattaattgaaggatttggtatgtcagaatgtattggtactttaggtacaagatattcatatgcacatttaggtactgttggtggtccatttagtgatgtagaagtcaaattaacatcagtattagaaatgggatatgattcaacaaaagaaccaagaagaggattattaaagataagaggtaacagtgtatgtaaaggttactttagggatataatcaatagtaaagaattgattgatagtaatggttggttagatactggtgatatagcagaaagacaacaagatggctcatttaagattattgatagaaagaaatcattatttaaattgtctcaaggtgaatatatttcaccagaaagaattgaaggaatatatttatcatcatcatcattaattcaacatgtatatgtatatggccaatcaactgacagatttttagtagctttaatatttccaaatgagcaagcattaagaaaatggtcggaagataagggaatgaatactttatcattatctttggaagaattatgtgaatctcatgaattatttgatgaattgaatgattcttttcataaagctgaattaagttcaaatttatttggttttgagagaatacataaatttaaagtaattcctgaggttttaagtacttcaaatggattattaacaccaactatgaagattgtgagaaataaagtcaattcaaagtataaggaagttttgaatactttaagatcacaaatttga

SEQ ID NO: 945 - DNA, 1056 bp, Cryptosporidium hominis
atggtagtaataccaataataccatttaaaggaataaatattgatgaaagaattgagatggaatttagaaaaagtgggacatcacatttaaatttattaacaaatgatttaatagagaatgatttgagtccaataagaggagtgaattctattcatattccaggaattttgaatgatgctttaaatcaagtaccattaaatgctaatgcaacagaattatcaagagcaataagaaagaagatatcagaaatttcaccaggaagatttccagaatctcaatgtaattatgatttaataaatacgaaagcaatatatttaacatttttatcatcatgtaaattctttaatgatataataacattatttaataatttaccagaatcacatccatcgtatgctgatattcactatttgttaagtaatattgattcatggggatttgatgaatctcataatacaaagatgtgttcaatagtgaatgatagaattaatagttatatggaattatgtgataaaacatcaaaagctggtaaattgagagaatctaataaaaataataaatcattgataacaaaaagaatttgtagtattgagtggaagaatagattctttttcgggtttgctttaagagaacattatgggccaattccattgaatgctttatcaagttctttactaccaagaaggcgtacaataatattaaatattgaagcagatcacatatttaattcagttccattgagtatgtatgagaatagatttttttattgtacaataaaaacaaatttattttcatcaacatttgagacaataagaaagataacaatagctacaagatcaacattgaaatatgtgggtaatatttcaagtaataatttgaatgaaattgataggagtgacttaagaaatgttttggaagttgctagaaattcaacaaaagttttccaatctcatttgagtaatttgtttgagaaattggataatggagggtctacaaataataagcttcattacaagatttataaagaatacactaattgtatcttaatagactag

SEQ ID NO: 946 - DNA, 1533 bp, Cryptosporidium hominis
atgaaagcttctagcttactttgtgttttatttgcatttctatttcgagctattaatatttttgctcaaaataatgatgctaagtcctcagaaaaaagtacttgtgaaatctatcgagatgttaagctaatgtcagcaaacaataccagatattcttatacatcaagctcttctaagaaatctggtccagctcctttcagattggcaatacttgcaatgttagtttcagattttgtaaccgataattttgccgaaattggtactggattccaagaatttgatgtaattaaattctatgaggaaatattgaaacatggaggaacaagaggacttaacaactacaaagattgttgctttaattcctgttttagtggtttgataccttatgattctgatcatcatttggctaattcagattctatatctgataaaattggacgaactactttatgcgaagcattatgtgatcatacaatgcattttcttaagtctatggactatttcttcttatcaagttcagaactttttgagcttaaaattacggaaaaggaatctaaccactttttggagaaagatagaaatttcttaaaaggtcagagccaagctaaaaaacagcaaaaaagctctttaattagagaaaatgaagaaaaagacgatatggctaaggtacagagcttctcatctgttaacaagtttttattagatatccaagatcgtgaacagaatcaatcagagagtagtgatagtaatagtattggtagtaatcatcattatcaacttcacaaccatcatgaagaagatcctaataatattaaagatgcttctgttatgaattttattgaagataaagattttgaaactgaagaaatgattaatattaactccaggcttttaatgctttgggatgtcgataaaaccttatgggacagttataattttattcaaaagggtgttatttatggtagagctgggaaatttaatccttatacaatgagtttgttatttatgattaaagaaagacaacaacatgatccaagaattcttgatcagtatataattacttatggaagaggtactttaatgaagcttcaatctccttttcttaaatctctttgttattcttgttgggatttaatgagagtatatgatagatactttgcagaaaagtatgattctatacaaacacaagattttaaaagagtatttgaagctaaagaacataatacaatatcatttaatggagaagaattcaaatttagaaattgtccaggaactttaaagaatttattattttggaaaggtaaagatatggaattaattagagatcatattgtttcagctgatgaatctttaagaaaagaatattattatggtaatatttcaaataatttgacagatttagagattgaatataattttagatatccatttaaaacaagaagtgaaataaagattgatgagattgggacaggacttgttgacgacaccgtaagccctttaaagttgacttgtattgaagaacacctcttttaa

SEQ ID NO: 947 - DNA, 2661 bp, Cryptosporidium hominis
atgggaaaaaaactattatcaggacttatagtcccgtttttagtcttgtttactgctgtagaaggtactccagattattctggaatattcgatccaaccagcttattgtcaaaagagaaaattagcgatgctttagtagattcatgggatgaacctattgatatttcaaaagctaatgttagtactatttttggagatctattgaatagtaagactttttcagactataattctttattcccactttcaccatataattcagtctcaaatgaatatctaattagatgtatatcagctgaggggattgtttatagtccagatatatgtccaaatcttgattgtgaacaatatccaatgtctactgacttcaagtattatgataaatcatcatcatctaatattcgattatctctatccaaagaaaatgtagctcttggttcagctatatatacttttgatacttccacaataccaagtattacactaattaacaaatttgtggtaatccttagaactgaagatcccaaagttaattccaaaataagtgttagattggtgtcaataataaaaaaagtagaagatgggaaagaaactgttccaatacttagaggatcttctttccactctattgaacaaaatattattccaggtaaaactttttattctattgatattgttggattgttcagttacttacccaatgagtttgagttaagtcgaatatcaatcatggttttaccttcttctccttctactcaagttgtccttagcatggatgtatttgctattgccaggttttacatggctgtggatacgattccaatctacgaatttggaggaattggtgaaaaggccattcaacagagtaagtatattcaagttaggacatcatcagtttttggaagatctatcatagattataatgataagcttaaggctagattcaatgattattgtccaaaaaccttcggaggacagtgccttgttcaaattacttcccttcaatctactaatgcaataggaatctttggattccaactccaattagcaggagtagtatttgctattaagagtgccaaaatatacattcctatctcagtatttaaatcagctgagcaagttgttacagatatccaaatttctcttctaaagccaacattctccattactaatttaaattacgaaaagtttagagaaagctttgagaaaccaatcaactctatatctgtaccactatctctagaatctgggattaaaaccctaattgttgatattacacggctattccagaaatctccaacattagctgttgagaatgtattaattagtctatctctaccagaaaactacgtaggagcgatctttactctcaacaaagccaaaatcacatatcagtttgatccttctgaaactttccaatctatggatcatcttaacacacaagtcttctcaaacccaaatattgcttctattgaaacttctttctttgatagtaatggaggagctgtcagttatgattcatcattaggttttgaagatatcactcaagcaaataaaacgtccatttctggcaattctgcatttgtctcacagttttctatacctttcatcaccactgaaagtttacaagaaatgaatattaccattgtagagagattacatgcctcttcagaaaacatagatacctcagattcggactcagactcagactcaaattcaacctcggactcaaattcaagctcaaactctaattcaagctcaaattctagcgaaaatggagatcaatatgaaaacgacctaactgaaactcacaaaacactcgattataccctcagtattgtaaaggctctaaatacctccactttaaccagttcaaacgatttaacagcaatctcaagcaaggatttcaagcttaagcttggaggaacaaccagagttgacgtattagatctggttaaaaaagcaatcaatgaatctaaacttaatctaggccttatcacattctacggttttccaaaatctaaggattcaagtaaagatataaacctagctctaccttttatggagatcaaatggaatccaggatcctccctctctaatggagtcatatctggagggagctttgaaactaaactcaagaatctgaagcttggagaactcactaaaaccaattggagctccacttccacagttgcaactgccaagctaaacagtgttgctctagctgcattcgatttctctaaagtcccttgtctaaatactatcacctcagctaaagcaaaaatagagttctctaagttcactgctaatggagagtttgaagttttcctcatggataaattcgactggaactcctcctttactgttgaaggtcaaagcttttttgataaccctacacaaaagtacacaactgacaaatctatccctcctactcttctagctgtcccatttgttgtagacagggaatcctcctttgaaatggatgtttccattactaatgtaatcggaagtggtggagcttcattattaaagaatccccatttgggagttattgcattctctacaaattcagatgacagcgaaatgatggtaaagtctgttgaaattgaccttaaatgctcttttaatgacggagtttactacaataccgccatagtgtga

SEQ ID NO: 948 - DNA, 1749 bp, Cryptosporidium hominis
atgaagaatattattagatatttattcgttttcatagcaatatttgctttaaactcccattccacacttgcagaaaacaatgaagaaattttaaaagagctagacttttgtaaataccctgaaatgtatccaggaattcacctccactttggatattgggatgggtttagaggaagaggtaatttaatccgtcttgtatttgaactttctcaactcccttatattgggcatgcatttggtggttacaaccctgaaggtgcattcgactttacaaattggtttggtaaacacaaatctttaatttcacaaatagacccaagctcaactccaaatttaccattcctagtagattgtagtaataccagtaagacaaagtttatgacagaaacattagatcttatgatttatttggctagaaagttcaatccaaaacttcttggtgaaggattagcaattccagaaaaccaaataatgagtgccagtatcacagcaaataatctcttttctggatgggtacaacatttaatgggaaaagagggttctattgaggctgtcttaaattcaccagatttcttcactgatggtgatattactggtgggccagttattacaattttccaagttgaagagtttgttaaaagtcaagtacaacaatatgatggtccattaacttttggaagtgatgctacaatccctgatatatttatctatgaatttgcaaatttgattaatactttgttccctggtataatcaatgaatatccttcgataagaggtttagtcgatgctttcaatgaaatccctcttgtaacaagatttattcactccgagagatctgtaatctatccacctttaacttctgagctcttacctttccaatattctatggcattcaatcctagaagaagtttctcatcagaaatcccaagacttggacaatatttggtattttatgggcattcagaatccacatctgctgcatcaatctgcctttcccataaaatattctcaatatcatcatctaatgttgattcagaagaatttaatgaaatgtatggactccttcaattcccacaaattgttgatattgcaactagagtgattggtagaaatgcactcgttagaacttggtatagagtctttagaaagcttggatctacaaaaaatagaatgaagaagagctgtgttgcgattctaacatctggaaagtatcatcaagtctcaatttcaaccgaacaagcccaagaaatctgttcctcctttattaactgctatacaagcagatccactgcatggaatgcaacgaaaactcttatcgatgcttcaaagagatttaacttctttggtggttcaacttcagtatttaattctgagaggtactttaagaaatacatcactgctcctttgctatttgcaaaagctatccgattctattacacatccaaagtcatgcttaagagtggatctttctcaaagaagtctattgttgaaatcttgaatgagacccagaaacaaggtgcagtctcaactttcggtttcactgttaataaagagcttgcaatacaaatatgtactgattattgtgcaaataagttacctcgtaagagcctttattcattcaaaagttcatactctatgcaagctttatgtgaaacatcctttatgtcttattatccaaatgaatcttcagaacttgctatcgaaaaggcttcaactttagtttctcttctcgatcaaatttcaaattaa

SEQ ID NO: 949 - DNA, 4761 bp, Cryptosporidium hominis
atggatagattggaatttttatataaaaatattaatgagaaacaaaagtggggtcatccaaagagtgcagggctgtggagcaagctcacactgggatggcttgacaagtatatacaaaatgcatcaacgggaataagtcacaacccatctgaatttccaaaaattttagagtctgattcaactgttctttgggcaaataaacttgaaaaggaaatcatgaagatgaattctaatttaaataaatgcgatgactttaatgttaacgtatttagagcagtattcaacgttctaagaggtactttgtttagaatactttttggtaagattttatgtgaaatacttggaatgtttattgctgataggctaaagttaagtttgaaaatggttgaggatttttctaaacttgacaagaaccaggatgactattataactctagaagaaatggaatatctattgctattttaattggttttcttcaggtattgtttgtaatattgactacccaagtaggttattatatttgcagacttactgtccgaatccagggtagtgttactcaccttttatacaggtcggtactttcaagaggcattaatagaattgaagttattccagatattaaagattctcaaagagaagataccacaagtatctataatagtatcttgattgatacgaatattgtagtcaaagtggtagtatctttggttgatgtgcttattattccttttagaatgattctggttattactatgttaacaagaacaatgggtgactcagttttaagcaggccagcaatgttttgtattatcttcatttcactactaattactatattggaaatctgtttagccttctttaaatggacttatcttgtaagaagagatgaaagaatgaatcttatggactataccattcataatctgtcttctatcaaaattcttggccttgaaagtttgttttactggaaaatcaacaaatctcgtattaatgaattaaagtcccgtaaaagctttatcatctttcaatctatttcatcggtactatactctactgctaatctaattactcagtataccttattcaagactgcattaatttgttcggttctttatagtcttgaaatccctccaagcaaaattgttacttcttattacgtgattgatatgttttctcaaagactagcagaccttcctctactcatttcaaccattgtcgaaggtaataactctaaaattcgtatggaatctgtaattagacacgtaattgctagaaacctagaaatccaggaaagtattaatagggatgcagaattccataactccgtcaaagaactccaaaacaatggctcttttgaaagtaatatcaactttaactccaattctatagttgatgatggtagtgttggagaggatttcacaagttccagctttaatatcaatattaacgaagaaagtggtatccaaaaggccagaagtgtttcagataataccatagttttgataaagaatgtggagctaattaacgaactttttgaagatcgaataaatatcaaccttttccaagttgaaaggagttgtctaactgttattgaagaccattcttcagaaagacttgaaatgtttgtgcaagcaattcttggatacaatgactatggatgtcaagttggacctaaaatcagcaattgcactgattctatcttttatattcgaagaatatcgtgcctccctatattctggtgttctcatgatccttggataccatctggaactattcgatcaattattctttgtgggtctccaatggttaaaagtctctataagctagcgcttttttcttgtgaccttaatgctgacatattttcttggaaagagaaagacctcagatttgtcgatggaaagcaaggacttagtggaggtcaaattgcaagaattggtcttgctagagctgtgtacaagtatctctatcatagccaatttgactctgaatttgaccatcttttcattttggacaactgtttcaggtcaattgacgttcctgttgcagtaaatataatgttaagactatttacaggtgaagaagcagtacttcaatatgctaacactatcctaattatttcaccaattttaaaggaaatcctcttttcaaagtcagtaggaactttttcctgttcaattagagagtacaaatttggaaatgatggaattactaaaggatttaccatattcaaaaataatattaatgatatgaatgtttccaaatactttggtgcaagcaacaataatagcagtttaacctctattgaaagccagcaaagtgatgatgaggaaattttaaggaagaagaaaagttcttcaattcaatgttctttaaatgtttcagaaagtgaacaatatcccttaaattatgactatccttatccctcaaaaacgattttacttggtaacaaattgagctccaagagtgactgtatttctgaatctgacttgattaaggctatccaatctaaagaagtcctacctcttttggaagatattaatgaaataggttctgttagtaataaaacctatggttcgtatctatcaagtgtgaacaaaatcactctattattaatatttattggagtattaatcacagtttttggaggcattttaagtcaatttggtcttacatatttcttagatcttatttgtaagactaataaccagggtaaagatcttgatatcattaaaggaaatgctcccatgagtgtaataccatatggaccctctagaaacattgatttaagaaaacatgtttctagattcgttctagataagttcaaaggtccattggaatatattctaggagttcaaatgaatattaatggtcaattaagcctgaacacgaatcaactgattggatcttttggcttaatgttatttattattattatgggtaccttccttacatatgtacttgaagctgtagcttgtattcaagcatgcaaattcttccataataacttattatacaaaattttaattaattcatctattccaacattgatgaaaatatctgctgggcaagttctcaataagttctcaactgatgttatactaattgactggaacactatgagaagttttggaagagttacatggggttttgtatctcttgtgatgaacatatgtttattaatagcactggctccttggacattaccaattttcctaataatgatgggactaattctattcaagatcttccttcccatgatttcagccagtagaaatttgcaaagaattaacttgatagcattttctccaatttgttccattatgtcatctactttagagggatcaagaaccatttttctacttaagaatagcgaatactttgaaaaaacagctctcaatatacttgaattcatgcagagaatcagatttttacagcatacatcattaatttggtgtaatacaagaattcaattcttcattcttcctatttcaatcatcaattcaatatttccatatattactccatttgcattaagctccgctgagaataagatgcctaactcaattatcctcttttatttaaagctactttctcaaccaattactattgcttggggaatatctaaatgtttatctttagcagagaatgcaacttgcttaatggcagattatgtccagcttgaaaaagagatgtgtagtattgagaggattaatgacttaatgaacttcattactcaaaaagataaagaacgcaattacatacatcatgaggaagacaaaattgagaagaatatgcttcttagacttaaaaacaattctacacgtaaatctcttttcttaaataaagattcagatcacaccaacttcaagaagacttaccataacattttcgtctcacttctttcggctaatgatatgtctaaccatagaaatccagttctatctatttcaaatgtattcattaactatgaaattcctgataagggaaatttatgtacgagttcaattctcagggacatttctttgaaagcattcaatggagaagttgttggattaattggaaggacagggtctggaaagtcttctatttttagctcaattctgaaaatatctccagttatctcaggaacaatatctctgcttggccagccaattaactctatcccaagacatattcttagaaacaaaattggagtaattcctcaaaaaatgtgtattttaccaaattgtaccgtcagggatgtaattgacccattcaaccaatacagtgataatgaagttcatagcgtacttaagatttgtggaatttataagtacgtaattaatacattaaatggaataaattcacagatttctcttcaaaacagtcatattaatatccatgaggaagatcagtcaaagcagaaatctttaccactttgtctaagaagttccagaaattccagtaaacctccaatatttgtaatttctgaaatttatcttaggtacctttacgcatgcagaataatcctctattctaaaaactacaatctgattctgatagacgaacctatcattttccaagatgaactttcaaaaaactcatcaatgaatgagcaaacaatacaaatcattgatattatctcaacttattgttctcactctgctgtgattactatttcccacgacatcagcataatcaaaaagtgtaaaagaatttatcatctttcggacggtattctaaaagaaatatcttttgttaaaacccactctctaagttaa

SEQ ID NO: 950 - DNA, 2991 bp, Cryptosporidium hominis
atgaattatttcgtaatattaggaaaatttatattattcttaacaattttagaacttttcattgatgttatattagcagaagaaaagaacgagcctattaaagtaaataatgaatcagaaactggcttgaagaataaattatggaatttcttatatgaaagatctcttcaagacaccagtttggtgaagtttcttcctccaaaggttccaaaagattttgtttgcaatgaagaaaataagtctgagttttttaaatcatgtttcagaacaatcagatttcttttgaaggaacaatggaaacgccatgagagccagaaaaagtacaataacccaaaattgataccaggtatgatcaagattggtgaagatctaaaattttctcctccaaattctgatatagagaaacaggagacctacgaaaaccttaaaaatttttgtattaaaagcgttaacaattatttcgaggtgaagaagaacagagaagatttcattaatagatgcaaagctttaagtgttaatcccccaaatattaaaaatataaaaagatctagcttgcctatagatgtgcgatgtcgaggagaaaatatgttggctaaaatggaagagttggattataaaagaagagaagcaaatgagaatgagaaagagtacttggaaaagattattcgaggagaaattgttccagaggaaggaagggtacccttacaagaggtattgaaaagatttgattatggaaaagatcatgtggaagcatctcaattggtagaaaatccaagcttttataagcaatggatgaaccaggacttagaggcttctgaaaaactctcagctttagagaaactcaaagaaaatcctggatttgggagtttatttgggattactaaagaccaagaaaatatagattacggagatcctgatctttatgaaaaaaacgacgctgataaagattctatgtcattcaagttccaatattccaactatgcaattcctggaacaaataaaagaattaaaaagaaagattctttagagattcagaatgatgataatccagagcttaaatccctgaaaacacctccttactatagtggaagtcatgaaaatatagccaacagtacagaaatcaaaaaagtgtctacaagtccagaattcgaggttcctgagactaaaaactatactaatagcaaatttaaagataaatcccaatttcaaattgacaaaaactctccacctcctccaccaccccctcctcctcctcctcctcctcctcctcctcctcctcctctaccgccatcgcaacatctactacctcctccccctccacttcctctttctggagattcaaaagtttcagatatgcagaaagaagaccccactctttcgtttgaagcagtaacttcggtcccgaaatatggaaaacctttcttaagaaaaggcccaatacgtccgccctcatctcctcctcctctatctccaacttctcctcatccaactccacaacctcctcctccaccacctctaccttcaacttcatttcctcaaccaccgccaccaccccctccccttcccattcctctttctgaaagttcaaaagtctcggatatacagaaaggaggtcccattttttcatttgaaggagaaacttcagtcccaaaatatgaaaagccctctataagaaagggtacagtgagtccacctcctccacctccccttccactctctgaagatgcaaaagtgtcagatattcagaaagaaaactcccaatacgttttagattatacaaaattacaggaagaaaaagaagatccattaaagaagttgagttatatccaagatgagcaagtcttgaagggagaactattttctgaaaacaataaactaggcccaattgaactttttgagaggaaagatagaaaaaacaggcaagatctcttaataaatggtccaacaaaatactatggacgccataagatgaatatatatgaggatgaatacttggaatatggtaataaaggaataaatcatcatggaatgttaaaaccaaagtatgatatgaacttaagatccaaagttaaaaatccagatagacttgtacctttgaatgaagtttatacattgccagaaatcttctcttcaaataaaaaaactgataattcaaaagttaatgatgaaatagttcctagaggatatgataggcatggtttaatggaaataccatctaaagagagaataaagaaagaatttgctcatagattaactaatagaaagatctatacaaatctacaaggcgatgtgaagcttaatccactaaatgttgatcttccaagtaataataaagtttactatgtaaatgttggtggaattcgaaaaatcattccagattataatttaaaccctgtatataagtttgatccaaaaaaatcaaatgaagaatattaccaaaatgatgctaataatcaacaagtacttaaagattttcttaaaataatacaagaaaagaaacgtaagagaaaagttaatactcatgcaaggacaaaactaaaagatgaatcagatagacaaagagtttctaccgcttataaaatccacatgaatccaaaaagaggtattaatactaaaccaacaagagaatttgctcctttgagtgatataaataatttttcagctattgaagttaataaagacgcaaaaaaacgtattagcttttcagatatcataaaagaaagttctgaaaataataacaaaggaaatcaacctaaaaacggtgaattaaatcaacgtatatatgttccaggaaaagttgaagctgatgatttattagaagatcgaccccatgaaagtatttctgaaaacttaggggaacaaaaggtagttcgcttccagcttcccgatacaaacaacaaaccaaaaaaaaagtacgtttctcctcctcctcaaataagctatgccggaactgaagaagatgaagatgatgattatgatgaaaatgactag

SEQ ID NO: 951 - DNA, 354 bp, Cryptosporidium hominis
atggctgtcaaatgtcctaattcagtgatccccaagcttaaacaactcttactttcttcacttaattccattttccctttttctgtctcaccaaataaatcaaaatccattcctcttaacattgcaatgttgtcaataagttcttttaattctccaattggaagtcctaaattcattggaacaatgaaccatcttctttctagcattgtatttaatggacaattttcaatgcttaaaggaatttcaagttttggtcccttgatcagactccatgttttcaaactttacttgattctcattaccaaattctttcttattttcaagttccttcttggagttcccttaagtacgtaa

SEQ ID NO: 952 - DNA, 366 bp, Cryptosporidium hominis
atgttaaaaatgtctccaagaaaagaaagagatcatcaaaaatcaatgatgaaagtcttgaaaaaaattacctcaatggggatttggatacttttacaaaccatccaaaaaagtaagaaaaaaagtaaaattattaaagcttttaaaaaaatacccattatatctccaactatctcattcctttactctcgtctgtcaaacagaggtaagaaaaagagaaaagcaaaaaaatacattaaaacaatacgaaagctagaaatccagtttaggaggaaagcttatggccattttcaagaaaaagaatatcaacaaggaaatgaacttagccaagatgatgatcaatttatgtatttattgagttactaa

SEQ ID NO: 953 - DNA, 6789 bp, Cryptosporidium hominis
atgatcataacaaaatgggtatacaatgtttttctaatattattttttcaagcatttctggtggtattagcctcaactgaatttgaaagctttaaacttggtagagttgagcctcaaaagcttaagattatttcaaaaactaccaccttaaatgattatggttcattaggagtctattcctttaaaaattcaaaagatgaagttgttatgaagagtattctctttcctaattatgcagtattgtttgatgaaggtagaagacagttttgttctggaaagtattctgctgattctcatacttacaatgcaggcgatcaaataccttttttcttaaactattggactgataagtatacttatagatactgggtcttggaatctgatcagggagtaatatgtatgcttccctatacattagaaacgaactttaccaaagttattactggagttgattcagattttcaatttgagcttgctccaacttatgaaccaaacaacaccaattcaataatccagcaaactcctttatttgatcactcccagagctgtactttaagtctattccaaggatgtttttcctctgagtttgttctttctcttccagactcttcttttacttctggattagaacttattgtcagaggtttttctgagtttagaacatacaagggaatcttctcagagctcgtatttcatgataaaacagcttcaaatgcaaaaatactacatatactcattaaccctgatatgattggtatacatcttgtgggtactggagatcaaatttggggtgaattaaaacaccaagtagaaattggaaatatgaaattcaattatgattttagaattataatcaaagaaaaatggatatatattacttctccacaaggtcagactttggtttcatctaaacttcctgacaatttttccaatgtaggtaaaattgtctcaccccaaagaagtgtatcagatcctacctttatacaagttcttctggcatccaatactgagatttccaaagatttcattcaaagtgaagctttttgtcttctttcaatgtctccatttacatctcaggttaagaacatcttgggatttagtcaggaagtcctctttacagaaaattatcatcttgatatttctctagatatacaatcttttgattctattcaagaagaggatctacttcttggcatctcttttgacgaaattttgattgatcctgctaatcttgagatccagagaactagtcacttaactgatcctaaagtcagaattggtctctttaagggatatatatccctggaagaaatgcaaagtagaactattattactggctcatatcaagctaatattaattctaaagttactattcaaatccaaccaatttctagtgaaaataagcttaggatcttatacaaaatagatcagtctaattggtttaggcttactgaagtttctggtgaattgaacaagcttttcaacaaaatcaaatttgaaaagaactcaaaacattcagagattctgagttatactattaaaggagaaaatgatgcatcttctcttgctactacctacacagatagtactccattcatatctccaacttctgataacctttgtaaactcatgccactatcgtattgtaactctcaagatgtatcttttgtacttgaagatcttacacaagtagaaggaaaggatcaaacaatggaagaagaaacaagtaaagttgagtctttgatgagtattaataatgtaaccattcaaatacctaattttccaacatccaacaatgatttaatgtacaaatggagacttttgtcaaatgatattccagtttatgagatttcagtatttcaaacttccatttcaatcacgaacttaatcagctatgagacaatcacgggacctccaatgagtattattagtcaatactcagagaacttaggaatctcaataatatttcaaactacaaaaatcttcattgttgactctggtactaataacattattgcttctatatctaaatcaaagaatctaaatattaacaaaatccaaacatcctatgaaaaaaagatctctgttaactattattcatcttattcatttactcctggtccaaaaacaacttcaactgaatcttctatcctaaatgttttatttgaatgtcaatttttcaatcaatgtaattatggaaactatgtatgtcaaggttctagtgcgagacaattatgtaaagatcctgagatcatgaaactttggtatagtgggcctttgatctctactgatacttccttaagcctgggagtttttccaaattctttatctgtttttactattggaagtcaaaacgaaaatctatttcttattaatgtatttgagagatatatctcacttagtgatccattttcaggaagatcttgttataatgagcttccaaacaacatagttctgaatcaaaactcttatgttaagtttggagttattgtctcaaatggaaaaagagtagatctggtttatttctcaggaaatgatactccaaatctattatgttctataagtatccaaggaagattcatttctgatttttatttctttgaatctaatggacaaggcttatcatctacaattggagatattactatgaatactgaactggatgacttaagtggtcaaataacaacaatttctcctcctgcagagtccaattctaatagtttggttcctttcaaaccaagtaatcaattagatttggagctcagttctgaacttaaagccaatatgggagtacattttgatgttaatctagatcctgattcagattctgccttagttattggagtttctattttaaatagatatcaggatattgatactcatctatatatttcaggaggaagttatccttcagtaatacttagttcaaatatacctggagtaggaactctaacaaactattcctctattccagatgaatgtacttcagttagaaattctttatttaatggaggaaatgttcaatttacaataggagtagatattgaaacttttgttaagtataatttgggagttaaggaagaaatcaagattccatacttgtatgtagttttatgtgatcaaagcttagcaaaagttccaatgggaggtttgaatattaataagcttttaatatcaaataggtcaataatttcaacgagtacaacattagttaatggtttctatgctaatagatccacctccagaattagagatctctcagcagttcctttagaaaatgatgattctatatcaggttataaagagggttgtgaaataaatcaagatcttggggtaacttcctattgtctttcctcctcattaaatattgaaggggattctggtcttaatgagaactatgagctcacagtttatctaacaattcaagattttcctcagttcaagtataggaattctacttactttaatggaataagttaccaggttggagggatgtcatcatttgtggtacttttcaatgaaacacatttaggtgttttaaacttaatagaggagagagagatctggaatctttatggaggagatgctttaatgccagtttcttcttggatctcaatttcagtgaataggatttcaggattcatttattttactttgaatgatcagatttttgcaagttttccagattacccatcccaacatatatcaattcaagagatttcactactacaaccaggatcttggagtgtttttcaaggagttaaacaggattcagtttatgagtcgaatagatacccttttatttatcacgggttcattgaatgctcatttggagatgaatgtcaacccacaaaggaacaaacttgttttggaaattcctttagtggactttgtccatatccaaatcctgatgaaatcgtttggcttttcaatgctttccctgaaataccaacagaagtgaataatgggacatttggaagctcctttgaacttccagagcttgtacatgcctataagctcaacgatggattctttgatatatttgcattttatttcttcaaggactatgcagcaatacaatatctattagatggtacagtttgtagaaacagttataatgttcaaaacagtggttctacatccttggactctgttccatcaaacttccagtggggtttctatcttggagatggaacaatcaatttagtaacagatttaggtggtaacggaattaaaaagatttgtagtttaaatatcccagaaaatattgatcttagactaaatgtggtttatccagttggtcattttcttggtattattgaagcaaataaaaagaataagaatgatttaactattacagatgttcctccagaacaggatacaggaaataatccctgtatgttggaaatgtttaagaaatgtaaaatcaatgatcaagtacaacttttccccgatgaaacttatttcaaatcgaactatatttttgagctatcttttgtttatgatgaatccagagaatacaatatagtttttaaaggacaaacaaatggtcttctttctctttatccagttagcaaaaaacaaacagatctaatcaaattaagtatcttagggaaaagtcttcagctttctaatagtaatagtgatatctctatggcagatattctcatagaaaatgctgaatcaggtgttacaactttttctttatttgtttatctatcatccaagggagatactttcaatttggtttcgtctctagatcttgagacggaaaataccaatagccgtctcagaaatttggttgaaggatataaaggagtttcagtttctcttaatggtaaaatttcagagatttcaattgacaaagttaatgaatcaaatccaacagtatatctcaataattggatcatagaagcagatagcttaaaaccttcgtcaaagcatttaacttgtaagctagaagaagtggatccaggaagttggtgtgtgggtttgaatgcaacttacaatcaggttgattctgattcgaagcttatttggttgaatttcactctttctaaagatcttcagggcgatccaaacacttttgagtatttagattcatatattcttaagaaagaaaacgataaagatttaatagagttgaaatttggatctaaggagcttcaaattaaggatcttattaatgatgagacttcactttcctattacacgaataagacaatattaaagtctggagagattttcaagcttgggattggagtcttagaggaaagtcctgacaagatatatttctgtgatgagtatagtaatgtattgttaaggattccatttccatcttctgagatctctggatctaactttataattaactctaagaaagagatcttttcttcctttatggttgattcaaaacctctttcaatcaatgaaacactaattgatggttataattcttgttcttttgaatcaaattgtggtcttgaaactttaacatgcactggccagatcttagagtacccatgtccaagatctactccagggttaaattggatgattagttccaagcttgtagatacaggtatctctagtggtgaatgggggaatgagtttgcaatcaacaatatattaagttcctttatcatattgggagatttacagattaagtttttggttcacttcttccgaaatagagttgttctattagatcctagtcatggtctttcttgttctggtccatatatatcaaatcaagcagtaacggaaggagatagcgtggattggactattggattagattcaaatcatatggtttttcttggactttttgactcaaatagtaaaaagcattttactgtttgtggatttaagaattttggagaagatataccttttgtagccgttattcctgtgggatctaaaccaggattgaatatctttaagcagtttggacgtggattcccaactggaggatatgaatctacatcaaattctaaagataataatggcttttatcacccaaatcttgatactagtacccaagaatacactcctttgattccttatggtcaaaatgctcctttcttaccggttggagttcctgttactgatgatcagggtttggtggttcctcctggtttctactttaataaaacaacaagccaatatgaacctttgggatcagctgaggattccaattctttaagaccaccagttcctttccaacttgtacaaggaattgaggagtgtgaattggagatttattccttctgtaactccacaaaagttgcaatggagtcttcaatgactaatttggataagaaagattggacattatttgcaatggtttcaactggaattccaacttatactcaagatccaagccctaactttaattttcaatttaaattcaaagataaacaggatcagatcaaattttctatagacatttcaaactcttctattgttatttcaggttcagattcatcccaaattgctgaagctgtgtctccacaatgtggtccttattgttcaacttatccaaaaggatacttcacattttggttacaaaagaagttcagtgaaaacaagtttgttgttggagtgaactacaataatcttttgttggtggaatttggctcagataatagagattttactaagatagatactggtggagatcctggagccactctttctccttctaaaacttatgttttatggaatctcttagatatctcaaatccaccaaaacaaagtgctacaactactactacaaagaccccttga

SEQ ID NO: 954 - DNA, 2199 bp, Cryptosporidium hominis
  misc_feature (1707)..(1707): n is a, c, g, or t
atgacaaagatatatcattttaaagataataatcaagatgaaatcttaatattaggtttcaatatgactcatttaactttaattgataatcaatcttcaaaagaatatagttcttattatacaaatcaaacaacaagtttcccaacaaagagttttagtataggaataggatggagtcgacttggattatttgtattaaatgaatatggagatggattaattcaattaaaatctgataaaaagtatgaatttgttaaaattgaacaagctcaagttcttgagactttgactatttatgaatggtctaacaaatttgtatatcctagagaaatgttatttttaggttattcaatttgttcagcttataatgattgtactgatgataattctttatcttgttctgctcaagcatttggagatttatgtaatcgaagaaaaactaatatttcttgggatattgaattcaaagtaactgagacttatgtaaataatggaacatggggaaatgaatttgaacttccaggattagtgaatatttattttgtttcaaatgatcatcagaatattttatcaatatatttctttcaaagttatttagctttaagagatcttgagaatcagaatatatgttctggaccatatccagagtctatgaatattagtcaagatgataagattaattggtctttaaatattggacattctggagaaatttatttgaatattgaaagttggaagggatcaaataaaggaactaaatttactatttgtatgattggtggtggttctaatggtaaaaataagtatattcaagatgtgaaatatattcatcctttaggatattctccttcatttaataagtatacacaaattaattcattattaatacctaatggaggttatgaatcaacttctgatcctactaataataatggaggtttttattatccagataaagatgaaaatactggagagattaagcctgaggataagtatggagaatcttatccatttttcccacctggtattaaacctgctccaattgatggagatgagaataatacacctccaaattatcattataatacaacaactggtcaattcgagaagaatgaagatcatccaaatcctgatgaaattaatccattccaaccaaatcatattgttgatggtatttcagaatgtgatctttatttattctcaacatgtaatgcaacttctgctaagattatgccagaagataccacatttaatgaagattggacattatttgtgatcttaagtaccggtgtcccagtatatggagataattctaataatattgcttttaattacaaatataattttgttaaatcagattcaacaagtagtgatgatttagttttatctctttcttttactaataatacagtaactttcaagaatgaaaaaaccaatgctgaaagtgtggtaggatcaccacaatgtggaccttattgttcaacttatccaaaaggttactttgctttttggttaacttataattcagttacaaataagtacattatttcagttgagaataataccaagaaattagtagaaattgaagctgatattactagtgattcagtatttaacaagatcattcctgtaatagataccaatagagttggagttgaagtttcaaagactttcaatatttggcaattgacaaatattaaagaaatnccagctgatactactactaccactacaactactactaccactacaactactactactaccactacaactactactaccactacaactactactaccactacaactaccactactactaccactacaacaactactactactaccactacaacaacaaccacaactactactaccacaaccacaaccacaacgactactaccacaaccacaaccacgactactaccactacaacaacaaccacaactactaccaccacaaccacaaccacaactactaccaccacaaccacaaccacaaccacaactactactaccactacaacaacaaccacaactactaccactacaacaacaaccacaactactaccaccacaaccacaaccacaacgactaccaccacaaccacaaccacaacgactactaccacaacaacaacaacaactactactactaccacaactaccactaccgctatcacaaactccaagtaa

SEQ ID NO: 955 - DNA, 3600 bp, Cryptosporidium hominis
  misc_feature (3377)..(3377): n is a, c, g, or t
atgaatttatatttaaatatattagatgataatgtaacaggaaagaattatactgtttgttatataaagaatttgaatcaatttggtggtggatttaaatatttatctccattaggttataaaccaaattattcaagatttattcaagaaatatctccaaaattccaagatggtggttatgagtcaacatctaaacctgataatggttattatttcccagaaaaagatgtaaatactggacaatataatcctgatgataaatatggagaaaatagttatccatttttcccaccaggagttcaaccagctccaattgatggtgatgagaataatacacctccaggttatcattataatacaacaactggtcaatttgagaagaatgaagatcatccaaatcctgatgaaattaatccattccaaccaaatcatattgttgatggtatttcagaatgtgatctttacttattctcaacttgtaatgcaacatctactaaatttatgccagatggtactatatttaaacaaggttggacattatttgtaatgattaatacaggagttccagattatgatccaaataatgtaaataataattataattatagatatgaatttattagtagtactaatagtaatactggtggtggtacattatcagataaattaatattatcattggaatataataatgaaacagttacatttaggaatgaaataacaggtgaggaagatgttgtaggttctccacaatgtggtccatattgttcaacttatccaaaaggttattttgctttctggttaacttatgattcaaaatataattactttattatatcagtcaatagtaataatgattatttaacatcaatttcagctgataatactgatatgatttttaataagattattccaaaaggaaataacgttaataatagttataatatttggtatttaaatagtcaaaataggttgcctgtttcaatagctactacaacaactactacgactacaacaactacaacaactacaacaactacaacaactaccactactactactacaactactactactacaaccaccacaaccacaacaactaccactactactacgactactacatcaactactactactacgactactacatcaactactacaaccacgactactactacaactaccactacaacaactaccactactactactacaactactacaaccaccacaacaactaccactactactacaaccaccacaaccacaactaccaccacaacaactacaaccaccaccactaccaccactactacaactacaacaactaccactactactactacaactactaccactactactactacaaccaccacaaccacaactaccaccacaacaactacaactactaccacaacaaccactaccactacgacgactactacaaccactaccactactactacaactactacaactactacgacgactactacaaccaccaccactaccaccactactactacaactaccactacaaccactaccactactactaccaccacaactacaacaactacgacgactactacaacaactaccaccactacgacgactactacaaccactaccactactactactaccaccaccactaccaccaccactactacaaccaatcctccatgggaccaaataattcaagataattgtgaattagaaccaaataatcaaccatgtagaggttttaattcaaccatcccatcaatagtcaatcaaggaaatctcttctggattgattctaatattgcttattattctcctaaaaattataatatccgaaaattatactttacagaaaataataatccaatttcaaatgatggttattattggatgggatataacttcatgaaagataatgatcctgtatttactctcttattcaatgaaacttatctaactattaaagattggaaaggaaaacaagaatattattcaccttatactaatgaaaaacttgcttataataatatgaactttactataggaattggattaagtagattaggactctatttaatgaattccaaattacaaagtttaatacaaattcaacctcaatatgattattcatttaatcatgtcaaacaattattatatgataatcaagttattactaattatttattacaagatggtttcctttatccaaatactcttttatatgaaggatatgaaaaatgttcattatataataattgtctatcaaataaattagaatgtaattctcaagttctaacaggtatttgttcaactttatctcctggattaaatttagaatttgaaacagaaattaaatcaacaaatcttaataatggtacttggggtgaaatatttaaacaatctgatttattaaatacttatattattagttccaataatgaagatcaatatattatttatatatattccaatagaattgctattcaagatttaaataattatattagttgttctggtccatatcctaatggtaatttaattcatattggatctaaacttatttggaaaattggttttgattcatattattcaatatatttaaatgtatatgatcaaataaatcatgaatattattcaatatgtcaacttaaacctgttattcatcatattacaagtctagatcttattaatgctgttattactaataataataataataataataataataataacaataataataaaaataatacaagtaatacctttggaatagattctattgattatatttatacaagaggatataatccatcaaatactaaatttattcaatatattaataatttcccaagaggtggttataaatcttcatcatcttcaaattcaaatccaaatctagtcacttcttattattatccttattttgataaatctatcaatgaatttaatccattatataattatggtaaaaattatgcattctatccacctggtattaaacctgctcctattattggaaattatcatacaactcctccaaattatcattataatacaacaactggtcaatttgagaagaatgaagatcatccaaatcctgatgaaattaatccattccaaccaaatcatattgttgatggtatttcagaatgtgatctttatttattctcaacttgtaatgcaacttctgcaaaaattatgccagaagataccatatttaaacaagattggacattatttgtaataattagtactggtattcctgaatatgaagataattctaataatattgatctttataattataaatattactttattaattatgataaagatactggaaatgaggaaattatattgantttgttacttaggaatgaaactgttactttaaagaatcatattactaatatagaaaaaactgttggttctccacagtggggtccttattgttcaacttatccaaaaggttactttgctttctggttaacttatgatgaagataatgatctttatgaaatctctattaattccaatacagaaattttacttaaattacccagcttcaaaccaaaaattcaataa

SEQ ID NO: 956 - DNA, 861 bp, Cryptosporidium hominis
  misc_feature (850)..(850): n is a, c, g, or t
atgctttatcttaatattaaacaaaaagatcaatcaatattctcagtttgtgtaattccatttggagatcatcttgaacctattagatatatttatccaaaaggttatgctccaagtacttcaaatttcactcaaatacttaatagtattccaaaaggtggatttgaaccaacttcaaataattctaaattaggattctatagaccaatatttaattcaacttctggattatataataatgatcaatacatttctttaaagaatgatgatggtagtattggtaaacctttcttaccagttggaattcatcctgttccatattttggaacttcagaaaatacacctccaggttatcattataattcaacaacaagtcaatttgaaaagaatgaagatcatccaaatcctgatgaaattaatccattccaaccaacccatattattgatggaatctcagaatgtgatctatttatgtttgatacttgtaatgcaacttctgcacaaattatgccagaagagaccacttttaaacaaggatggacattatttacattaattagtactggtattccaattcgtgatccaaataatataaataataatgatattcatcatcaacaagaaccaaatataagatttgattttattaatgtagagattggtggaaataatcaacaaacacttgttctttcacttgaattatttaatgatactgtaattctaagaaatgaaaagactggagattcttctattgcaggatcaccacaatgtggtccttattgttcaacttatccaaaaggttattttgctttctgggtaacttatgatccagaaattcacgtatatatangtttctgttga

SEQ ID NO: 957 - DNA, 4344 bp, Cryptosporidium hominis
atgagttatgatagtttaaatgaagagatttctatttctattgatagaaatagacaaattcttttaaaacttaggaatgctcaagctgtttcatcttttgatagaattcagccatgttgtagtaactcggtaatgaattcatttagcttatggcaactctcaaatgttgctcatattcctcagatagaagcaacaacaacaacaacaacaacttctcctccttggcaagatagtgtacataatgaatgcttattagttgaaaatattcattgtaaaggatttaatgccacgcttaaagatccaccggtattccatcatgaaaatatcttatggatgaattttaaattaccaactcaaaattgtaattcaccttttaatttaaatgagaatttctggtatggatatttcttcactaataaggataaagcagttttatcaatcttatttaatgaaactttaataagtttatatgattggaagaatcagcaagaattctattctccttatacagatggaagtttagtataccaaggacaaaacttaacaattggagttggatggagtagacttggattctttttactgaataaagattctgaatctttgataaatattaaatcaatgacagatttttcttttgataagatcagtaaccatggagaatctttaaatccatcaatatttctacttaaatcaggattcctatatcccaatgaggttcttgtacatggatatagagaatgttcattctttgagaattgtgtatccaattcactaagttgtaattctcaagttttgtctcaaatatgttccaatcctacagcaggaatgagttgggaaattgagacagagattatgaatactcaagtaaataatgggacttgggggaaaagatttaaatcacaagatattatgaatgtctttgcattaagtccaaatggaaagttggtttcctttgtaaaccctaactcgaatggaaatcttgaagatcctggatttatttatattcttaaagatagacttgtattacagaatcatcttggatcagtatgttctggtcctcttcctggagctaaagaagttaattttggagataagataaaactttcaataggaatagattcaatgtcaatgttatatttgaatgtatttaatgaggatgataatgaatataatacagtttgtactataggtaagatagagaatggatggagattcaagtatattttcccaataggacattctccttcagtttcaagttttgtacagattaagcttggattccctgatggaggatttaagccaacatcaacagaaccagattcattgtataatccaccttttgataagacaacaggaacttatcatccagaactcaagtatttcaatagttatctctatttcccttcatcaattgttccagctccaattgatggtaatgaggctaacactcctcctggatacttttataatagaacttcgagcttatttgaaaaggaacaagtttctcagaatccagaaatcaatccatatgcaccagaatatattaaaaaaggagtagatatatgtgatcttagcctattttcagtatgtaattcaacaggtgttgatttgaagcctgataatactttctttaattcagattggacacttatggtaatgatgagtacaggaaatccagaaacccaagaaattcttggagaaaataaccttaaaagacaaaactatagatatgaatttttcaattccaatacaaattcactcatattatcaataacttattcagattctttggttagtttaacaaatgaacagaatggaattacagtgtattcatcttcaccacaatgtggtcccttctgttctacttataccaatggattctttaccttctgggtaacttatagtaaaattaagagttcttatacaattacagttaatagaaataaagaaaaattacttttcttgaatggaattgacgaatcatttaaccagataagaggaaagagtctttcttcaaaaacttcctacactctttggcagtttattaatgtctcaagagatccagttggaatttcaacaacaacaacaactactactactactaccactactactactacatctactagtactcctgggttagataatacaagttcttcaacaactacattacctccagatctttcaggaggttgcaaacttagtattggaacagcctgtactggaggatttggatattttgacaagactaatgatagtacatggaaagaaggagtatatgtaaccataagattcaaattcccaaaggttgttaaaaaaagatttacttactacttagatagttcactcagaacattatctagccaaacagtttttagccttacattaatcaacaaagatttaaatgtgggaagtatcttatttgaaccaaacaaattaaaagcagtattaaatgaaacctccataacaactcaatatagtaacggtagaatctattcagaaggagatgatatagaaataacccttttgagaattaatggactcttttacataatggattcaaatggtctagcaatgattgaataccccagtttactactttccgaggatgaaataaaatcaaagctaaactttactttcactgatatttacccttcaattccaacaagattaatattttcagttcaaaactatcaaggatatccatttgttctattaaatggatacctacattcgactttaacaaattattgtggagtagatcaaacaacaatagtaaatcaagctgcaaaaggagtttgtaactatccaaaaaagggtatggaatgggatatctatacaaaaactgtgaatacaaagttaaatagtgggtattatggagatttatatgataatgaagagctaatttctgcttataatataaataatggaactcataataccttaggtttcttattctatagaaagtttgtggtattaattaatctaattactcatgagcaatgttctggaatacatccagattctgaaatattgaaatttggaatggatcatgattggagtattggttataatggaaattcaattttcttaaatgaggggaaattatcaaagaatttcaataaatttacaatttgtactcttccattaagtagagaaatgttaccattcaaatacttaatcccagtaggagaaagtccatatagtaagatgagagttactcagtttggaagaggattcccagaaaatggttatccaataacagaaaaaaataatgaggttccaataaatggagtttttatggttcaaattttgattacaaactttgactattttgttcaaaaacaaatagctgatgagagatttaaagaatttaaagaattatttatttcatcaataaaaagttcttatggtcctaaaaataagcatgtaggaattgttagtttgacaccaagaaatgttcaggtaaacaaagttggagacacagccccttacaaacaagttaaaggagatatcttggtaacattctacatgcattctcaagttggacaaaaattggcagatttctcattcgaagtgtcaataaaagtaatttttaatccaaccagtctttttggacaaatcttcgaatggagtcaattgaactttttgacaagtggagcttcacctccaatagaaaaagtaattaacaatacatcttgtatgggaatttataagaaaaaaacagaattggagactattgttaataaatatggttattactcagatctggttacagaatatcttccagaatctgtagttggttatttctcatttaatcatattattccaaacgtccctacttttgatgatcatcaaagatttgttctttcctttaagaagagacttggtgagttacttgagattgactataaaagtattggtgtgattgcggttgctgatactcctattgaaaatggagtattgggatacggagtacttagtttctacattaactcaaatagtcttgaactttcaacagctttaattgaacaactttctattagactttccaacccaaataatgttttcacaaaaaatatggactggaagcaaatagaagttggatattgtaataagcctaaattctatatgtatcaacatgatcgtagagatggtagaagattcaaccattattcattagacaatataaacctaaatgatgagaatgatcctttttacatttcttcagataatgaaaatatagacaatcaaaatgaatatgaagacattgataactcagaagaaattagtcaaggattggatgaattcatcaatagttttagtcatcacaacaactaa

SEQ ID NO: 958 - DNA, 1260 bp, Cryptosporidium hominis
atggatttaaaattggaattcctcaataaaactgaaaatagaacaacaggatgcagtgcacaatgcatatttggcaaaataattctgttaatagcgtcaataatattattattagggcttttggtttggatattccaggagaagcttctgttctttccaaatattaatgggaaaagagacttagcatcaaacttcccaggatacagacatccaaatgagaataaaatgaattcagaagatgtagttttaactacggatgataatgttaaattatattgctggtttataatacataagaagtttgacagatattctcatgaacaatcaagtgcgatgcatattagttctaatctatcagaacctcatcatttggaacaagttaaaaaagatagtccaaggaaaaagattttagataaaataagaaaggctccaaaatatatgaaattccatttccctgaattttcagatagatatgaacaacaggaaaaagctccaacaattgtcttttttcatggtaatgctggcaatattgggcacagactacctaggttcttggagttttataatttgattggtgttaatatatttgcagtttcttatagaggatatggggacagtgaggggaccccttctgaagaaggtttctatttggatgctaaagcttcacttgagtacgtcctttctaggactgatgtggtggacaagaatatgatctttttatatggacattccattggcggcgctgttgccattgatctcgcttctaagtatgatgttactggcgttattctagaaaataccttcactaacattaaatcagttgctttcagagtttatccaatatttaaatattttggatttttcttcaaattcatacaaagacttaaatttgattcagtatctaaaatctcacgtgttaaatctcctatcttatttgtagttgggaatgaggatgaaataatacctcccacacattctgttgaattatatatgaaggcgggatcgccaaaatctttaaacaaaatttatctagtatcaggtggctcacacaatgacacatggattaaaggcggaatggaattttatttaatgctgctacaatttatatataatgccattgattataacaaacttgaattagaagtatcttcaaacaatttgataaacaaaaatcaagaagagactttattttcaatacaggaaattttaaaaactaaggaaagttctcctataagtaagctaagaaaaaaaacaaattaa

SEQ ID NO: 959 - DNA, 1056 bp, Cryptosporidium hominis
atgattggaaataatgatgtgttgggtattcttggaacaaaacctttaaataatttaatcaaagataacttatttttagaaaatgaacaattcaacgaaagtttgaatgactattggaaatctttcctatgggagttccaattctcaagactatatttcaaattagctagaggagattgtagaataattttctcaaatagttggctaccttatgttaatcattcaaaagtactcttatttaggctattttgcctggtatttttttgtacaattatactatacgatatttttacagaaataaaaatttggaggattgaaaacttagcaaggtactatactacaaattggtgcagtattgcaacaataggatattttcttgttttaagtattgtttcaatccaggcgcagaatttggtgagctcaagcatcgatgacaatatttatgggaaaaatattgcagaaattgaagatataattggaaaagcaagctatctgaattggacatgctggtatgcatggatgattcaaagttttctacttcctacaggacttatagtaaatattggatattggatggtttctcacccaaatacaagtgtaactctaattttagcaatagccaaacatgcaattgcaagtattttagttttttgggattgttactctacttaccaaccattctttttattgcatggcctttatttatatgcatatattattggaattcttttggcaattggcgctataaatctctttccaaattcatttctttccttgctaccaataagtataaatgatttatatacatttttcaattttaacgatgaaaatcatataaagatagctccaagtttattaatttttatttttacattattttatccgcttttacttcttttcctttggtttctattcagagaaaagaatttgctagttgatcctcttccaaataataatcttattagcagctcagaatctaaatgtgaaataatgaaagcggaaacatcagaaaaagttgccttaatttcaaatgaagagcaactagaaaaagtttag

SEQ ID NO: 960 - DNA, 585 bp, Cryptosporidium hominis
atgaataagcgtaaggagcgatcagaaggggttgaggtgtcttgccatgagcaattgatgggtggtaattttgacatatatggatttggagacaaaaggcgaaacttgaatgaatattacaatggcagacaattattggggtttattggagatatttgtgagaaggagaattcagttcttgctcctacagcttcattaggaacagaaaatgaaattactgaagctggagttggatctgagactgtattagggactagatctgtttctggaccagaagtggagggaagaagattgcaagatttggaatctgcagaagagcaacagagctacggacaacttgttaaaaagtatgagagcttacaaaacagccataccaccctacaaaaggtagttaagtcgttgttggataagctttcacaactaaatgagctatgttcacagaaagatagggagcttagtgagtataaggtccaactcaaaaagttagttgacgccaatgaaacactgaatatgtatattcagtcgtctcattcttccataatgagtaatagcatgatcaataaatttggttcagatatttattga

SEQ ID NO: 961 - DNA, 291 bp, Cryptosporidium hominis
atgaagtcattcaaaccagaatcaatgccagtgaactcatcttcggaatcaaagaatgtaggactatataaggaccatcttaaaaagtctagagtgaagctcttgccaatttcaaatacatgctacacgattattagagaaaaaactgaagatttttttccaggtgaatgtgatgaaaacgctgataatcacaacagtaacggacaaatccaaaataatatgaacaaaaataccttagaaaatcaaatgttagattctaacatgattagagatgtgataagctcactataa

SEQ ID NO: 962 - DNA, 507 bp, Cryptosporidium hominis
atgaaagaagatacaacagaattaagtcatgttgaagacgagattgaaatggaaggagaggaagcaattacaaacaaatcagcaatagcagacccaatctttggaggaaagcttttagagagatgtcttaagcttgtgaagaaggttcaagagtatgagaaggaagaaaggaaagagaaaggaagtaagaaagttagatatatacgcagaggagtacatgaagttacaaagagcatacgaaaaggacagacagggcttgttctaattgcctgtgatattcatccagtggatattattgctcatattcctattttgtgcgaggaaaagaatatttactatggatatcttggaagtaaaaagactttaggtactatatgtaaatctaagagaccagctagtgtactaatgatttcattcaacagcgagagttcagttcaagacaaaccgttttatagtatttatagtaaagttatctcaaatatcaaaaaagtgcatccatatatataa

SEQ ID NO: 963 - DNA, 885 bp, Cryptosporidium hominis
atgtgtggagactatcaagattatttaaggctaagaaaatgggttaagagggtttctactccattattgctaaatgatgcaattgtaattccaatgcattgtaaccaaactagccattggtggttaattgttatttgccatcctcataaaatctttaatttgatgaattcctctagtccaagaaataactcaactacaaaaattgagaactcgaatagaggttggattatatgtatggattctctaggaggaaagaatattagtcagaatgaaaagaaaaaagctataataaatattttgaagtttttagatatagaaagacaaaataatgatagctattttaatcttctagaggctggaaacatacctacaatggtttatgattctgtaaatactaaagctcataatactaacacttcagttactcatgataaattatctgagacttttagatccttgagtaactgggagattatatataatccaaggagccttccttttcaggaaaataactttgactgcggaatatatatcattgaatatgctcacttgcttttccactatggaaccactatttttaactctatgattaatactagttcaagctctgatgtttcgcacacaactcatttggatcaaaacaaattctccagaaactggtttcaaaatagaagaattgtttacaccaaggttttggaattcatgagtaataatgagagttggaatgaggacaattttctaagaaataagttagtggagatctttgatgacagtatcgaagcttcaaatcataatgaaaaaccttctcaagagaatatttcatcattacaagccagaagaagatttgtaatgtcatccttaaacaaaagctatttcaataagtag

SEQ ID NO: 964 - DNA, 525 bp, Cryptosporidium hominis
atggcatttgagggagcaactaaaagaaataagccaaatcttgttcccggtaattatgtatgttcaagaataaactacgtagaccttgagagcggggaaattgaacttacatgtattacaccagaggagaagaaaacatggtcgaataatgaaaattatttaggagttttaaagaactccaactacaaaaataccaatattatcgaagattactccaaatctgatagatcttcattgcctggagaaagccaatcatgcattaaagacggtatgacagttactgtgcctcagtctgttgcacaaatacttcttgctgaccaaagttatgttctcgaggctctttccaagtactttgcatatgaaatttgtgttggtcaaaatggaatcatttggttttcagcatcaaacatcaaagaaatgcttcttatcatgagcgctttaaaagtcatcccaaactgtacaaaaccacaggtaagcttaaataattttttgttggcgggcttaaatgacttatatttaccttga

SEQ ID NO: 965 - DNA, 414 bp, Cryptosporidium hominis
atgcaaatagttagatttcaggtctattcactgttggtcttgataaatcattccaatttatacctgaacgaccatttaagaaagacaagcaatttactgaattcaatagtttataataatagctctgaatcaagcttggatatgagttttgtcctaaaactatcagaatataatgatcttgaaaattattctacttccattattctaaagaaaatcaatttatctcttttcattctaccagtttctcttttgagcctattggaaagtgaagaggacgccaaatcagcttttgaagccattcaaaatagcaatgcatttgggtgcatacaaaatgaaagcttctcaagtctctttgacatttggaacgaattagaaaaaaaatatctgaacaagaatggagaatcagaagaatga

SEQ ID NO: 966 - DNA, 813 bp, Cryptosporidium hominis
atgaagaaatctaactttgaaaatgaaagaggtcattcaatttatgatatttttactgatcaagaaaaagtaacatattttggaaatgataacttaaattccaagaccatttgtggctctttgaaagatgctggtcttgacttgaaggttatgagggatgtagaaaattttttggggaattcaggtggaattgacgagttgaaacagtctggatatagtagctcaaatccaaagctaacaggtattgcaacaagtgtgattcgaatggataaagtaaaggaggagaagaagcctcaggatgaccaagatctgaaaaagttaagccataaagtttttaagaatgaaggcttttttgacattgcaagggaaattaagcttagaaaattaagttattctcattttattcctcttcatcaactttggaagcaatatatcaaagggttaatagagtcaaattcagttcatagtggggcaaatggagctatgagaacaagaggagggatcaaactctctcaattatcccaaaacctctctcaggctgatttacatggtagcatgatcagcgtgatttcaagtagaaacaaaagttgtgtgaatatccaaggaattgttgttaaggaaactaaagaaacttttgtgattatttctgctgatgataaagtgagaacaattctgaaaggccagagcatttttggaattgtgatttctaataactacttagtaactatttatggaagccaactttgttaccacccttatgaaagaatcaagcacaagttcagacatagagactctttgaacattactccctga

SEQ ID NO: 967 - DNA, 2952 bp, Cryptosporidium hominis
atgtttaagcttaataatattaataataataacaataataataataataataatataaaacctcagaatgtacttcgtaatcaattcacaatgagatattcatttaataatgatcaattatactcttacagtggaggtggaaatagaggtcaacgagtacccagaaacgaaatgagtggaacagtaggttataacaatggagttggatttgtaaatcatcaaaattacttggaacaggtaattaaatatcaacaagtccaacttcagcaacagcaacaacaacttctgtttactcaacagcaatatgaatatagtttacaacttcaataccaatatcagttgcagcaacaattaaatcagaatcgatttaatatacagcgaaactcccatattcaaaaccagtcaaaaattatgaatggaccagtaacaacattaccggatcctcaaacatttgggaaagctgaaaatatgtattccgagatttgttattcaaatgatcaaggagaacttgaagttttagaaccatatgagattttaattataccaaagcgtgataatactgtaacaataagagatgtatcacatgtagatctcagtaataacaagagctctagatatcaggaaatggaagttgaggttgagatcaagaaaggggataaagatattgaacttgagactgttagggacgagcttttaagtgaaaaaaagattaacatgaattctgatacaaatgaagaaattgaggtgaatgtctatgagacaaggaattttgaagaagagaaatactctgagagtagttttgatcaaaaatttaatgactttggttatgagcctattaataatcgcagtatagaagtagatttgaaggaatgttataattgtgaaattcaagatgaacagattctagaaagtgaatcagagcttgaagaagtttctttgaacggtaatcaaggagaaatcgagattgaagaagattcagttttagttattaagtataagaataatgttgggacagatattttgaatctcatggaacagaacattgacaattgcgtaattgatggtaactcttactattatgagaattttgtgagatcacttagttttggagattattccccctacgaaagtcaagttgaaccaaatttgttaggtttcggagataattgtttttatattgtaaataatggacctttctcacaatcaaaccatacttccaaactagtggaggtcttagaagatgagaaaaatgaacaagaagagaaagatggcaaagatcattttcaagaagcaaacaaaaaagaagaaactgaggaaaacatacaaacaaaagaagtacaagatgtcaaaagtgaggttggaagccccaaaaatagtagagaaagcctagaagaattaagcgaaaagattcaaagatttaatttactcttggagaagataaataagatggaacaaatgaatatatcatttaaggaagcatttttaagtgagaaatggaatttgaactctaacttaaatagtggaacacgaggtctggagggcattaagggaaagatggaagaaaatcaattagaagacgacaagagtgtgtctgaatgcagtgctttaggaacagtcaaggacatttatgatagtaatccccatattatttacaaaaatatagaggatagaagttttgaaaactcatctgaaaaattggcagatgtagaaggagaactcgaacaaggggaggaacatgtacaaagatatattcaagcaattaacgattactttgctagagagggacttcttggcgtgtgcgaatcaagacttaatactcatagatgggagagaaattatgaaaacgctatgagctccttaaatagtcaattcaaggattcattctataactcggatgcattttctgagtctgatcctgaatctgcagtaaattctatagctgtttccgaagttaattctgacttcattgaaaccaaggagaatgaggttatggatggagttactaacgaacactgtgaagatattctggatattcctgacaagtttgtagatgaatacaacaatgatttaatcaaggatgagcataatcaagaagataagcttccaaaacaagattcacttcaattagaaactgaagagattaaaactcaagaacaaaatcttattaaaaattcccgattgtctagcccaaaggactcaagaactcaattattccctttaaatcctattcatactgaaaataaaatggcagcctctagctcaatttctagaacagtcttagtttcaaaaacgaaaaacgaggacttaagtaactcaaccaaaaatcaccaaaaagttaaaattccaacaattaatattcctaactcaaatgatattcccaagaaaatatcctcgtctaatattttaaagaaacctcaaaatgatttgaaaattaggggcaaaactctttcgcatgcaaatcccacacaaaaaaatgcaaatttggcgggaagcgaattcaataaagagataattgataaagatgatgaaattttagcaaggctttctcaatgcagagtaatcaattctaaaactatcaaattggccacaaataacaataataataataatttagagggaaacacaggctataaaatatatgaaaaaagtcaaagtaacgcaagtttcagacctagattgaatacatgctctgttccattctcaaactctaataattcatcatccacaaacaataattttaatcaacatacaaataagcgtgcatgcgaaaaaatgacaagagggccggcatccaataattggtttggcggcaaaccaacaaataatcaaaatagaccacaagctccggtccaggtaagaaaggagccgaatttgggatttaagtcattaattagtagtggaataaaagtaaatgtggctgaattaatgaaaccaaggataatccgaaagtga

SEQ ID NO: 968 - DNA, 429 bp, Cryptosporidium hominis
atgaagttaagttttttcttatctttgttggtgctttttatcagttactatcaagttaattctcaagatgcttatcatccatttagatctactgctcttgaattagctgattcaaaaaatcagagttcttgtaatgaaaactgtattcaggagaaaaatgatagatcacttcaagagtctagtgagaatagtaattcgggaaccagtcaaggttcaaacaattcggttggcaatattattcaagaaaatataaataatctttataaagagttagccgatcattctcaagaacaagcaaagaatacatgggattctttaagtactggagcgaaggctggtattattattgctattgtagttgttgcaattattattattgcaggaattattcactgtctctgtatttgcaagctctgttgttgttgctaa

SEQ ID NO: 969 - DNA, 381 bp, Cryptosporidium hominis
atgaacaagaactcaggattacagattaagcagttgatttcactctctgaggaagaacttaccgttaagattgacgaactcaagaaggaattagcaagcttgagagttattcaatctactggtactgctccaaacaagctttctagaattaatgttgtcagaaagggaattgctcgtattttgacaatcttgtctcaaagaaacattaagagcttaagagagaaacacgcaggttctaaatttatgcctttagacttacgtaagaagttgactagagctaagagaagagctttaactccacaacaagctaagaagatgaccgttaaggccagcaagaaggctttgaatttcccaaagagaaagtttgccatcattgcatga

SEQ ID NO: 970 - DNA, 1314 bp, Cryptosporidium hominis
atggccagaataccagaatgtattaaagaattttctcaggaacagtataatcagtacgaaagtttattagaatatgagagacttttagatgaatcaatactccaacagaggtatagcttaagtgatgtatggctaactctaatggatgataagagcattcgatgttataagaagaagctaagagtacatattttcaacacatatgagagtcagaaaccaactgatgctgagttggaatcttttagctttgataatgattggactagaaaagttcctccatcttggactcttaagatacttggatcaattattcaaggagatgcttatcagcctagatttacttcaatcttttctaaaattattattcagttgtcagaaacagaaactattatatgggataagaagacaagtccaactccagaatgtgatggtttggaaatacatcgtattggagatgaggaaagagatatagatatactgttttttttagattatagaactcctcattatagcttatctcctcagttagaggagtttatgggaacaagtttggccaaccttccgagtattgtgaaaagaatttggcaatatgtggaaatgaaagggcttcaaaactcaaaagcttctcatgatagtattatgatagatgaatatcttggtaaattgctatcagtagatactgaacatgttctacttaaagatgttccagatcttttaaaacagcatttactacctccaaaaccaataaagatcaggcatagattagctttgaaaggagattggattgacaatgaatcaacctatgatttcactatagatcttactgagaatgttccgggagacatcacattagggaatccaaatatgtcaaccagaatccaagaaagtggtgaattttctaccattaataaagctttagaggagctttatcataagaatcagagtatattgtcaaaaatatatagctcttgtaataagataaacttttatcaaggatttgcgaatgatcctgtagatttcattcactcactattaactacaaagcactttcaattatatggaaataactcaattaataacatattatcagatcctaatgctatttatgaataccagattgccgataagtatgcagaatactatagacagccatgggtgcctagagcaatagaaaagtatttgtcatgtaagaacaagaactttgaagaaagagtgaataagactgtagcatcagtctctgcatgtgaaaagatcaggagacgtagtggatttgggcaagatcagaggatacagagtcatccaaatcaacaataa

SEQ ID NO: 971 - DNA, 369 bp, Cryptosporidium hominis
atgtttgactttatcaataaatatgtcggagaagtagcaaatgcaagtgcttccgagaatacagagagaactttaagtgagacaggatcaacgcctcctcccgaagagtctagtgatgaagaaagtgacgtaattagtcacaccatggattggggtttccttgattatgtcgagcatttattaatgttgtctaggtcagatgaaggagaagacttagaaattactaaaacaaaagtaattcaagactcctggtcttccattgacaatagagcattatctctacataaagcactattaattaaggtaagtttaaaattattcattcatttactattgtttactatcaaatactcatctatattcatttaa

SEQ ID NO: 972 - DNA, 552 bp, Cryptosporidium hominis
atggggttagcattgaccaagatatggagaaacttatttggaaagaaggacatgaggattctcatggttggacttgatgcagcaggaaaaacaacaattttatataagttaaagttgggtgaagtagtaacgacaattccaaccattggattcaatgttgagactgttgaatataagaatatttctttcacagtatgggatgttggtggccaagataagatcagacctttatggaggcattattattctaatactgatggtttgatttttgtcattgatagtaatgatagggagcgtatcaatgatgcaaaagacgaactagccagaatgcttggagaagatgaattaagagatgcagtacttttagtattcgcaaataaacaagatcttcccaacgctatgagcgctactgacattactgagaaactccaacttagcggaatcagaaatagaaattggttcattcagtcaacctgtgctacgtccggagatggtctctatgaaggtcttgactggctatcaagaactcttgcttctagaagcaataactaa

SEQ ID NO: 973 - DNA, 339 bp, Cryptosporidium hominis
atgaaaaaaagaaacgtcttaattggagtaacggggagcgttgcagcaataaaaattcatgaatttataaagaaattaaaagaaaaagttataagtaacaatattgaaatagagatcaaagttgttgcgactgactcagcaaaaaacttcctcaatggtttagctttagatttattagtagattgtcaagatgaatttggtaattggaagagtatgggggacgatattcctcatataagcctcaggcaatgggccgatttatatattattcttcctttgtcggcaaatacgttggcaaaattatctaatgggctttgcgataatgttttggtaagttag

SEQ ID NO: 974 - DNA, 411 bp, Cryptosporidium hominis
atggttaacataaattcgccaagaaaagatttatcagttttggcacaatgcatgaatccagtagaggaagaaatgcaagaagaacaagtatttcatcctgactctgttatattaccaccagtatctgctgtcccatttgattactatccatattccccaagatataagtatccagaagtaacttgtagttatccatttgtatcttctccaccatatgtagtacactatatgtcaaatttgggagttccaagtttcttccagcaattagacattagtattgatcaaagaaggaatgtattccaaagaaattctggtagaaatagaggcttgcaatttgaaaaaggagaagaaaattttgggaaatactggagtgaaactcaaccatcacgtcctttgggatgtatgggatga

SEQ ID NO: 975 - DNA, 828 bp, Cryptosporidium hominis
atgggtaaattaagtagagatcgcagggatatttactatagaagggcaaagcaagagggatttcgtgcgagatcagcatataaactaatccagatagatgaaaaatataatatatttgataaagtgacaagggcagtggatttatgtgcagctcctggaagttggagtcaggttttgagcacaaagttgctcaataattcagagtataatgaaggtcagcccaaagaaactgataaaatagcttcaaataatgaggaggctccgttaattgtagccgttgatctacaagaaatggctccaatttatggtgttaatattattaagggagatatcacttcacgattgactgtcagcagaattttggagtattttcaaggaaaaaaggcagatttagtattatgcgatggatccccagatgtgactggattacatgatattgatgaatatatacaaaatcagcttttaatttcttcgcttagtattacaagcaagatcatgcggaaaggtgggacatttgttgcaaaaatatttcgaggggaaaatatatcaaggatctaccaacaaatgttttgttactttgaactagttgattgttgtaagcctgaaagttctagaaattcaagccttgaagcttttattgtatgtagatatttcaaatttgatgaccaagattcaactaatgttaattttgagattccagatccattgactgttccctttatttcttgtggagatctttctgaatatgatcctgataaaacatatgagacagaatatactagctcacttgaacctatacaacctccaataaatgcaccttatcattag

SEQ ID NO: 976 - DNA, 645 bp, Cryptosporidium hominis
atggaagagagaaatatagaagaaaataatgaagatgacgatttgttcggagaagatatcgcttttagtaaagagagtgtaaacaggaggttaggaaaagttcagaaaaggaatagattaacaaaaaaagtgtgtattaacaaggaatcacaacaaaatgaaaccagagaaaaaattagtagtaatgacaacaatcatatagaagaagattccgactatgaagagtttaaaccagctgctagaaagaaaatatcaagaaaagaagacacagttttaactatagaaaagacccaaaaaaaggttggaacaaaaaatgagcaagttccacaagttatcacaattgaggatgaagaaagagaaaaaagtgtaatcaaattaaatgttaaagtatataaaagaaaagaatcagacataatagtaattaaaactttagttgtagctttgtatagaaacgatcttgttaaaaaattagtaatatatatttcaaaaaacttgaatcctaaaccagaaaaatatttggaagatataaaggtttactttgatggggattgtgtaaatatggagatggaaattaaagaaataggaattgaagatgaagaacaattggaagttaaggtcccatttgagtgtaattggattaaatga

SEQ ID NO: 977 - DNA, 837 bp, Cryptosporidium hominis
atgacaggttctgagcttaggaccccagtttctggctgtcaatggttaggttataatagagttcatattagagaaagtaggacatacaaggtttctccaaaaaaaaaggtagaacttatgagatatgaatataattccacgagtggatgtgaacttgagaattattcaagacaaattataggatatggagattgggatgtaaataagtatacaagaggaaaccaaacattagtagatgtaagaataaattggaggaaagtgataataaggtcaagaatgaatcatgtgaatatattggatgacttgaataagattaactggctttataaatctttgtcaccagtttacttttatgacctaaatctattaaatacgtgtatagaacatttaacaatagttccagattatgatatttccgctatagattcaaaaacgattaaaattgatggtgaaactattaaaattagtaatgaaaagctaaatattgaccatattccagattctaaagtagaagaagcattactaagaatggtgacaggttatagtggaaatgtcatttctgatatggttaaaagagaattcagtattgaaaaagattgggaggagtttttcaaacacaaaagccccaggatgagaaagatttgtcaatggaaagatatcaaagagttttgcttaatgcctccttcagaaatcattcataaacatagttgtaaattaccttccgttgatcacttaatttccagtgatcttgaaactttaaaagttgcactatatccttataattcaacactaccagacacagaccttatcgaattctcaaagtataagacatgttag

SEQ ID NO: 978 - DNA, 1617 bp, Cryptosporidium hominis
atgggaaatactgcagtagggcatacaggaacaaggcttaaagcaccagtagatgccgtagtaaacactactaataagaaagcacctgtaagtgaaaagccaactcaaccacaaataccaaacaaaacttctgatgttaaaaagggaggaaccatgggaggagagagaggaagtgtaacaactggtatgtttgttcagagtggtagcgggacttttgcagaaaggtacaatattgtatgtatgcttggcaaaggttcttttggagaggttttgaaatgcaaagacagaatcactcaacaagaatatgctgtcaaggttattaacaaagctagtgcaaagaacaaggatactagtacaattctgagagaagttgagcttttaaagaagcttgatcatccaaatattatgaaactattcgagattttggaagattcatctagcttctacattgtaggagagctttacacaggaggagagctctttgatgaaattattaagagaaaaagattcagtgagcatgatgctgctagaattattaaacaagtattttcaggaattacttacatgcataaacataacattgtacatagagatttaaaaccagaaaacatacttttagagtctaaagaaaaagactgtgatattaaaattatagattttggattatcaacatgcttccagcaaaataccaagatgaaggatagaataggaacagcctactatatagctccagaagttttgagaggtacttatgatgagaaatgtgatgtatggtcagctggagtaattctatatattctcttatctggaacacctccattctatggaaaaaatgaatatgatattttgaagagagtcgagacaggaaagtatgcttttgaccttccacaatggagaaccatttctgatgatgccaaggatttaataaggaagatgttaactttccatccttctttgagaattactgcaacacaatgtttagaacatccatggattcaaaaatattcaagtgagactccaacaattagtgacttaccttcattagaatctgctatgacaaatattcgtcaattccaagcagaaaagaaacttgctcaagcagctctactatatatggcaagtaaattgacaacattggacgaaacaaagcaacttacagagatctttaggaagttagatactaataatgatggtatgttagatagagatgagctcgttcgtggttatcatgaatttatgaggttgaaaggagtagattccaattctttaattcagaatgaaggatcaacaatagaggatcaaattgatagcctaatgccattgttagatatggatggatcgggttctatagaatattcagaatttattgcatctgcaatagatagaacaattttgttgagtagagaaagaatggaaagagcttttaaaatgtttgataaagatggttctggtaagatttctacaaaggaactttttaaactcttttcccaggcagatagcagcattcagatggaggagttggaatcaataattggacaagttgacaacaataaggatggagaagtagactttaatgagtttgtagaaatgcttcagaattttgtcaagaatgaataa

SEQ ID NO: 979 - DNA, 306 bp, Cryptosporidium hominis
atgcattcctcttcaccccaagcaatgaatatggattcaaactgtcttcccaattacttgccatttccaatctttgtacaaattattcaagcaagaaaaaaaaaactaccatcacttaattctcctcattcaaaaaagggccctatttcaagtcacaaaaattccaaaaggttccctttcaaacctcacaatattagtatacaagctccttcctttattcatcaacttattccactttataatttcaacaatagtcagcgccggacttttggcgggaaaatctcttttatagatataaaaaattaa

SEQ ID NO: 980 - DNA, 495 bp, Cryptosporidium hominis
atggcaagtaattgggaagacagtttgaatccatattcattgcttggggtgaagaggaatgcatctgagcgtgatattaggcttgcattcttgaggttggttagaaaatttcatcctgataagaatatttctgagctgaaccaagaaaaagagacgcaaatagcgaataatggagaacaaggagatcacaacagtcgtataactgtgaaatatcacgcattatatgatgcttattgcattttaaaagatccagaaagaaggaaggaatatgatttgtctgcttttaatgaatctctgagtaattataatagtatgatttggcataaatctgtagatcttgaggaacttgaatatatgaatgaagatgggaaggaggtttttgcttatttttgtagatgcggagggttgatctttttagagaagaagcatattgaagagggttacaatttgttttcttgcgatggttgttcctcgaagataatgataactttttaa

SEQ ID NO: 981 - DNA, 207 bp, Cryptosporidium hominis
atggttagtatagaaatgaatgagtccagggaatcttcttctaaagaaatctcaaatatgatcattgagattaatcatatcaaagaaagtctagttgattattggatagaactcactttgactcaagccaaatcaatgaataacaatttagaatctaatagtgacgcagatacagttttaaaccaagctttaaccaaacaagaataa

SEQ ID NO: 982 - DNA, 2121 bp, Cryptosporidium hominis
atggagaatattccattacttaaatcagttgaaaacaaggacccatcattaaattggaatattgatgtttcggctgagcttgaaaagtatttatcagcaatagaactactagatgaggatatgaattatagtcaaagtatagaagctaatggttatggatataataatgaaaatattactagtaataatgggagttatatgcaaatgtttaattttgttgaagctgctttaattattcaaaactcgacaagcctatattcaaagaaaatagagcatttacattcattggtatttgatgcatttcatttattatctacaggaaaatctcaattaaatgatggaaaaattggaaatgacgaacatacaaattcttcaaatcagcttgcaaataagaataacatagcagaaaaaaatacagcattcttaatgtctaatatggtttcagtacctatcaatttacttcagccagggagaaatataaatttgcaatttgaacagtttggaaataacaatttgaacgacgatatttcagcaaagtattcttcttactcttcttatataggagtttccactttgggaaacagcatttctttgccccaatatagaatagatacatcttcaaataccctttttttggatgaagctgatttgggccactttacttcaaatgattcagttgtagagcatgagtatttgggtgatatgtttgcagaaaatggcatggactatgacagcttccagaaagaacatcaagaccatgaactacggcaaaatgatgaagtttatgatgatgatatggtaatgaatgaagataatggacctgttggggccgagcttgatgatattgaaatagaaagccaggattacattgaaaattttgacaataaagaaaacgagttattagataatatggatgaaaagggaaagaaggatgttaagagctctgctggaggacgcagggataagaacaaggaagattattgggtgtttatggatgaacatatgaaacttggtaaagataaaccattgaaacctggcagaacttataaaatcccatctagaaactatacaatctctttagaaagcttatctcaaaaggaagatatattggattttattgatatttatagtttaagttcctactttatgggtttaactaaaattgagggggaaaaatataagcttggtagtcaaaaattaccatttttctcagatttgaaacctccaaagctaagtgttgaaaagcttttgacatttgatgaccctgattatgaatatttgagattattagaaccagaacttaataaaagcgcctccagttggaaaaaatatcattccaaggtattctttggaagtatggataagaaaaggagagaattattaaattctggttcaggcaatgataatgagcaggaaacttcagaatttaatgatcttgggatgggtgaaatttctgaatacgattttgaacaaactcaagatgttctttcggatcctgaattgcctttggatcctatagaagatcatatccaagacgatgaaaacttaatggaaggaacacaaaatcaagaggaacagataattagcgactcaaatttggtagatattatagattttgaacagaacttgtcagagttgcacaccagaattaatacatggactggctatgtagagccattattacaagctcaaaactctagacctgaattcaacattcatgaagaagggaaaatgatcattgaaaggatgaaaaagttcaacattatggaacaacccataaggtttgaagaagtgactaatgggttttctaagtggcaagtatgcagatcatttctggcaactttaatgctttcaaataatagagaaatagatattcttcaggaaaaccaaaacactattgaagaggaagtcgacttcttctccataaagttgttagatgaggatgaaaagaatcaagcattgaatacaaatgttaacaatactgagaaagctagtgtagtaaatcttgattttccaaaaaagaaaaagacaaagaaagactttgaagaagaaagcaacgaattggggaacaaattagataaaggtcaaagaacatctagaaaaagagggaacaaaacctaa

SEQ ID NO: 983 - DNA, 561 bp, Cryptosporidium hominis
atgagttggaacccattaataattcattgtaaatatgcgaaatttctgtttcaattcttgatattttttattgataatgtatgtaatttagtattatgtggaaaaagatcacaattggaagataatgccgattataaaattgatttctttagaaatacaggtaaatatccatcaactggctatcttgaatcgaatggtctatatggtactcctttaatattgaaatcgcaagactcaacattatggataatacttttcggagtttgtttagctgcgtttatttttggaatagggattttcatgattgcaaactttggtggaaatttaaagcatagcgaagataaactggccgaattagaatccaatgagtacttttatgatccgcttgaaagtcctgaagaagaaattaaacaccttaataaacttcaaggcaaatttgtcagtactttgaattatacaaatccaaataattacaatcactgtcaccatcctcaattttcacaatttgggaactattacaactcaaatcaacaatactattcaagttcaagtctaagataa

SEQ ID NO: 984 - DNA, 474 bp, Cryptosporidium hominis
atgagctcaacttattcaacgtttgtgagctcaattggagcaattgagacgggagtaatgggaaccttggcaggaggaccttcatattttattccatttgcaatttttggatactataagacgcgagcagatgttaatgcagcaacaaacagaatgatggaaatagcagattcttcaagaaatccaagaaagaattttactaggagtacaaaaatgagaaatactcaagaattttcaggacaacaaaatagctatttttggatattgacaatattagcagttgcattaggagttattgccattagtctcctttcgtgtttggttggaataactcctgatgatgattatagagaatcaaaaaaaagaagaagaaagttaatggaaaatcctaaaattacaccagaggaatttgcagtcacaatggctaattacactcccaatgaatataaatatagagaatggaaccgaatataa

SEQ ID NO: 985 - DNA, 252 bp, Cryptosporidium hominis
atgattttgattacttggggcaacccatcatcggctattgatcactggggtcatattggaggattcgtttctggtacttgtcttggaattatatgcaattttaagtcagatttaaagccaaaatggtataaggctgcttttggagtttctattgctttaatttcatccactttgattggtcctatcatcagaatatgggcgtttgaacttgctccttgtgtagtttttccagagaaacttatgaatccttga

SEQ ID NO: 986 - DNA, 228 bp, Cryptosporidium hominis
atgtcaaatatacacagactttctgatttacctccccaaagagatagcagaagccaaagtggtagaagctttaataacaatgatccagggcttagcttaagatttgttgatttgtttttccctggaatcacttggaaacatagtattatttggataagccttgttcaatttattgtatatatagctacttgtattgttgggtcttatgcattatctccatttgtgtaa

SEQ ID NO: 987 - DNA, 528 bp, Cryptosporidium hominis
atgtttttgaatgtcttaaaattgactcctttgggaggaggtccagctccattattaaagaatcaaattgtgaggcaatgctacagcctcatgtttttaaatattttcattgctatttggagtatatcttcaattttgtatagtaaatttacaaatgcaaactttggatctgaaatctcaacatactttttcattgtatttctcattggaagtgtaaattcgatcttcttttcaaagcttggatctctcagatactgtagtgattcagaatggtccaaccgactaattttaatacttattattaacctcgttcaatatggagccattctatggggatgctggatttcttacaaggtattcatgtcaagataccttgctggtacaaaaatgtactattactttatattttcaagatggatgtataatactctatttggaatgactgccttcttttcattctctgtaatttacacatcatttatatatagcaaacttttagtttctcttacccaccaaagggttttgtag

SEQ ID NO: 988 - DNA, 756 bp, Cryptosporidium hominis
atgaatgatgaagtagagaaacttaggagacaggcagaaataagaaagagaaaattgcttgagaggagcagtgatagactaaagctcatttatccaaattatgaagagtctgagaataatgtgagcttggagtcaataacagacgttagatatggggaatcttcaaaatcgaagccgataagtgaatgcaaaagtagtattagtgagacaaattcaagaaaaataagcacaaatggtacattttcagatttttctcaagaagaaattggtgatcagagaaagaaacaagattcaagatcaggtcttaaactagtttcttatattgaatactggaaccaaaaggaatttgagaaatttagaaaggttggttcatgtatattgggaatatttttatttatgattcacaattttgtcccagattcttgcttatatcagtttttctcagcgaaaatcaggatcaattcaatatctggaattgtttctttcattgtatatcagtttttggtttcccaagtttacctttacagttatttcagtatttttcttaactactcaggttcaaatgatagcgaaaacaaaaagtggtataaatccatttttggctgtaacaacactcaaaaagttgactatttagtcataatgaataatattatccaatttgccattgcaacaaaaaactttatctcagagtggtttcttcttgtcacattttactctttttttagttttattcatatctatttccttgctaactaa

SEQ ID NO: 989 - DNA, 396 bp, Cryptosporidium hominis
atgaataatggaaagctaaatacaatgaaagcaaattattttgttcctgagtataatgtccgagtagtaaggccaatgatttattgtagagaaaaagatcttgcaaactttgctctaaaggctcaacttccaatcataactgaaaattgccctgcttgcttttctcagcctaaagaaagaaggcatatgaaacaacttcttagccaagaagagtcacataatcctactatttactcctcgatcatgaacgctttgtatcctcttatttcaattaaccgtactaatactacggtgaaggaagaagaattcatatctaatgatgatgctttgaagaccatgtccaaacttgatgaagacatttccggtgaattattactaacatcttgttctaggtag

SEQ ID NO: 990 - DNA, 1344 bp, Cryptosporidium hominis
atgtcagaggaattgaagtttaatggtcaggatgcaccaaatgaggagatccatgaaaagaaggatgaaggccaagtcgggatgactttcagtgagagagaggctaatatgaatcaaacagcggagtgtgaagaatatttggaggatgaggagtattacgaggaggatgaagatgaactgaatgcaagtttagatccggaattattattagaggagggtagaaagttaagaaaagagaagaagtttgatgaagccattgtaaagttatattgggccatgactaataggatgaatcttttgaatataactgaagaaagtgggatagacccaagactttcagaatactacttgatttatgcggatgtattattggagaaagaggagaattcaaccaattttttctcaaaaagaaatgagcaggatgcaatgagttcattttcatcatcgtcgtcatcttcatcatcatcttcgtcatcatcttcgtcatcatcttcatcatcttcagacccaacgtttatagagtcaaccgtaatgaatatggcaaacaacagtgtagctgaagctacagacgaggaagtagcatgggagaactttgaagctgcaaagctagcttatattaagttgatatatttgaagaagaggggagattacgatacatattgccaaggaataattcctgaatatttaactaacttgttttcatcaaatgagttgaacgatggaaagtttgaggagcttttgagagaggtttgtagttgcgattctgaggaaagatcgagaattccagataaagatatcacagatttatcgtatgtttttataagactaggagacattttacagctagctgaaaagtattacgaagcatcaatagaatacaaaaattctctatttatcttagaaacattcaagttaccagaagatacaactgaatcttcattaatatgtttggcacaaagtactttattttcgggcaaaattaaagactcaaaatatttattcgagagagctttaaatttagttagaaatcactttgaagggaagaacggaatgactgcacctacagatccccaacaaattgaagcttataaactaaccttggaagatttacaacttactttggatgatattaatcgtaaattggctgtgaaccaagaggatcagaaacctgctactgctattcctaaattagaagagataaagaaggaaaattcttttaataaagctcaacttcctgagaatgaacctgttaaagttattaatacggttgatataaatggaagcacttgcgaaaatactgtagataataagaagaaaagaagaattgatttatctaaggtataa

SEQ ID NO: 991 - DNA, 273 bp, Cryptosporidium hominis
catacctttcaaatataccaaaacgaacaaattaaagataactcaacaactaaaaaagaaacatcctctaatacttcccaaataaactttcaagatttaagcctcttaaatgataaactcgcctctttattatttaataaagttagctcctcaaataatgattgccaacaatcctttgagaaaaataactatggactaactcaaagtgaaaccattcaatttaaaagatcaataattaatttagttaaccaaatgaacaaagatttctctctc

SEQ ID NO: 992 - DNA, 1734 bp, Cryptosporidium hominis
atgaaaaacaaagtttttaggaatgtgtttacagaattcactgttgatgagtatgaagaatttcttttaagtaatggaagatacgatatattggcaattctactagcttacaattcttcttacttgagatctctagagattttagaaaatatggtaaactcttcagacaagagttctttggaggcatattcaagcaataattcgaattttattaatatttatttgataatttttcaagtattattgcatttatgtaactcagagattactccaatacatattcaagctaacttattaaaacgatattcaagatttattcttgataagtttgacatttgtccaatagatcgtttatttactttaaaacccgttgataagtttccgcttacaatagacgagatacttggattatttaatttattgccaacaatagcttcaaatcgcctaactaaatcttatttggagacgataatagcaactcaaggtgataatatagaattgaaacataaaataaatttgattgagatttatattaatgatatatcagcaaacattgaaactggcattaataatttaattggagatggatcaagttatattaatctttttaatgataattttagaccttccaagctggccattatgcttgaagatctagaagattttgatactgagattctagtaaaacacatttcttttaacagtcattttaaatataaagttcatgataacattattattgagtacataataattttattcagaagtaacagacatgatcaagctttaaattatataattaatgttttggaaaatattgaattggcagaaatttatactttggctcaaatttatcataataaatatgctattcaatccgataatatgaatttaaaagttaatgcaatagaaaaatcagaatttgagatatcctttcaaaattaccagcaaaacaatttaattaaagatagtaaacaagtatatcgtaaattaaaattttttacagaatttaaactttggaagattttcaaggacgaatactccaacatttcgagtccaatacaacaaaataatacgggggatttagaaatgaattcttggcttgaaattctggatatttctcataatgagttatcactaatttcagaagaatataataaagttaaagatattaacgagcagagtagttacatgaaattgataaataagttaacatctttaaatagagatagaaatcttcaaaacatttatagttatggttcaatggattctaatggagaaataatggttttagtgaaaatcttgatagagtcttggaggtcttgtatacaagacaaatctatcgaaaaggcagaaaaacttcaaaattcaacaattaatatcttaaacaaatattcatttcatcccgatatatccattggaaatattcttcaagttattccagaagaatggcctttattaaagatgataaatttcttaaagaatagtcttgtatcatcaatacacaatcaaacaagtaaatcaatttcaacaaatttatctgcaatttcttttctaagattatacgaaaaatggtcaaatactcgatctaaccatgtcacaattactcaagatatgatttgccatgtgtgctcactaaaattgggtaataaaccctgtgctctatatccaaacggttcatgcgttcatactcattgtttatctaacgaatattattcattcaactcttattaa

SEQ ID NO: 993 - DNA, 594 bp, Cryptosporidium hominis
atgagtggcgtaaatagtttaggaagaaaggtgtgggacaaggagttttatagcaagagtaaagaggagagggatcggataaggagccttgagaatgcggagcacgaaaaaaagcttgaaaaaaaggaggaaatttctgaagagggtgcaaagaaaatgagggagatatacttggatatatcaaaaaatgttggattatcgaagagtcatacatctggtgatgatataagaaaaaatatttcaggatattggtgtgaagtttgtaatctaggttttaacgattcccactcctggatacgtcatttaaatagtcaaagtcataatcagaagatgggaacttccttatatgtagagaagaaatcacttgagtctgtaaaaaggcgactttctgagttaattcatgattatgatcatggattaggaatatttagtaaacataataaaaacgaaagtaaaaatggagtttacagacaaggaataaaaggaggaaataaggtaaaggataaagatagggtatcagaagaggaaaatatgtcggaagatgaaactaagaatcaaatgctccaatacaacttcccatcaagcttctcataa

SEQ ID NO: 994 - DNA, 1536 bp, Cryptosporidium hominis
atgaaaagtaataattatcaagaatttgaatctttacccaattctttattgtttgagaagaaaagtaaaagtcaagtattaagacaaaatgatttaatagcaaatgttgtacgagataatttagataatagggacaaattattcaacaatgaacatgatgttaataattttgatgatttaccttttgtaataccttcaaagagaattattattgaatggcctttatatcttttgaagaatttaaaagctttagattttgagaataatgatttttccaaatatgaattagagaatatcgagatttgtaagatagtgtcaaataatgtgagggaaaagggtgctcaggagtgggaggaggtccagaagtgtgagaaagagtcaattcaggaacacgagaaagagctgatccaagaacatgaggaaaagctgactcaggaatacaataaagagctgatccaagaacgtgaggaagagccggctcaggaatacgagaaagagctgatccaagaacatgaagaaaagctgactcaggaatacaataaagtgccggttcaggaacacgagaaagaactgatccaggaacgtgaggaagagccagctcaggaatacaataaagagccggttcaagaacacgagaaagagctgatccaagaacgtgaggaaaagctgactcaggaacaaaagaaagagttgacccaagaatacaataaagagctgttccaggagcatgagctagaacaaacccagaaccagagccaaaagcaaaaccaaaaccagagacaaaaccaaaaccaaaaccagagccaaaaacaacaacttaccatccaaaaacaacaacttaacatccaaaaacctcaactaaacgtccaaaaacaccaacttgagcaaactaaattcccaacaaacttgagactcaaatacatgcagatctacattatgggaggatatgcaaaaaaacacttttataataaagaacaaaattcatataatatcagagttgaaatcaaaaaaaatcaggaaattcaagcaattaaagttattaatatattagagaaagatgatatgcacttttttcaccatggcaataacattctctcatcatttcaaaacaataattttgagtatcatcgtaaatttatatcatcacaaattcaagcaaataaaaggatgttcagactcaattctcaccaatataaacttcaaatctttaaattcttaaatctcaagatcccaattaaatgtgatgatcaaatatatctttatctcggaaattgtcagtcaaaacatgaatttaatgatgttcaacaagatcaccaaattcacagaagaaatgctatattacccattacaaaacaaaatcttctcaaattaacaaaagatgggggatttcagacacttctggaacttcatgatcattttaatacttttcaaactaatattactcaacaaaattccactcattcttttttatctcgaaatttcaatcatccagatacctttattggatacattctactatccatccaaaaggcatga

SEQ ID NO: 995 - DNA, 7452 bp, Cryptosporidium hominis
atgagcttgagacacaagctaagtgaacataataatggatttagatttttgttggattcttctgctgatgactatttccagaaactcaagactaaattagaatatttaggtcatgttggaatagagtacagaattcaaaacaaagtaccaaagtcaatcaggaccattttggactatgggattaaaccttggtttctctttagcgtctcatcagtgaattccattagactgatacataaaatcttcccaaattatgacaaaatccccttaatcagattggataggcttccattgaagaacaaaaacaaagctatgtcattcttatcgtcagtgtataatgaactgaagattatcatgaataacaattatagagttattgatcaattttacttagttgcagaaaaaatgattaaaatggagagttcatctaaattcggtgagaaatcagctaatgaagatgtttgtagtgaatttgaagaaagtgttaatgattttttcgaaaataaaaagatctccaatattgagcttttgaaagctttgatcacaatttccagcctaaacggagaaatacagctttctcaactggaatctatcatgacagaaaattctataacagataatgtagagagtagtggaagtagaaataacttttacaacattaatgaggattggcttggatggggaggatctgtatcaggacatggaattcttaattctcttccaggtatcgtattttcagctttacaacttagtgaaatatttgaatctagagacttactcaactacttcttcttagtggccttaatatcaccttttgttgttgttagtgactcaaccacttctgatataaatacaatttcgaattatttaaagaataatatttcaccaagacctttaatacttggaatctcaggaattacaggtaatgtcccagtcctatcatcttgtgacatttctgtttcagtttctttatcaaatgatattagtgataaagataaaaggatgaatgatgattatgattcaagaagcgagaaagataaaaacaatgataaagtaagattatatagattagggaaaatttttaaagtttggagattgatcaagaaaaacaataagtccattaaaatttcagatgccagcaataattatctactgaataactttaaggaagaagataactcattaacaatttctagtagcaggaatttagataatagtaccgaaaaggattcttatttcacaagtgaaacattatccgaaaaggtagaaaacagcaaattgaagaagaaatccacaatctctgtacataattatactatccaagatatctttaagaattctgatgataattttgtaatcaaccctgttactgatgtatcagtacgtaaatttcatcaaataattcctctattatcaagagctggaagactcacatattacagaatatctttagccatattcaataacatattcaagctcttccttttgattatcccaaatttattattccaattttattgtgaatggtctgggactttattacaattactggatattgtaagtttatatattatcttttggacagtactacttcctgtattctatggaatatatggaatagatgttccaaagtaccttttggatttaccatatttatacaactcttcaagatctggctattactcacactggattaattattttggtgtttttatggaatcatttgtattgggaatcatatctttttacctatcagtaataatgtgttcaaattctccgtataaaaatggaatttccccagatatttccatattgtctgcatctttgactatgtactgtattatgggaaccctattttcatttttaattaagatcaagtcattttcaacatccatgttggtagcgattcttttcaagctttgttccatattactcatcactttacttttttcaatcaaaaaatatgattctgacttcacctttcgcctttatgcactatacgcacaacattcttacatattcttcctttctattccgctattcatatcttacgtggtactttataacttgattttcaagattattattcatcacattcttccagatcccgcaacttgtgttaaagattggtggttaatccacatcagccaaagctcaagagtacttaagagtccaatcattcttaaaatgaagaattctttcaagaagatgaagcctgcatgttttgtaagtagcattttttcgttaataaaaatatcattttggtatgagtggataatgattaaaattcatctacaacttggaaatgatcatcaagatgaatatatgaatcccatattatttgaatctctaaagattccaactctaacaaatttgattgtatctcaatatcagaaatactttatttggaagcttaagaagaaaaaaaatatgagacaaatttctaataagggaggagatgatcaatcgaattctattaataacttaacatccgtagaaaagaaagaaattaatgaatgtcatcatcatatgatcgaattaaatttacaaccacagatcatcgtctcatcaagttctattaatattgacaataatcaattacctttgagagatttacatagtgaaactatggataatgaaatcaatattcaaaaccaaatgcgaaatgtttccgcaggaagtttatcatacaaaaggctcatgaaattttttagacccattgaaatgaactactttggtgataatcgagtttctgggcaagattggtcatttgaggactggaaaaggcgggtaattttccatgcaaatatagtttggagccctaagcaaatttacatgcaaagcgttgccccaattacaaagaaatggagagcaaaaggaatgcgatctttacagtttgcacagagcttgagaaagttttcttcaagagaattggaggaatataatatttttttattggattatgcattatttttggcagataacagagtgggattaatgggaatacaaaacaatgattctaattattccagagcacttaggaagtcagcttttagcaataatattgatatgatatctaatgagagatcaacagctcaaaatacaagatatgggaaaaacgttgaaggattttcaaatacagtgacttcagtgtctccaattacaaataatagctcttatgtaaattctagaactcaagagccttcaacagttgatttaaatattaatttaactggtagctcttcaaattatggaagaatttcaacattttctgaagatgttaaagcacttttaaatccatttaaattaacatttaaggtgaatcaattagagttggaataccagattgaaagacaaattgaagcatatgaacacagaaatgctttgagagcagttttatgtgtaatttctggaatttttttaacattgggtcctttttctgtgaatgtttcaaacacaggctacagttgggtcggaatactttcaatcattttttgtttagcaatctttatgaactttgttttgagttatacttatggtaagaataaactaagtgtaaaatctcagcttccgttattagtaatgatctcagtatcttcaatattaacttcaagtcatggatttgctttagcagttatatttccaattatatcctttatcatttttaggcttgggtttattcctggggtttatgtaacaattattggttttttaagtgttgtaattggtcaatttatttggaatatgccaagctcctattggatgaggtatttaccaatattacttggtattaatacattttgtggatttcttggatatcgatcagaattattgtacagagcacaatttctattggaaacacatactaatgacttaagacaaagacaaagacaaatacttgatacaatgcttccttcatttattgttgaaagacttttaattgatcagaagaataatccaagattttcaagtgagagtgttgaagatagaggtaccgtatccatattattttgtgatatttatgattttcacagtattgttgcagtattacagccaaagaagcttatttctctccttgattgtttcttcttaacattggattgtcttattgatagttacaactgtacaaaaattgagacagtttttgagacctatttagtagcttcttgtttggatccatatgatgaagcttcagctaatttcgagaatttcaaatcaaaaaagagtaacaaaagttcttatcgtcagaagcctagaaaagttacggttaacaaatctttaaaggatattatcaatttactcagattcgctctccagatccacaagattggatcttctttcttttatgaaattccaaataccaagaatatggatctttcacagattgatacagataatcaaatgattggagttagtccccttgcttcattatcttgttcttcaaaagatagaaaaggtaacaaaaacaattcttttattttcactggacaagaaatggctcttaaacagcttaagcttaagattggaattcactctggaagagttatttcaggggttgttggtactaataagcctcaatatgcactttttggtgatactgttaatactgcaagtaggatgaagtcttcttgtgaaacaggaaagattcaagtatcttcgatgacacatgatttagttaaagatatctctattttgaaatggaaagaaaagagatcttttgttaaaggcaaaggaatgatggatacttttactttagaaagtgtttctggatcagcatatccaaattatacacatattagaaaacaagagatacgtggtaaaggggttggagctatacagattggtaattactacgttaaaaatacctctgattttgatattttggctttagatgacattttgctcaaataccttgcgaaaagtaatgatgataaaaaagtctcacaaaaagactcgaattctgtttcttattccaagcagctcactaaagagcaaaaaagaacttcttcattgttcaaatcctccattcaactaccacaaccaccattactgccgcctctttcaacatcaattcgaaacgaagatgagagaaaagaaagtcatttttcccaggaatttcctccagaaacctttaaacctgttcaggagctaggaaaaggtattgatgactatagagaggaggctgagtatgataaggaggataatactgaagatactcctcttcaagatgggttgttaaagggaattggacgtcaagattctttttcccttaatgaaaatattggtggagacatagagcttcatttaaaaagtcaagattctagttcaattggatttttcaaaaagaaagaacttaactcaactttggtgccttctgaacatgaaactgttgcaaaatcaaatcgaaaaagaatgaaaacgagattcagaaaatctacagagcactcttttatgtccatttctcgcaattcttctgattatcatcaaaaaattgagagaattaattctgatcaatttgcttactctgttagaaaagattctaattatcaaaaaagtaatattattgatcgaagaaggaaagaaaagatttcagatctaatgagtctaacccttggatttaaggataatgaaattgaacaaaagtatttaatcacctactactctgatttaactactctcaaaactattgaagaaagtcttgttattgttattgttacacttgtattacaaactctaatatatacaatattaccatgtggacaaaattatgaagatggtattccaggatttaggatactatggactgtcagaattatatatatatcatcagttttcctttcatggcttgtattatttagtacatatactaattatcaaattcaaagttcaacagaaatatcaggatctgtgatacctggtgtatctgaatcaggattaataagaggtggtggagttggtgaagaagcaagacaattatctggagataaatggaaaggacaattaagcttggagaatactaagcatgttggaggtccaatcttatttttgaatgcagttctagcaggaggagcatcaatgttaatgttgacaatattatggcaatttactatggtagacaattctatatcattatggtgtgatgaggagattcttgaacttttattattggcaacagtacatcataatgctggtttacttttcaagtacattgttttatttgatttattgattatgtttcttatattaactatcttttctgttgggattaatgttaatttggaaggtattgtggtatattgtgttgcattattagttaatattattgcagcttattcaagagaaagaacgggaagagcaattttttatggtactttggtagcaggtaattgtgaaaagaaagcagaagagttattggttgcaatgcttcctagaaaagttttggttgattttcaggaagataagttaaaattggcatatattcataaaaatgtcacatttttgttttcagatatatgtggttttactcaatgggctatgacagtggaagcagagagtgtggtttatatgttaagtagtttatatgctcaatttgatgattcactttctaaatttggattattcaaactttttactattggagatgcttatgtagcaatgagtgaaccagaaattgatccttatgagcagaaatcttcaaatgtttcttctcaaaagataaagaagaagaacaaagacaatcaggcaaatataagctttggaacagtaggtggaggagttggtagtttaggaatgaattttggacttggaataaattatcttaactcagttaatagctatctttcccataattcttctctaagaagttcttctccaagtattttaagtaatccaatttcaagtaaacaatcatcatcttctagtggtagcaataatagttacaatacaaaggatcgacaaatttataatttgaatatttctcagatggaaggttacactccagcagaaggagctagaagaagtattgcaatggcacatgatatgttagagaagattgcatttgttagggaaaagttatcacttcctgaattgagtatgaggattggattacattatggaggatgtattggaggtattgtaggaagttctaggttaagatatgaggtttggggacatgatgtaataataggaaatagaatggaatcctgtggaactcctggaaatataacaatttcaggtcaattgcatgaagttttatcaaagaactttaatcatcttttcaaattcagttatgttggtaaagtatcagttagaaaacaacagattgatatgtataagacaagaattaggaagaatgtacaacttaagattaacaaggtttcaaattctgagaacatgtcaaatttgattagacggaatataatatataataatgaaaaacatatggaaaattaa

SEQ ID NO: 996 - DNA, 327 bp, Cryptosporidium hominis
atggacaaaaaagaaattgcgataggaaaccttttgcttcttgtccaaagagaaacaaatacaaactggaatagattatatttacatcctgaatatttatttgatggatatttattagcacctttaacttctcctgacaagtttaatataatttttcttgagatccaaacaggtttcttgtttattccattaatattttcatcttcagttgctacaataattgatttcccaaatgattctgtcattttctttcttttagagaaagccagaagaccaaaatctgactacttagtaatcttgagtagttttttttttcacacttgttga

SEQ ID NO: 997 - DNA, 519 bp, Cryptosporidium hominis
atgaacatgttactaccagatataaagaaaggaaagtggagtgaagaggagaataaaatgctcattctagccgttaatagatttggccctggtaactggagtcttataaaaaattttgtcattggaagaactgatgctgactgttcaaagcaatgggaaaagctcgatcctgcttcttccttccaatatgatatcattcgagcaacccaaaaacatatgcttccactaagttataagtggattggtctgtctagatcaaatcataagcttttaaatacaatacagagtcaaaatcaaggatttaacaaaaatgattttactcaaccaaaattgtctggatcagatttcttcgtcaaacccgcccaaaatattctcagtattgctcaatatgtcctctctacttataataataattttaattcacaaaatgacgcgtctgattattcaataagtcaattaattcagcaattagagcaaaataggactaataatcaacttgttgacccagatattgcttaa

SEQ ID NO: 998 - DNA, 690 bp, Cryptosporidium hominis
atggcttttaatatttttgttgaatatttgtatattttagttattttcaaagtaaattatgtgatttcaataagaaataataaatcttcttccaataagaatcctacatcaattttaaataaattaggagagtattcagttgatttaaaatttatagaattacaaaaaaaagttgatttgtgttcatcatcgctatctaaaacaaataacgaattgatttcagcaaggttaagaattgctggaaaacaatctaattcacaagaaatcgataataataaaagtgaagaagaaataatagatgaattaactaaaaaaattcaagaaataaaccaggaatgtaatagctttgtagatttactattgctaaaaagaatttatcgtttttcccaaatatcattagatgagaatattaatacagaaatccaagtaaaagagaaaattaataatgttattagaaatctcgtaatcacggaaaacaatgcaccatttattaggtcactgattaataaagctaaatgtaataatttctcaataaatgagcactgcaagttgcttacaagcaaattactttactatatggcaatcactccaaaagaaatcattgaaaattttgaaaacgttcaattggtagatacagaactagctcagaactctacaattcagaaaattaacaatgaaaatcaagtttga

SEQ ID NO: 999 - DNA, 726 bp, Cryptosporidium hominis
atgctttcacaactggaagatatgagtcccgaacaaatgtttgagaaatttgaatcgagagatgaatcttggttactgcaattaactacgaatgaattggagttgttattggacaaactaaaatttttattagatttacaattaaatagacataatgagcttttaagtagattacaaatagagttatcagaatcacaagaaacagttaatgagctgaaagtttcggaagaatttactaataatcttttaaaatatatattaatgcttctaacacaaattattgaaaagaagctatttaaatttgaaataagccttaaacaattaaaagattcaaataggttcactgaacttgaattgattcaaagagagttatcatttcttcaagaaataaaggattttataaaaaatttatttttcgtttattattgtaaaagtccattggtaatgaacagttcattatgcagtttccttacttcggtatattccgatactgaagccaaatttttgtccaagatagagaatctttatgaagtatatgataaatatgaaaatgaatgggaagacgttaatgatgaatctgttaaattaatgaataaaaaaaagaaaaaaaagtctaatttaaaaaagaagaaatttaaaagtaaggcaaaacgtattaattttaaaaaaaccaaattaaaatcaaggaaaaaagtcaaatatcagagaaagttcaatataaattaa

SEQ ID NO: 1000 - DNA, 990 bp, Cryptosporidium hominis
atgggtttttcatttatatatgatatgagattttttttaattaaattttttccgatattattattttctacaagaattaacaatggattgtttataagaaattacgaagagacattaattgatttttcattaagccaactatcggcaggattagaatcaagcgatggatcattaagaagcatgagttcttttctcagtttagaaagttttggatcttgcttttcagaattccaatcacaaagttccttctatactgcccctgactatgatagtaataattctatcgatcgagccccatgtgtatttgaatgtttatattctaaaagagaagtacttacattacttcgtagacgtaattataaggaattaaaaagtattcgaacaattgttcttgaagaagttatggaagaaataattcaaaaaataaagagcatgattttgaattacgaagaacaagtgagtagaaaagaaagtttattagcaatatataatctgtgtaaacggctaaataaaaaagcgattaaaaaaactgaaaaagaaattaagttattaaaatttgaactaaaatgttacctaactcactttgatctttatttgtacattctgtttaaacatttatttaaaagaaaaataaaagaatttaaatcaacaacaaaagatcttcaatcaagccgacatactaatcgagttaattctttacagcgagaaatcgcattcaataatgagctgttatctttattgggagctgcgttcttatattatttgtgcaataatgaaatacttgaaaatcttcatttatgtacattcatgtcgaaacagcatttaaagattactaaatataacgagaaaataattagcctacataagaaagctattgatagtattggtgtttctactgtaccagattcgggatcggtatcgggatcggaatctgaatcaaaacttgaaacaataccagaagaatcttctgattcgtatgaaccattttaa

SEQ ID NO: 1001 - DNA, 1482 bp, Cryptosporidium hominis
atgaaacgaagcaaatttaatcttttatatataatattgaaattctttgtattatttattttttttgtttatttgaaaactagacatgatctagttaagtacgatcacactctggctcaaaacaactttaaacgaagtcactcatctaaattaaagcaattctatcaaattctaagtatatcttttattaataatgggccaaataacgtaaatggtgaaggtgctaaagatatctcagataataaatctggtacttgttcaacatctggaaatccaagtcctaaaaatgaatttgactcagaaagtggaaaacaaagtaaagctcattctatgaaaatgtgtagatcaagctcgtgtccaagtttagggcatatatctagctcgagatctaattcaagttctagtcatgattcaaactccgaaatgaaatcaaggtcgaaatcggaatcatgcttaaagtccaaaacaagttcgagctccaaaacaaggtcaaggtctaaaacaaggtcgaggtccaaagcaaggtcaagatcggaatcaagatcaagatcggggtcaagatcgagatcaataagagtaatgaagaagcggtctaaatcggattcttcaatcaatcctaaaccatctatttcaaaaccagccccacttaatcttgaagatcgaattggttctagtggacctttatcatctaaagaagaacttggtgcttactgtatcgaattatcttttgaagaaatttttaaaattttgcagtcaaaagatacttcccagctaaatgatgtatcatctttttcattaagcacggctttagatgaattaatttttatgaattcttctctagctaataaattaattgatttggaaaaaactatagaacatgaaaaatctaaattaaatcctgaagacaaaaactatgaaagaaggctaagtactctcaaagattttactctaactgaatcctctggaattgtcaaacaaagtgaacaattattcaaacttgtgcaattactttttcatattttgtattcaagaaagattcaagcgtttgaaagtactacagatgctattctaaatcaaaattcagatcctaaagttataacaaataggagaattgttttcagttcagaattaatttctaacttaaacgtattatataatatgttacattgtaatcaaaagtctctttccagcctgcttttttgtcgttttcttcaagattttatagaaaataataaaagggtaaatgctgcattaacaaaatatatgatgtcattagaagaatctaatggaggagtggaaggttttagtaaagttaataaaggaagaaaatcaagaacgcggatgaaaaaaaagagaaatcgaacaaaaatttctctaaaagatccagaacgtgaaaatcaagaaaaaaaaataagaaaattgaattctaaatttagaaaattgttcacaagctctaatattggacttgaaagtatagaataa

SEQ ID NO: 1002 - DNA, 372 bp, Cryptosporidium hominis
atgtcaagcttattgaatagaatgattaaggaatatagagccgcttcatattctctttttaagttaaatcgtgacaatattcaagcaattcaaagagatttgtcattttatcaaggtttagtttcatatttaacagatatgagtggtattttatcttataattacaattatatgaaagaaacagctttctgcgcttttattacaatatcaattgctgaatataattctagatattcaagtttgattgaaactttaccaggaactaaagaatatcaaatgtttgaagatattgatcatgaagaagacataaaagaaaagaaaagtgataaaagtgttggaaaaaaaggtaaacatggtacaaaaaaaaagtag

SEQ ID NO: 1003 - DNA, 1500 bp, Cryptosporidium hominis
atggatgaagatttgaaatcaacaactccttctttaataagaactttatcaaagaatttaaataaccagttattgggtagaacaaattcagaaacatcaataaactcaaatagtaataatggaaatgaattagaatcatcatcaaatatttctcgtaattcaagctttaatttaaagaatttatctccagaatgcatagaaaagcatcatgagatcattaaatttagctatagacacaagaaatctttaaatatcttattacaatctttccctcaattaattttaccaccaaatggaagtttagtaccgttattacgtttagctccaatggtagtaaactttgaaaataagagatgttactttaggtatcgtcttaaacaattaagaaaagaaagtggaagttatagaagtggggataaccatcagttaagattagtagttcgaagaaatcgggtatttatggacagtttccaacaaataagtacaaagagtcctgatcaattgaaacaaaagttacatataactttccataatgaagagggattagatgcaggtggtgtaactagagaatggtataatattctagctagagaaatgttcaatcctgattatgctttatttagaagagaaggatcaaagagtgaatttaaccatccaaatccattaagttatataaatgctgatcatcttcatttctttaaatttattggacgtataatagggaaatgtatttatgatggtcaacatttggatgcatggtttactcgatcattttataagaatatgttaggacaaccaataacaccatcagatgcagaatcaatagatcctgaactttataagaatttgaatgtaatgctggagcatccaatagaagatttgggattagaattaaacttcacaacaacaatagatgaatttggtagaagtaaacaagtggaattaaaaccaaatggtgcaaatattccagtaaatgatgaaaataagtatgagtatgtatgcttactatgtgaatataagacagtaaaattgattgagaaacagcttagtttcttcttatcaggattccatgagttaattcctgctcgtttaattgcaatctttgatgataaagaattggaacttttaatatcaggatcccctacaatagacttggatgacttaatggagaatactgattatcataattatgataggaaatctcaacaaattatttggttctgggaatgtttaaaggaatttgatcagaatcggctcgcaacgtttgtacaatttgttacaggtacttcaagggtgccgataggtggatttaagaatttgatgggtatgagaggcccacaaagatttagtatccataaatcttttggtgagaatcgattaccatcagcacatacttgctttaatcagttagatcttccggactattcaagcaaagagcagttgaaagctaaattattacaggcaattacagaaggtaaggaaggttttgcattagtttaa

SEQ ID NO: 1004 - DNA, 11760 bp, Cryptosporidium hominis
atgcatgagtttcccgcttttgcatgcaatgaatacaaaaaacatgagatgggtcagatttgttgctatattgcagaaataattgatgtattctacagggtgtgtatagatgacaagcaaaacaatacattttatatttttttaatagatttgtcatacaagactggtatttttgagaaaattatgagccttttccatttctctatgtcaacatattggatggttttgggcaaaattattggtaaacacaatacagaaaatgttaataagatgttacctcctttgaatccaagctcaaggttgaaatatagctctgaattcttaggacaactaagtgagtatattcttccaaagctttcttctgtccataacttgaacggccttctctatttggctacaaagagtatgcataataatattcttttattggagcacttttcatcttggaaaagatatttaaattcaactttaactactcatcttcataaatctaaattccatttgaataattgtaggcctataatctcaaatactaactctgcagaacttaatatctttgattcaagcttggattccttctttagaatggagtttaattctgtggaactaactgagtctatattattaatgattatcacaaatatccaattgtggtggaaagaagttctaactaactattatttggatatggcacacaataattggcttatattctacccaataagatgtttatcatctactttcaaaatcatgttacatatttttgatattcaatccgattcatttaatagttttgttgcgaagaacttcgatcaatcaaatgataaaactgtcaagcaaaatagtatcagtgatgcagatgctcgttcttcaagctcaacaagtaatgataatttgcagctttcttctaatctgaatatagatagttcggtacagaatcatgatgcttctctgacttcccaggatgaaaatactgtaaattcaatattagaaagattaaatatgatgggatttgattctagagtatctgagcatgcaatattctgctttggaaataatattgaagtaattgtcgagtatttgacaggagttacagaaaggaacgagaataagacaatgatttcagaagaagctggaaattatatgtattcatttaggagaataggaaaagttctttctgaacaatttgagttaggcaaacttataacgtataagactttatccaaagaagataaaaaaagtgagattctaaggatttactcaactctaccttcagagttatattatttaagcaaaaatgtctactattcatcacctattgtttgtgatattatgcttaagttctcacctttacttaagaaaatcaatatgttggaaaaggtcctatttcacatatatacatctatgaagatgcttttggagagaaatcagtcagttttttctgcagagtcttcaaaccatcgttaccaattcattaaagaagaactttctttcttacaagatgaaagacttaataatgacaagtttcctataatattcaactctttttatacatcacttaataattcaacgcctttgattgacagtaattcaaactttaacaaattgaactaccaagaaatatattcaaacttggatacatactcgaagaaatgtgctccaactaagaaaattcatctaagcttaattccagatttgtctttattatctattctcctttataagaagacagatctcaaatcattttggatatcaatagattccaattatattaagttaacatcgactcagaataagaattcgagcaaatcaaagaataaaagcaatattagtaattcaaatactgaacaggtacctgaacaatcttttcatccaattaattcattattaagttttgttaatatttttactcaaggccattatatatttgattccaaacatgatggatttacatttaagaatatggaaaagtatatacgtgataatcttggagaaggtaacggacaatcaactggacaaaataaccaaaatggcaataatattaactctaacagcaattctaataatatgaagagtagccaaagaccatccagtttggtttggattccagcaaataaagaaactgaatccaaggaatataatgataaaggaattaagttagcaagtaggtgcccaatttggtttgaatacttttgcctgatattatggagactgctccctatatttgagcaatctatacctgtatcggaaagcagtaatactccatttttggtatcacaaaagaatcagaaggatattatatttactatgttagatatattaactcattttccaggaattaatggaagtacaagtatggctgttttgggagtaataactatattaacacgaaaattcaataattcccttttactacttagttatactccattctatatgatagagatgcataagaataaggacaaaactcagaatattgcttgtatgtgtatgggaaatacacttggtggaggattaggagttttatatagacttccaaaaactgcatattttgatggaattcttcaggttctttctctaattactattcaagttttggaagactttactattttgactcagcttattgagaacaagttggacgaattgttttcaaagcaattatctacgcaaatacaatcaggagagatttatggggaaaacttacaggtagtaaataatactgaaaataatacggaaaatcaagagaatgaaaatcctaatagttgtaaatacttctcattttacccaagaagctttactctgaattataagaaggatctgaaactacttgagaagaaggaaattgagtatccatttattgtattaagtttaaacagtgtaattggagagcttttcccttatattcaaagatgccctgaaatattttatcaagttttgaattacttttgtgttcttcattctattaagacaggaaatgaatcaagttctaattccaagactaattctgaggatcattgttcggattcgaattacaaagccaaatctgaacctgctgaaaatgatgatgttttaatgaatgatgaaaacaaaatcaaagacgatagtgcttttacaagaattaaatacacaactttcaatgacttgatggaaaaccaggagatttattctaaatacaatataccagtgaatgagaacttgttacttcagtggaaacctttaaattatagaaactctgaagctacacaagaagagcaaaataaatatttggagcttaaggaaaagctcaaatatgtccaaggtgattctgctttaagaccaagttcaacttgcatgttcattttgatgagtatttttgatcatatggtactatttggagaaatcttaaacaaaagtaaatttggaaaaaaacgtgggataaattcatgtttaagaggtagaaaggatgatgaaatttttagcttaagtttggactcacttacatatataatgataagaattgctctaacatatccagtaaatattaataggatttcaaaggtaccaatattgtctatttgtaatgagaataatgcaagattgtggcaggaaaagaaacgggaattctacagctatagatacagaaatagctctaatttaaagttgggagtatcatgtttttgcttaaatttacaaaagtctttatcaactattgattctgaaaataagaaagaactcaaggctgcattagaacaagagttctctggaatctctaccgtaattccaaacattcatagcttaacaaacaatataatcaagtttaagccatattcctttgaattcttgttaaatcaactttttgtgactcaatctctaaaaatcaacttccttccatttattttcagaaatattgcctcgtacattgtaatgaattctattaattgcatgacttctatgcccacatgcacatgcaaaaaatgcaagcaggcgggtagtcccagctccggtactgaagaaaatagtcctttgaagatggcgggctggcagttaaatttagattggcaaacatacaatttgaaatgcatgccaaacttgtcaacgataaagaagtcgaatataaaagatgtgcatttcatggaaatggatcacttcatttactttttgcatatcttgattggttggaataagttcgtattgaagaaatttatggtttatacagtgaattctttaaggaatctgctagcaagtttggacaaattcaagggtaattcaaataggcataattggagaagtgaatacgtgaattcttattttttactgaatattcttcaatacttaatagttcttctccaagtttacccaagtatttcagatcctggacttttaagaaaagcaagtatttataacatactaagtaagctttatgtaaagctaccatattctgatttatcaaatataatattgttttgtatgaaaaatctgatctattctagatctgtaatgatgccaaatagtgaatgtcttgctgcaattaaggaaggcagcttggatagtaaagttaagaaagttagaaattctattggagttggtaatggaaatgatcagttagaagatgatcaattggaggtagatttagatcagtttggcttccaatttaattcatctgatgaggatttcgacgatgatttggatgatagtctagaggacgattttagtgaagagttcgatttgacaagcttggatggtttggatggcgaagatatcgatgataatgacgaagatgatgatgataatgatgtggaagatatggatgatgatgttgaggatgacgttgaagatgatgatgaaaatgatgatttgttcttagatgaaacaatgattaatgatggggtaattgatattgaaggagaggatgatgatttgagcaatgatgatattgttggcgatgatgatttgactagtgatgttgatgatgttgatgatgatgacgatgatgatgacgatgatgatgatgatgacgatgatgatgatgatgacgatgatgatgatgacgatgagggggatgatgaagatgggatgaattttgatgaatctgatatggactcgggtatgtcgtcagaagattctgatgttgatgaattaaggagaactcctaggattagagatgaatacgaatttaattacatttaccagatgaataatcagactaatattaatggactggaggatgtaccaatgaatacaagcagtgaagaagtggaagaagatggcggagaaaatattaatgaaatattgatgagggatgcagaacgtaatggccagaataggattattttgaataacttaagaagctcagcttttagaagaaatacaagtactggtggaggaagcagtagtagtagaagaagaagtggaagaggatacaatagatcaattagggatgacttggacaatgatttgaattttgatgatgatgaagataatgatttggatattgatgatttagatgacgaaatttttggcgaagagtataacagtgaagaagataatgaggatattaacattctccaaggaatcaataatattgtaacgaatacaaatattactccaaccttgctaatttctgacggtgtaaataatacagtagttcagggtaccgaaaatagtaatgttactggcagcgccaacactaatagtaatagtgacaataatattaataataataatagctcatctattgagcaaagcagcgaattggaacaagcattaccggagcaaagaaacgagagagaagctactgaagaaagcgaggcaagaatagaaaactctaataatggagctggttattcaaccctaagaacacctccacatcctttaagaagagaagaactaatatcaaatacaacaattcgaaattcgaatcaactgaatgaagttaatgaaaatattctaggaaacgaagtcagtcctgcaccattaagaagaagaattgcttctcaaggaaacaattatttggatgatatgatgatggtactattaagagaggatgatgatgattttgagattgacaatttgcagttcttggaagatttgagttctttaggtggagttgctggatctgctggcctatctttaggtggagaaggaggaagagatgatttacaggttcagttcttaggaacccagggagtaggtacaggattattaaataatctcatcccaaatacaaacaatacagtttacaatgaaagcctaaattcaagcttctatttggattcaactgaagctcattggccgcctatgcctttaaatcagagaaatatcttcatcaactccagaaatattcccctttcatttttgattctaaactctttaacctttgttccaaacacttccaatttaaatcctccatccaataatgatttaatattacaatggatgagctatggcggatatttgactaatccagttctatctcactacaatattggaaatgttagaaactctgattcttcaggaaactcttctggtggctctaataactttaattctttctctattaacaacagcactaataacaactctcaacctgcatttggttggcacttccataatgatatttcccttccaactgaacatccattcttgacaagaaatattattattgacaataatatggggataaatagtagtggaaattcaaataatcatggaagtggtagtggcaataataatagcaatagtcacactaacaacctttcttggtatagcaatgggccattgtatgattcccagagatctctcattggagaaatacactccagttctttgagaaataactctgaactttctattctaatggatgcaatcagaaatgctgacaatttaacaaataatgatgatgtcattacatccatgcaaaataattcaaataatggaaacggtataacaaatacatgcactgaaggtggcgccaccagtacgaatgctaatttgggtggtagttcatctttaagaggaagcaatcttaatgtgtctacattgataagaaatattggcgatattaatagaaacaacaatcttgacaggcttttgactgatgaaaacaatagcacagttagtttaattccactggtattggtttctcaggctacaagctttctaagagatgcagtatcaagtaagattccgattgaaactaataatattaacttatttacaacaaatattgaacaagatgaagagagtgataaccatacattcgatttacaggaaagaggtgatgtaatttgtgacaatcagttggatgataatactgaaaacatggattcgatacaaggcggagaagaaagtgcacagcatcaagatcaagagcagagtgatgacgataacgaagatgatgaagaagatgatgatgatgacgataatgatgatgacggcgttgatgatgaagatgatgaagaagttgatgaagaaagcgatgagaacatggaggatgaaggattattggatagccaagtaacttccggtagcttaaaccagattaatcaaaacgtaattgaagacttgcaaggaactcaggtttctttcaatcaagaaattcaagaggtccaaaatgaaagtgcagatcatatcactaacttcgaagtggatgataatcaaacaaatcaagcaaatacttcaattaaccagaatattgaaggtttagagaatatgaactatcaggatgttccagtttgtgcactattacgtgttttggaagaaaggataggactaagcagaaaccgtattctggagattgttggagttgatactggagtattttatgagttgcccgaggatatacaatcagacgttcttgtattacaactaacagatggtgataccactagaaggcttttagataatatgactctctctgattctgggtcaagaacaagagaaagtgatttttcaagttcactaaccattccttcttcaataatggacatgcttccttcatcattgagagatattatcagactaagaggttcagcaaatggtggaaattctattgaagattctggtcaaactctaaatggtgattctacaatagctggagtccaaggcggggcagacgggaatgcatcagcaaataatgcaaatgaaagtaatcagggagaagacttggaaaatattcaatttatttcctcattagacccagttttacgtcaagaagtacttttaactgccactgaagaatttttaagaacccttccagcagaaattgcagacgaagctagagcattacagcagagaatgttcccttcatatagcagtgcagctacaagagaaagaggaaaccactcaaatactggtaattcatctcatttaggaggtgcaggtaatacaagtggatcaaccggaggaaataattctagaagaaataatagaatcccatcattaactttagatggagatgatcaatatatttccactagtgaaggtgccaataatagttctggaggaggctccagtaacaatcaaaatagcagttctgctcaattattgagtttgagtaataacctttatgacttattaccgctcatttcaaatagtagaaatggaggaataaccactatcagatttaatgtcaactcttcaggaaatggtttaggtattagaagcttactttcagcagcatcagctttatctgaaacaagaagaggcgctaattcaactccaagtggtaatagtagtggtaatccaagtggagatcatgatattattggagccgatgaaaacacaacagatctcttgggttccagaatagaatcatccgctactggaatgaataattccactggaggaggatctaatgccaatgttattaatctctctaacacatctggtattgcttctggaggaggctctgtaaataatactaataacagaagaggagcatatcaaatacgttctatcattggaaatcagcatggtaatattagttttgatggaggactcaatattagtgcttcaatcccatttttatcctctttaggaggtaatgttggggcaagatcttccggagctgtaggaagtacaggaagttcatacgatatcttgtatgaacttttgaatgagatttctcaaacttcaactcccacctctaattggaacataacaaatgaagcagatggtcctgcattagagaattccatgtatccattaatgaatttaacgtctacatcctcatcaagttctgcatttaatagaagacataataaccaaacatctttgattcaacatcttcaaggaaacaccatttcaggttctgcaggaaggtctgcatcatcctcttcattttctattcaaaatattctcccaatgttaagaacagaatataaccaaatgcttaataatggagttggtggttcatcttctggactacagaatatttcatctattattacctttggaacaggaggaagctctagtgtattaaatacagtatcaggttcttcctctaatattaatattagttcttccacaaactctgtaagaaattcaacatacaacaactccagttatgtcagaattatcccaatgttaagtaacagaaatattcattctttaccaggaagaacatcttctaactcacttaatacaactcttcaaattacaggaagatctgtatctacacgaagagctggaaatataatatcaagtacttccaatagtaacagaagaagaagaagaggaagaagtggtactggtggtaatgacggtgaaggagacggaggcagtggaaatgaggagaactttacagataaccatgttataaattctgagaataatgatattaatcaaagagaaaatgatcctaatcaggagctttcctcatcatcagcagatccagatctagaaaataatgatactccaactctagaaggaagcttgggaaatattatatcatttagagatccactctatggattccccgataaacaattcatccttttgtacctacaggaagtattgatcaatattaagaataataatataatggaccagaatcttcttcaattgagtattattcctgaagtactatattcaagtactttcacaaggcaaaatatctccaaaccactcttatattcctatctatttaatatgttgggttcttttggtccaaatcaatggatggctttagataccttatttgctattatttcaattggaagaactcacctggaagttacaccaatgagactattaactaggtatcttggaaataacagtaatagtataaatggatcaaatcaacaaatacaaacatttaaatctgtcaataattactcaattaattacaaagaatcaagtattaatggatacttttctaatttaataccttatgagttattattcacatctttaatgagtcactgtgatgtaaatccaatcaatatgatgtactattctttattacaaatattggaagttattggagactttattactcattttcctgttattgttatgtatctattagatgaatgggatccaattctaagacttgataagtttattaagaagaataatcttggaattaatagtactgattataatgttaatcatagaagatctatttcttctggaattatggaaaatactgtttttatggatataaaagacgaaggaactcaaaaggatggaattaaaaaggaagatgatatttgtgatgacgccttagtatttgatgataataacaaaattaagcctaagaatgtttctttattatctcctgtccaatccaataagagtaaatctgaagaaaaaaggaggattggttcttccattcctttaagttcaagtgttgagctaagtagaaaaaggaagagaagatttactaaggaagggtttgagcttaacagtaatgatagtagtaataataataatattgaaggaggattaacaactttaatggatatttcaactccaaattgtactattaagatccaagacactgttgaattaactccttataatcctagatctagtattaattccaatgtatttccagaaaatgaagactctgcatttgaagaaaacttggttttagatgcaaatgaaaacttgagtgaagaagatgaaaatatgactattctttatggaaattctgcaaattgtatccttgacacttgcaatgatgtcacttctggtagaggcggctcaaacactggttctattgtaagaagagaaggaggaatttctggaaatgatgactttgctcaaactcaaagtcaaaatcatatgcaaacacaaacattatctcaatctaaaatatttgatcagaatatgaatcatattcatagtaagattcagcatcataatcatagtcaaaataaacatcaacctattggttgtaatcattcaatgaatggaacagttttaaatagaataggaaacaaacgaagtgctattttacaattaaataggcttaaaagaaaattattcaatacaaagttcccaactgaaatgattggtcattcaaattttactccattgttattattatttgagattttgaatagtccaattgttcagaattctccacaacatattcaaaagcttttggttataaaaaaaaaaattttcagccttaactttgatgagatcccaaaagttcaaatggaactatttgcaatatcaaatgatttaattcactcagaatcattaaaaccaaacattaaagaggatctaaaagtattaaatgaatataatgaaaaggatcaagcttaa

SEQ ID NO: 1005 - DNA, 357 bp, Cryptosporidium hominis
atggtatcaactagcaatgaacatgaacttattaccaaggagtttttagaaactcaaaagaaatttgagcaaatcaatgaaagaagacgtattttggttgcacaagaaagtgaaaatcaaatggttagtaaagagcttgaattgttggagagtgatgcagttatttataagctagtcggaagtgtgatggtaaaacagtctttagatgatgcaaaaagcacagtttctaaaagattggagtatattactggtgaaattgaaagtgtcaataagagttttgaaagtttgcaatcaaaacttgttgaaaaatctaatcaggtgagttataattatcacttatttattacttttttttaa

SEQ ID NO: 1006 - DNA, 1395 bp, Cryptosporidium hominis
atgaaagaagtggcagaactccatttgtccgcattgatcattattactcttcttctatcttttggttctgcactcttttctggtctaactttaggaatgatgactcaagatcttttacatttgaaaataacttcatcctcaaagaataacaaaaatgctgctttttatgcaaaaaggctcttacctctgagaactaatggaaattttctcctagttaccctattatttggtaacgttaccgttaatactggtttatctatcttaatttctgaattaacttctggttggctagccttcactgtctctactattcttattatgatctttggtgaaatcattcctcaagctatctgttctaggtatggtctttatattggagggtttttctctccatttataagacttattcaaattattttatttccactactaaaacctatctcagtcattcttgataaggctgttggtaagaccaacgaaaagatatacactagagaagaattaaatactttacttgaacatcattctaaaaaagatattatttcagtttatgaacttggacttataaaaagagtcatcttttccaactttactttatctgatattatgatacaaattgatgaatttcatatctattatattgattctcaacttgaaactaatcaaattgaagattttattaaaaaaggtatttcgaagctttacattattgataataattctacatattctgaattattcaatgatgactcccaacaatgtttaacttatacaaagaaaaatgatattatatacttggatattcctaatactaatgaccatcaatctaactatattgaatattcaaattctccaataacatcagaaacttacgattccgattgctctatttgtaatgattgccctcattcaaaaagtggtattatattaggatatatagatttagatcagctttcaaaacaaaacaaaatttttcaaaataaaaacaattcaaatcgaatctcaactattgtcaataccaaaagcttcataagactgacaaacattgttatatcgaataaaatgatggatttgatcaaaaataaagatactctgtcaatacttactagtatctctaatattaaagataaaattctttgtatccaaggttcaacatcaatctcaaccttatttaatgtgctctgtcagtacaacttatcgcaaaatgatatcattattatatactcaacaataggaaatggatataaaatgagatacgacggagtaatcactctgacaacattgtatgagtacatgttctccagcgaaaaatatgttgtaaatgaactaaaagaagatatatgtagtaatctactattaaaacatcaacatccaaatatatctagttatttctaa

SEQ ID NO: 1007 - DNA, 873 bp, Cryptosporidium hominis
atgcggacggtatatacagtaaatactcgtaacaagttcgcagctttaagcttaagcgacgatgaagatgatcaacaaataataactaagcaagagcctgtaaaaagcactgctggaaataaggagaatccatcatctttaatttatccaaagaatgaagttacccctaatgctccagcttcagctttggatacaacttctaaaatgtctagaggtgctagaaagggaaatactgtacatagaggtggcagaggaggatatactagctctcatggaagagtttttgatagaagagacgcttctggaaaagcccatagagtttcaaagcaaaatgattctgctggtattgaagatgaagtaattgataaggagaagaagtacaataataacaattcttctgatgttgcttctaacaatcaattagatgaaaatgttggtgactctgaggaatcacaaaataaagtagatgaaaccaaagagaaggagagccaaatgattagttacgaagaatatatgaagaagatggctccaaaaagacttgaagtacctaaaactgagattgttaaaggcaataccactgctaaggatttcgaaaaggagggccttcaaagatatgttcgtgatgatggttcaaataccattacaaataagaataacaagaacaaggctaacaaaaataacactaagagtgacaaaggtgtatttaactactttgagttggttgaaaagtacacaactagaaactcttacaataggagaggaaatgatgatagaagaaacagaggtaaccaaaggccaaataacagcttacaagccagaagagaagctcctgatgtgtctgacactagagcattcccggtattgggtcaataa

SEQ ID NO: 1008 - DNA, 1110 bp, Cryptosporidium hominis
atggaatcatctagtggaggaggttcttctgttggagaagttgtcactccagaggttcagtcgaagattacgagcaaattgcaggaaatatttggagatgacgatgtttcagtattaacagattacatttgccacatggtaaaccataatcaaccaaaagaacacatcatcaatgagctcaaggaatttctttctgatgaggcttctcaatttgggacatgggtctttcagcttgtggaaagcagtaaaaacgattactccaccaataataatataccaaacattaatcatgataatggcttaggcaagaacaattcttctcctaatgatactcataagagttccacccagtccaatcaaaacaaggattctttggactttgcaatctctaatgctatcaagaataaatcaggatctggaagatcaaaactatttcaacccgcttcctcacataagaataatcattccctaattaatcatgaatcttcttctggtccaatggtaggaaataatagactacctagagttaattatagaaatgctccttacacaaggtccaataactttaatcagtctggagctccctataactcttccaatcaagctgctaattcatccactggtccatcttctactcatggaaaaattaaaattagatgtaaaaactggcctaattgcgataaaggtgatcactgcttttatattcaccctagtgaggcttgtaaatcttggcctctctgtccatatggccctggatgcttttttattcaccccactgtaccctgtaggtacggtttggcctgttacaattctctttgcaactatagtcatccaaatggctgggatcctaatcatgttgaagcccctgtatttaaatatggtggttataagaactcctccctcattattaacaataataaacagtctcaaactattggtaatgctaattctaatagtgctgaatctaataatgataatgccactaaccccatctccatgaacttaaatcaggaaaataccgacatgcctagctatgattctaactgcaatgggaaaactggacattttaacctggaatcggagaaaaataattcttttggtcataattaa

SEQ ID NO: 1009 - DNA, 1371 bp, Cryptosporidium hominis
atgaaggaagactcaaatcatggattattattggatgtaccattcacaagtcccatttgcacgataaattcaattgataacaggatcttagtaggaacatgggatggctacttttatcagatttgtttaaacaaaaaagatgatgtagttacagtacaaatagaaccttcttacccaataaggtatataagtgcattgaaagattcaaactgtgaagtagacccccatactggggctcagaagagctatgagcttattttgggaggtacatatagaacaaaagtaagaatgaaaaatcggatcaattcacctataactccattggaagagcttgagatatcatcagactctcattaccaaataattgaaacaagatcaagccttgaaccttttgactctcatactaaaggaattgaatttggaaacaagtaccataaggcccccttgtttttgttttcatcaactattaattcgtattttggttttaatagtgaaaaaggagaaattgaaatattaattgggaattttaatcttccagacagagaatttgttattttagattatgattttctgaataatcatttgcttattgttgagagatcaccagaaagattggactactatgcattatgttcacttcaaatacttgaactaccaaattcccagaattacttgcaagaggaagttgattcaagtaatatcactaatttagcagaaatacctccaaaatatatactaaactttcctataaagaatcctctttttattacatctaatatcaagtcagatttaactcttagttcatcagctgaatataataactttaaagattctgctcacgtatataaatatctctactccacaatgttttcaatttctgatttcaaaaaacgacctttaaatatattcaagtcaatgtataatctttgtgacgcaaaattctggggatttaactcctttatatttcttgtttcaaaccacacaattattgcaattgatgtctttttctcaaaagataatgaatttgtaactaatacaaacactaaatgcaaattctgcattaagtcaccagatcgaaatattacatctatctcgactaccaattacaattacttggttgcattaacagaaaaaaacagaatatttctatcaaatagaaatggtgaaattgtgtattctataagtaatataacccctaataaatccaattttagatgggtttggccagcgcatgtatttgttacgcacaccggtactataatcttttcaactaccaaggggttatattatattcactgtgatttattggacaaaagaaaaactcaatttacgaagaatcagagctttatcatagatttacctaataattaa

SEQ ID NO: 1010 - DNA, 291 bp, Cryptosporidium hominis
atgactttatttactcgttttgttgagccaggtcgtctttgcagaatccaatatggaccagacacaggaaagatgtgctttattattgatgtcattaatatgaatcgtatcttgattgacggtccatcaactaatgtagctcgtcagagtattcctttgaagagacttgctctcactgattttaaggcaaagatccctcgtggtgctagaactggaactgttaagaagattttggaaaaggataacactattgagagctttaataagaccacttatggtcagaaatggtaa

SEQ ID NO: 1011 - DNA, 801 bp, Cryptosporidium hominis
atgggtaatttaatagaaagagagaatagaggagtgcaatatccagtcagagagcaaataacaagaagattgagtaatacagaatatatttttagtgaggctctgaataggaatgatcccagaatttcactaaataacgaaaagcaagaaaaaaagctgattagtgttagcaagtcaaaagcaatacaaaatcagtgtcatataaatggcttatcaatccgatatataccttctttaaagaggatgagattcgaatatgactgtattcaagattcaattttgaacatatacaattcaaattcattagaggaaaacttaattaacacagaaaaaccaatattctcccacattgtaccaaagtctttgaataaagagtttcaatgcgacttgaaatcagacttaaagcaaaattttgtattggagattaagccaaaaagttcttccactaataatactgagactatccagctaacattttgtgagcagatcccaaagaaagaaaataatacattggaaagccagataaaaattaaaaggcagtgtgtactttacaatggcaaagcatttgaaatccaaaatatatttggactatcaaacaaatccagtaaggcttcaaagaatgacgaagattcagaaaaatgtgtaatttgtttaacaaataatcgggaaacaatattgcttccctgtaggcatgcttgtctatgtaaaatatgtagtaatacgttatttaaaaatactcgagattgtccaatttgcagaaactcagtcttgggagtagtaaatattgaagatagtaagtaa

SEQ ID NO: 1012 - DNA, 591 bp, Cryptosporidium hominis
atgaagaatattatgaggtctcgcccctcgtcaagttcatctctgggagtgaatgggataggcggattgggtggaggaagtggaagtaacttgggtggaaatggcattggaaatagctatatgggttcagtctcaaaaaggacagaactaacagaacaacaaaaaatggaaattaaggaagcttttgagctttttgatggggactcgataggttatattgatattaaggaagtaaaagtggcaatgagagccttgggatttgatccaaagaaagaggaattaaagaaaattttgtccaatgttgaactaaataatggaatggttagctataatgatttttacgacttagttgagactaaaatacttcaaagagacccaaaagaagaaattattaaagcatttaagttgtttgatgatgatgaaactgggaaaatcacctttaagaacctaaaaagggttgcaaaagaattaggagaaaatatttctgacgaggaaattcaagaaatgattgatgaagctgatagagatggagatggagaaattaatcaagaagaatttattcgtattatgaggaagactaatctattttaa

SEQ ID NO: 1013 - DNA, 2139 bp, Cryptosporidium hominis
atggaattaaattcagataaaaattttagtatcacaggtatcagaaagaagacaagaaaagcagtaaggccggaaataggagagagtaatataggtataggatgtacatcaatttccagaccctcattgatggggatggaaaaacaaaggcaagaggagtcaaatttgagttcattatttttaaaaagaacatcagttttgaaaacagaaaaaaagagtgaaccaagagatgagaacaaagttgaggcattaaggcaaaacttaggctcaatgggattggaaaatagaaatagggagataaatgatggaaagagctcaatattaaagaagagttttaaggaggatatgatagagaagacagtagtagtggctacggaagatactgatgcacaaattgagctaaattcgactacgaattgcccatttttagttgggtcaggatcagaagcttcatatgaaagaagtagtgaagtaaagacagtattaagaaagagtagatatgattatgaacagatatatgatgaggattcagtctctttaaaggatttggtttcaaatttgaatggtgaaagcatgggagtatttggtacaagccatgatattgaggagctttccaaatggttttcaaagatggtaggtaaatttgagacttttggtttaaatattcaaagcaaattagaaaggttggaacaagatttggaagaaaataccaaagatcttaagggctatagcggtgattcggagcaagttgggattaacaacacaacaaatagagaggaggacgagaataatttacggaatgagccaatgagtatttcagagagatattcagagctaatcaggctgaagaataagttattggaagaactttctaatgttgagaatgaaataatgcttgaagaaatgaggattaaaaaagaagaaagcgaaagaaggattagaattgaagaatataaaagtacaagacaagtttataaagacgagctttcaagcttgacagtaataatttgttggattgaagaatgtttacaaaattttgtatatcctatacaaaggaaacagagcgaatataagatggaaatttctagagaaggtgatttactaaaactgatccaagaggaaatttccaagattgaaaaacaggaaaaggtagttttagagaaactgcgagaaatacaggaaataaagaggtacaaaggtgaggagaaggagttattagaagaacagatccggctttcccaagcctcaaaatctgacaagattaaaaacgcaaactttaaagaagcctctatgatttcacaaacaattcaagttcttcaacaagaagttttggagcttgaagatagttactcgagcgtattacaccaggaaaaagagtttatggaaaagattgagaggattagaaagagccgtcaggatgagatcaatagaatggacgcttgtaaacacgaaatacttttaaacagaaagcaaagaagacaacagttgaagctaaaagtagaacaactcaaagaatgtaaattctccttcgatagtgaaatattctcagagaacacgtcatttgttctaaactcactatctgagaagttttactctcaaattaactcagttttgagcttcgagattgacttaataaataaacacgatttggaggatggaaaagaacgtgacaatgtacagatccaacctcagcaaaaacaagctgagtcaaccgaacattcttcccagttggaaaacaaacaacccgatgctatcaccggttctgaatctgaattaaagtctgagcatgttttagaagaaaaaagccctccatctttaaattatgaggatgttactgtagagtataagcactcagaaatccaatctgaaaaagaaatttcatcatttctagacaataactacaatacaaatgataataatagtagttttgatgatagaagtggatttgatgataaagattgcgaatctcaagccttaagctgtgagttggtttgtccaaataacgcacatattgctggaaaagctgactcagacatatgtcatgaaactgaaatagtaagtagtagtagttctaaaaaagagtctgggggtgaaaacaccaatttggatgaccccactcaaaattctttaagtttttag

SEQ ID NO: 1014 - DNA, 765 bp, Cryptosporidium hominis
atgagtgattcagtaaatgcaagagagtctaatgtttatatggccaaattggctgaacaggctgaacgttatgatgaaatggccaaatacatgaaggatgttgttgaggcaagacaagaatctgaagaacttactgtagaagaaagaaacttacttagcgttgcttataagaatgctgttggatccagaagatcttcatggagaataatctcttctgttgagcagaaggaacacagcagaaatgctgaggatgccagcaagatgtgtggaaaatatagaagcaaagttgaggctgagcttacagatatttgcaatgacatcttgactatgcttgacaagcacttaattccaacagcaacaagtccagatagtaaagttttctatttcaagatgaagggagattatcacagatatatctccgagttctccacaggtgactccaagcagagctctgctgaggatgccttgagagcttacaaggatgctactgttgttgctaaggatttggaaccaactcacccaattagacttggcttagcattgaacttctcagtattccattatgaaatattgaatgaaccaagagcagctatagatatggccaaggaagcttttgaaatggccattgaacaattagacaagttatctgaagattgctataaagattctactctaattatgcagctcttgagagataacttgactttgtggactgcagacttgggcgcatccggagaagccgaaggtgctccagaagcatcgtaa

SEQ ID NO: 1015 - DNA, 504 bp, Cryptosporidium hominis
atgccaccagcaggtaaagcagatccatctgaagtcaagtacttgtacatcagacaacttggaggtgaggtaggagcaacatctgtcttagccccaaagctcggtccattgggtatgtcaccaaaaaaagttggtgatgatattgccaagggtacagctgcctggaagggtatgaaggtttgtgttaagcttactgttcaaaatcgtcaggctaagattgatgttgtcccaactgcaacatgcttgttgattaaagagctcaaggagccaattagagacagaaagaaggttaagaacatcaagcacagcggaaacttgtcaatgaaccaagttatttctgttgctcgtgcaatgaaattcaagtcaagagctaaggcattttctggtaccgttaaggagattctcggaacatgcaatgcaattggttgcactgtagatggacaaaaaccagttgatttacaaaagatgattgatgcaggtgagattgaagttccaactgcataa

SEQ ID NO: 1016 - DNA, 921 bp, Cryptosporidium hominis
atgacagaaatttcagaaagccaaactgaattgctacaagctttctgtgagatcacaacctgtgatattacaacgggtagaacaattttagaatcaacgaactgggatttagagaatgcaatatctctttattatgagcaacaaaatgcaaatgtatatgaaggtaataattttaatattactgaacaagttaatgctaataatataacagtaaatcaatatggaaatttgaatgaacaacaggaaacaaatgttgatcaggctaatgaaggaaaacacttaaacactttgaaacttaaaaaatgttttaaggtgtttttgtcagtctgtggaacaagtttaagtgcaatctttggattctttaaaactttattttgtgttccaaatctaaataatagagcccaagataatgtatctataaggaatttcaatagatcagttatttctcaaattgaacaagttcagattgaggaagctagaagaattagagaagaacaagatcttgagtatatgagatctttaaatttggattctatgaaacaagaaaaggcattggagaaaaaaagaactaaggacttgattagagaaagaagggaaaaattaaaagctgaatttcaacaagatagagatatcgaacaagaaagtctctctagagtttgtgtgaaaaactcagcagggaaaaagtttcaaagaaatttccataaagacgactctgtctatgagatatttaaatggattgattctcttgcattggacgaaaacaacttaatctctgataaattctctttaagactccctcactctaaatcagtggaaattgacgattcatatgcagatgaagagatcactataagtgaaattggattctatccaaatactctcctacttattaataattttgacgaggactctgatgactag

SEQ ID NO: 1017 - DNA, 600 bp, Cryptosporidium hominis
atggtgggggacgggtttgatgaattatctccaggatcttctcaaacatcaaatgaggatgttttcaatatggatgaggagatggaatactctggagcagtcaaagattacagtatgaacaccacaagtagtagagtagtagaaaaggaggatagtgggattttaagcaatgaaatggttgacttagttttagattacatatcatataaggctggggaggggagtaatgtaactggaatagaaaaggtggattccacaattcaaaattgtagaaattcaggttttaaaaaatcaataattcttagttatttagtgagttctgggtatttggatttaaatgagggggtggaaaatggagagcccattgaagatagtttgagctatatacagtcaatgcttcatcagaaaagtaaatatattccagagaatatagaggaaattactttggcagtttcttctgctaccaagctctttattttggagcttatggcaaaaattaataaacaattaaatgatagcggctcaaataaaagagtcattgcaacaaaacatgtatatgatgcctatattactcaagagaagctaattcctgacttgtaa

SEQ ID NO: 1018 - DNA, 618 bp, Cryptosporidium hominis
atggatttgcttgttacaggccaggatgaaaaaattaagcctttcgatatgctaattccattcgtcaatgaaagcggtcaaattaaatttgtaactagaaggagattaaggcaattagtcaaatctggtctttcaaaaggtttctcggaaggtgttcctccatttactcaagaagctatggttgaaggtgcagctgaaccaaaagagaataatgaagaaaaaaataatgaaggaaagactagcgaagaaaagaatgatgaaaagaagccagaagaagaaaagagctcagaatcttctgctgcagaaaaaggtaaagaagctgcgaacagtgcaaaaagcctactgcaagaggctgaaactgttcttactggaggatctttatttgaaccctctgaaaagaaagaagatgataataaaaaggaggaaaaggatgatgaaaagcctgaggaaggtgaatctagctcagagaaaaaagactccagcgagtcagaagaaacctctgaatcgtcaggtagtgaaacatcaaaatcttcaaaatcggacgatgttgatagtgcgatgggagcacaagattctgcgagtgtacatgcatcagaagaggaagaggaagaggagtga

SEQ ID NO: 1019 - DNA, 1767 bp, Cryptosporidium hominis
atgatgtttgatagtaatgatggtggaaggatggtaggtagtatggagaatagccaaatgcatatggatgctaatgcaacagtttatggagaaatggatgggttgagctacagggtagaacgtcctaaatatatgaactgttgtgtatgcggagttgcaacagaaattaatccatctagaatgtgtataaattgtattcgatcagaagttgatataactgaaggaatttctaggcaagcaataatatcattttgtagacaatgcgagagatttcaaaagcctccatgggtatcttgtcagttagaaagtagagagttattagctttatgcttgaagaaaataaagggtttgaacactgttagactggtggatgcatcatttatttggacagagccacatagtagaagattgaaggttaagtgtaccatacaaaaagaggtaatgaatggagcaattattcaacagagtatagtagttgagttctttatgcaagctcagcaatgtgatgattgtagaaggagttttactcctcacacttggaatactgttgtacaagttcgtcagagagtagaacataagagaacctttttgtacttggaacaacttattctaaagcatggagcacatgagaaagtgtctaatattgttgagaaacctgatggattggatttccagtttcaacagaagagtcatgctcagaagcttgttgactttattactcattattttgcatccaaggttaaaaacagtagacagcttatttctcaagatttaagctctaatactcacaataacaaattcacattttctgttgagttatgtccaatttgtaaagatgacgtagtttttattccaaagaatctatgtatatcactcttaggaggtatttcatctttattgttatgtaagaagataactaacagaatctctcttatagatcctttcacaggaagagaagcagatcttacaaaagagaagtattggcaatattcgggatctaatggaagctcgtttatcccattgttatcacgttcaagtctagttgacttttatgttctcaatgttgaaaggatcaataccacaggaaagcactcggctataggatcagatcataaccaaggtaggaataacaaagtttgtattgcagaggttgaagtttgcagagagtctgacttaggaataccagactctagtgtaatagtaaccacccatttaggagcatacttgaattcaggcgactgggtttctggatatgactttagaacactaaataactttggtgttgttgaagatatttcagaatttgttcaatggagagaacgtaaccatgatgtaattcttgtcaagaaggttttccgaaaaaatcaaaataatcttgattcatctattcaaagaccttgggtcttacaaagacttccaaaagaacagcttgcttttgataatgcaaattctaagagtagctttaaccaagatcttgaacaattcaaagcagaacttgaagaggattcagaaatgagacgtgatgttaacttatattgggatccaagaatacaagaatcatccagagaaatttatcaaaaggctagaagacccagacaccttgttaaaaaagataaactctcaaagaatcaatcacaaggccaatttgaatctgatgatatgattatggatgacgaagggtaccaacatgatcatgatgatgaattttcacaacaagttgacatttctgagttacttgatggactttcaatcaatgatctacagtag

SEQ ID NO: 1020 - DNA, 246 bp, Cryptosporidium hominis
atgaatagggaagagaatccttcaagcggatccagtgaggtttcacaagaaaaccctgaaaatcatcaagggattcaaaatggagaaaatatttccgaggactggaatccagttgagggggatataagaactacagtctccactgatcatcatcaagctcaaaataacaatttggatactggaattcatgcctcgaatagtttaagttccgaaaaactatgtagttgttggttcctcagaaaatga

SEQ ID NO: 1021 - DNA, 864 bp, Cryptosporidium hominis
atggcagactatgggaccactgaatactgggaggaaaggtacaagaaggactcaaatccatatgattggtaccaaaggtgggagaatatgagggaaataattaaggaatatttgaaatttgatgataaaatacttgttgttggcaatggaacaagcagattaccagaagaaatttatgatgatggatatcaaagcattgaagcaatggatattagtactgttgcagtagaaattatgcacgaaagatttgcctcaagaaatattccatgccaagtcggtaatgttttagatatgtatcagtattctgacgatggttatgatgtagttattgataaaggaacatttgattctattttatgcggtgaaaatagtcacattaatattgacaccatgatgagagaattagttagagtactaaattatgacaaaggtaggtatatatgtatctcttatggacaacctaattatagattgaactacttgaaatctatgaaagagtgggaagttaccacaattccaattaaaaagcctgcaaatgaccagatttataaacttaaaaattacaatgacgaggattctaactcacaagaaaatgtgaatattacaacttcaaccagaccagacttataccactatatatacatctgcacagtggttaataaaaatgtccctgaaattggaaattccttgaatttaaatgatgatgagaatggagatattaagactgataacgacgttgaattaaatgcggataatattcaagatcctaataactttgaacaagatcttggggaaacccaggaggatgagagaaatgaattccaagttcctgatgagaataaagttcttgaaaattcgatttag

SEQ ID NO: 1022 - DNA, 1467 bp, Cryptosporidium hominis
atgttgataaataatgagaatgtgagggcagaagaagagaatggtcgtagaccaacaagaaacgaaactatcgtctataagatagtaaattacatgtcatctttaattggtggaattaacgataatgtgggtagaaataatccatgtattggtattttaagtccaatgtcgccagttatgataacagatcatgttaagacagttgggaatacaatggttttaccaagtccagagccaataattcagatgattccaaatcaaaatctaaggaataatatgttctttaacgtttacagcaatgataaaaaatatgttcataaatttgggcctaaagtcactccatatactaatttgaataatggattactagctattaatgaaaaaggagaccaaattgttactggaagtatatcactcatgagctctcctactgatatgtgtttaaactcttcaagaaataaattaatcaatcctagtagttatttttcgagattaaggaatccaatcagtgaatgtggaggtcttgtaaaatcaccaatcaattcatgttttagtggccaaatcaacaaggctaatgagtcatctattactgaaatacttgtctcacctgaacttgctcaaacacttcagcagattatttcaataatttcccaccaaatagaaattgatgattctgaaaattccattaacattaataatatcaaaggatctgtcaagattaacagatttcagagaattaacaagaaaagtacaattggaggattaaactatgccctcatgagttattcagctagtattattcaaaaacactttagaaattttgataataatagaatggtaagatatattaatccagttactagaagtaaattttcaaaaaatcaaatcatgaatgcaattcatattattcaaaggtattggagaatttatatttatcgtaaccagattatgagagagctcttaataaaaaatgttatgactgctagaaatgctgcaagttgtaagatagcttctatatggaaaggatataaaacaagaaagtttatggattctataattaaagatgtatatatcaaatggatttggaatgatagtgattcagctaataataattgttcttctgaaattaacaatacccaaaactatgaatattcaaagtatgaagttaagttaagaggatctttcacgtgtaaaccatggcaagagcatttaaaacttaattgggacaaccaggaaaactgttttctaattaatatatgtcttacaaaaggggctcattacctccaatttataattaatgatgaaattaaagcttgtgggagtatggaaattgttgttttacctatcattggagtatccaataaaatcaatattgttggagaagcctacaaaagttcacgtaagtttattctactttcctatcaactaacacattttttacttttttttatttttatttttcagtaa

SEQ ID NO: 1023 - DNA, 1959 bp, Cryptosporidium hominis
atgtttagtcgtctatacaatagaaacgtggatagcaataatcaaaactctggtaaatcaaacagaattagaattactttaaaggacagaataaattctagagaagctgcaaaatttccaatcactgagagcaggtcttttatcaatcatggagaaagagatgattattcggtagtaagaagaagtaatactataggaagaatcatacaaaatggatctcagcaaatcttctatcctataaaccccaataataactttactagacaacaaatgagaggttgttacaattcaaatatagtacagaatagtcactcaaactttcaacaaaatggttccatcgattctgctctcagtagcaggagatccaatgagtttaatacaattcaatctttaagatcaacatctgatttagcttcgaagatatcgtcaaacgtagtattagcagaagatcaagaacctagaatagctagaaacaaagtaaagtctattacatcttcaattcctctaaatttaatagagaaagattcggctgagagattaaaatcctctataaatagtcagattaatgaaattgaagatagtgaaaatgaaagactaaatagtaatagaaatagatatggactttcacttgatttatattcactaactgaagattctgcgagaaaaataaagccagaattgtcagttgaattggaatgttcgattaatgagacaaatgaaaataatgaggtacttgtaaggagtatttcgttacaaaaggaaaagttacctaatttggagatttttcctttagaaacagtgaatagctcaaattcaaaaagtaacaatagagaaaactgtgaattaaggagatttattgataataatgaaattactggattaatttcaaaacttaacaaatcagcattttattttgtaaggtttaatttacttttacatttagctgcaatagttattcaatgttatttcagacgatatctatgcaagaaatatctatatttcagaaaatatggaccaataaagctcttgaatacttctgcaatgcaaatacaagcatgttggagaagttttctgactagatttggcgcatctctgtgtgaagggacgccttcaaacaatggaagtcataaatgtataaatgagtataattggtcgactcttcatgagaagaattttactgagattgttaaaaaaagaaatcaaaatgcaaaatgcatacaaaatttctggagaaatatatatttaaaaaatatcaacattgagagggaaatcctgacaaattccatattctcagctagagctttagctaaagagactattgagaaattccttcttggttatttagttaggaagaatgctgattctagatataaactagtgcctattaaatggagttggagcgttcaggagatttcagaaatcttcattttgcaaaaaattagaaacagatggtcagaaccaaagaagatgtggttcaatcaggaggaaaatgtctatagatataatcttttcctatcaaatggtatccatcaagttgtatttaaagtgtactataaaaataaggagtgcaaaggagatcaggattacacaattttatgtaattcatccttggaaactactccaagtgatgaattccagtttgtaaacaatatcagtgtttataatagtaactatactgttagtgctttcaagtacatgagagatagaatctcatatattaatttctcaacaataaattatttggacaacctaaaccccgatattatgcaaaatattgagcaggatctaggctatattgcattatctccgagttacaagcagcgccttgacattgaatactcagaaactgaatatgaaaactctccctataaagagtttgacagaattaagaatgatgtaattaatactccaagtactaacttagactatagtccaggaactcagcactttatccattaa

SEQ ID NO: 1024 - DNA, 2409 bp, Cryptosporidium hominis
atggagaattctacgataaatcatccttttaagaagaaactgaatagagtactagagctaaagctaggagagaatgaggaattaattaatgggcttatcagcttggacacagtagatgatatatctgaggggatcccaaagcacttagttactgaattactgaatactaaaggtcaaaacaagtgtagatccatgcagcttttaatatataggtaccatctaatggttgcagagagttgtttggactctttaaaaccttttattgatgatttgagagcaatgaataacgaaatcagatcatttgaaaaggagtttaatgagaatgttacaactcaactaacaaactggaataaatttacttttccccttttggaggaatttagcatgatacaagatcaaatacaattagtagagaataagaaaaatatgtgtaatacaatgttatcacacttaagtactaattttgtgggcgatattaagaacttaaaatcttccatggatgaatccagggggaatctcttgttatctttagttgcaatttacaacaaatgtatggccagcgaaatcaattccaagaaattgattgaaattctttctagtgattcactagactcacaaaatacttcggaatctgtcctctctaagcttaagagtgaccgtgaatactctagtatgataccacaaattctaattaatctgaaagcattaatattagatttggaacttaaaagaaatcagctggcgactgaaatcacaagtttcttggttgatctagtgatctctaagtcacctgatgaatttaatgatcaatttgaagagtcacagaatgatgaagatgagaccgaaggaattgaaaaagggactgaagagaaagtatgtatttttggaagtcaaagctttcaggagtctgttgaaatactcgagcttcatcataaagaacagtgctattctttacttacctgcgttgttgaaaccagatcaaagtacttagaatatagatttaaccatattattggtcatggaatttctattggagacaacaactattcttctaatctactggactacctggagtctattttcgagtggattcgcgtttgtggagtgtccatagagtctgaatttcttattaaagcctttggctatcagatatgtgaagattgtgagtttgaagaaaagcatctggactttaaccaaagcgatacttctgagccagaatcacttgatagtatggccaagaatattttgaataacattactcacacactttgtatccccttttctggagcaatcagagatattcttcgtcagtttcatcctccacagacatccaggccggattccactcatcattttggcaacctaacttctctcaagataggaattactattggaattaaaattgcacatttaatcaataattatgttgaggcattaattccaatgtttaagatcctgcctaagagatttagctcaaagccaaaacaagcccgtcttgcatttcctttacttattcaacgttttaaagatttaagagaagaagcaattgctcaatattatgtgtatgcgggaattgtcaaagaaaacatatcctctcgcatttctgaaatcataactacagacttttccatatccattttggtcatggaatggtcttctctcttaaaagacatcctctctacaatacaaaatggagttcttgcgatttcaaatgacaacattccaaaaattgaggacattaactctaccctaacatctatgcttgacacctttattaaccctatgtttaatgctatctgttcagttgctacttcagacaaaactcctcttgcatcaatcattcgaatcaataacgtaaactactgcctctcagtactaacaacttttcaaaaaatgaaagtcctattagagaaacagattgaaattgcaaatcaaattatcaatgatgaagtttccaaactaactgattttttaaaagaagaattttgtgataaatatagatttggggaactacttaaagagcttgaagccaaaaaagaaggcttaacaaccccccaagtatttgaggaatctgctaatagtaatactgaccccaaacccaaacctaattctaactacaatagtagtgaaagcgatccaggccaagacccacttttaatactctcacaggttattattgatcagttctttgaaagtatcctacgatttggagccatcccttttgccaatgctgatcgaattcaagataaacaaattagaaataatattttaaaaaacctgttcgcacacatttcccgccaatacgagttaatatttgaccaaattaccctaatttggcctcaaaaaagttcttttctcaggcacgaccctcagcaaattaagcttattttttctagtttgaccgtttag

SEQ ID NO: 1025 - DNA, 3987 bp, Cryptosporidium hominis
atgagtaactataaacaaactgaactaaagagaaacaagggcgattcaagagatgtttcactactttctgcttcaagcttgcatgaaggccaatcaaatatgcaaatgtggagaagaaggtgggagccatgcctaccacacatactaagatccccgttatctattaaggaagtttcagcttttgaaggaatgggggaaatggaaagatctgacgtttcaacctattttcctttaacatctggaaacagtttggtgaagtttgaggccatttcagatggaagtagctcatggaagaagtttcccgccagaagaattggagtagtattatcgggaggtcaggcctcaggaggtcataatgtgattgctggattaatgtcttatattaaactttgtaaccaaagtagtcagctttttggatttttgggaggtccagaaggagtatatagtgagagatacagagagttaactgaagatgatattaacggtatacttaaccagggtgggtttaatattatttgttcaggtcgtcacaaaattgaaacagaagaacaaatgagagcttctttagagatttgtgaaaaactcaaattacatggtctagtagtaataggaggagatgattctaatacaaatgcagcagttctagcagaatacttcaaacgtaactcgtctagcacagtggttgtaggatgtcccaagaccatagatggagatttgaaaaacgaggtaattgagacatcttttggttatgatacagcagtgaaaacttatagtgaacagattggaagtattatggatgcaattaaaactgagggatacggatactattttgtaaggttgatgggaagatctgcatctcacattactttggaatgtggtcttcagactagagcaaatatgatcttgattggagaagaaattaaggaagagaacagatctttgatgtcgatagtagacgaaattgtagaaatgattctaaaaagagattcactgggaaagaaacatggaattgtattattacccgaagggttaatagagtttattccagaatttgagactttaatcaaagaattgaatcttattttgcttaaaactaacgatagaaaacagattgtagatagcttaagtcaagaaatgaagactcttttcttggaacttccttcagatgtacaaaatcagctccttttagaaagggatccacatggtaacgttcaagtagcaaagatagcaacagaagagttgttagtacacatggcaaaagaaaaacttgagaaagtaaagaaggattatattttagacaatgttaagactcactactttggatatgaaggaagatgcgctttgccttcaaattttgatgcaagttattgctttgctcttggacatactgcagcagctcttatagacaatcagcgttcaggatatatggcagtagtcaggaagctaagcctaactcctgaacaatgggaaccagcaggatgtcctcttacatatatgatgaatattgagcttagaaaagggaaatctgttcccgttattaagaagtacttagtagatcttaaaggacaatcttacttagcttattgtcaagttagatctgagtggaagttgaatgattattacaagaatccaggaccaatacaatttgatggccctaattctggaataactaattatatgatttctcctccaagagtggaggatttacttagaatggaggatagatacgagaataaaatgaatcataaattattagggtcagaaggctctcaaaatagaacaaaggacgacataaagataccgaagatccttctttcaacagcttccaagtttaacgatgatctaatcatttcctcctcatgcagagatttagatgcttacattattactaaatgtttacctcatcagactgggagacacaacagcaaagtactacaattaagagaggaggaatactcatcagaattcacagagataagagagagcagccattcaaaatcttccgtgggtaattcactagcttgtgagtcacttggattaattctatcatgcctttcaactcctggcactcagaatgtaatttgtggactagtcaatggactaccatcgcttaaacagcttatagtttttaagtctctctcagactttttagaaggaaaagctctaaaagtcgatcttacttccgaaggatcattgactttctttgagaattccctcaattctggaggctgtatattcccaaatggagtagaaataaaaatgaatgcctcagaaaaaaagaactcaaatacaactttaaaagctaatgacaaccaagaattcacaaacagctcttgcgttctttcatgcaaagggctagttagtaatgacttcctctctcaactcttgtcattttttaatatgcgtgcaattgcaattgtggggaacaacgaggcggcaacttttggcgcctcgctatcggagcaattaatttgcatgtcgttaaatggcatgaagagtgagattccagtagtgtttgttccagtttgcttggagaacagtatttctcatcaaatgattgagacatgtattggatttgactctgtaactaagagtatttcaactttggttgggaatctgttaacagattcagcttcagcaacaaagtattggtatttcatgaagatgataggcgataagacttcaaatgttgctttagaggttggaatacaaactcatccaaatttggttgtaattccagaaagatatgcagatagaaaactttcagtttatggttcagaaatggctggggtcactttagatgatattattactgaaatttgcgatataatttgtttgagatctaatcagggaaataattttggcgggcttctggtatcagaaggcctttttgaccaggtatacccaacaagagagtataggaagatattttcaaggtttagcactcagaatttatgtaatgcttcaaattcaggaggatgcgagattctgggttctgaaagtttaagtagatatgagaaaaaagttgttgaggatttcaaacttatatttagtgatatagatgcgaggcttattgagaatttgattaattcaagaaagatatgtgatgttaggactgagattatactctcagctctggttcaaaaggaactaaaatttagaaggtctaagaataaaattaagaatgggatgaacccagtgtgctttagttttacagatcaagtcagagcttgtatcccttctgattttgactctacacttggattaatgtacggaatgcttgcgtcaaaaataattaatagtaacttggttgggggatatgttacggggattaagggggtattaagccaggcagatagttggaatatgtatgctattcctatttcctctttaatgactttaaatattgaaggagataaaataaaggattcaagaaacaactcaaatctttcatttgaatcaaagaaacttctaaccgaatctacactaggaaatgctggtcatcaacttgaattcatatgcaaactgaactccgttaattcgcgcaataatccttcatttaaacttttaatgaatcacattgaaaaatgggaagtcgacaatacttatgctaatccaggccctattcaatactttaatctattcaaaaatttattcaacagaacactgtttgagagtgaatacgtttatacgcgaaacctaaaagaaatggatcaaatattacttgaaattaagacattatgccaattgggtgttgaaaaggatattttaaactctactgtacaacacttaaaggcaatccaaaattctatttcaataatgagcagctgtaaccacagaaaatctaaaccagaacaaatagaatgcatacagaaaacaaactcaatagcaaactatatatcaaacttaaaatgcaaaagccataataatgaaaccaatctggaaatgattgttaacaatattattaatcaggaaacttgcaattaa

SEQ ID NO: 1026 - DNA, 375 bp, Cryptosporidium hominis
atgaatacttctagtaatgaagtaaaaactgatcaaggagaaaagaatgtaagcatttctgagccagtaagacaaacaatatgtataagtgatgttaaccaactttctgaaaaagaaagaattgaattaagaagacagaagtttggagcatgtggtccatccacagaagctgagaaaaggcttgctcgttcaaaaagacttggtgctgcgtcagaagatgataagagaaagcttagacaagaaagatttggaatgatatcggaagctgataaaattaaaaatagaagagaaaggtttggaacaatgtcaagagtaaatgatccagatcatgagaagaagatccaagtaagaaaattaagatttggtttgaagtag

SEQ ID NO: 1027 - DNA, 678 bp, Cryptosporidium hominis
atgaggaggaacaaagaggtaaacaataaacattattgtcaagtttgcaaaatttggatagaaaatcatccaaataatataagaagtcaccaagaaggcggaaggcacaactataatttgagaaagttgttgaaaagtgaaaactatagggaactacagaagaagaaagatgaggaagaggtccgaaaggagtttatgaagttacaaggggtcgagcaaacttctaatcgtgaaaagaaaagaatcaaactgatagataaggaagtcagatcaggaagttctaccactttcggggataatgttttcacaaccaactatacctttgataattcaaagaatatttttgaaaaaaaagatcataatgaaagccatgacaaaacgaacgaaatgggaattattggaaaatgggaagaagttaaagagtctgaatctgcctttttaggaaatattgccttagaacaacaagatcatgctcaaatcccgaacccatttaagcctattgaaggatgtgtccagattaaaaagaatagtttatcccaaaaagtctactcgtgtatttccgatattgaaggaagctttgaagaacaacaatttaatgagaagagtacttctgattgtcaaaaagtgaaaaatgaaaagataaaaattgtctttaaatctcgaaaaattcctcgttaa

SEQ ID NO: 1028 - DNA, 984 bp, Cryptosporidium hominis
atgtcaacccaaatttggatagaaaaatatcgcccaaagattttggatgaaatggttggtaatgaagaagttttaactcgattaaaagtcttagccaagcatggtaatatgccgaatctacttctttctggtcctccaggaacaggaaagactactagtattcactgtctggcttctgaaatgcttggaagtaaatatggtagagctgttctagaattaaatgcatcagatgaccgtggaattgatgttgttagagacaagatcaagagttttgcaagagagaaaattgacttacctgaaggaaggcacaaaattgtaatactggacgaagtagacagtatgacagactcagcacagcaagctctcagaagactaatggaagtttactcagaaagtacccgttttgctctagcttgtaatcaatcaacaaaaattatagagccaatccaaagtagatgcgcaattattaggtactcaaagcttacagatgcacaaatcagaaaaagattatttgagattatcaagatggagaacattccatacgttgattctggaattgacactcttgtatttactgcagatggagatatgagaattgtaattaacaatctccaagcaacttaccatggattttctatggtttctagagataatgtactcaaagtctccgacattccctctcctgagaaaattaagagtattttggactcttgtgttaaatgtaactggagattagctcactccattgttgaagaactttttattgggggttactcaccacttgatattgtcattaccatgagaaatgtattgaaaaaatatcaactccctgaaagggccattttggagtacctaaaagaggttgggagatgccactttgtcatgcttgatggttgtgccacccccttacaattagacaaacttcttggccaattgtgtatgatttctgctagatgtggtttaaattcaaataagaccaactaa

SEQ ID NO: 1029 - DNA, 1617 bp, Cryptosporidium hominis
atgttaaacattccagaattaaaggagactttatcttgggacgatatttatagcttatttgagtcaagcctaagaatcagctcaaacttggatccaaagctacttgttaatgcaattttatgcgaatgtaggaaagtcattaattgtagagattgtaatttattcatctacgattctattaacaatgttttctaccatgggtttgacacaagcaagtatataatatctgactccctacttaagaaggtacttattacgaaaaagtacgaaattcttgacgactcaggagattctgacaattatcaactagagaacaaccatgatattaagacaagaagattttccaataatgctatttacattcctatatataatactgagaaagaatctccaatagcagttcttgagattttggacaaattcaaattcgataaagacggtatcgaagttaaggatagttttacccaaattgacattattaaattaagatgtatgtccagagtattctcaatttcagttatgaattgtgaaaaatacagagaagttagaaatactaaggaaaaagctgacaatctacttaaccttgttcaatctttaagaccagatctgggacttcagtctaacttattcactctctgtatccacgctcaagaaatcatcgaatctgagcattgtattgctttaattgggatccctgaaaggcaacaaatcatatctcttatatctgatactgggaatgaacttctatttaattatgagattggtgatataattcatagaattatcgagactaggcactctcttattatacagaatactggagatgataacaagccacgtttcgaaaatagactcgttgaatgttcatgcagctcaattagaattgtgataggaagcagctctgtatcaacgagcaatgatgatcaatttatccgcctcctacaaaaagtgtacggaggtgaaaaaccaatctacaacgctttagtattcccaatctatgcagaaagggacaattggtcatgtgtcccgacccccagccaaaggatctcatccatttcttctctttcatcagccttctcatcatttgaaattggacatgattatgatgatttagtatcagtttcacccagaaacaattcaattctgaactcttcaatcatttcctccagtattgttgctcctggctctccaaaatcggatagagttgggagaagcagcttagttgctcaaactcatacaaatacaagatcttcatctttatctccaagcaatcagtttgcccaaagtaacaacacccaggcaatttctcttattgtacttattaatagattaggtgttttcaaagaaaaatccaaatttactgaaaatgatgtcaggcttctcgaaccatttggcagaattgttgctccaaatataggtactttgttccaaacatctttattttcttatcttcaaacaatttacaatactgacagaaatatcagctttaataagtatcaagacaagatgccacaagatcccccttcattcgcatttcctcatagcaactggaaaaacagacattctgatgtaattttcgaggaggatgaggacggagctaaagacttagagaagtag

SEQ ID NO: 1030 - DNA, 945 bp, Cryptosporidium hominis
atggaggccttaaagagactaatagataaaagatctgagaggatggcagttgttgagaagataagtgcctcaactgaatcggaattaattttaccagagagagtaaacttttattttgcagctttacgcattctccatcagttgaaaagaaaaacaccagagcctatgaaagggatgcagatacaagaaacaataagcttaatatgctctttagaccaagttattagcttgtatggagcactagtaacttctccaaaaagcacaattgaagattatgaagagaaagttgaaagtaatatgaggactattatcagctcaatcaatcgtttgggtttcagagatatccttcaaaaagaggtccagtattctaataaagagaatttggatcttcacagagcccaaaggattattcctggaattttcttaggaggaagcactatagcaaatgatttaaaaaaacttaaggaccttggaattactcacattgtatgctgcctacagggtgcatgcaagtttccaaacgaatttctgtatttaaatatccctatttatgatactccatttgaagatattagtaaatatttctcctcatcttttgattttattcacaatgcactatctcaatctaccgtggaaagacctaataatgtctacatacattgtgctgctggtattagcagagctccaacaatttgtgcagcctttctaatgagagaactagggattagctctttacaagctttaaatctaattaaattgtctaggccctatgtggcgccaaatccaggtttcctaaaccaattatacaattatcagttattcttgacttctgctaaggtttgtcaaaaaagacaacaagtatcaaattcaaatcagactcagattcaggttcagggtgtcccatatcaaaccaacttaaagcggaatgttgggagaatcaaataa

SEQ ID NO: 1031 - DNA, 1827 bp, Cryptosporidium hominis
atgtttagagatgaagtaagaacattctcatcaggaagaagatttgcatgccaaatgaaatcctttttgaaaaatagaaggtgcatttcaggatgtgccacagcttttttggcgggaggcttgtctgcatggctttatttggactccagagaaaaaccagaaagttatttttttaacaagctaaagagttcatataaggttggatgtgcatctcaagaaacttctaacaagttatttcatcagaaaatcttgaatcaaaatctatcattgaaaactgaaaagcctaattacgttgagttgattggagaacaaggaccaataaaaagtatggttttaggctctgaaggaacatcagcaatgatttcaatttcagctattcaggtgaatgcaaataacccaatagaagacaggttattgatacaaaggatgaggctcaatttaccgggaggggaaaataaagattttgtgatttcagcagtaattgatggacatggagggtggcaagttgcagagtatgtccaaaataacttcataaggatatttcagaaagaactttctcaatatatgtcttctctagtgagagagggaagtgctaatgaaagtaatcaaatttctcaaataaataaaactgatataatagctggacttttttactcacttaaaaagacatattatatactggatgaggaactgaagagtaaattggaagttgcttataatcttggattttctaagttagcctcagtaggagcatgtacgactgtctcaatcattacagaagatgcaattcttacagccaattctggagattgtctctccgtttattgtaatgagaatgggatctggctccctttaaatgagcagctttcagcaatgaatccccaagaacaaaaaagacttgaggagattcacaagcatgagaaggataacttgattcaatgtaaacagattcttcatgaaaaatttcttatgggactttataccattccgaagtataggggctgctatgtcaaagggatcttacagccatctagggcaattggtgactttagactaaaatctatggatttcaactataattgggagaaagatctaagcacagaaaaacttttacctacattttcatatgtacttaaagacaaagagagtgaacaatctaaaaaagaacaacaccgagaaaaagaagatctaaatgaagatgagtttccatattcatatgacctaattaatggaaataattcaatcaatatgagacgagacagttatagatactttgtaaagaatccattgagctttccttatgtaaaatctgagccaatgttacatcttttcttttataactctttgaataataacttgagttcaacagataacactagtgtcgagaagatctctccaaatgaatactctttaacaccagtacatacaaattcttcccttaaagttgaatatattactccagaatataagcacctacctatttcggagtattcaaactctaacgaatttatcagagatttcactttatccaaaataagaaatgcatattcttacattcaaaaccccatgaattcatccaaaaagagttttcttgtgcttggaacggatggagtttgggactttttaactccaaaagatgttacaaacgtcatattaaactccaaatcagtagaggatggagtaagaagaatccttaaaaaagttttgaataatgcaggaataaacagcattgaaaaactcaaaagtttacccaaaaaaagaaaggtatttgatgatactagcattgttctagctgagatcaccccaaataaacatgacaataactga

SEQ ID NO: 1032 - DNA, 411 bp, Cryptosporidium hominis
atgaaaatcacaccaaaaatgttcatctgcgaggttccagagaagattctggaagatggagattgttgttggattcacggttttgtggtcgatgttgagatagatcaagatggagaattggatatgattacgttggatgacggaacctctaatattagagtttcaatcaaggacaagctgaatgatgcaaactgtgacaatttccatgaagataccgtaaagacttataggggacttattgaagaactcgttcaaaaaggaaggttaatttcgactgtttgtcaattaaacaagggcgtttttaaagtccttcatgtttcagacagtataaatggaaatggagactccaagaatgagtggataaataattctattagatcaagaggaagtcaagaagatgattcatcatga

SEQ ID NO: 1033 - DNA, 978 bp, Cryptosporidium hominis
atggagactatgtcgagggagtacgagcagcttaagaatagtattttagaactagccaatggtatttcgaatatatctgagaataagaatcttccaattctattaaatatattaatggatggaataggtgcttacaattctatgataagtagacaatcaaacttttcagattccatgctagaaatgtcattttggtcgattgagttgatggacactatttatgcaactaatggaggaatgacgactttgttagattatactttagaaaagattcaagaccaatttccatcaatattgaatacttttgacgaaataaattacttggataaattttccacaaggtataaaatttcagaaatttatagaggattagttaggataaactttggacttgaccagagaattaaatcattagaggagatgataaataagaggcagaaatacaggaacaaatcaaaagcttgggaattatataatagagaggaggtgttattgaagatcaacaatttaaaagaattatcagatttcctaaagtatgaattcatttctttaatcaaagatattctctttttctcaaaataccttggaatagatgatgaacataattcagcgattaatagtagccatgaaactgatacagatagcattaaagggagctatgatgacttaatctctgaaattgaaacagtttgcgagattttccaaaatggacaggttcacaaaacaagagaaataatggataggatcatatcaaatttagatgtagaggaatttgaggaaatacttggtgcatttaaccttttgaattggctcaaaggtagggtttccatttgtttaggtagaaaccttgaaaacaacattgaagaaatctcagtaattcgcagcaataaacaacaagaatcgagtagtagcgaccttgataaagatgatgagagactattaaatcaccaggagactcggtattacgacgaagactga

SEQ ID NO: 1034 - DNA, 996 bp, Cryptosporidium hominis
atggaggtccactcaagcacagtagggtgccaaacagaatgtacaagcacttttgaagatactcaaggcttagaaaaaaactatagtatggttagagtgattggagaaggcacttatggtattgtttgggaaggtttaagaaaagatactggggaagttgttgccttaaaaaagattaggtttgacagtgatgagatattggatgaagttggattaccttcaacagctataagagaaatcgtcctattaagagagttaaaacacccaaatatagtagcgctactggaagtatcatgcacgggcatgcagatatggcttatttttgagtattgcgagacagacttgagaagatatttaagactaaataggaaaaagggtctttctataaaccaggtcaagtctctattacgtcagctactcagcggtttggctttctgccatgggaaaaggattttacatcgtgatttaaaaccgcaaaatttattattaagtgattcaggaaacactcttaagattgcagattttggccttgctagaacctttactcctcctttaaagccaaatacccacgaagttgttacattatggtaccgtgcacctgaacttcttcttggacaaagatgttataattgtagcgttgacttatggagtgtaggttgtattatggtagaaatgatctctggaaagcccatattccctggagacagtgaaattgatactttattttatattttcaggcttcttggaactgcaaatgagagtaattggccaggggttactcagcttccttgctataaaagcgtatttccccagtggaaggtgaatccaaagttgaatctccatgcacttcttccaaaccttgatcaggctggtgttgatctgttattcagattgttgcaatattgtcctaagaagcgaatcactgcattggaagcccttcagcatccatggttaaatactaatactcagaatatgaatgttgaaatgacaatatag

SEQ ID NO: 1035 - DNA, 444 bp, Cryptosporidium hominis
atgttaacttttattggaaaagatacttccaaatttatccaaaaagctaataaaaaactaccaaataatttaaaccaaatatttaactaccaaaattcacaaaaatctttgggtgaaagttgttgtaatagtattgaaaacataagtttggtttcaaatacttgtgattcaagcccattttctacatgctgtaatagtgagtcccctgatggatctagcactattacttccgaaaaggctcataaagatcttgaccaagttttaacttgtacaagtaagaaatattgtagttctgaagttcaagtttctttaattagctactctccaacttcaatcaattctgattccaatcacttggattcaaaaaacacaaactctatttcttctattctggctttattcacctacaatatacttcttgtatttattgttttagttttttaa

SEQ ID NO: 1036 - DNA, 615 bp, Cryptosporidium hominis
atgaagttaaattttgattttcaaggagtttttaaaagtataaacttgaaggaaaaccttcattttaataattgtgtatctgcatataacaatattaagagttatgcagcaaatgcattcaaaagctgtgaagatgatattagtttattccttgaaggaaaaccttttgtattatcaaacattaactacaatgagttaagtaataaattaattaaggttaggaagaatattgaaaatggtcttaagggtggaaagggaggttttggagcaacaataaagagtcagaagagaaaagtaaatgtaagagagcttagcgttgacctttgtaaagacctaaagacaggaaagcgcatcaaagacctaaataaatctggaaataatgttgaaagtaaagttgagggtggttctagaacaaaaagttcaagttctactaatagtggtagtattagtagaaattctaaagttttagaaaattcatgttctatagtcaattctgaaaatgagttgttaactcaatatcagtcccatgttttaaatttagagaataaatggaagaatattacaaaatctgttgattttggcatgaataatttgaaccaaaaagttaatggttga

SEQ ID NO: 1037 - DNA, 864 bp, Cryptosporidium hominis
atgctatatttgaagtttatattaaatattcttatcttttttgcaggccaaatactctcggagcctcttccattttcatcggatgaggttaccgttgttccatttcctcctttcatcccagtagcaggaggttatgtaccagagccacaaaataatgaaacaactattgattacgtccaaaaaagtaggaatgactactttgggagtgagttaagccaaatagtaaactccccaaactttcatctggtcactattcaaaatggagaacaaaataaacaagtttgggcgtttgtacttggaaatgaaaagaaagtatttgcatatagaacagaaaacataagtattactgatccactacatctaggaagtaattggaatgttatcagtaatagtgaatcgaacgtttggccagtaaaaatgagatttgtatacccttcttgccacaatatggttaaagataaggatgaagaaggggtggattgtggaggtccttgtaaaccttgtaatatgtttaacagttgtagaattgggctggatgatctaagagcacataaaattttaaagtactccacatgtattggtgagttgaaacatggagagttttgttctctcacatgtcctgttggatatagaatgaaagacttaaccaaaatgaagagtgaaatttattctcagtgttatgatggaaggctcaaccaactgatatttgggaatatgcaagccccaatgacaggagaaagctactattcaagagaatatagaggatttagaaacatgttggaaagtgaggtgagccatttggatcaggagtttaatgaactgtgtgaatctccctttgatatatgtgtaaatatatttctctaa

SEQ ID NO: 1038 - DNA, 3609 bp, Cryptosporidium hominis
atgcaaggttggaattatggaaccaattacaatggtatatgggtatctgttggtgaaagtactgatatttttaatggagatataagaggtatatatattaagccatatagcaatttggtattactatataatatgtataaattacaatgggaaatatatgaacgcttgggggatgtttcatatgaaaaattgaagcaagtaatgcgacaagatggaaagattaaagatagagtattgaatgaagaaaacacttatcttaaggagaacaataaaggatgggtacttagagcaatgaatccacacccaaatccttccccccctaaaggaaaatggctcactacaccaaaaagtaattttgaggaagaaaatatattgcaaataaaatactatcatattgatgtttattgtgattcaagcgtaactactctatctggtggtgatgttcatcttagtccaataaagatggtaagagcaataaatgaggatcctgttgtatgttcatcagaaaagccagtaactagcttttcactcaatttggacttttcaaatttagcattcaaaccaagaaatagttatatttataggtatgatggtagattttctggaaatggttgcaagtatatggaagttaaaggaaccacaatagaggcaacggagtgctcaggattctttagaaaagaggagttaactcagggtgaaactatttggaagaagattgcaagtaactctagaattgtattattttattggacaggaattaagtggatttgtacaagaaatgatagtagtaatacgatacttggatatattgacaatgaagaacaggaagaagggtattggttgaataagattgattcttcagcgggagcttacataaagacaagaacaacattgaaatgtttcaaaaatcatcctcaggaatcaggagctgaacatgcttgtaacagggcattattgaaaggctggcctattggaatggaagctttaaatggaaattgggacttaaatagatatgaagtttatattgaaggaaacaaaaatggggatgaattgagcaggagtaagaaggaaattaaatactatgaacacaggagatctgatggatgtaaattatatctttattttgatgataatgtgggttacacagttattactaataatcatccaaaaagcaggccagaattggaaaacaagaaagacaagaagaacaagtatattgcaatttataaggatgaactacagggaactcctatattaaaaggacaagattctcatcatgttcaatggctatattatccaattgatgaagataatatggcaaatttgagttctccaagagcgctttctagtacatatatttacactaaatgccgagataatgaagagcatcattctaaaagacaaaatagtcaaggaagagattttgatgaagaagatatgaataattctattaattttagtaatgaaggagagaataagaacaattctcaattacaaaatacaagtacaaagaaacaaaatagagtttcattgggaggtagaaagctagttaaagctaaatcaattagcaaagtttctcaatgcagtgaatacaaaattatgggatttaataagcctttggaatctttaaatggaatttggaaaagggatgaaagttatccaaaacaaggagagacttcatctgcagaatcaatcttggaactttataaatgtacaaatagtaatgacaaggatatttatatttattattcggaggctcctttaaataagactggatggtttttggactatgatcttaatccattgaatggtttcattgcattggggactaatagtacttcagatggattaacatcttcttggagactttggagtttaacagaaaagaaatggaataatttggaccttagtttggaatgccaagatcaaactaataattctaatgttaataataaaaagacaatttttactaccactgatagcaaagtattggtgaatggatttgaagtattggaaagtgaatctccaaaagaattgagtataattccttttgaagatgtggaagatcatataaaagctgcaccaattcgtgaaatgccaataccatttttcactgcaagcttaccattaataggacaattagcagcgaatgcttttcctatgataaaaggtatatcaagcttagctccaaagaagccaaaaccaacaaacgaagattcattaggatcaccagtgacagcatcagcaattttacccaacttggacatattttcaaccgctgaacaattaagacaaaatattacaaagagcagacaaaatgaaaggcctagtatatattatgatccatctttacttcctcgaaatagtataaatggaaataatattccttctgtaatgccttatgatcaatttggccctcctgtgaatatgtataacccaagaaatgacattcccaactataactacttgccaggacaacacaatatgttttattctcctatagggcccggaaacattcataacaataatatgtttgatccaagtctgggtccaagcaataactatttttataatccgtacaataataataatttcaatggtattcaacaacaacagaacactggaaatgagatgagagatatttcttacttgaataatcagcagcaacagcaacaacaacttcttcagcaacaacaggaactacagaaggagcaacttgaacaacagcaacagttgcaatctcagcagcaacagcaacagcagaaattacaaaagcagcagctagaacagttttaccatccaactcaaaattcacaacaaattaatgaaataccaacattggcaggagaacatgaaggcgttaatggccaactattatactatgtaaacggaaattttagccaaggagataatcatttggagatacctgtttctacaagcacaactactactacaactactactaccaccacaaccacaagtacaactaccaccacaacaactactactaccacaactactactaccacaacaactactactaccacaacaacaactactaccacaaccacaactattgctactactgaaattggaaattcaaatagagataacatgatcccaggaatttcagaagagggaaggaaagagtgccctgaagataaagagtgggcagtggagcatggaaagttattaactgaatcagggagcataacaaataagtacaaggtgataattgtgagcattttgtatcaagaagatttgaagctgaattatttacaaggagtatatagtttcaacgggattttcaatggtagaccttcatatagacattttgtaaatggagtaagaaatgaatcaaataatcttccagagttaaaaacttcaactttggatgtttcacttttttatgacaagagattaaggtcatggatattcggagatttggagaatattggttataatacagaagaatcaatatatataagaagctcacaaagtgactgtcttgttccatgggactccacgattacatggaaaaatgcaagtaattcagcttctttaccattaattatttcagtaagagcaggagaaagcattaattattaa

SEQ ID NO: 1039 - DNA, 954 bp, Cryptosporidium hominis
atggaacatacagataatatgaaattagataatttgacaataccaaatcaaaagatacaatctactaataatgaggatagagatttatcagctgaaattaatattggtataatcaatacaattaatatgaatacagatattgctaatattggtgatatgagccaacattttataagagaatattcagtcttatcagaatctccaaatttagctgaaaatattgcaatgattattgaagattctcagagtttcttctctgcttcttcaagtttgtatattaacgaagataatgatgaaaatccatatgttgaagattttcatcataatttaataattgataatccttgttgtgatcataatgtatttcagtcttttggagttttaccaatagctatggaaagctttaaaaattcaggaaaaaaatcgaaaagttgtttaaagtcttcaaattattgtaaaaattcgaatattgttaatgaagaaaataataaatccaatttaattaatacatataattcgaaaacttcaaataatgtaatactgaataattttattgaagaaaatggaataataaacaataaagaactttcgaatcaaacaaaaagtttgaaggatgataatgataaaaataaaaataataaaaataatattaatgacaatagttcatatgttataagtaatgacatattacgagattatgaccaaattgtaccaaagaggtcaaatttgagtttatcttcaccaattattgatattaatcctcctgtttcagctttaaatacttcatcttctcgtataagttcaatggaaaatactaaattgaatgattcttttagttatataggtaaatctcatgagagccaaaaaatttcaaaaaagagcaaaattaaatcaaagatttttagagtaattaataaaataaaaaatagaacttctattattgagaatgaataa

SEQ ID NO: 1040 - DNA, 597 bp, Cryptosporidium hominis
atgatttcgaatgaaggtttgatcacagtatactatttcataccgtcagatggcgataaagagaataatcctaatacatttaaagtgaaaggaactcattcaactcttacaacaaaacaaataaaagattcatttccattacctggaatttattactttagatttaaagtacgtgttgggaatacttacgcatggatggatcctttaaatgatgatgatatcgtgccactatacgatgatgcaattatagcaaaggttttgagaatcaactgggactacaaaaataaatttacccagagattaaataacaaacaagacgcttattcaatttcatcaggagtaattccttctcccaactctttgaatcaggcattttatcaatcacagccaccttcacaggcttcccagccccaccatccatcttcacctcctcctcctcccccacctccaccgccaccaccaccaccgcctccagttttgaggcattcagtgacggcttcagctacaattccatcatcatcaaactcaaataatattgacttaattgacttaaactgtgaacattctaaatggaattcaaattctggatatatttaa

SEQ ID NO: 1041 - DNA, 1914 bp, Cryptosporidium hominis
atggaaattattgattcatatgatgtttatagtaagaactcatggtatgatatttatgatcgatttccagattacaaaatttatggtccaacttgtattggaacagatattcgagttcataatacaagcaatatatatggtgcatctgagcattctacggaagttaatttaccagaatattcaagttcatacagattttataatttggatgtatttacctacaaaaatgataaacctgatgcattatatggttctattccacttgtattgagtgttcataatgatgaaaatgaaaagaactcattcatttctggaatcttatggttaaatccttctgacacatttatggatattaaaaggaaatttaataagattgatacttggtgggtatctgaaactggtataatggattttattcttatggtttctgataattttgactctttttactataattatcatatgcttacaggttttcctactttaactccaagatttggtcttggaaaacatcaatcaaggtggtttaattgcaaagattctgatgtacttgaactatcatctacatttgaagaaaacaaaattcctttagattctatttggcttgatatcgagcacttaaacaaaagaaagtgttttacttggaatattgaaaattttaagaatgttccagaaatgcttggcgagcttgatatcaagggtagaaatcttatagttattgcagatccgcatattagtattgatgataactatcatgtttacaataaactacagaatcagccatatttatctaataatatccttgaagatgacgagaaggttatccctattacaataactaaaactgaaccaatatctaatccttggattaaaattagaaatcatcaagaatgggaagattttgtcggtgtttgctggcctggaaaagttaaatacccagactttttgaatccaaaagttagggaaatatactcttcattttataccaataagcactatcctataatgaattattcaaacattggattttggattgatatgaatgaaccctctgtattttcatcatctgaacttactttacccaagcattcatttcattataatgatatagagcacagacaagttcacaacttatatggttattatcatctaaaatcaacctttaatggacttttaacatgtgcagcacagagaattatcttccttgataatatttcaaatacaaatgaaattgtttcctcttttcatggaagccattcagcaatagataaagccttagctaatgaaaataaaagattaaatgatcgattgaaacaagataagtcagttttgaatcttatttcatcaggaagaaagattttaaatcaggataatttacttgaattgggaaatgttataaaaaatatacaacgtccattcatattaacaagatcattttatattggttctcattgttatggttttacttggactggagataataaagctgattatgattctttttcttcagttatatcaatgaatgtttcaaattcagtctgtggattatcatatactggctcagatgttggaggtttttatggacatccttgtaaatgtttgtttataaattggcataaactatcaatatggatgccattttacagagttcattcccatattgactcaccaaaaagagagccatgggaatttggaggtgaaacactcaaatatattaggaaactagtagtaacaaggtatgaactactttctttttggtacacaatatcttcattatactcattccaaggcaagccaatgttaaagccactaaattggctcttatttgaattcaaaaaccatgatttaattggtaaaaatgaatcaattttaaagatttgtgaatgtcagtcttttctattaggagatacttaa

SEQ ID NO: 1042 - DNA, 525 bp, Cryptosporidium hominis
atgcaaaaatctcctccaatgactccaagctcaatattttcgtctgtatcatcttcttcattctattcatcaatgacttctcagtcagacaatgtaacttcaataacttctttagctgaatcttcaataatctttaattctaaacatatatatgaaatatactctcttcacaaaagcattcaagtttacaatccaacaacaaaccaagtatccaggattaacacaaattacgatgcaatcagaaacaattggatatacagaaatgatatctatttggaaactattagtgtttttggaataatccataaacccaaaattattctacttaacataaacaatataataagtgaaagtaacattaatcctactaataaagtaattaaaaagttagatttcactcttgtaaatctagaaaatattaacgaaagcgaaaccaacaaactggaactttataatgttgaaatcaatgtcgcaaaactcgtaaatcttattaacaataattggaaaatatctatttatgtatga

SEQ ID NO: 1043 - DNA, 870 bp, Cryptosporidium hominis
atggaatcttcccttggaaatctttgtaagctacatggacaaatgtgccaaaaatctagagagaagtcctatgagatatttagaaactgcgatagtggagttttaatttctacagatcttacagcaagaggaattgatattcctgatattgaatggattatccaatttgatgctcctcaagatccttcatattatatacataggattggaagaactgcaagggctggtaagcttggaaaatctataataatgcttcaacctcatgaaggagcatttattgaatatattgaaaagaagactatgagaaagattttgggttataaccatttagaaggagaaaagaataatacgggtattatttatgatggaaattataactctattgaagatccattctataaaaaatcaaacaatttaaaattgtgttactgtactaaactaaacgaggatattataaaaaaagatgaatttttaaataatagttgcaatattaacagagtaggattatgtacaatcagaaagtttatgtatagtgattttgaattttatgaaaaagcaaagaaagcctttgtatcttatattagagcttacaaggagtaccagcttccatttattttcccttttaaaagcctttcaataggagagattgctgcatcttttgccctgcttagaattccaagagtaaaggaaattcttggaaaatctaatatttcaggaaaatttattacaggatctaaaaacattcatcctgatgactttaatccaaacccaaaacctccatctaatattgaaacttcaaaagaccaaagggataattttgaaaataccaaaaaacgaaaagaatctaaaaacattcaagtaaatttatga

SEQ ID NO: 1044 - DNA, 1005 bp, Cryptosporidium hominis
atgaaagacagaaaacgaacacctaagaataaaggaaatgaagagataagttaccgtggatttgaagcgttgaggcccagcattagtgagggaagtttggattttatacagaaccaccttggatttagatttatgtcaccagtacaggaagtaactattccagagctccttactcacaaggatgttgcagttgaagcttgtactggttcaggaaagaccatgagttatttagttccagttgttgaaatccttttaaaaagtcagattcagtcaagaggaatttcaaattttaatatgggttcgctcatattaacaccaactagagaattatcaacacaagtatttgaaatcttagagcggtatttagatattattaatcaatatagagaaaaaggaggttctggaaatgttctaaaatgcttaatttgcattgggggaggaaatattaataaaacatttgattatattaaacaagttgcagaagaagaagcttcagaagacaatagtaaatactatatattagtcggtacccctggccgtatttttcacttatttgagaatctaaaggatggatttgactggaatatcaagtctagcttggaaatactcatcttagatgaagctgataggcttttagatatgggatttgaaaatcatattaatatgattttgcattcaatgccaaagcaaagaagaactggtctattctctgctacattgaattcacaagttcagaatcttattaagacaggtcttagaaacccaaagtatattaaagtatcaatatcctgtaataatcttgaaaaacagaatactaatgagaaacaagagacttcaacatctatagaagatgctgaatgtgatattagtgtcccaattggcctaacatgtttttatgttgaacttaatccgttgttaaagattgaatttctaatcagatttctgcttaatatgaagcgagaacttgaatctggaaaacagattaaatgtattaatttttcctaa

SEQ ID NO: 1045 - DNA, 1275 bp, Cryptosporidium hominis
atgaattccgttaaagacaagtgtaacaacatgcccaaacaaaatcacaatgaatcaaagatttctataatacccaatacagcaccatataagtttatgagagggttaatgtgtttccttactgtttctctttcaatgctatatttgatatttagttgttcatttgccattaaatatagacctcttgtttttgacaatattcttactgagacaataaaaggtactattaagggctcaaatggcgaatatattcagtggattgcgacaataccaacaggattagttagtcgaacagttgctattatttgtgtggtcatgttcttaatatttggagtatataccatgcttttttcattttacactgcatgcaagaaatacaaattcattcaaccatggcattttatgttattatctgcaatgtcttgtgttggtggacttatttcaattttcctttcaaataaatttgcagtggttgaagaatttactcataaaaaggattgtcttctccaatctgtagtttcaaatgactgttctgtagctattggaaacgacgaaatctacgcttatgacatttgtaaagcagttgaatcattttgtttggatgaaaacgcatcaatgtccagatactacaccaaggcaataatagttgcagtagtttctttcatcgtttcagttttaagctttgcctatggaattgtcttactaaaacttaagatgaaatattccaagaaattagctttgatcaatgaaaagaatgcaatttctgaaaaaaccaagttagatcttgaaatgtccaattcatcaagtatttgccaatatgataaggataattctggaattaactgccaaaataaccaaacaggtaccggatattccacagcagataacactaatgtggtgaactcaacaaaaaccaacgtatattacccaaatatgtctaacgattcttgcaaagccatacaaccttaccaaaatgaaatgagaagtataccaatgggtattgttgtaactacgacaactagtaagcaatgtcacattgcagcccaccgaaatgcaaattcacaagttaatacctcaaatatgggtaatattattggtaattcagcaattagctgtgtaaactcgatacatcattcatgccatagtggtaatttaaatcataacaggaatgctcatcttggattatccctcaaacaacaatatcatcaccatcatcatcaccatcatcatggccctaaccatggcaatagacaacatcacaatcaatttctataa

SEQ ID NO: 1046 - DNA, 2571 bp, Cryptosporidium hominis
atgagctcttcagattctttaaattgtgaaaatgtaaataacattgaagaatttgatgtagaacgctctatacattcaacaaagtcaccttctgagctagatgatgatcggaatgaagacattactggaactattgaagctccaaatctaaatattgaattaaatagttctttgaataaacataatgatgaaacgagttccaattccacaactttggagaaattatcaaaaaaaaagaggttcaagtataaaatcgtttctaagtttatgagtttgatatctcatagaagatctggaaaagggtttagcaaaaaccattcaagaagaagatctcagagtattaattataatttaactttaccaaccaattcttcttcaacttctacatcaagacacttttcatttttaagaaagctttcaaagaagaatcgttttaagaatgataaaaccaactcgaaaaatttaacaaatattgagagttcaattgagaaatttgaaaaatcgatttctaagtcttcaataaaattgaattttaattcacttaataatatctgcattgcagaggatgttgatatccaagtgatggaaggtcttgaaacagcttgtaattttaataagaagatttcaactgaagggaattttaaaaatttttttgaaattattccaaccaatccaaaacttgatgaaaaattacatgttaaagatgaagataagagttttgatatatcaagtaaaaatagacaaataaccaatccaaatatgatatgtaatgataatagtaatattaatattaatagcgaaattaatattaatactataaataccttacttaaaaaaagagtttcgatattatccaagccaggaaaatttgaggaatacttgaaattgaagtttgaagagcttgaggaaactaggaaaatcttgggtaattttctaagaagatatgagaaaaacaggaattttttagaaaatcgcaatatagatccttccaatttgaaccaaaagcagcttaacaatcaaagattacgaatgtatgctcgacttgccaataaattgagtgaagttagttttgaatgtttacttagcaaaccaaatgaattaatgtgccaactagtttataataaagatggagttcgggtttggaagaaggaacacaaatctggaagagttttgcttcgtacagaatttattgtaccagttgctcctttggattatgttgaatattccacagatagcaataatagaagagtttatgataataatactgtggatcttaaagtcgttgaaaatattgcaccaggtttagatgttatgtatgttgcaactaaaagaatagcaacagtatatccacgtgatattgtaaatattcggtatttacatggatataatattaagaatgggttcaagtttatgagctggaatgatttaagcgcttcagaaaaaattaatcaagatgaaatgatgtgttgttcttgttcttgctcaactgaacaccctgatgcgccagagcgtcctggatatgttagaatggatttatcaattggtagttatatggcaatcccaataaaaactccttttggtatttggagtaacgtttcaatgttcaatgaagcaagtccaaaagggtggattccatcttcagtgactaaaatgatagctgcaaaaatggttccaggttctgttgaaagtatagtatcatcaatgttaacttattataaatttcctttcaaaaacaaattaaatcgtccattctctggtttttgctatagagccttatcgactatatatgttgatcaaaagaaattggaattaaattgtaatactcttcaagatccaattataaatagtaaaggggtcagcaacggtacgatgaattttattagtggttctaagaatagcaaatcaaattcaaagatatcttttttgttaaatagaccacttataatgagtattcaagattttattgctacttataaatccaactcatttcaggaatttattgaacaatttaatagtgtacaaataattaataaatacattatttccgcttcatcaagtattttgtcttcatgtaactccgacttacttagctcaagcactgatgcatccagaaatattagcttagaggttgatcaatctaagtcaatagaatataatgatgccgatgttaaacaggttgagcatagttcaaaaatttctatgtgcaatttatcgttggataaactaccaaatattactgagaaaaatggcaataaagcttttttaaatcaaattatctcaagcaacggtgcattacaagacttttgttacgattcatcatttgaaagaccaagttcttttgaattttttgaagttcctcataatatcaataaaaagcaagaccaaagcaaagcaatatctcagtcatgcagcaacaatattttcgtttgttgtaatcagattaagactaatcgaaaaagagttcttaaattattaatgaattcctgtaaaatgtatcaagatttcggggcttcttatctaactgatttcagtgacatagctattatttcgcgattattatctttagattaa

SEQ ID NO: 1047 - DNA, 1038 bp, Cryptosporidium hominis
atgagttttgagttatgcgtaaactggccaagagatttaaacaaagcaaaagaattgattcttaaagcttatagttttggataccttggtattgcctttaataatactctgaatttagtagaaaaatgcaataagttaagaagtagcccaaataagaattcagtcagtggcaatattcttagcatcctggctaaagaaggacacgtttgtcctattcaatatattcaattagaaaaagaagaacttcgtggcctgagaaaaagaagtcttattgtcaagtcaaatagtggtccattagttcctaaaaatgcatatttacctcttagcctttcctgccataattttgaaattaataaacaatttggaaaagaagatgatacatctcttgacttttttcaactaagaagattaagcatagtttttgataatcctgattgcgttccttatataaatgctttatccaggggaccatgcaatgaatcttctgatagctggagcaaggctatattctcatcagtaccaaatcaaccctacgatttggtctctgtaagaccaaccacacaaaatgcattaaattctgcaatttcatctgtagaatgcgatatcatttctatcgatatttcatctgctccaagacttccatttattattaaacgcccacaaattaaccttgcaatctccagaggaatcttttttgaacttgatatctcacaatgcatattaaataaaggtaattccagacgtaattttttctctaatcttaatacacttaccagacatgtccctcacaaaaatattattattacatgcaatccatcattcccattggatattaagacacctatggacttatccaacatttgtcatgtacttttatcgctggattttgatagaaaggttaaagtcaactcatttgactttattaataataatgctattaaagcccttgctaaaggaacaaatagacgctcatttgcatccgttattctaattaacaaaaaagaagagcatcctgatcaagaaatggatattttatag

SEQ ID NO: 1048 - DNA, 489 bp, Cryptosporidium hominis
atgactgtctttgttttgtatgtacaagcagattttgagggaattgaagaacttatctttccagaaaactatacatggtgttttgatatagaacaaagcgcaggctcactaactaaagaaagaattactgttgatcctaatgaaagtattgagatggaaaatagcagaggcattgtaaattttgcaatgaaatgggaatccgataagagacaatcaacaattacttgcatcaagttaaataacatatcaagaatgaaagtaactagcgaagatgagggcaaactagttcctgttgcagcttttgattgcagaggaatcaacttaaccaagtggaatccaagctttggttacaatgtcatttcgaattctggaaagaagtttgaaaacattaatttagaagaactcgagtggtgtgattttgacgaaaattctaatgaatctgttggaatttacaatttaaacagtgaatttagagtccacaaaatttag

SEQ ID NO: 1049 - DNA, 996 bp, Cryptosporidium hominis
atgttataccatttgcttttttatcaccttccacaaccacttgaagtatgggtgactccgagatactcaagaattggtgaactcatggctaatatggagaatagcgccaatgaatttgattctgaaaaagggagccataattattatatggaacataatcaaaaaaagatgttaaataagacaattagtagacgaaatgagcgttgtcctgctgaagattattgtacagaaaatgaaacttttttaaatgttgatgaatatgaagccaataattttggttcaacaaatttaatccgtgttaaacagggagtttttcatagagctatcgcaacatggaatctgagaatcacatttttttctctctctttggcaattttttttgcattttcagctctaatttttccattcggactgaatctcagaagagtaatttttaatgatattggtacatcatcaggaacattatattattttgccaatgcactattaagtatttcaccaagtaatttgtttgcattttttacctttatccatgcattacttatttcgatttatgtatttatatacaggaggccagtgatttccagattatctcgtattttaaaaatgagttgttctgctattatggtcataataatccttatcaggtcaatatccacatttattctttcacattattatatgaacaagttcagaagtggaagactgttcaatgataactatccaaatcttaactcatttttggcagattttaatattaaaatgagggcgaaccactctttttatattagaatggctcttgctagtagctcccagtatctatttttgtttgttactatggtgtttatttcaagctactcacttgacattcaccaactacacttatcctctattaatgctttcaaatctacagaggagtctgaatcctactctttaataaaaagagggggggattttgtatctaacaatgacgaaaaagacggtattctatactag

SEQ ID NO: 1050 - DNA, 1392 bp, Cryptosporidium hominis
atgtctagtgatcatttatctaagcaagatgcagataatttggacttgaccaagttaactccaattactccagaagtaatttctcgtcaagcaacaataaatttaggtacaattggacatgtcgctcatggaaaatccacagttgttagggcagtttctggagttcagactgttagattcaaggacgaaaaagagagaaatattactattaaattaggatatgcaaatgcaaagatatataaatgtactaacccaaattgtccacctcctcaatgctatcgtagctatggatcaaataaggaagatgaaccaatgtgtgaagttccatcgtgtaatcataagatgcagcttctccgtcatgtatcttttgtggactgtcctggccacgatattcttatgtctactatgttaaacggagcagctgttatggatgcagcacttctattggtagccggtaatgagacatgcccacaaccacaaacttctgagcaccttgcagccgtagagatcatgaagctcaagcatattattattcttcagaataaagtcgaattaattaaagaagctcaggcgcaagaacaatataaacaaattaaggactttgttgccggtacttctgcgcaagatgctccaataatacctatttccgcagtcttaaagtttaacattgacgttctctgtgaatatatttgtacacaaattcccattcctattagagattttacatcatcaccaagaatgattattatcagatcctttgatgtaaacaaaccaggagaagatgctcaaaatatgagaggtggagttgcaggaggatcaattattaaaggagttctcaagattggagacgaaattgaggtcagacctggtatctataataaggatgctgatggagaatttacttgcagaccaattagatccaagattgtcagtctctttgctgagcataatgacttgaagtacgcagtttcaggcggactaattggagtcggaacaaaaattgatccaactttgacaagagccaacagactatctggacaagttcttggacatcctggtttcttaccagaaatatacgactctattaatattactttatatcgtatgagaagacttctaggagtgcgcgcccatgatggctctaaagcacaagctaaagtgtctaaacttagagaaggtgagcttcttatggttaacattggatccacgactacaggaggaagggtcacaaagattagagacgaccttgctaccttccaactttcatctcctgtttgttgtagcgtaggagataagctcgctatttccaggagagttgataagcactggagacttattggctttggtgacattatctctggagatactgtcaggatcattaatgactactaa

SEQ ID NO: 1051 - DNA, 831 bp, Cryptosporidium hominis
atgaaatatatatacgttatttcctctctaatttcatatattattgtaataaatgcctttgctttacgaaaaaaagaaggcttagatttgggcttgaaaaaaaatctcatccaaagtagaaattcctataactttgaatgcgatgtagcaattgaatgtatgaatatattaaggcgttattacttttttgtggcaattgtttatgagattatttcaacatcaaactgtgttccaagatcttctgacattaaatttagaatatacctttcaaagaacctttctgaattgaattactacaggaactactttgccgaacatataatggataaaggaagaagtgcttctctgtttgaagttattcacgaattcccaaaaagaaaggcattatttttgaatgtatgctctcaaattaaatttatcgatgcaaaagagctctatcttatagagcaaagagttatttcgaattatctgaaaattttaatggaattgaaaatatacattagtgctgatattagtaatttttccggctctccttttctaattaatcaaggaagggaagtaattaaaattataaatatggcgattgagataatattaattactcaacataagattcaagaattagagaaaagttcaaataaacctacaagtatttacaagttgtccaaggtccctcagaaactactggttacaaagatttacaaaagtaacctcattgttcgtatatctcacatagtcaagttaagaaagtctattagagctgataagagcgacttattaactatattagaagaccttgaacgtaacaatgaaatgcccccaaagtattaa

SEQ ID NO: 1052 - DNA, 360 bp, Cryptosporidium hominis
atgtttttatttgaaagacaaaagtgtatacttcaattgcttaaaacaaaatatgaaaaaagaaaatgtgatttattgcctagaataatttctatttcgttaagttgtcgtagaattaagaaacaaattaaaaagttggaaagatcattggaaaaattaactgaacaaattgaacaacttgaaagatatattttgaattgtttcttatctgctataaaaatgttatggaaggaagggcgagaacaatccttcgaaatagatgaagaagctgcaaaagaatgtgattataaagagctgtactcaatttggcaggaaaaccaacttttaaagaaatctaaaacattattaaagtcatttact

SEQ ID NO: 1053 - DNA, 237 bp, Cryptosporidium hominis
atgagcaataagtgcaagtgtattttttcaactgctgatcaaatagaaaatcttataaatgaatttgaggaaaaaattactgaaaaaactgctttcatccgtagttgtacaagatacttaacaatagatacaaatggaactgtcaataacagtgtggttagagctccatcagaaaatatagatgaagggcttaaagaaattatgcaagttagtcaattattaacagggactttctaa

SEQ ID NO: 1054 - DNA, 2106 bp, Cryptosporidium hominis
atgtacttgaatttggccttttttttatgtctacctctcattagtatctatgagtttgggagctctgatttttactttaaattgagtctcattgagctcaaggcagttggtgggtttggtgcaggccaagctgaaagtagtactgaaggaagtgttgagagatcaaatcaggaagaaaatagtgatcaatcctcagaagagtctagtacaagtcagaatgagaaggaaaccggtggagcttctccaatattaaactctaaaagtgaatcagctttcctttctcaaggaaacagttactataaaaagaaactcggagaaagcatattatcttttaattctcgtaatgaattagttgaatttgtattatttgagagcaataaaagagatttaggattatctttttctgattgccttaaagtctcccaagtatatttaacttcaaagttcacaccaaacacaagtgaaaatgaaatcgttgttgatattaaagaactactttcgctgttaagaaagtatattaggacaaatggaagttgtctagagagcttttgtgtcaaaaatcaacccaaaacatccataactagcactgaaagcaccttaaacatcgatgaagagaatgattctgacgcagattctagtgtgaagacaaatcagagtacctcttctgatgcttcttcgggcaaactctacgatggctctagtggtcattcccagcttcaacttactacttcctcaaatagtgcttcaccaacttcaattgaatttttagaaatgcaacctaaaaatgatttgaaattcgaactagtcaaacaagatcaatctactccaacatcaaatgagtttgtacaacctgaagaaaatctgaggactcctactccagaccttaatttgcctgtatcagaacctgaaaatgtgcctactaacgaagaaaatcttaataccgtatttgaagaaatgggaactgaaattcaagtaaaccaagatgaagtcgttcctaatttagacttgaatgctagaaacgcaatacctataacagaggttgagttggaacttgattttgttgatccatggaaaagtttgatttctatgatattatatgacccagtaagaaggtcttcattaaaatttgatgagacacattgtgataaaatggcaaaggttacaggccgaattattgcatttataactaagtatacttgcaaactacgtcttatcctaaaaaactatcgaagaaagaaatgtaatgaaagaaacaaagttacaagtgtattggtaggatgctataaacttaaaaaacaactcgaaaaaaatatcaaatattactctaaattaagatatgatcttgtggattcagttgtaggtgttactcaatgttcactggcaaaaaacaatttcatatctcagagaaataaaactttctttcatttgtctgatggaaattcgtttattcgatgcactttaaaagaatattatctattatttgactttgtaatatttttattctatatcattaatgcatataagtctgcagtagaaaagctggacaaatttatctcaagtagttgtactacaatatgtccaacaagatgtgggaaaagaccacaaatctgcaattgtcttgaagagtcttacaacaatatttttgctgacaagattaatatggaatcttacagacataatctcaacaacagaatgatattgtgcaaaaattatctaatttctaattatttattttcaagtagtattcctgaatccgctgagtatgtttcaacatctggatatagatataaaattgagaattttgagtatatacaaacagttcaattcccaatcacttatccttccagtttagaaaagtataccattctcaaatcaagtctattcaacctactgctaaatcctattaataatcaggaacaaccccccaatcctgctcctgcagccaaggaagtcccaaatagaagtcgtaatttagaaaaaaggccaaaacataggcttaagtccaaatttccaataagaagaaataaaggtaaaaatacaaatattaatcataatactcaaactcatccagaccccacttcaaatccacaaaataattggctctag

SEQ ID NO: 1055 - DNA, 903 bp, Cryptosporidium hominis
atgaacattttttctctaattggaatacaccttcttgtgttctttggcatttctgctaataatattcgattgtcttttaaagagttcagtttgttaagtcttaaggagaacaatgatgtagatatttacagaaaaaatgccatgatacaagtacaagaatgtagtcccgaaagtatgaatttgcttttgggaattgatcaggttttaaagtttgaagcgacttcttactcctgttatgtaaagaacctcacaaatgcatttgaatcatgcaaaagaagatgtgctatttctcgtaatattggaaaatgtagaggaattgagaatagattagctgctgcgaaagaaaagtacaatgaacttttagagcaacaaactaggtgggggaaattattaagttactgcattaagtgtagagcgctgacagaatatatgctcattaaaagcaggggaggaattgcaaagaagagtagaattactagtcgcaattctggtgatgatcctgcatacactccgaaaaacttatttgattcgtatttgacaagagacctttcaagttttgagttgttatatttatcaaggatggatacatatttacaatcgcagaaaaaattatgtaaaacaaaaagtagggctttgtgtagttgcgctaagaaaactcttaaagatctaaaaaataataaaaacgtattacaaagcatcgtaattaaacaagatagttttcaaagaagatggtttacgtttaatgagaaaaatattcttggttcaggagatacaattgattctattaaagaggaatgcgaacatgtattggaaaaagatgctgaaattcagaacggaattaatggaaacttaaacgcaggattcacaaaagaagagttggagcctgttactagtgtactttaa

SEQ ID NO: 1056 - DNA, 813 bp, Cryptosporidium hominis
atgtctatagccaactcgagcaaatgcgcttttttccactacatgtgtgcttatttatttatattgactgtaatatcttttttatgctgggatggatttacagaaatattagaaatgaatcaagtatccttgtttcaagtaggaatgccccaatatcagtcattttcagaagcaaagccattattttctggaaaaggaagtaaggaatataaggattttcttgcagaatttggagttttagatggtttagaaattgaaaaagaacgttcaaacaaagcactcaagaaattgcttttagaacttaagcaaacatttattaagtattattctttgaaaggtctagtgctaagctttaaaaaaaagccaagttctgttgagaaccaagatttagttgaaaataacaatcgaatgcttcaagaagccaacactgagctttcaaagttacttcttgaaattttttcatgtattgtactcaaaaaagcctctaaatacaaaaactataccgtttctaataatcattttgattgcacaatttattcatatgtttattattcgtccatgaaggaacttagcaaaagaattattattttactggaagaaactctctcaagctttagcaaatcgaaattcagttgtcaacaatttaacgtgaatgttaaacaatcaccttgctactatctctttttttctgtcaaggcaatcaaagcttcaatgaccacagagacttcttattattgccaatacaaacgaataaaaaagaattgtgagccctatgcttgtttaagtttacgcaaagctctttcttttagatga

SEQ ID NO: 1057 - DNA, 897 bp, Cryptosporidium hominis
atgctcaagagttcaagtataataaatttccttcttgttttgctttttaccgttagctttacttcaaataactttgtaaagaactttattttggaagtatcattcttaaatgcggcaagtttagaaactggatctgaaagtgaacctgtagctttgcctccacaagatactcaaatgcctcagtttggagttctccagggaagaggaccaattgtccttagcgatttcatggcgaataatggagttggtttagatttatccgtgaaaaaaaaatgtagtaaaagggaattacaaaaattgttaaaattacttgaaaatacaatgcttacattatttgaaatttatggtaaaagtgtaagctcagagaaatctattaatgagcaaacccactcatcgagtctagaaattggtagattaaatgacttaaaagcaaaaacaatttctttaaacgggaaattagaacaattattggcggaaatttttagttgtgttttgaggatgtcagcaaaaagatactctggcaaatcaataagaactaataagaaaggatgcacccttgtttcagtaacatatttctctgctcttaaatctgcaagtgaagcgatcttgtctgtattgaaaaaagtactcagagaattatccaagctatataacaaatgtcttacatcagtccatatagatccaaatttatgccgttgctacggattctcactctcgagtgcccaggattcattttctgcacaaaaacaaatttccaaagattctgcatctgagaaaatgaaatgcaaatgctacgtacgaaatagaataactactagactattaggcggtataagagctagaacgtctggtgaaacagtttttgaggatgaaaatgaggttaatacttatttttaa

SEQ ID NO: 1058 - DNA, 1128 bp, Cryptosporidium hominis
atgatgcattttttaaaaatatatatttattcaattttgtatttaatatatttaattcagcccagaattttggtctctcgattagttaaaaataactatattttcgaacttagtttcattaaggctgaaaaacgccagaatttccccgttcaaatgagaattaaagagagccaagatcaggcacctggagctcctactgttgaatcagttgaagttcaactaaaaagcaatgttgcagatttatcgccttcaaaacccgaacatatgccagcttctcaatttctggctgtttttggtctagatgatcaaatgtttgtaaaaggaacatgtagttcagaagtgaaagatgtatttattaaaaaaacaaaaaagatagttaccttttatttcttatacaggggagaatacaagcgtgattacgatacatcaggaaacagaggtaaagatatgactgttaatacaagaaaccattcagagtttgttaaattaatgacgagatctggtgaagttattatgtttatgtcaagatacatgagcttactcatgaactgtataatgtacttgctttcacattactataggaaagtatcaatatcgtataacgaagaaggttgcacaacatataatattttctttcacttggtaatgatggaaatgattgaatgtattttaatgattcttaggtattcaagaagacagttaataaaactaattgctaaactcgctgaaggaagctatactgactctgaaagtagaataaaagctatagacctcgctttagcaatgattagtgaaacaagtgatattgagaaagaaaagtttaataaacataaagaaaattttgaattatgtaaagaatatattaaacatgcaagctcagcgaaaggctccaaatataaaggaagcaagtttgacacatctataagtggaagttctagctcattaaaatacagcctcaaaaaactccttggtaaaaaacctaagagtaatgaaaagggtgaaaagaaaaaggatgatggggatggggatggggatggggatgacgataaggatgaagaaccattttggaaactcgttcttgattccttcaacattgacgctatgtacgatgacgatgtatttttctga

SEQ ID NO: 1059 - DNA, 849 bp, Cryptosporidium hominis
atgctatttttgtggcttttaacaattttttttgtatttattggaggtataaatgaaaataaggggatcttaaatcataatattaagctgatctcctttttgcatgctgagggaggaaaggatcttgaatctagttcttctagctacttaactaaagaaacaagtacgacaaactcagacgatggagaactttcacaaccaaatagttggtttgttacaaaattagaatctaatgcagaatcttatctagaaagtattggaatcagtcctgatttgaccagcaaagagtcatgtactgaatctcaactaaagaacctattaaaggagttaaaaaaatctcttaagaaattgattctgactaatgagcaagtaaagcattataatgacaataattcatctgggaaatattcaacagtaggttttcaagaatatctcactgaaaaaaaacaagaaatctccatgcataaacagaatatagaatcacttttggaacaaatatttaaatgcctaattttgttgcgtcttgataaatactcccggagaatatttaaggataactcagtaaattgtaacgcccaaacttatactttttttgcagttttaaagacaacctctaaacaacttctatcaatcttaaaaaaactattacataaattcaataaagaatacaaaaattctaccaagaatattacagcaacttttgatcattcaactcttagtgcctctattcaaacattaaaaattctaattaccaaacaagaatatactattagaaaaatcaaacataaaaagaaaaaatgtaaaatgtatatggaaatttcaagtagagatatcagcacacttctttga

SEQ ID NO: 1060 - DNA, 879 bp, Cryptosporidium hominis
atggcaagtttcaaatatatatttacagttggatttgttttaatttctatttacttaaacgcatttaatggtgctatccgaaatgaaaagatcaaatcaatcgaattttcgtttctgaatgcccagggtccgagttattctttacgcgagcctccttctccttttaaaacaactataggttcagtattgtttgctggcaaacctgaaggtgtgtctctcgaagaatttctatctagatttgggtataatggaagaaaagaggatctacaaccagcttgtacaaaagaacagattaaagccctccttagagaattaaagagaatgtttggagattactatctgcttttgggtaaaaacatctacttcagaaaattgagctatactgcaactcagaactcggtagaacaattagatattacaaaatatctaagttcaactcgtcctttatttactaaagctgagtcaatactgatttcactcttagaaaggctgtttaaatgcattctttctaggaaaataaaaaagtattccaaaagctctgattatgaagttttttccttaccttacagtaaatctatgaaggctatttctaaaagtttgttaaaattattgaaaggtgttgaatctagtcttaaagaagaatatcccaaatgtttaaaaacatctactggagcaagtttggtagaatgtaaagctttaggagagtcattggctgtttgtaaagaacatgctcaacatcaaaaagaagtcaaagatggtagatacaaggaggaaaaggccttgaggggtattttaaagagtccacattctgataatagtcgtaggttaccctcagaaccgaaacatgttcaattaaagaatgtttctgtagatgtataa

SEQ ID NO: 1061 - DNA, 1593 bp, Cryptosporidium hominis
atgaaactcaagttattaagtctgatccacctattcctgtttttcgtactattttctgagtttaaatacgatgaaattaattactaccaaataactccgtttaattcttttgttaagcttaaaatatcatctaacttaaatggtaaaccaaaagatactggagagtctaaatcaccacaaagaaccaatcgaggtccttcatatacgctaagaaatacttctagttctcaaaaccctcagtctaatgctcaaaaagcagttagtcctacgcgaaaagtattttcgtggccacctactgaaactacgaggaaaaaaactactaaaccttcttcgcctaaatctctttctgaaagttatagttggcctccaagagaaagaacaaaacctagtattggtcaaggtagagtatcaagtgctgggcctcaacatttagatactgaagatttgtttactgcagttaaagtacaagtcacagaagaagatagtgatgaagaaactgggcctgttacagctaaacttgtggtgttatctgattcagatactgactcagattctagtgattctggaacctcaacttctaaatcatctagttctgactccgattctgatacaagtgttcctggaacaccagttacaaagagatccgttattattcagagtgaggaacaattatctccagaattagctgaaaaagtccagaaaatgaaggaagctagtgaaagaattgttagaaaaaagttattagctggtgatgtagagactttgatgaaaagttcaagatttaccaaaagaatgttgcttatttcaattccattattaatccaattattagaagcaatctttaagtttttaacttcagaaaatacaactatgctttctccagaagtgttcagccagattcaatttcaatcacaatcttccgcctcttcgagcagcctatttcttgtcaatctagaaactgcaaatgaatcgatcaactcattaaaattgaacctgaaagaacaatttcaggaaaaatacaaagtagaatgtaatttgcaatttttgaaaactcaaattcaaacatttttaaaagtatttttagaacatgctgaacgtgaagaagaaatgaggataatttccaatccaagaaaaggaaaagttgaaaatagaattcagaaaatagagtcattttataaacaactttggtccagattgcaaggaataaaaaaagagatgattccatttttggattgctatttaacatatctcgatataataagcactaaaaatatcgagccaacgaaaaaagaaaaatgttcttggaacgaattgatggttttaaatttctttttgacatctttcaagggctttgctatgttatttagagagtccttaacgggattcgaacaagatattgaaaaatttgagaaacttaaagaaaagcctcaagatggattaagtgactctgaaaaaaaaatggtcaaagcacttaagccaactatgaggaagattgaacaacttagatttgattctgcaattgcttcaattatatctagtgtccttttgacaattatgggtaaatgtttaaatcacctgaaatccgaatattaa

SEQ ID NO: 1062 - DNA, 1704 bp, Cryptosporidium hominis
atgagattaaaggttgcgactttaatcgctattatttccctaattaatccattgaatgtactttatcatgttgtagatattagacaaataagtaaatatggcgataataaattagataccaatttttctctattggaaatttttaagaaaaaatcaagaagaaataaaaaacaaacaatttctattgaggaatctgattcaacttctgattcggaaattgaaagtaaaaaccaagattcagtggataaagagaagaaaaagaaaaggaataaattgaggaaaagattgagaaggattccaaacttcttcagaaatctatttagaagaaataagaataaagctaaagctaatggcaaacataaacgaaatagaagacacaaagctgaaaaatcagcttcaatagaagaggaatttgcagaccaagctaacaaaagagtaagacaaccagaaactgatctagaaccagaagttggtttaggatcagactcaaaatctgggcctggatctggatctggatctggacctagatctggacctggatctggacctggatctgaacctggatctgaacctggatctggacctagatctggatctgtacctggacctggatccgaaccgaaagctgaggaaggcataagacccagccaaggagaattatcaattcaaaataaacatgaaaatatacaaaatttagatatttcaaagctattcagtgaagcgaacaatagaaggaagaaaaatcagagttttgtgaatgaattgaaaaataagttaaaacctcaacaaggtagtcatgatcaaatcaaaaatttaatatctgagggaaatcctgaaggacaaaaaataattctagaaatgaattataaagagttttataaatatttgaatcaagagattatcattaacactggtggaatcactccaatagtcaaattggatgaattggtgttattaatcaactttgatcaaatgctcttaaatttggagtcaaaaagtggtaattctgaacagataattaagagtttattccgaactgaaaatgaaaattataaaataaaggtaaattcattgtttaatgtttataaacaagattatggccgtgaatgtacttttgaatggatgaatgatttggttacaatgtattataatgcatttatggagtttaaacatgttgaggaagattaccaacgtcttttggacccaagaaaaagcactccaagcgagagagcccaaaacttgagtaaaacttactattcaatgaaagaagctaaatccaacataagaaaaatacttatgaaatatttaaattgttttatgattacatttttctctattaatattgatgctattaatgttggtgaaaatcaagaaaaatgcactattcaagatttaactactctatcatactatcaaaatatctttttagcattgaagaatttatttaatttagtattcaaagaaaaagaagctgaaatatctgagttcaatacaatgcttatttcaggaattgaatccttatcagaggaaaagcaacataaatatagaatattttctcgactttcagaaaagttatttccattatataaagacgctgatttatatgaaaaattaattagaataattgatgtaaaactctcgtcatgtttaacttatattgtaaacaaccaagaatcaattgaagaaaattattcaaaattttag

SEQ ID NO: 1063 - DNA, 3375 bp, Cryptosporidium hominis
atggaagagattgtaactctattaggtcttagtacgagcatcaaccctgctgatgtgaaaatggctgagaactccttaaatatgaaggagggaatgccagggtttattgaaactttgctcatgatcgttactaagaccgatattgaattacatattagacaagttagttgtatttatatgaagaatttggtcaagagaaagtgggatattgattgggaacatggtgggatgaataaacacgatagggatattattaaaggcaacattgtgaacgtatatatgagcacaccaaagatgattcagtcccaaattggtgaaatgcttctttatatttctatcagagactttcctgtatattggaatgaccttcttgtcagtatcgtcaagtttttacccgatgagcaaactgatcttctttccaataatgggatgtttcttgggagtgatttgaatgcattggtttctaaattgcaacaatatgaaagcaccctttctatgattaaattaattttggacaaatatagatatgctgaatcctcaaacaaggtcttgcttgagctgaaggaaattctcaaggtggtttgtgagcctatgtatagaatgtttgtttattcttctcaatgcctttttagaagacttccggtaatccaagataatacaagcagacagttggttatgaatatatgcctcttaagctgtcagctcttttatattcttcattgctgtgatattcctgaattttttgaggatagaattgggccatttatggaatccttccaagctattttggaattagacactactcctggtttggtggattcagaggatcagcttattatctgccttaatatcaagagccagatatttgagaatttaaggatatattctgataggtaccaagaaccgtttgatatttatgctaggaagtctctttcaactgtggcaattctgcttacaaagatggtttctcagaataataatactgtagatacaaatcctgaattgtccagttctatatcttctttaattgatgaaggtctaaggctgattggttctctagcagctacacaatggtctgataacgcctttatggattctggagtattggatcatcttgttgagaagatcctcataccttgtacatttttggatattaatgatttaaacataattgaagaaactcctaaggactttgtatacaaatacctttgggatataaatgacgtttgtgactcaacttccaaacgatctgcagctttggaatgcatcaagaatttggggaagttctactacacaaagctgagtgaactattgagtaatttgattatcagtctcttgaatggcatttcagatgatgtgcatggaagttcatctatctttgactgggaggagtttaatgagaaaagcggtaattactgcaagtatcaaatcactaagtctgatgttaccagagaagcttctgtattcttattcatttgcttatcagtgagatctttttcgaagattggaggagttgcacatttggagcatgggatagacattgttggattctatgacaactacattaaatcttttaccagctctcctttgatgcgttgctgtgctttaaagtacctgatcgttttcaaaagtcatttcaataacgcttcttccttggatattctccagcagtcctacaattggctttctactcaaacttccagcattgaggaaatgatgattttgttggcatttgagaggatattaacccaaaagacagcatcatctactggaaacccttcaattcagggtggtggaattggcgcaaatactagtatttgcacacctaatgataattcaaactcgggaggagctttattaaaagtccaacaaggaatgggtagccaggaaactgtttttaagctttccccaacagatacatataatctatgtttccagatgattgggaatattcttcatccaatgctcaaaaaagccttccaaggaggagataaaaggacttatttgacagagagtgaatttattcctagatgtatgatgaggctcttgacgtatttaggtaagcttgggtccgaattggttaatactttagctcccaccattgcggagtgcacaaagcttgcagtggagaatccaaagaatccgtccttcaaccactatttatttgagcttcttggagtctgtataagaaattcttcagattgtgaaaaattggataattttgtcctaccaatactcattggaatcttagagaagaatctaacagacttcattccatactctctacagctacttgctcttaggctagacaccttagctagccagaatgagctttatgacaagctctttatccatttgattgatgcaaagatctggcatggacctgcatctgcagtgcccgggattgtccgactctgcagttctttcttcaagagacattcattatttgaagccaccatttccagccatgttaagcaggtgtttgaacgcttccagttttgtctgagccacaggagattccaatcaactctctcctttgaattccttcgagacatcgttcgcttccttcctttccaatggtattctcagtacttgaccgcactagccaatcttctacttactaaatctcaggagtggaatcgaattggagaccatcagacaataatccaagtcgttggagcattttcaataattgtaattaaaaagccgtatggagagatgcaagaaacttctcttcttaacgttctcgatacacttcagaatgggctctcgttcatcttcttcagcaaggtggttttcccaaacctacttaaagccacgctttcgcctcctctcagatatactattttcattgcacttttgaagttggtctccgaactaacatttgaacggagcaaacgcaatgactttgttcttgaagcattcaaatcagtttaccttcttttcaatgcgataaaactttcggatgacccaaacttccagagaagaaattccatatctactgaccttagtggcgtctctgatgactcagctcaaaacaactaccttgctgttctccctgattcaaatttagactcacaaaaccccattcaagatgagtttgagattaattaccacaaacttctgattgcgtcttgtcattcttccaataacccttatcccagccataaagaaattttacagattctaactagcggaccatccagtaccagtattggcgccaacagtgcgcatgcatgcaatttcattgattgtataagaaattcagagcaattaaatttgatgaagattacttttcaaccatatttaaatgagatatctaatcattttgttggtgatcaaaacattcagagttttattaattctctcaagtaa

SEQ ID NO: 1064 - DNA, 1686 bp, Cryptosporidium hominis
atggataatacttccttacttagagcggaaggagggtttgtcccaccggagagaaattcaaagctatatatgatgcttttgattttaatctcttcctgggctaactcttgcattacaatgatatggccgttattagtggttggtgattacctaagactcccttttcaggcgataatgtttttaattgagggtttgctttgctttttcttgggaatgacctcagacttgaagtctaaaaaaacgtctttaaagtattcgttaaagataatgttgggatcagttttggcagtattattaattgtagtaacgaacttatttattgaaaccaaatttctcaaattggatatattaaggtattctggaagaagtggaggcttttatgtttttaatagcgaaacattaaatgataatattttaatttttgatgaaacaacaaatattatgaataatattcatagagaagaggctgatttagctccaggaagctctgaaatgaattttggaaacaaagttgagttggatgaaaataattcaaatttacaattaaagcccgatagtgtttctgtgcttgtttttacattgatacttttcgccatatgctgtattttacaatcaagttccaatagtatgtactacaatttgaacattttgattgtggatagtagtattgacgattacaacactaggtattctaattcatatattgattatgcaggatggagcgaaatttgcttttataatattggaagttacttaagtttattaatttcaagacttacatttatatcgattttagagttattaacccaaaaaaatttaaaatttagcaacaggacaattgaaattgactatattcatatctattgctttaatttattggttttactaataatgattccatttggatattacttagttgaacataaactaaaattaaatttcacaaataattcaatttaccaaattaactatcaaaatattaaacaatattcaacaagcattcaagagtttatgggagataaaagtaatttattttggttcctagtaattccatactggataatatatttcatacaatcaggtaataactttcacaagtggatagtaattgaccaaacagcatttaatattgagtggtgggaactttactcatttatatacgaagcaattatatcgttgatattgtcgatttttcttgcatatatgtccaacaaattttctccagtaattctccaggtttattgttttgccattctgtcaatggtatcatttggactaaccctatgtacatatatgctccatgagattccagtcaaaacctttactgactttatttctgctttcacactctgtcatggcatattccacatcagttgtgtagttccctctatcaatgcactctacttttcaatcaaattcacaccttcagaaataaaatcaatggttctagcaataattcacactattttgttgtctgctcccatacttgaccaaattataaacaactacagttttaagttaattaatatttccgaaaaattcttattaattactgcaattaatctcattggaataatttatacaggcctttttatggccaaacaatctatagaagaaagcagtttcagaacatcgctagagcttttgccagtatataactaccacgaaaacaaaacaatcaaatga

SEQ ID NO: 1065 - DNA, 1296 bp, Cryptosporidium hominis
atggaggtccgagtgggaggaaaatatagattgggtaggaagataggaagtggctcatttggagatatatatttgggcacaaatgttacaaatagtgaagaggttgcaatcaaactagaaagtgttaaatcaagacatccacagcttctatacgaatcaaagttgtataaaatactagcaggtggtataggggttccaacagtgcattggtacggaattgaaggtgattacaatgttatgattttggatcttttaggcccatctttggaggacttatttactatttgtaatagaaaattctccttaaaaacggttttaatgcttgcggatcaaatgctgaatcgtattgagtttgttcattcaaaaaacttcatacatagagatattaagccggataactttttaattggtagagggaaaaaactcaatgtagtatacattatagactttgggctcgcaaagaaatacagagatcctaaatcccaggcacatattccttatagagaaggtaaaaacctgactggaacagctcgttatgcttcaattaatacccacttgggaattgagcaaagtagaagggatgatttagaggcattaggttatgtacttatgtactttaacagaggtacactgccctggcaagggcttaaagcaacttctaagaaggataaatatgacaaaattatggagagaaagattgcaaccccaatagaaacactctgcaaacatcatccgtttgagtttattactttccttaactattgcagagctcttagattcgaggatagaccagattatgcctatttgagacgattgtttaaagacttgttctttagagagggctaccaatatgacttcatttttgactggagttttctccagccagaaaaggacaggagaagaacaggaaattctgtaggtgtcggagtgggcgtcccagttggagctgctgtagcaaatgctggagcaaatggccccatacctacaaatggaatgggagttggagttacacagggaaatatacctgctgggcagtccaccaatgtagtagccacaggaacaggaactactactggtgctattcttcctcccaatgcaagccttcctaaccaagctggtccttctcaatgcatgatgcctgggggtccctccagccctgcaggaatcccagttgccgggggagcaactcaggtaacatatactcagacaaatgcaaactgtgtagcgggtgagggtggacaggatgtttatcatgaatcacaacaagatgaacaatggggaggagttgtcaaataa

SEQ ID NO: 1066 - DNA, 2274 bp, Cryptosporidium hominis
atggattaccaagaacaagaaaaccagactggggtccgcttcaattggaatatttggccatcaacaaagctggaggctacaagagtggagatccctttgggatgtttgttcactccgcttaaagagagtagcaagctgcaacttgtggaatatgagccaattcgctgtagagcatcaggatgtattttgaacccatattgtccggtggatttcaggtccaaagtttggacttgtccattttctttacagagaaacccatttcctccccattatgctgagcacattagcgagacggtattaccagcagagctaatgtacccttctgttgagtatatattacctggaatccctgcaaataacgtcagtcctcccgtattcatttttgtgattgatacgtgcctaattgaagcagaattgacagaacttcgtgactcgatccagcaggcagtttctctaatgccttcagacgctcttgtaggtttaattacatatggaacagtatgttgtgtgcacgagctagggtttacagaatgccccaaatcatatgtcttcagaggcactaaagacgttacttctcaacaattgcaacttcaattaggtctaacttctcgtggagacactcgtaaccagatggctgagggatcctccagaaggttccttttgcctgtttcagaatgtgaatattccttgatgaacatattagacgatttacaaccagattcatggccaattcctgctgacactaggcctcagagatgcactggtgtggctctagcggtagcaacaggattgatggaagcttgttgcgtgcaacaaagtggaaggatcatgctctttgttggaggggtatgcacagttggtcctggaaccatagtttcactcccactggctgagtcaattcgccatcacttggatcttcaaaaaaactctaactctgcaaggcacgtgcaaaaggcccttaaattctactcctccttggcacagagagctgttcaaaatggtcatgcagtcgatatccttgcttgttctcttgaccaagttggactgcatgaaatgagagttctatgtgaccgttctggaggtcatatggtaatgagtgattccttcagtatgaacatatttagagattcattcaagaaaatgtttgagcctgatgcttctggatacattaaacaagcctttaatggcagagtggaaatcctttgctcaaaggatgtcaaaattaatggtgcaattggtgcatgcaccagtactggtaaaaagggcgcccacgttggtgacaccatgataggagaaagtaatacatgtgagtgggcatttggcgccatggataaaaatactaccgttgcattttatttcgaagtagtagcacagggagtgaatcagattcccccagggaaacagtcttttatacaattccaaactttatataatcatccatctgggcgaaaaaggctgagagttaccacagtttcctatagatattcagaacccaatattttggatttagcaccgggatttgaccaggagtcagctgccgtacttatggcaagattggctgtatctaaaacagaaagtgaagatggattagatgtacttcgttggcttgacagaaaacttatcagacttgtttcgaggttcgcggattatcaaaaggacgatcccaactctttccatctttcttcggagttcagtatatacccgcaatttatgtatcatctccgtagaagccactttcttcaaacttttaatgcctccccagatgaaactgcatactacagaactgttcttttaagggagaatgttatgaactctttagttatgatccaaccagccttactacaatactcctttgatgaaggtcctcctcagcctgtacttcttgatgtacaatctcttaagcctaatgttattctccttcttgattctttcttccatattgttgtctggtacggagaaatgatccaccagtggaaagagcaaggctatcacgagaacccagaatacgaaaactttaagaatctattacttgctccagcagaggatgccaagtctatccttcaggacagatttcctgttccaaagtttgttctgtgtcacgcaggaggttctcaggctaggttccttcttgctaaagttaatccttctgccacccacaacaccctttcaggtgccacttttgattccgtctctgatggatcaattgttatcactgatgatgtctcgcttaaagtattcatggagcatctcatcaaactcgccgtacagtcataa

SEQ ID NO: 1067 - DNA, 3300 bp, Cryptosporidium hominis
atgaagattccaagaatttctaaaagaggctcaaatcaactactgttatcgtttttttctggcctatttttacttaattatgtgttttccacaaatacaacaaaaattgcatgtaatgcatgtatttaccgaccagtagtttccaatttaaatactcatttttatggttcaaaatctaacattgtggattttgagtttcaaataccttgtacattctatagcccaatgataactgtttctgttccaaaaagctacaaaattaatcaattgaagttactcccatctagtaatattggcaaatttgaagattacgaaactagttgtttgaaagaaaatgaatcttatctggaacacaaagttgaaaaaggaatcgttgaaaagtctagttctattgatactaaaaattctctttttgcatttgacaatatagtaaatgaacaaattccctcttgtgatcttggaaaagatgctgagaatgagttacttcaagtatttacttctttgggattccaaacttggcaggtggtttcgcagaattcaagtaaatgcttggaagtaccaaaatatgaaaccaaaggtacagaatcacttaaaatgatgggaaatcttgcaaatgggagttatgttcttagatttgacttacagaatccaattaaagaagaatttacaggtaactggaatcttagtattacaagcacaaaaaataacttcccaacaacgcccttttgtttaacatatatagatcaaacttcagtttcgagaactctgggacctatgttgggtccactaaatgttaaaaatgctacatttaattcgtattatactggtagccaaaaaggagaattcagttttattataaactctttgaaatggaatggatcaaataggataaatcaacagatatcagaaattggagaattagagccaattagaataagattaacatttccagcctgtgaaaaccaaaatgattgctactcaattaactcaaaaaatagtgagacattttgtcaaatatatgggcataaatatgaatgttatttggaaagaaaaaaacccgagctagtattaagcattggattatctgaagcaatagataataataacctaaatagtatcttcccccttaaagttgaaatcaaggatcttgcaattccattcaggtcagaagcaaactacaaacttaaaatcgaagttttgattccctcagctcctatttcaaagcctgagtttctaagtttaaacgtatctaccgttgaagcaattaccaaaaagaaccaatgtattggtcagtggatcaagtttttaattaaagaccaaacagtttcaaatttaatgaataataataatagcttatcttattcatctgtctcaattggaacatataaactccctaagacgagagatattgacatacaaattagatatagagtaagtaattcagaaacatatccaattttgttaaggataggtaagatgaatgacaagattcaaggaagctacaatattcgggtaaaacctcttgttgagggggcccagtttgttaagaaagaacttgaccaaagaattggatattcaaatgttcttttgaatgccttgatatatgataaatccagacttcaggaggaattatccattgagtttgagacaaaaactgattctattttgcttaggaatgtagattcagataatccattggaatgtattttattagtagaaggacccaaatctaaaagaaactcaaaatatcaggaaaacatatttgaagctcagaagaaggaatgggaggtggaaatcttctcaattggtgatgaaattgttcaagatgaagaagaaaatgtacaagttatcacaaaaaaagttctattgggggagattcttgatccaagggaaactgaagtctctgaaattgggggaccttttgtattcgttgacactaaagaaaaatattcaatggtagtatatttttttttaataggacatcaatataatagaatgatgacaattagtatgcttattccaaaatctattacagaatacataaacacagatttgaatgttcgggtaatacctccagaatcatatgatgtttctaaaacattttcgggcggaagagtcaaaattacaaaatatacaaaagaaagaattcttgctataactttggagtcaaatgaagggtttagagaaggatggtggggaatttcaatagatattacaagacctgttgtaattaattctatggatttaacagaatatgttgagtttaatatttcaagttcagtttctaccatggattcaccttatcttacatctctcttgtttctaagcgtacatgaaaattttaaggggccttataaaaccccagttgcaaataaactacaatatgttaagggagaaaattatatttttcaggtaatatctgttcaacaaagccacatatcctttcatccttttccaatgctcaaagatcagattgtagagctagaaacaaattcgccaaattatttagtcactaagttgatgtatatggaaaagtttagattcttgtatataatttctgagccttctttagatggtaaagatattgatatagttacaagagaaataggtaatttgggatcttcttcttgtcaaataattctcgtccttgggaatggatattttaagggttcaaaatgtgataaagttgtgaaatactcaagattggacaaggaaaaaaataacaacaaaagcagtggatcgaaggataaagactttgctctagtaaagaggttgctatccaaattcttaagttcaaaagacaaattcataatgagtttgataaccttggttattgaagaagacgacatagaaacatacgataatgaaatatattcagcagatgagacaaccccaaatgagagagttaattataattttatcataaagaaaaaaagtaaggtaaatacttggaaactgagactagatcccagtccaacttattttgagagttactatcaattcaggaaggcattaatttcaactcattattataatttgtatacagtaccttcaagcatacaagcattaaaggtatgccctccagaagttcctattctctcccaagaaaaaacgtccagtcagcctttggtgttgaaatacaagttctttagtgaaataataagttcttataattactcagttactccaaatattccagggacctgtataaaacagaggctgataacatcaaattcaatagatagaaagataccaggggttttaacgatatctttagtattgcttttaatattaatctga

SEQ ID NO: 1068 - DNA, 5232 bp, Cryptosporidium hominis
atgaaatcaaggccaaatggctcgagtacattatcaaatattcttcagcaatatagtgattctgttagccaaggagaaggagttgggtacattggaatcgagtggaaggggccatttcctcttcataactctataattcagcatgtaaaacgtgtacaactactcataggaaaaacgccctcacttgtatacggtgtaattccaaatataaagtatggctatgtaggattggaaaatatgttgtatatattccccatagaagaaacaattcagaaagttttaagaagagaatcatccattggttcctctactgaaagacgtagcactgatagaatgagaagtgctccctctatctttgaacaaggatttgatggaaagccagccagtgatgagtcaatacttaccattgtttttccattttcaataaaaaacatgacaggaacttttcctcgagttggtattttcaccagtgatgttgagtatcttctgtgtgtcattacagagaaatctgttcatttgttagctctgaaatttgataactttgatttggcaggtgattgttcacaagcatatgacaatgatagaactgttccaagaggagctgggttgataaaagtcccaataatgaatatcaggggtaaggatatcggaatgctccaatgctctcttcctggctctcacaattcgaagttccattccttgcaaggtacactggatggcagattctttttcttagaagagaatagttcaagtatccacgagctggtctaccaatcaagtgaaggttggataacgccttattgctacatacattctcatcagatttacagttcatttacaaaagaacttttcttgaaatatacttttctgagatttatgcccagatcattttcaatcaaaaaaatctctctggcaccctgtggcttcatgtcaattcttgatacatctcagaatatttatcttgctgcttatttgaatgacattaatagcaaggaagttctttcaaacattattccctggggtagaatggtgaattctttgggctactgggcatctaacctggatattaatagttttttcttgccaacagactgggataactatgtttcatctgagttccaaaatagtgaaaaactcttttcaaaaactgaaaacctaaatcttgaaaactttagtttgggtctctttaataaaaacgattccaaaagattctcttctccgagttcattgaaagttgttgcaatgctgaggaaaaaagatatctttgacattttctccaagataccgggcaacccattattcaagaaaaacgaggagtcattttctatgtattcaattagagccgaatatcaaaatcaatttgatataaatgacctccaacttttttttacttctgactacaatctctccctttcactgtttaccaacaatggcacaagattgcaattccaatgctctaaaagaacaaatgaagtaatgccctccatccagaatgttataaatggctttagatttgagcccgaaagtctttttgagtcgcctaaaaaaaagattcagactgaaaccgcttttaatcaatcaaaattgagttcaagttcatattcatcgaacgatttaacttttggcttttggctgacatatgttcttcctgcttcaagctctagtaatgagaattctaatatatcaaattcctactatagaaatgggctcacaattattaccaggaatgcagcatcttattcattccaaaatgttaatgccagtaccgacttttcaaaaacttcgaacaaaaatatttgtcaagttgagcttaggctttttagttctcttcctgctgatattggaattacttcaagctccaattttaggaacaggactttgaatagccaaaattctccaactttgagcctcagatataatggaaatttctcttctgcaagccaatgttcaaaaggagaaccaataattattgagtttgacgagcaagttaaagcaattcacgaatttactccttactctgaaaacaataacaacaacagccttaataatttggaagattttcacactttagcctgtaaaaggagcagagcttctccaaatgtttttcttgagtatggaggaaatccgctagggaacaataatagacagcatgatttacttggatgggtcaaagataggtgcatagtgtttgtaggtgaaaccagatatttctttttagtactgaaatggaatggccttcaacaaattgttggggcgagtggattatttatgcaactaatacagtctcctctctcttcaagtacaaattcgagccaatttagaagacttgtccatccagaagattcatttttaactgatgaccatctttctttgacatccccgtgggttgaagctctttctggagcgatagcttttgatcttaaaagtgttttagagctccctccattttataagtatgaaaataagatgcaattgcaattgacaacccaaattcttgaattttgcctttcaaagctacaaggtttgttgaatattctttcgaggtcgcaaaatataatagggaacgaggtttttgaccagtcttcgctcccttgtattccaccaactatgagccggcccttcaatcaaattctgtctgaagagctaaataaaaactatgatacccatctcaaagactctacaacgtttttgttgaagtcagtggcatacataaccaactttttactccaattattcagatttctaactttatttgattcatctccacctgagctaaaagattttacgtttaaaacatttgttaaacatgatcagaatttactaactgaaatgccaattctatatttgattgtttcaaatacaggagtctcacagattaaaaagtttgtggagtctttttcggttaatattttggaagcgatttcttatcaagatcactctataatagaaattagctttgtcacccaaattaaattaatatataaaaagattggttggcttattaattcaaagtcaagtaaaatcatgaaaagacttgcattggttgcagacttgtctatagaagttggagattgcccgtctaataatcacttaaaagagagttcaatgattgaaagaatatcttccagaaatcttcctccaattggaggattttcacttccacctttcaaatactgggaatactttcaagcagatccatcgcagaatgaatattttagagaaatcttttcatcattattgttgaaaccattcaataaaactgaagaaaccactctcctgcttttagactgtatatctcactttgatcatcttttgactgagcaattgaagttgaaacagaatttcattggatcagattcacaagaagagttcaatacccaaaactataatatttactttttacacatcgaacagattattaaggcttggtctgactctttgtgtgacgcatttatcgaatcatttgattgcaatgcttcattatctgaaataagtattaattcaatgaagtctctgattctccttagcttcagtcagccactaaagacgttgttctcatcttgctttaataaaaaggttctggagtcttgtgtggctcgccttttaagagatttattccctgtaatgatgagtaggttcattgctacttttgctcggaccgacaaaagaaattcatgttgctgccaaatcctattggaggatatgatcgaaatttccagatatgactcattacaaagaactagatgttcagagaagtctcttttgggtattattgccttctctatttctaaatcattcaagtcattaaattctaatcaacaccttaaagagtataactggaatgacttctcttcatttttatatggactagcagctgaaagtaattactcaccatattacttcattctttctactatttacttattagatgatttccaagaaacacattctggatatatcaaatgtataaatatgttatcagagctttctctcaacaaaaatgtattatgtggaagttactgcaaaaatgtcagaaccagaattgaaaccttgaggttcataaaagaaatctgcattgtgggagtaggaaaaggcttaatatcagtagatatgaatgtttcacaactccttccaaggcttttaactgagtcttactttgacagaaatcaattccaaatggactactctcttgaatacgcaatttcgaacttggagggaattatttccctttgctcaaatcttcaaattcctttgctagactatattgaaaagctggcatataatcaaggccaaacctttaaccaacttatacaaattctttccacccagatatttccatattctgaacttaactctctaatcaaaagtaactcatacatagaaccatttttgattgtctcaactttacttgaatctagtgtgtcaattaagcaagaagacaataatatagaagatctctgtagccaaatttcggactatctccttcaaagccttattcccccaaaagatcatgtaatttattttcatttctcagatcgtgattatggatcacaactcccaattctgagcaaattctttggtttgaatggtcctgataatctttcagaatcgattaataggttattagagtttattcagacacctttactcaacatttcagggtcatcattattaggatctctttccgttactccaaagacttacctttgtgttggactatcaaaccaggaaatttttgaaaaatatgacctttttcaacaaatttattcaatcacagcaatctttgaatttactaattattatatctcggcattatcccaaaatataactgatccttgcaacttatcccagctcccaacatccatttcaatacagctttggaataaatcatggtctgttccatatgacttgctttttgacgtctatatttcattactagactcttctttggcttccaactcgtcgtcagatccatttatgctaatttttaatcgaattaaagcccttgaatcaccaattttcaaatttgagcctattttaaaccaccacgatttctttattctgcacctaagaaagtgcgttattggaattcttgacaactggattaaaaataggaaactcttcccacttaataaaaatcatatttctatggcaaataactttttaattagtactttagcttatattcaaaacgcatactctgctgaccagtctcagaagcttactagtact

SEQ ID NO: 1069 - DNA, 1017 bp, Cryptosporidium hominis
atgattagcttgatcaatgaaggtgacacgtcattaccacagtggaacaatatgatggggttaaatagcgatagcgatgaaagcgagaatggctgggtgcattggtattgcggattaagagaacattacttctttatagttatcccaaacgaatatacaagggatgctttcaacttgtacggtttaagacagtacttccctaaaaactatgacagcttaattgagttaattttgtcatcaaatattccagacgaggatgacttagcggatcctgctctacaagatttacatagagaagcaggggaattgtatggtttaattcacgcgagatatattactactcctagaggtctacagataatgaaacataaatatgacaaaggatgttttggaaagtgccctagggtactgtgtaatggatacaaagtgcttcctgttgggattacgaatgaattaagaagtaggagagttagggtttactgcccaaattgtcaggaagcatacgacccaagaaacgttaatctaattgatattgacggtgccttctttggtacatctttcccacatattttcttgcaagtatatccagaatacatttcgacatcctgcccagagccatattatccaaagatttttggatttagagtttcagacaagctaagcatcattgagcgaaaaggcattaatggcgaatatggtaagagagcgcaagttgaaatgtttaaggcgaggccttcatctgttcagcatatagaaaaaccccagctgctaaatattggaacaggaaagcttccaaatttaatggtagatggttctaatgtaaattcttcctctaatcaggataatttgaattcaagaaattccgaatataactcaacagcttcttctaaaacaatcaagtcttccaatacttccaatgcgaatgttttggcttaccatcctgaagatataaacatgaaccaaatgccatataatttaaattcagcaagtagaagttgtagttacagcagacaatga

SEQ ID NO: 1070 - DNA, 1710 bp, Cryptosporidium hominis
atgatgcttttgatttcttatattatttttatttatacatggctaatgcttttcgaaaaagtagatggatcctttctaacaggcaacaatattgctgctgcaataacaacaaaacaaggaacgaaaagtaatacgggcagtattttagggaacgccaacagtatggatacaatattaatgaccgcaaaaatactttccacagctgataccattcaaaagtcaattcaaaatgaaaacaaagaccagagagtaaaggctagtggagcagaagtcggccaagagaacttcaccgctttaaaaggtcagaattccacaagagaagaccttataggatcggggattcagtattgtaatattgacaaagatggcctttgctgtttaatgcctaattactgttctaaagaagcaacctgtaaatctgatatagttggccagcagacttatattgactatttgaatgcactcccaagatgtcagtgcctgccgggatatataggagatggaagaactaaaggcacaggctgtcagaatgtaaatgagtgtttgacaggagaggcaagatgtgaacagttatgcacggattattctcctggatatgcttgcagctgcaatatgggatacaggctcaatactaaagacatgagatcctgcatagatatagatgaatgtaaggaaggaagtcatagctgtagccatatttgtgttaatacacgaggaagttttgtttgcgagtgcccaaaaggatatacccttgataagaaccaacaggactgtatagatattaatgagtgccaagaaaattcagggcttggaccatgcgaatttggttgcaagaatcttccgggagggtttgaatgccaatgcccaagcggttacaaacttgataaaaaaactcaaaaatgtattgatattgatgaatgtaaggaagaaaagaatttatgtacaggattcggtgaggtttgctttaataaaaaaggtggatttgaatgtaagtgcggtactggatttcaatatgatgagaatgagaatgcttgcaaagatataaacgaatgtgtactaaatactcatgattgcaaaaaagattcagtttgtgtgaatgaggatggtggtttttcttgcaaatgtttagagaagggcttcgagtttaataaagaaaaaagggcttgtgaagatattgacgagtgctctaatggcgattctaagtgtgatcagttgtgttttaataccataggaggttataggtgcggatgctataaaggatttaggctaaatttaacaggccctgaagagaacagattagacgtaaaatccagagtttgtatagatatagatgaatgcttagaatcaccagaattaacaggttgttctcatggatgcataaacaaaagaggaggtttccagtgtacttgtccaaaaggctttcagctaggaatggatggaaaagtttgtgaagatatagatgaatgtaggatgccagaaaatccatgcgagaacaataggcaatttccgtgctgtttaaatactctgggaggattcacatgcgtagaacaaataatgtctggagatctatttaaaagacatgaatgccctaaagctgatggagatagcattaaaagagaacctagaactggaaatgtaaacaatagcagtggcaaatttaaatggttcagatcaaatacagatacagtgaatagattgaaaacaaaataa

SEQ ID NO: 1071 - DNA, 504 bp, Cryptosporidium hominis
atggaaagggatattagattttgtccagaatgcaataatatattatgtccaaaagagaatatcgaacgaaggaaacttttgtacgcttgcagaaattgtgaatactttagttatgccgatccaaccaatgctgaagaaaacgttgtaaactgtattacctatcaatatgaaggaaaggaagatattttagttgccagaggtttgcatcaggatccaactcttggaagaactcttgaatggaattgtagaggatgtggtcacaatgttgccgtcttttttcaactccctgagagagtgtgttcagaagctatgactcttgtatttgtttgtgttagctgtggagaatgggttaaagaagggaaggagaccgatgatgaaatggattacagtgaagaccacaccaatatttttaataggccatatttcaatatagataatatttcattcgaacccaaaaaggaagaaactgaggaaaataactatcagcaaattaaagagggctga

SEQ ID NO: 1072 - DNA, 3411 bp, Cryptosporidium hominis
atgcggaatttgataaaagatattgagttgtatcccacaatagcggacaaccatttaagatttatagagtcgaatattaagggtgaagcagggttaaaggaggtagagcaactatatgagggcgcactttctgtgtgtggattgcatcctgccgagggaccagtaatatggagtcagtatcgacgttttttaagccatcaaaatgaggagaatttgtctttaagagtgagtaaagtaagggacttattttacaggcagatgtctttgcctttaagcggacttccagaccttctggatgaatacaggatttgggaagaggaacttccagccgaaaatagggaatcttttgatgtagcaaaagaacactatttgagaggccagcaggaatggagtttaagaaaaccattggagatgagagttcagactgataatgtgtcgaatttacaagagttgtttgatgcctggatgctctatattaactttgaaaaagataggatgctttcaattgactattcaagtaacgctgtgcctcctcaagagtctcattctggctgtaataactgtaattcctccattaaatataggttcgatactaaagactccgttattatggcttatagaagggcacttgatgatttgggttcaataagaattgatctttggctagagcttgcgaattttatttcaacgaccacaaattgcccacatttactttccacagtatatgcttcttcgctccaacatttttctaccaacccaaagctttggatgttttatctatcagctaaagcagagtcaataaaagatatcacatctcacttttgccaacttcatcatttttatggtcctggatgcaaagcccgttccagcgctacttggtatccacagaattaccaaatccttaaaattaaaagcttgaaagaaatgcttgaaattgctcttgaaaattatatatcagaactttataggtttcaagaaatcttttcaaagtcaaaacaagacgctctcgagttatactttgttgtcaccaactcactcattgatattaataaatctcttaaatcccagttagataccgcaaaaacatccaatattacgtacgaacagacacatttggagggaattaatatattagaattggaggaattaatatttaaaaagttggagaagttatatttgaaaggagaggagttattattgggaagtaatgtcggattggtagaaggagatgctaatggaagaggggaaaagtttgatatattggaggaatcagctgcattgttctattcacggtggtttgattttgaattactgagatcagcaaatttgaaggaggtgataatttctattttggaaaagtttctagataaagaggaggaacaagttatgaacctgttgcctataatcatttcagtcataaaaggtagacttacagcacaagatcaaattgagatagggccagttttgatagaaagatttagtggatgttctgagaaaatcaaagcaaaagttttgagtgagtgggaaagcactgaaagttttgtaaaatacaaagacagtaataaaagacaacgtttggatgcattcgagggagatccgaatatactatactctccaaatattggaaagatttcattgggagtttcctcttcaagctcagaaggagtgccaacacaagaagtttcccaatgtatcttgccgctacctattatacatcaagggccaatgattaatggtagctctaggacttcaagctcaaggtctatctctaagaacaatgatattgaaggtgatttcgtgtgcttgagcgagatcagacttagaagagataagaggaggagccgtagaaactttacagaaagtgactatgatacatccagcgagtgctcttctgaaagtaacagtatttcagccttacttgggagttcaggaacaaatggagggaggcagtttctcagaaacttcactcctcctgggacccccagttattctatacagaaagtaccaggggtaattgcacatcagaaccacaatttgaagtctccgcgctctcccacaattacatctggattacaacaaacagctctccattcagatcagccaggctcgaactcatttactcccaaagggagtcatctaataagatcgcctggaatggttcctcaagatctggaagcgagaacacagtgtacttgggatggaagggaagctattgaaccctctattgctcctccgataccacctatacctactatatcatctatttcatcagtttcttcaaattcatctcattcatctttaggtgctaggcagattgaaagatcaatttcacaattcgtttctttaggagagcaacaaatttcgatttctgaaaggacagttgacgatcaaaatatgcctccacctacatatactcccaaaaaaaataagttggatcgttcaaatgagaagggcgggatacaacgggagtcatcaataacatcggtatctatggcagtatctgcctgtgaggattctgacttgaattcaagcccaaaagaaagtttgaaaactgccaaagatttgccttcagattcttaccaggaggatactttgttcattaggtttccccaggatcaggatatggatgaagaaagacttagaggaattcttttggatcattttctcattcaaattagccagataaggattgttagagatcccaagggaaaacctaaaggctttgcatacgttgatattgagccggagaagattgatgaaataatgaagaattctgaggaattaaagaggttagaggaaattggaattcaggttaaagcttccaatccacctaaatctcaggccccaagaaagagtttatcatcccgggggaattcaaagtataaaaggcagactagaagaaagcaggcacaaggtcaacaggattctagtacgactattcttattaagaatattgataaaagtttggatgaaaaacaggttatttctcattttcaggatagtcttgggctcaaagtaaaaaatattagcatttctagagaccaaagtggtgcatctagaggatttgcatttatggatttcttcgaatcaggagatgctcttgctgctcatatgcttaatgaatcgaagttgggctcaagcagcattactgtcagctcttctactcgtcctttaacattcccaaaatcaacaaattctgatgtcgacttaactgactccctgaatgccagatttgttcctagaactaagagtaagcagaaacttccccctggccgtataggaatgaaaggcagagaaactaaggttaacacttctacgttccacgaggacttggagttgggaaatcaacaggaaacagtgaataaaactacctctttgacaaatgatgatttcagaaaactatttttatag

SEQ ID NO: 1073 - DNA, 2244 bp, Cryptosporidium hominis
atgtctggtcttaaggaagcagagcagagcaaagataaaatgagaaatagcgtagacttgctttgcatactggagcaaaacaaggtgaatgaccatggtacaagttcaagggtgggggcatttttgaatagagcatctagggttgcaagttcaccaatagtccactggattattatttttttatgtattttgcatatggcaatttttctggctatttttatgaacaaaacacaaaactcagctttaaataggttttgtcaagaaatatactttcctattggaataatcatttcaatttactgtatttatgattcattggttattttagtatatatttgtaaacttctaagggcaaaatatggggtttcaggtaaattgaaggatgagactattattatgaggaattctgtggagctgtttctgaacttagtcattggaatgataagtattacgggccttagcacaaatattgttggatttggtaaaattcttggttatgcagccaactggaaacgtctttctgtctttcttcgaaaacaagttggtcagaataaacgcttttatacgaatgaagaatattgtttggatttggtttatattactgatagagtgatcgctatgggacttccagcaattaatattgaagcaatttacagaaatccaattgaagaggtttcaacttttttcatgacaaagtatccccgcagccatatgattattaatctctgtaatgagcgagaacactactctcttagttatttccatagtattgtttcttgtccatttccagatcatcaagttcctactcttggatctctgtttatcatttgcttccttgttctcaattacttggtaagcgatcgcaagaacgtagtggcaatccactgtaaaggtggtaaaggtagaactggaatcgtcgtggttgcttggttactatattcgagactctgttcaagcttagaagaagctcttgagtactactctaatagaagaaccgatctcagtcttccaggttgcgtcaaaacaataaagaacccatcccaaatcagatttgttcattactttagcttccttcttaaacacaccttcccagaatcagttattaaacgaggctcaaacttcttttgggaagacctccaaagaggtttccgttctggatactattggaatatttgcaattctgaactgagaagagtcaatcaaaagtgcgaaaagaggcattggaagatttcagaactgcttagagaccattgcatatatcttccacaatgtttaatccatcctatcaacgttttcccagtctccattgttgtcaataataaagaaagagaaataagtgatatctttgaatggaaaatctgtctccattctgagtataatcgagatgcagagtatctttatagcggcttaactacaaactttgattggaatccacgtcatgcaggtacccatttaagccaatctttatattcaaaaggagaaggttatcagttttttttgctagaatctgactctaataagcaagctttgagctattttggtcaagatcaaagccaacttatctattccgctagatctaagattgaacaacttgtttcaagtcttaaaactaaaccattttcgccagatatagttactagaactgctcaagaccgcccaaagccttggattgagagagagtttgttataaagattttcggatacgaatctcctcagagacatctccagaaacattcactttctccaaaatctatgcatcaaagaagtgatgtggactcagaaaccacagaaatgagctgtttgctttatgatcccattgaaagccttaaaccaactgaagaagaggaagaaaacgcacatatgctccgaagcatctctctcatagatttctcaaacccggagcgcaagaaggagttttctaatcatgtaattacagcagtgaactcaccatataaagacattgttgaattcccaattaaaaagattaatgaatgggggtcctctagacgcagtttctcaaattcttctgttgcgttggcccatttttggcttcatcctgctcttatacatacctctagccactcgaacctttggacattctttctagagtgggatacttcctccaagacatggttgatccgagactgctttctttcaatttctctcaagcgtaagaaagaaattgatgttagatcatcaaatttcgaaaatgtttgtatagacgtcacgtttcaatataaatga

SEQ ID NO: 1074 - DNA, 876 bp, Cryptosporidium hominis
atgacaggtaacaatccatatggaggctacgacttggtgataagggagtttgatccttctgatagcgatggtgtgaggcgtgtgtgtttcaaacactttcgttccttgacattcccgtcagttttcttttacttgagtcagcatttggcagatatgatagccttgctggtgattggaaaagtgtttatggactttaagcagctgatttcaatgctggttttattttgtgtctatttgacaggcagatccatatgggaggttgaaacttatattaggaactgttgtacagatttaagaaatgtacatgaactttacatgatttctcctggatatcatttttgggttgcagagcttgtcaaaaggagaaactccattagaaagagaaggagcatggttttggggagcgggggtggaagtaattcgagagcagaaggcttagaacaaaatgataatgcttcaaaaggtattgagtgtgaagatactccaagtaataggatggagggaggcgagtccatcttagtcggatgcgtcggcctagctccatatagagacgatccaaagataggccgtcttgttaggctagtagttggagttgaaagcagaagaatgagaataggaacaaggttgttagctcagatggaaaattttgcaaaggattatggatataaggaaatccacttatacacgaacaatttgagcacttcaccaattaaatttattagccaacatgggtaccaacttgttcaggtaattagtagaggattgatgagaggtgacttattactttggagaaagtcttttgaaaaaagcagctctgataattcctacttgaataatgaaaagaacagtattggagagagagttatattagattaa

SEQ ID NO: 1075 - DNA, 1047 bp, Cryptosporidium hominis
atgaattcgagttataatagctactacaaactcaatcatggatttataaaggaaaaacattctgatatgtcctctatagataagaagcttaggggaatgctggaaaagctaagaatggaaaggcgacaaaagtttctcaaatttcagaggacagaagacaaagagtattttaaacccaaaggcaaaagtgaaaaagttcactcaaagtttatcaaagattggaagctttcaagagtttggtctaaagagctaatagagtatacatggttgtctaaactttctgaagggtacaaaagcatacaggaaaaccctcaagattggcttttacttccaatttgtacaggaagtaggagtatgttaattcaaggaaatggatattgtgaactgagaaaccaagatggatggagaatttttacggtaaagaatgtcccatttgctcatactggattgactatcatcgatggaatatataatcaagatcagaatacattttattgcaatgatttgattgtttggaacaatttgaatatatgtatctctacaaccgaatgtagattgcatttcctatcttcaaggattgaggaatcaggagtcactaatagaattgcggaaagcatggatgtttccatggtattggactcaagtcttaaatttattccaaatattagaatacagttaggaaaatattttcctttgtctaaagatagtttgttacatatatatggagttaatgacagaacgcatggttctttatcagattttgattgtttggtgtttgtaagaaaagattctgtgtatgatgtcgaacaagattacgaagatgcgtatcccgaatgcaaagagtattgcactgtttctcagaaaaactggtttatatggagggataaacagaataggtcatttaaagattgcagagacgaagaaatggataatactaccttcaaattgaatataaatgaaaaaaatgaattatatactaaggacaaagttctaattggaaaagtaagatgttccggaacactttacagaaaatctatctctagataa

SEQ ID NO: 1076 - DNA, 786 bp, Cryptosporidium hominis
atgagaaatgagcaaagcagccaccataagttgtttttagtcagttcaatccttagagatcgtgtgttctcaagcatttattggaaaggggaatgttttgccttagacagtgaaacaattctggataaggctgttttgttggattatattggaacgacttatggtggtgatagaaaggcaactccatttctatgcttattagtaaagcttttgcaaattaggcctagtacagaaatcgtcttagagtatatcaacaacccaaggttcaaatatttgactgcattgggaatagtgtatcttagactcactgaatcttctattgttatacacaagtctattgagcatttgtaccaagactatagaaggattcggattcgaaatttggatggatcttttgatattatacacttagatgagctagttgaaatttgtctctgcgaaaaaaagttcctagatttggactttccttatattcataaaagagcagtcttggtaaagcaaggttatttgaagtttccaagaaaatcaatgcttgaatatgtcccttctaacagtggggattcttccccaatctccaaaacagaagatgaatctaatgtaaagcgaagaaaatcattctcaagatctccctctgtatcatctatagaaggtaataatactcaaaatctaggaaaagaaaaagccagaaaaactttcatctattcttccaaaaatgagttaagcttatctgttgaacagtggaatgtttatagaaagaaactaggccttaagccactacaagagtag

SEQ ID NO: 1077 - DNA, 987 bp, Cryptosporidium hominis
atgatggcatcaagaaaacaagaagaagttcttgtaatttatattaagtcagtaattcaactaatatgttcattgtgtgtaataatcatcatttttaataaggactggatttcaggtcaaaatacgatttctgaatcttttgtagttggatttttggacgagctatgtataagaagttcagttttgcctctttcaagacaatcatggaaggaatctgatgcgggcaaaagttttaatttcaatgaatcagagaaatctccttttcaagttgggaaaagtaattctgatattattaagaataagttaggggaaaatttggactctaagattgtaaatagttcaatattaaggaataagaaactttctcataggcataagttaaaattggatgtggaggaagtaaataatatatttcagcagagattgttgggcgaaaatggaaatattactagtttaaagggaaatgaaggcaaattgaataatggggaatcaaaaaagagtggtttatatttctcctcttttgatcaggttcaatattgtattagccataaaagtaacaagttggtgaaagattggtatattcatccaaattatttgagttatttggttttgttgattgttatagtttcagtgatttttagcttaaacttgattaagatgaaaaataaatggtcttcatatgagttattaataccaattctagattttttagttttctcaatatctctgctcaacctagcacaaattcttcatgttttaactccactattaacctatctacagaaacacaacttcatggcgttcttttcaaccaacttttttatgctttcaggttcaattggaggatttttcatagtattttctctatcaataggaataatacactatagatacgaagcatttacgaatctaaaaagattcgaagatcaaatcgaaaacatacagtcattcagctcgttcattcacttaatttcaaacagtaactaa

SEQ ID NO: 1078 - DNA, 519 bp, Cryptosporidium hominis
atgaaggtctacaaatgcattttcacaggagacgaggtcatgtctgactcttacaagcaaacctctccatttggaaaggctgagtttgacgacattgcatttgaggtacaaagtaagagagtccaaaagtctgctgaagattttggaattgcccataacaccgaggagggagaagctgaggttgttgatgctgatgttgaaaccgtaaatgacatcattgacgccttcaaattagagtcaactccattcactaagaaggagtatatgacttacatcaaagcttatttggcaagaatcaaagaaactatggaaaaatcaaaccctgatagagtcgagaccttcatgaagaatgctcagacttttgttaagtacttattggagagattcgatgacttggagttttacttgggcccatctcttgattgcgaaggaatcattatctacggttattatgaagatggagatcttgcccccagatttatctatttcaaggatgctttgaatgaggaaagatactaa

SEQ ID NO: 1079 - DNA, 855 bp, Cryptosporidium hominis
atggagggtgaaggacttggcatggcaaatacaactgatctagcttgcccaatgagtttggaggaggaggtaaaaatgcatgaaaataacaatccagaagaagcaatggttaaggggcaagttgttggaaaggagaatgggacaataacagtggagacagatctcatggagaaactaaaatctcaacatattgttgaggaggagtcaaacaagagcgtgggcaagactctagaagaggctgtatgtacggaaaactcaaacaattcaaattcaaatgtcgagagcacactaaagggcgaaaaacaagatgaaaacaaagaaaacatagaaatgaaggacgttacttctccagagaataaggataagagtaaacacctctcaaagatcgacttttctgtatttgaagaaggtttctacaggcgctataaatcatttttccacgataggcaagctgatgaaatagatttgacgcaagacaaagctacaatatccaaaaaaattaatgaacattttagtaactttgaaattaatcctgttgatgttattcgcacatttttggttttaaggaaaaactcagaacattcgcatgggcattttgtaatgtcgcctgcgcaatctcccgagccaaatatccatccttcctctgaaggaaatactagagggagaagatgcactaataaggatatgggaggcgtaagtaatgacacaaataacgcagaaactaatgcaaatggagtgaactataaaggcgaatataaatcagaaaattcttccattgtcgacaaccatacggaaattggggtatccacaagaaatagtagaaaggggcgcgtttctaatcgtggaagaagatag

SEQ ID NO: 1080 - DNA, 357 bp, Cryptosporidium hominis
atgcgttccataactattgaagaactatcagagatcgacgacgataatatcagacagcttgccgaaattattatcaagagaaatttcaatgagccatcagagtcaagatatattaatgaaatcctaaattctactggagaacaacttaatcagaaggcccaaaatctaagccaaagtattaaagaaaaaaataaaaaacttcaggaaatgactgacgagctccagtttatgaatattagtttacaacagctaaactctcccaaagctctcaaaaagatgacattaaaggagctcaaacagcattgctcatccctaaggtctattatgaccagctaccttgactcttttaatcaatag

SEQ ID NO: 1081 - DNA, 2835 bp, Cryptosporidium hominis
atgacgtcttgttcggaaaaaattaaagcctctgaatctggcaccaaggtttcagctgctagccacgaacccctagctaaggatgaggtatctcaagctcagataaaatcaattgaccaggcaaagagttctctattagaacttgacccagagattgtagagaattctacaaaccagaccgaaaatgggtcaggtagcgtagttattacaccaacaggagtcagcaaaaccagctccattgatgatatcacaacttgtacaacaagtagtgacatttcaacccctattgagctcagtctgacggcaaagagaccgagagccgagacatctttctctgataagctagattccgatactttggaaccaacaataaaggtacagagtctagatccttctattggaattgtatccaaaagcgaagccgaaatccggagctcatttattcaggatcatggcccagcttctactgtggtatcatctccaactccttgcaacagtattgtgtttaagtgtattgatgcctcagaaagcggagttgatatcaataatcgcacagagtcaaactctacagaggtaattcccacatcggaagcgtcgaagtctaccactgcatctgcatcacccttgaaccaaagtcagagttgtaaagatgaattgaattctggtatttgcatgggagccaaacaacccgcccttctatcgtctaagcaactctttgatgagctagttcaactagctgcagtctcgccaactaccggagctagtggtattgctttgttgaatccacagcaactcgcatccttagataatggagttctccaacaatccttgcaaaattttggtttgttaatgggcacaggtctgggaatgccatcattgggagcaacaggaaacactaccccaattaaggtacagtccccgtcaatttctgcaagccagcttatggtgggatcaatggggccatcttcagcggaagatttacagcaatcaacatctgcaagcactacggcctctgcctcaaccgctacatcatcgacagcctccccactaacttctccaatcaacctttcatctgcatctgcaacccatggttccgctggtcaaattccagggatggtcactcaaaatcaattcatctcccaactaatggcgaacccgcttttccaaccccaggcgatagccagccaaagttcccaaaatttgaataggatggtttcagcagcctttggagccggatctccacaaactactcccgcctctagtacattcggctggccatcaggaggttcaactactccccaagggttttgcccaactggtacccaaccaggaatgtcaaattttgctgctcttcttgctgcagcaaattctcagctgcacagtcacaacacgtttcctgtgacatttcccacaccagtaaatagaagtattagtaacgggtcgaatccaattctaatgcccatgcaatctgcaactccctctgatggatctgctttcgaaggagcccagacatccaccactgcaagcactgcgtcttccagcgaggccagtacatacccttctactataggccagcaaaatgatcccttactaagactgggtgcgggacttccccacaactcatctggaactccctgtattccaccattctggcacgcaaaccccgccttgctagcatctgctgcttctttaataggctctggagatatatcccaaaccatggcgttattaaatgttaatcccttaggtttacaaccttttgttcaggcgcaaaccccacagcaagccaatactcacaactcaaattctgaagaggaaggcgccaacagagcccaacaaaactgcctttctctcttggcatctttgcagcaacccagctttgacttctcttcactttctacttcaagcccagcaactcttgctgctctagccagtgccgcaaccgctgcaactaacgcacaactttcttccgctgcacagacacaaccagatgctgaaaaccatgcttccaagcccgtagctaaggcttctggtggtgggagggcttcccatggatcaggctccagagccttgaacgcgagctcttcagttacagcggctgctgctgctcttgatcatctagatgtagattgggatagtgttggacttagagaggcagaactagctgcaatggaaatttgcaagactgcaagcactcttttcgacaccactgatgggaccaccccagtccctagctccccagctgctgtaggagaagcagtgctaactgcagcacagctcactatctccgctagggcaatgctaaaatttgtgaaaggtctgacgcccacccaacttggcatcaactggcacgcatgcactcaaagattttgtgtaacttacacaactagggatgaacagaatccccgaagctggactttaggcgcatactcaaatggaaaactacattacaagtactttgggccaagatcctggacagttatgggtctaaaagaggccttaagaaaagcctttaaggctagaacttctctgcttcttgggcagggaattattgaagagccagaggatacagggttaagcaaggaagagttaacataccacgcaaggcaattactacaacaactcagggactcactcggagtcaagaagggtaatgttcacaagggcctctacatttcttggcaccccaaaacaaggagatttgttgttgctttaaaatcatgtgaaagtggtaaaactatctacaagtacttttctccaaaggagaggtcaataaaggggataaaaactgctcttcttgatgcacaccaaatggttgtagctgcttgccaataa

SEQ ID NO: 1082 - DNA, 3099 bp, Cryptosporidium hominis
atgactcctacaaaccccaaagattcggatgcaactgaatcgcatgaaacacaatgcgtacaagagagtaaaaaggatcaagaggtgccaaaacaggaaatacctcaggaggatgatacaagcgttgcggaagaagatgacgatgattctagtgaatatgaatctttgatagattcctttagatttgagagaggtctgagtttgttcttagaaataccaaaggaaacaataaagtatatttatagtgataaactagagaaacatatacaattgccaagtatcgtatcttttcgggatctttgtatggaagcttttggtgaagagaacgtagtggagaagagggagtctgatactggtagaagaaaatgggacaacattttaaaagagaagtcatttacccaagattcaaaggaaaatgacgatattggagaagaggaaaataaggatattgaagagaaggaaaacgaggaaagtgaaagaacttatgaagatattacttcatttttggatacaattaagtcgaatagtaagcaagattcgcaaaatgtgaatgaaaatgtcttgagaaagagagtacacgaaatgtctacaagactttcaaaacaaggattactatgcgacccaagggagtattactttaatccaatgactatgacgggagccagtggagctaatagaagtagagaagattattatgatgtatttgatgattttattgatgattcagagctcgtggatgacctaggtttgtcactggacgagctatatagtaggaatgcagacagaggaaaccatactgctgatcatggcgatgacaatgttacaacaacttcaattcaaacttcagaactaattaatgctgattactcaaacccaaatgtttttttttgtgacgacgatccgcaaaacgactttattgatctttactacgaatcggaattgggagatgaatatggtgaaataagcgatggagatggatattctgatggagaacaagatgacttggatatgaagtcaggtgggtctgatgttttacatgaaaagaaaagccaaacattgcgcgatatacttaataatccagtaattaaactgcttgttcaactgcgtacagactgttgggtttactattctcctaagaatgcacaacaaaataaggagcagaacatagagcagaatagccaaggatcattgaatgctcaaacttcatctaccccaatgatcgatttttccataggagttccttcatctcaagcaacagttgatctaactactccaactgcaaaaactagcaaggaggcagtttctggtacttattatttcccacaaagaacccccagagtagtttcagattggtttagaactttaaatcagaagatcaaggaaataatcgaggcctataaccattgtaaaggatattataatgaaaaggggaatatcaagtatgaaaaaaatcaccaagaccctgaaattatgaataatattggggtactttctagtaatattgaaaaggatcccattttattgaggattccattacttttctcagatatatactcaaacccagctgatgtagctccttttgattctaagctaattagactcatctgggaaggactaaatatttgtgttccaataaataacaaaaagaaacagttcaacctttcacagaattcttctgattcctcttcaataattcaattgcttaccagatttgagagcttccgtacgaaatgggcaagactaatacttaatcacaatcaagaagctttataccaatttgatctaaatgcctttgaagcgattacaaattatcctccaataaagaataagtctccggaatatgttcaaagagttttgagctcaatcaatgagtataatctccaaattaacagctccggttccaaggataaagaagaaaagtttgactccaaagttggtgaaccaacagaaggtggtagtacacctgttttagccatcgatacttctaatcttgacgagattagtattgagggcattaagctggagaatttggaggtatctcaaacacaaaatgatacttcaagcgaaattaattttgagagatccgactcttttacaaatacatatttaatgagtacaatggagcattcagatagccaagattcacctaaaggtgatatttttgataaaaccagaacagaaaaagctggcgactcaaattcacagggaattaaggcagttaattgtgatctcgtgttcgattttggaatttctcttcttgaatacatccacggaattaatcggcttagaatagtttacaaagatatgatatcctccaacgtgatgacaaaatctgtccaaaaggaacaagagaatatcccagtaaatggctctagaggacttgagctaatgattaaaggacatattctcaaaagattctcaagcgtgaactttgaggggcagaagataaaggatattcctcataggttctttctcaaccaagttaagcttcttcaaatcaagtactcctataagaatcttactagtatttccgctcgtagaaccaaagctgagcctgaatctaaaactgcaaaaaaaagacaaagaaaagataccattaaagttggttcagaacattctccaaataaggattttaacggcgtagaaaatcctgtcaaacctaaaaagcccagaaaatcgaatagcagttcttctggtgaaaagcaaattggttgcgttaatatggctcatgattcattaccacgcgaagaagaatcatcaatattatcaaacgaagagcttttaaattcgaatttacctgctacaacagaaaaactaaagcaaaaaccaaggaaaagcaagaaagcagttaaaattgaaggtaattccccggcagttcctccgaatgaattaaccgaatgcctacagtcatgccctctggaaaccccaaagttagatttccatgaacagaatatccaggcaagttcttttggcgttcctcccattcaaagttgtaatcaattaacatatcaaggcattgtaacgagggagttgtgtgatcctgaaaaaatgatttcccatacagcgcaagaagatttacctgtatacaattctgaatga

SEQ ID NO: 1083 - DNA, 2382 bp, Cryptosporidium hominis
atggagagaaataagttgattaatcaatttagtattactgatgtatatcatgggctggggataccaatttctatggtttattccaggaatcttttggggggagctggactttgtgttggagattcagaagggtatatttctctttattcaactgaagataaatttatagaaagattcactgagccaggaattgtaattagaaaagacgaaagaattttttctagaaagctacacagcggtaccgttacagatacaaagtttcaaaatgtagggttttattcagagaaagtcgaaagatatatctattcttcatctactgacagcttcttggtaaagtttgacatggaacatgaaaaggagagttgtaagcttagggcacataaagaatgggtaaagagatttgctatttcggccgaatcctcatcattaatagctacagtaggtaatgatgggagtctaaggatatatgatgatagatcaattcattcaaattgtttttatttggggcaaggaaatgtcggtagaagtagaacagcttcaaataaattaattcctggtcaaatttcaataggtccgtctattcaggctcctgaagggggcgagaatctcaatgaaagctattatgaatcaatagaaaagattcgtttagctcccaaatttgagttaaatagaatacatgaacacggtgtaaggaagagtataggaagagagaagatgattggcgacaagagtatttcggttagtggagtggcctttcttagtgagaaaaattatttagcaactggaggatgcacagatggacatattaaggtttgggatatccggaaagcatcatgcgggattgcagaaagagcctgcgcatttaaattttctcctcagaaggatgaagacgctcaaagaggaattacatggatggaggctgatgaattatataacaaacttgctcttcaaacaaggaaaggaacaatttatatatatagcgtatctgggattctttcatttagcaaggacctgagtgcaatagcaatcgattcaaataaagtattttatgaaaaggaaaatgtaggattattggatgcaagccaaagaccttcaatttcaagcaatggagagtggctaattacagcgtcaaattcggggtcaagattctatttattcaacacctccatggatttggagagctcaattcactattatacacatgaaaatctggaagagagttcaataccaatttttcaatgttttgcatgggagagaggtaaatttagcatggggggaactcaaaccttcccgccaaaagatgggaatgtgaatttccgggtggacaagtgtgtggggagagagtaccgtttaaatttttcagttgggacaaaattgaaaaagctgagtttttataacaacaaggactttcagttagacaatataaattcggttatgccaaacttttctggagtttctgcaggagatgcaaccaatagcagaactaccgttggaaaaaacgaggaaggtgatttgaaacctagatgggtatcaggggaaacattatcatatagcaactcttttgatggagatatggatgttgccaaccagttatctttgtcttcctcattgtccgtaccttttccaaaaccaagtaggtcaagcaaagccaactccgtggatctaaccttaaaaagtatggacgagaaaaatgaagaaaaaaacgaagagtctcaagaattaaagggaatacgtgaagagagaaaaacaggattccttactattggtgggattggattttcagaaaaagattcccagactttaagcgaaggtggagcatttggaaggcccactccaactcccgaaagtgtagagaagactccttttagaagaagtatccctttcatgggttcatcgcaggatagtgtaggttatcctgctccacaaagaggtcaaagtagttatatggtacaatctcaagagagcttgctaactccaatatctccacagaagaatacagcagattgtaagggagctttggagatggaacacgagtctggcaatacctcatcaaatcgctcacacgacttcaattcacgcagaataattcatattcctctttctcagtcaaatgaggaggttttggcaagtccaggaattgacggagcagaatcttttgaagccgattatacaatttactccgagcctattcctcacgcttcggtttcaactccaggatctccagatataagttctgacacaatgctacaagatgacaaatgcgaagaaggtaataaaggattcaagcagagaagattagatagctgggtaagagttaggaagaatacggagggtggaagcactgcaaattgtagtactgcagaactttctccagtaagctga

SEQ ID NO: 1084 - DNA, 543 bp, Cryptosporidium hominis
atgggagaattagatgttaatttattgctcaactacttagaagcaaatttcggagttaacacagcctcttcaacgggaattgatcttaacacttttactacattagtcaagaagcttaatctaggatggtctagtggacaaatcaggcatgccatgatcttcctttctggagagaggagtttatcctccatgtatgtttcatctttaagccatcaaaaaaagtcagaaaataaaaataggaataaatacctactttcggtcaaagtcaatgattttatcaataaattaatcacaattgaaggtggaatccccaataatatcgctacatcacattttaaaggagttgtttcaagtaatagttacgatagaagctctatcctttcaaatacaaacaagcatcctagaaatgatcagaatagctccgtaatctctaacagtatttaccctcaggatgatcacattagaaatgttgatgatatccccattgaagaatatgaatatagcaatagtgagctggaggaggaaattgttgagcgcatttag

SEQ ID NO: 1085 - DNA, 2595 bp, Cryptosporidium hominis
atgagcttgttttcgaggaagaaatttcgattattatcattattagtgatactttccttagtatttttactcgaattaaccgaaattgaagggaaagatgtggcaatatctttaagaagagggactaattttggagtagatgaaagctcacaagactttcaacaaaagaaatccgaaagtattgctagtcatcattatgttactgataaagtaaaaaatagatattcttctacagcaatatattttatcttatctggaattttagttattattacaattctttccacatacataataagagaatgtgtagtagatagaattcgaaggaagaacgattcatttttgcaaactgttatggacacagttttcagacaagcagcctgtatatttgtatctctcgctatctcctactgtatgctcacatctagactgattgatcacataagaaacttttgtgagaatataatggcagattattccaatcagagtattattaataatcttgctacacagttagacaaagcaatagtgaataactccaaagtttggacagctgagaatcttggacgagagtttaataatatccttgctattgtgattttgtcgtttgcatggtattgtctttttgtactatatttcacaggatgtgtaaagtttttggaaaaatggataagatatgcggatgaaacagatgttggagtactcattaagagtatttttaaccttcagaatttgtttagtttaaaactaaaaaaatattctgattccaattttggaaaggaggaaatccaaaaaaataagttgtatctttctaaaagtaaggacaaattttttggtgaaaacgaggcagtacaacataacaatgtcccaataacaatactaaatgaaaatgaaagtatttcaagctataaaagatcgtctggactatcaattgataaccggacagaccaaacacatgaagggagtggtaagagtaattatgaggcaagaaggacaagtataggaaacaactccgataatatcactgaggaaagctttgaagatcctttggatagttcaaattcgggaggaagttcagaggaaggaagtgaaaacgaaggtataaggagtgatacggacgttgaagaagagcttggactctctcaattaaatgaaagtattgagctagatattaataaatctttgccatttaaggggaaacaacatagagaaagcagtattttaaaacgtaaaaagaatgatgtggaagttgaaaatcttacgtggaaagaaaagttgaaacttaagctggagaatttctggacaaagttttggctttggccaaaccaattatttttaacatatacaaaggctcatttcatatctttaaggtacgattttatggatgaagttgcagcttatgatagttatggatcatctttcagtactaatcatagtggagattctggatattctgaagatggacttagtacttcttggctaatttcgttaacggacccaactacatctttggttgcaggcgtatattttacagaatatcttagagcaaagttattaattatggcagtaacattaataagaataccaataactacattaacttttattttgggattaaatgttttaggatggtttctaatttatgattactatcaaaatttgatattgtttaataatgttaagcattatttttcagagccaatgatttgcatttatatttcagttctgctactttgtttttctttaactatttggctaagagcttggttaatcaaacgacagctccaacccaggaatattctcgagtatcttaaaatgaagtatagtttagatgttggaatgcccttacaagaaattgaatatgataaaataatgccaagatataaaatatcaagtgctaaaattatatcaaatagtgaatattcgcagatatcttctcaaagtaatcaatcacttgatcaagaacgtgaggccatgcaaaataaatcttgttttgggagattatccaaatatttaaagttaaagctctgcggaacgaattctccttcattacatgatgatttatttttgttcaaacgtaatggtcctgcaatattattgagatggtttcaagcatcatactttctccaacttattttaatctccatagtaattcatctatcatatttgcaaaaaagattatggtatgaggaattccctcttgcaacatttactatttgggtaatttttggaattcaacatttatgcctgccttttataatctatccaatacttctttgtacttctgtaggccaaatggccgataagatcgtacttgaacaagttcttaacattcaaaaaactcaaaatattcaaagactttcgcaaatttcagaagcgcttagattttatagtttccttcatctttttaattcaggtagcgaagaaaataaagagttacaaagaagaaagtttagtattgtagctaagacagctccttgggagctccaaataaggtgcagaaatacaatgaactttttgataaacaatgcgcccattcgaacacgggtaagttattcaatatttttaatttacaagtttaatagtgatttttag

SEQ ID NO: 1086 - DNA, 1923 bp, Cryptosporidium hominis
atgggtatgtttttaacgaaaccctcaacaactaaacattctgaccaaggtggagattttgataaatatggtgtcagatttggtgtgagtggaatgcaaggatggagggtttctatggaggatgcgcacattgcattaccaagattagataagcatcccgagttatctttattcggtgtctttgatggccacggcggatccgtgatttcagaatgggtttcaaggcatattgagtctatttttgagcaagagttagatacagtattgaaggagctaagctcgaatgaaattaatctcagtccagagaaaagtaaacttccaaatagagtagtggctatctctgaggctcttcaaagaacatacattaaattagacgagcaaatggcctccccaacatccaggccagaacagagagcaatatatgacaagaagaagactaacagtgatactaacccaccaaaaacattcctccaggagcttttaggtggaattgatgggcaaaggagagtattaaggatggtagaacagaatgggaaccgttgtctccagatcgtttcctacaatggagatgaggaatctaactcatctgagaatggaaatgtcgatggagataaagcggaagaggtggatgaaattaaggaatcctctgctaaaaacgaagattcgagctacggaagacagccagctgaaaacattccctcgactgatttggacgaaaaccaaaattactccgatgaaattacaccatttgagagtgatatcaagcgagatgatgcaacatatgatgaccccaatacaggatttattgacgatgacggtttagctgaagatgatggctatttagaagatatttctgattctggagcttgtggtcctgaacactgtggtactactgcagtagttgctgtcattcttccggatgaaactggcgacaccccgtatttaattgttgcaaatgcaggtgattcaagagcagtcttaagcagatcaggacaagctattgcgctttcacatgatcacaagcctgaacttccattggagaacgaaagaattttaaaagctcatgggaccgttgaaaatggacgtgttgatggtaatttgaatatgtctcgcactcttggcgatcttcaatataaaagtgactcatctttaactcctgaagaacaaaaaatcacagcattcccagatgtcagaataatccctcttactaatgaggatgaattcattgtcttggcatgtgacggtatctgggatgttgtagataatcaattatgcgttgatattgtccggcgcaaaattttaaagcagattgaagctttagagtcaggaaatgattcaaaaaaaagagagtccaacatgaatggccaaaatgatcgtgagtttggttccatcgaatcaaaagagcagctttcaatcagcacaaagctagatggctcttccccaatacctgccttgacttcaattcaactttcaaagatttgtgaggaaatttgtgatgagtgtctagcccctaatccagttgaaagcgagggaattggttgcgataatatgacgtttatgattgttcaattaggccccaatattagaaagaagtcatcagactgcatggtatctacccaaattgggtctgcagttgctaagaggttgaatgcagctgcttctgctatagaaactcaaatatctcaagctcaacaagggaacaaaactgattctaaccctggtaatttttcggatgatgatggaactctgagaaatgagcagtcatcacgtatggaaacacaagcccgcaaggctccagatgcagtgttaaatgctccgcttccaagcgtctcttggattccaaaaaaggagttcaatgtaacattatatggtcatggagttgatgacggaagatttgataacattccagaaggaagactctag

SEQ ID NO: 1087 - DNA, 1203 bp, Cryptosporidium hominis
atgccattcccaaacaagaaaatcgaactaggtgacaaattatcagaatcaattaggtctttctcaactattacagatactgagataataataggtatatgccgaaaaaatattccaggttggaaagaaattaatgagtcgtatattgaagttaaacagatcttttcaggactcacgaaccagctttttgttgtaagtattgtaaatgaatccatgagtttatctctaaaacatccgagaattctatttagaatttatggtaaacatgtaggaaaattctatgattccaaagtggagcttgatgtattcagatatctgagcaacattaatattgctccaaacataattgcagattttccagaaggtagaatagaagagttcattgatggtgagcctttgacaactaaacaattacagttaacccacatttgtgtagaagtggcaaagaatatgggatctttacacattattaattcaaaaagagcagatttcccttcaaggtttgacaaggagccaattctcttcaaaagaatatatctttggagagaagaagctaagatccaagtgtccaaaaacaatttccagattgataaagaattgtactcaaagatattggaagagattgatcaattagaggaattgatcatgggcggagaaaagttcagtatggaaagggctttagaattaaaacttcattctccagcattttctttggtatttgctcataacgatcttcaagaaaacaatctgttgcagacgcaaaacaatattagaatgattgattatgagtattcagctataaactttgcaggggcagacatcgcaaactacttttgtgagtatatatatgattactgtagtgacaaacaaccatatttcaaatttaaatatgaagattatccatgtgaagagctgcgaaagctatttatttcagtgtatttgtctcaaacattacaagaacaagttatgccaagtcaacaaatcgtgcacattatgactaaggctgttgaagtattcactctaatttcccatattacatggggactgtggtctattgcaagaactccagggtatcagccaaactctgtggaatttgactttacagaatatgcaaatactcgatttacgcattatttgcaaaaaaaaaaagaactaattgatcagggaatattaccgcttaacagctggctatttaatttataa

SEQ ID NO: 1088 - DNA, 264 bp, Cryptosporidium hominis
atggagcttattaaagaaattcttgaaattaaaatggcaactttttacaattttagaaatcctgtagatggaaaaatgattcaaaaacattttccagaactccaaaaaggaccaaaatataagtttattataaatctcagtcttttatggtttttggctttttcacaagagccagaaaccccaaacactacagaagttgccaagtgcatggaatttataactgaaaatttcaaagaagtaatattagactctaagcctatttaa

SEQ ID NO: 1089 - DNA, 942 bp, Cryptosporidium hominis
atgggaaattactcaaaatatttgtcaattgtgaaggaaaaggatatggttgacgaagaaaaggtaatagctagcttcgtacatgagaaagatccgagcgtcgatacaaaaaatataactagacaaaaggtaccagggtttccatatgcagaaatttgggacaatgtattctcagaagatgaatgcaaggaaatgatagcatctcttgagaaaagcggagaattttctttttggaatccaggacattcctctaagaaaagctatagaaatgtggacacaattgagggtaatatgtatgcactatctaaattcatttgggaaagaatcaagaacatttttaattaccatgaatttgaaataaatgaaaatgatagctatagcgaggaagataatattgggaaatggaaatctattggaatatatgaaaaaatgttttttgggagatacagtgatggaggccactttgggccccatacagattgttcagtctgtatagatacaaatactcgcactctttggacagttttagtatacttaaacacaattccagaagaaggaggtggtgccacctcatttgtagatgaatctcaaaagacacagaaacgatttattgacgaatctggccgagaaaggacaaacccaaataatgttattactagagtacagccaagggcaggtagaatagtaactttctttattgcagatatgcacgaaggcgagcctttgtgcgctggatatactaagtatattttaagaacggacatactttataggagagtgaaccctatactgactagtgaagcagatcaaagggcgtatattctatggctaaagggaaaagatttgacttatagaggaaagatggacgaagcaaacaaaattttcaaacaggtgtcggaaatatctcctgaactcgcaacaaaatttaattgtttatgttaa

SEQ ID NO: 1090 - DNA, 783 bp, Cryptosporidium hominis
atggtagggcttagtggtgaatttagggaatttccccttggagacgttcttacaggaagcacgctttcgaacttagttgaaagcatggagaatgctcttgccgtagcccttagtactgaagatcctaataatcgatttggaagccccccagcttcaacacaagtcgttgagcagcttcctagagaaactgtgacaaaagacaacattgtaagaatcaaaatgtgcgggccttgcgttgtatgccaggatgagtatagtattggagatgaagtaatgggcctttcgagagatgaagaggtgtgccatcatatatttcatgcaaattgtcttcttccttggctaaaccaacataactcttgcccagtttgcaggtttgaactcccaactgatgacgagttctacgagagtaggagaaggtcttcggcgcaaaatatctcttcaacattggaatctacaaatcaagcaggtacccaagtaggggctcggaatggaattcaagatcatttagactctgctactgtttcaaataacaatatacaatctacaaattcggaatctcaagagcctcttatagaagctgaattgggtagcagtcaaataaattctcaagaacgagatcaagatcatgctagaaatgaaggtaactctaacaatgctactagttctaattttagaacaataaacttctcgaatcctataggagaagtaactacactcacatctcaactaccagttattacaagcacaatatctacggacagaaactttccacacaacctctaa

SEQ ID NO: 1091 - DNA, 480 bp, Cryptosporidium hominis
atgaacttcgaagataaagtcgatgcaaaaaaggtggaacatattaaggtattaccagaaggtgaatttcaaaactctgctcaatccagcaatggctttgaaaatgtagaccctaaatcagagccgctttctgaaatagaaaccaaaaatgaggaagggggaataaaacgtcgttttcaaccaaatcaatttctaaagttttcaaatttggtactagtccccggaaagccccgaaaatggaagagggttcagagaagatttggaagaagtgaaggcgcatggttatatagatgggaatatattcccgagtccattgacaacctattcatggagaatctagaacttatggctagaggggtagtcggtccaagaagaactggcaggactactagagctgtttcctttcacatgcgtgaaaaccctgttggacctaatcacctaaatatgtatgaactagaaggtaactatgagcaatcttga

SEQ ID NO: 1092 - DNA, 5343 bp, Cryptosporidium hominis
atgatgatttcgccgctttcttggatattaaccttgttgttggtatcttatgggtttatgctgatggtttgccattggcttttgtttgatagtattcaatgcattataactttgttaattggagtgggtatatttatctccacagttgtgtttgtgataatttgcagatttttattctttcctgttagtactttacgtcgtataaaaatgcagataaatgtttttagaagaagattagcgagaaaaaaagcctttaaagaaagaaacattcaagaatttgagatgcaaagaataataatagatgaaaatgaagataagcaagagctctcagagaggaaagaaattccttggaaatctgaaagcaaagtattaatttcagataacaacacgtttctaaatactgaagatattcttggagtaaatgaaatgagaactagtaaggaaacgctaggtagtaaaagtagttgttctgaatacacaaggaaacacaaagcaaatggggagctgatttatgccgaccctagcgttagtatattggctgacgcaacatcacttgtctcctctggaataaatcagcatgaggaaactacagaagatgatacaaatgcgagtggattcacatctaagccccgaaaaaacaaaaagatcaaatcttcagagatttctgggcatgggagcaggttcttttcgttcattggaaactactcttcttttggggaaaatagattgaattttgatgaagaaggcactattttctcaaaaaagctgaatacaataagaagtagggtgatactaatgtatgacaaatattttttgagaggattgacagctttcttctctaaggactttgtacagatttcgctttttttgatcaatataatttgggcacttttatgggctcttgattctaattatttaaccagagaatctattaatgacccctggaaagtaaaaaaaggagctgaaacgttgctgctattcgaagaagcattcctttggatcgcagatatctcttttttgtataagattcttggagaaatatctttacttagtcgtggaattaacggcattatcactctaaaatatttaatcacgtcggcaacatttattccattattggaaatgctgacaacttctccgatattattggtcatgaaatactcaattggatctggatctgttacaacactttttatgttaggatttttaaggtatttcagagtattaaatccgatcccaatacttacaattatattatcctggtcctcagaagtaatgagaatttgtattgtgattatttggacgattgcatgcgtggtactaggattttcaggtgcaatgatgataattgagtctcctaaaccaaatttcacaacattatttgattatttctactttacaatcatcacaatttcaactgttggatatggagattacacaccatcaaattttgtctcgagacttatctgtattatactgatcatttttacaataatatatgtcccaaatcaaataagcaagcttgtccagttagctcagactcctccagagactatgggagtttgcaacattggcgtttacgatgagagcattttcgaaagggatcatatccacaccactctggtattagtgattggatctccatcagttaaacatctttcttacttattaatggagcttaatcaactgaatgcaaatattgactacataaaacaattcaacggtaaatctgggaaaattatcagatatcaaccaatcgttatgttattaacaaactctgatcctcgtgattactcaacactcgtaaaaaactctcagcaagctcttcatacacaactttttgtcaagaagattaaaaatatagaaagcttaaaagtagatattgaaagtattaagggcttcatttatgcaatatatttctggagtgatgcaattaatgcaaaagtttattcaccaataaatgcatttcacgaagatggtgtcaattttcaagaaaataacttaactgaatttctaaattgtaattcagagcagtatggtagcactaaattatttgcaactgatcgggttttggatcttgaaagaaatacaatgatgatctggtatgcagttagaaagtttttggatttgaaggaatacgagtttctatatagaagtaaagaaactggaatattatacaactcttctagttcaatattgggtaaaaaaaacagaaggaactccgatagtaaaacggataattacccagatcctctacgtataaattctgtaatcgttttcaacggagaaaacgctgatttcaagcttgacaatgctcttagagatgaccatttctatgatctttatggaatccaggatataaatactgcaagaaggaacgtagtaacgaacaacccaaatctacaagctccaaagactcctgaagaaattagcagttatctgttttatttatcaaaagtttctggatctgaccatcaaattaatatgaatagaattgcaaacatggttagagatcaattgtcttcagagttaaatgaaaagtacaattcaactattaaaaattcaaaatacgcgattcatgagcaaaaaagctcctatactccagtatacattgcagagattaggtccagattacttgcaaagactgctctttgccctggattttctacattattgactaatctttttaatacaattaaaatagaagacttagaattaggagaatctctccataattcaataaatggaataattaatgaatgcggagggaataaatttaatcaagaattcgaaagtttagtatcagaaaacattaggaggcaatctagagctctaagcgaagatactgatcaactggaattcgatggaactaacatattcgatgcggacttttcagagcttgagaagggtacattaaatagaatggcaacaatcgatgaaacgcttttatacagctctcttgatacggtctctcaatcaggtattcttacaagagactatattagaggtactcattgcgagctaatggaaattccccttccaaactatttaataggaatgcaattcctccagattgtgtcatatattttcgaaaatcattctatgatttgtattggaatagctgtaaatgtttgtgaggaaacaggcattaataaaggtaacaaaaatcaatttgaagattataatgccaatggagaactaaacattgaacttgatgaatctgttaatgaaaacggttgtgaagatgatgaacactacaatttcattattacgtctgaagatgaagaagatcaaaacagtaataatcgaaattctgaaaaaaaggagttagattctccaagtaaaagctttattataaatgaaaaggactccgagaaatccaattataaaaaattaaaattattcccaaataaattgaaactagcaagaattgatgaaaatgtttccaacaaatttaagtataaaagctcaatcaggtcaaactctgaaaagaaagaaccttctaaggtttttggcatttgcaagaagaaaaggattctaaatccaagtgactttattgcaggtagaaggtggagatatggggatatggtcatagaagaaaatactgaaattgatctacttataatttctaattctaggagaaaagcattttcactcattcatgaaagagaaaatcttgatattaagacagaaaaatataaagaaccaattgttccacgcgcaaagcaaactttaaattatattaggctttgtttgcagggcaaaaccaaactaataaataacaagctaattattccttcatggagggtagaaactcctgttaccccaagaataagaaagatggacacttctagtggaaagtcagaccagttaagagggcagccaccaagtccaattcacagagaattaaagtactcgaaggtatccaaaattgaaaaaattgacatactttgtccttcaaaaatacagggttatattcatggaacaacttttatattgttggtttgcgaatggccagaatgtcttgaagagtttctgaatgggattgttcttaatagatcaattcccgttggttgggattcatttagacatatcaataagaattttaaaacaagtgtcccaacttcaactcaatcactcattctttctacaattatcgtttttctttctaatgatcacaatgaaaagtatttgcaaagatcaattgttcctcctagttgtgttggagtttatatcaaggggaattcttcaaacgatgaggatctaattagatctggacttttttatgcgcattcaatagtagtctgctcgtcaaactccataaatagcgattcaaaggttataacaacttgttggagaattcattcactgataaatatgaagattcaggctgagattgttttattaaagagcaaaagctcaaaatttagcaaaaatgtttgcccattatataaatcacataaaaaggaattagaaagcacagaaaggaatggattcggatcaaaaatcaaggacttaaggttatttgatgccaaatggaatatgtggcaatggaaagttactgctaaccttgcccaaataaccaaaaaatggctttttgagggagggcatttacctccttgcttcttcccagcaataattgcagacataagatttgaggaatcccttccattattggacagcacatcttggatttccctgaatgagtgggatttctctacatgccctacagttatttctggaagagtcctcactactgatatgataattccaattatttataggaacgttaaaattaatcctttattagctacttctgactcgatgaaacctctattaggctataatgaaaaatataactttttcaatagtccattaacatatgacaatcaaattataaatttggattgcccaagttcaggtataaaaagattttatactgcagttagcaaaataatgcctgaaaccgagtattttccagattatactgagtggggttctcttgagctaatttctataccagaacaattccatgggagctgtttctcaacagtattcaaagaaatgctaaggattagtggaattattactgttggagttgttcgaacaattggaaataatgtagatgttccagaagttgtgataaaacaaattactgcagatgaaaataatatacaagaaaattactccagaagtaaaaattcatataacacctatttaaatagagttgctcccaagtttagcatcaataatagagtcttgttattatcccctcatccaaaacatattatttcaaaaaatgatcttatttatgtggtgacacccatttctaagattttctaa

SEQ ID NO: 1093 - DNA, 771 bp, Cryptosporidium hominis
atgccaccagcagaaacacgtaaattggacgacatcgcaaagatgatcgtatgtaagactcatattggtacaaagaatgtcgaggataaaatgctctcatatgtttataaaagaactcatgaaggtattttcttgataaacttagccaagacttgggaaaagatacagatagcagctagaattatagcaactattgataacttggcggatgtagtcgttgtttctcaaaggccatatggttcgagacctgcactcaaattcgcccagcatacaggagctcatgcaatggtcggtcgttttactccgggtacactcactaaccagatcactcagaaattcatggagccacgtctcttgatcgttacagacccccgtgtagattcacaagctgttattgagagttcttatgccaacatcccagttattgccctttgtgatactgactctccattacaatatgtagatgttgctattccatgcaacaataaaggtaaagagtcaatcgctctcatgtactacttattagctcgcgaggtcaacttcctcagaggtaagactgacaaatgggacgtaatggtcgatgttttcttctggagagacccagaagagtatgagaattctgcaattggagctgatatggagcttaatgatggaatgggagttgacattgaaggtgctgctgttgatagcgcagctgctgcaaatgaatggggtggtgtctcaggaaactggggaggatctgcagctgacgaatggagaaatgctccatga

SEQ ID NO: 1094 - DNA, 510 bp, Cryptosporidium hominis
atgattatttaccttagcccaaaagattatcacagatttcattctcctaccaatattgaaattaaaagtgtaagacatatttctggagaatgtttcccagtttttaaaggtattgcttcaaaattaaataatttgttttccataaatgagagagtggtaataaaatcagaatgggagcatggaaaaatgtatattgtagctgtagctgctcatggagtttcagatattaagctattttgtgttccaaatctaaaaacaaatcaacgaggatcgaaccttaattatttacggaaaggtaagaccggccaatttattgaatattccgattttaaaaactgcaaaaatcaaggaaagtacctcaaaggggatgagttaggtctatttaacctgggtagtacgattgtcttaattttccaagctccggaaaactttaagttcgatgtcgacagaggtataaaacttaagttgggacaaataataggaaaggtgttagatagtcagagtagttaa

SEQ ID NO: 1095 - DNA, 1398 bp, Cryptosporidium hominis
atgttggtactttttgaaacgccggctggctatgggttgtttagagtaacaaactcaaagttactgagtatggatactgatgaaattgcggagtactttcagaacccagataaagttcagaagtctgtttctctagaagcttttttgaggttcaaagatacaaagtcagcattagttgaggcaacagctttggttgagtctaagttaagtaaaggtttatccaagttcattaagaagaatattccaaaccccgcatcagaatctctagctgtcgcagacaaggttttaggaggtcttataaagcaaaagtatgaaattgacgttgtttataatcctaagatgcaggaggtaatgaggggaattagaaaccaattaactgacttactcactggattaactgaaaaggatatgaaaactatggctttatcattatctcactcactagggcgatttaaattgaagtttagtccagagaagattgatacaatgattattcaagctgtagcattattagatgatttagatcgtgaattaaataattatgcaatgagattaaaagaatggtacggatggcatttcccagaacttggaaagattatatcagaccgtgatgtgtatgcaaactgcatcaaggtgattggttttaggcattgtactcgtgatgcaaatttacaatccccaccatgtaatattccaagtgaaatggaagctgagattaaacaagctgcggagatttctatgggtacagaaattactgaagaggatttaaaaaatattatagaactatgcgaccgtgttttggaactttcagagtatagggagtcactatctacatatttaaagactagaatgtccacaatcgctccaaaccttacatacatggttggagagcttattggcgcccgtttaatttctcatgctggtagtttaatgaaccttgccaaacatccatctagtactgtccaaattctgggtgcagagaaggctttatttagggctcttaagaccaagaagagcactccaaaatatggactcatatatcacgcggcagttgttgggcagtctgcacctaaactaaagggtaaaattagcagaatattggcagcaaagttatcattgtgcatccgcgttgatgctcttaatgatcaaaatgaaccaactgtagcgatagaaaataaacaatatgtcgagagaagattggaagaacttagcaaccaattaacttcaggacgcctttcctccacaggagggaacaaaaaaccatcaaccccatcatatagccctgttaaatctaaagctctaggttcttacgattcgtcaatggatattgttggaagtaagaggaaaccttcgggagatagtcaagaaggctcaccagataaaaggtccaaacattag

SEQ ID NO: 1096 - DNA, 6243 bp, Cryptosporidium hominis
atgtactctcaaaaaggtgatgagtttgaggtagaaaaaaataaattaataaatattcaaattaaaaaaaaattaggagaaagaaatgattccaatgaccaaaaagagtcaattattccatttggaattcctgtttgggtacaaaatagagatgatgacatagaagtcgttaaacgaggttttttaagagatgcaaatttaggtgaaaatgttatggttgaattcagctcgattaattcaaaaagtatatttgcaataaaaagttatccaaaacacaagataggattgattatagataatccgattaaaagcccagatttatctttgcttgatgtttgtactcctcatggaatttcacatatgcttggcgaaaggtgcgcagctgggttttgctacacttttagtgggaatttattgattttcatcctcccaagagtagaaaaaattccaaggctaatgaaggcgtatagcagcttggaaattcagaggttttggactgaaatgaaaacaaaatttgaacctcacattttttctttagcgaggcgtgcattagttagttgggcagagaatcaccaggaccagacaataattattatgggagcgcaaaatactggaaaatgttttaatatgcatatgttaattaggtttttagcaaaaaatctcagtttgtataagtatataaagagctcctatgcaatttccgagaaaattgcttctattgttcacataactagaagttttattcaaacacctggagaaggtaacaatggcgataataaattttatcattatggccaaagctattgtgggcaagtttggagaatttttgttgcttcagatggatgtttaatgggatctcacttgcatttgtggtcttttaacacatctccagtatcatattggtcaagaactggtccttttttttcaattttttaccaattagcacatggattaatattagacaataataatcctttgataaaatcattaaaattatccaatgatgaaacaatgctatatctaactcaagtttctccagatatgaatacaaattatattgatcaactccgcggttttaaaatgactgttggatcgttaaattcactagggttaaacgatacacaaaagattgatttttttaaggtagtatttgcaattgtagtcattgattcatatgtatcaatattatgtaattcaactgtaaatgaaattaatgactctaaaatcgtttttttcccattgctagcaagattattggggattgaaattgaagatttaaggacaaatatagtaacatgttatgaatttgtgcaattacaagttactctatactgcagattactagattgggttatttttacatgcaatgagaaccttcgccctgctgttaccaatttactaggactagagtcatttacaataatacatggccctggatttataaaagaaggtttctcattttcgaatgcaatgcaaaattattgtgaggaaaaattaaaaaagaattatattcacgaaatatttgattcggagaaaaagatacttgaatctgaaggtctcaatatgattaagctaaactatagtgatattgattcaattactgatttgtttgaagatccagaaaaaggatttatgaatttgctaaaaattacttcaaaaagacaaagaagggttgaggaatttatttcagaaatacaaaaagatccaacagagtcatcgttgcttcacaaacctacaccgtgcgatgaatttgggagaatagatttggatccatcgaagtcaatttattctaagtttgtgcgttcattcacaggaaacgaactgcttaaggcaaacgatgaatttattactaagggtgaatcaaagtttcaggaagagccatataatgaacttctaaaaagaaaaaaacaaatttgtaaagattaccacgattcaaattctgaaaaaataagaaagtataggaagataagaacaaagcgtggaaatagagcagactcaatgggcaatgatttattttctggagtagttaatgattttgaggtagattatggtgctaatagtttacattcaagcgttttagtagaggatgagcaggctggcgaattgccagattatctacctcctgaagttactattaatcattcatttgggaactgtaattatagtataatagctatggcagaagaggataacctgaatcaagttccagagaaggtcgatgaattatttagaaagtcaaataataagatcattcgcgcatgctggacaaccattttagaaacagatgaaaaatatatgcaagaaaggaatatctacaaaggtacagctcaaaaaaagaaagctagattatccattgatgaggatcctgaaataataaaatttgaaaatttctggaaaaaaacggaagattttatggatttaacttggataagattaagcgcaattccaggatctccttcaatgtctcaaattgcattaaaagcttccaagatggtggattcaatgttaagaagaggaaaactattcttttcagtttgtgcaagtagttatcaattgggtaaaaaaactgaggaagaggtatctgaaactaaaataacaaatgatttggaaatgtatgatatttcatctcaggtcttgtttcagcagtatggtttcacggtaaagatcccactaagagtctttttgctcaaatttagtgaaatatatatcccaagaatacacaaaaagggcattttagaaaggttgaaatcccagcaaaatttgagggactcgataagaactttattgcatggattagaagtacctgaagtcgaatatttaattggaacacagaatttattcctaagaaataagatggtattagttctcgaacgaagaagagaagaatatttgaaaaaagcgttgccagcatctattattcttcaaaatgcatggagaactttaaaaccaagattatttatttccaaattaagattgatgagcgtgagaatacaatcattaattaggatgaggtttgtttgtattttatggaggaaaatacttccttatcggcaatttatttgtggattagcattactaatacatctagcaattccatgggttaaaacatctaccatatttgataaactggaagaattagcgcaacagcgagaagatgaaaggaaattctttcgaaattctgcagcaacatcaattcaagcttggtggagaggtgaaatggttcgccgaaggcttacactttatcgttataatgaatttagagagttctcaatccaagtaatacagtcagcatggagaacgcttaaagcccaagcattattggtagaaaaattagcatttacaaaaacacccaatttcaaagcagttaagattcaagcagtgttccgtggatggttagtaagaaagaaattctgcaaattatttatgctgaaaagatgtattttagctctaaaaaggaagtcactaattagacttggaattgcaaagcatatcgaatatagaggaactttaagaagaagccatgtatttagagagcaaattagggctcatagagaggttgtaaacaaagctattataattcaaagagtttttcgtatggctttgtgcagaagacaatatgtcaaattacgtttttccgctcaagtagtacaatgtagagcatacacatgtttggaagtatatagatatttcaaggcaataaagtcaataacattattacagcagtggtggagagttacatccacactaaagaaacatattgattcaggaaattcattaattaaaaccctaagtaaatttaagatacaaaagaaaattccaaaagatccggtaaaaaaatcaatagaaatgaataatttaatctcaagagaattaaaacaatttaatatgatgagatacccgttattaagtatgcaagggttattccaaccacttgcaaaaattgttgaaagcaatactgtatttttaaaccctgtagaattaagtattgttaaagatgttggcgattattatccaagcacatggggaagaggttttgtgactttgtgtagaagattatgcggcgcaatatttgaaactgctccaacaaaacagttcccaccattgaaaatattacaattttcagtaggacaaaggcataccttagtattaatagcagaacgaattttggcagggcaaggggatgataatattgaaattgattcatttgataacgaggatttatccaatcataaattttcaaagagcggaaatagtggtgcattgttaggacagacttctggaaagctattgaactttgaatatagaaatcatgtatattcctggggtgttaatgatcaaggccaattaggagttcctgttatggacttggtatcatcgaatataagggaacctgtaagattcattgattctgaatataggtatacaaagaatgaaaaaacagggaagactgttcgttacttaataagacagatagattatacaagaagaattagatgggtaggatgtggatcagatcattcaatggcgattacagcggatggaaagctattcacatggggcgaaaacatatttggtcaatgtggccatggacataattattcatatatcccgagtccaaagatgattgaaccacttaaagaagaacaggtatacatggcttcagctggcgcaagacactgtggtgtagttactcaaaatggtgcagtttttatgtggggggcaggaactcatgtatgcttagaggattatagattcaaaacattatatggccatttggcagagtatgatactgtaagtagtaatgccaatttttatgagccatttagggtagaattgcctagctttgataactcttcaagtacaaataaaaatgacgataaaaaaaatggaaaattcgggacagatgaatataacaataaaaatgaaggaaacaagaatggaggagtgagacaaattttatgtggaaatgggtttaatattatatgtactcagaacctatttatttggggaaggaatgacaaggggcagttaggcatgagtaaaaaaggacatttattagtgccaacattacttccgttgcctacgactgatttattaaagcttgactattcagaagaactgaagaaagaagtgagaaggagaagtttattaacattgatttcaggtaataaaattactatttcatcaattagtgccgggccggattttgtgtgtgctacagttgaagatggatttaatatcatgtatttatggggaaactttactgttcatgagcaaactggggggagtaactcatcacattcagcaatgaaaaattttggtataagtaaaatcaacttaaaatcgcaaaattcatctacaatttcaaataaagcaattcaatgcccaacaattgtaaggcatagtatatgggaaaagaaaatattgacacaagtagcatgtactgttaattcaattgcagtaataacagatgatagtgaattatacggtttcgaattagtttcattaaaaaaaacagaagcagggaaatctgaaaaaatttcgttaagtacagatgaattggatactggacataagttagataattggggtggaatcatttctgcaaagaaaaaacaaaagaatgtaatggataagaaaaagacattattaccagaattttgtaaggatttggatatattgcgtattccagaaaaatataaaggtaacttaaatgatttattttattttgagccaagtctatatcaatacagatgcgtaccaaatacaaaaaaggcaggattattaacagaggaggtaatatcaagtattagttcaacaatgagcatattatgggttaaacaccgtagaaagacgtatatatctcaaattaaaggaaaatcggacacaaataactcaaaaatagatacagataatatggatgaaaatgaaaaattggtcgagattgatagagagaatgtatcaactgattcacagatgaagatggatgaaggaaacatactccagaaggttaaagaaagaagaaatattgttatgaatagaaatatgattttacatcgtatacaaccaaaaagttatataccttcttatttattccatgatcctcagcgtgtattgggaaatggctgtaatgatagtgtttttgttgaattattaagaagaataaagaataaaaataaaaaatccatagctgaaagcgatgaacatattttagatttaaatgaagcagaaaaaccaaattaa

SEQ ID NO: 1097 - DNA, 975 bp, Cryptosporidium hominis
atgaatgttagactaaattttttgctatatactgccgtattagtctttgtatgccttactagctcttgccagtcgtatgagtcgtttgatccaagatctcctaatgggggtgttactttaaatggatatatccaaaaaccagggattttttatttcctaaatgaggaactccgttggagagatcgtgactttccattttacaatatgttgatgagcactgttgctaccacttttattaatcttattaatcaaattgaaaagaatgaggaaggattaatgctttattatagcagggaagtagctagacttgcaaaaaaaggggaggtgattaattcaatttacaagagctttttaacagttaagggctcgaaacatgaactaaaaatttatgaagaacagttcaagcctttgtgtaaaagttatagaattgaaatagcaaaaagtcccattatatcaattgtttcccattcgacatccagattaaatgcttatgattatcttattccatttattccaagtgaagttctagacccggtaatgaaaaagttttcagtcgaagtaactaagtttttgtggcctcagtcttttgccgaaatgtccaatgtttttattactatgatagaaaaattggagaaactatgcaaaaaaatcaacttcaatctgctagaatcatgtaatgaatacatgcagcagtctagaagttacttgattgatctcattaaaaatcacgagaaatttttaaagtattcaaaaacgaaaaatgcaaattacttggaattttctaatatcttaagaaagctacgcggcgaaatactttcgttcaaaccttaccagattgtattaaggaagttagatccagttaaagcagatgcacttggggtgcccatgttttctggattcaatcacagcatacttgatgaaacaatgaaagaatactatgaaatattaagagatcgaaggttaaagaacaggtaa

SEQ ID NO: 1098 - DNA, 1332 bp, Cryptosporidium hominis
atgcatgaaagaactgatctatttttcccagcatcaacaaatgttgatttgaccatttcaagatgcaaaaaaaaattggctagcttgagaaggtatattaaatcagtctcttatctgagaagtcagacaaatactgggcattcgagggataaatatgatttcaatattaaaaataatatgcgccagctacaattgaacaaaaatgagaaatgcatggatttgagacgcaatgatgaaaaaaaatgtaattacaagtattatggccaaaatgagaaaaagtataatgctgaaatgaacgcttgctcaggaatagattctgagagttcaataagctacaatagttcatttgtaaataagttaattgaaaggtattactcaacttccaaatcgaaattacctgatttaaacaatgttgaaaagattatctcatttaagactacaagtaacttatccactccgcaattgagaataaataacgagagaaaagatgaaagtcaaattaatcaaaacattcccaaaaataacatggagttaaataatattgaatcaaattatggttcatattgcaatcctaaattcgatagtgattataaaaacaataatagaaaagaaaactttgaaaaacaagaatcaccccatgcaactttattaaagcaatatgacttagaaactagagagatagttgataatctcgacaagaaaattagaaacttggaaagaaggttaaaaaaagataaaaggaaaataaaactacataataaaaatgagtttcaagaacctatctacgaacgtctagaaaggtcaaatagtatagaatcaaaactattatcaatatctgttatgcctccaaatggaatttcgtgcttcgaaagttcattcttaccatattattgtacacaacaagagataaagattttggaggatttaatttcaatcaaaggagaaatttacggttcatcgcaaacaagcattaaaattgttgggattggaaaaatattttgttgtcatgcaaggactagatttatagatagtattaaacgattataccaaggttcaattaattttattaagttaaaattgctaatatatatagaagagcccgaaatactcctagctaatacctgtgggccacaaacctttgaaaataaatatgatatgaatttttatgagtttgaagaattatacgaaactaaaaaaatttccaggtttctaatttgcttggtgattactgacagaccaatggaatgctttaaaaagaggtgctatactattagcaacgcaaagcaagtacttccgatatatataattaatattaattcaatttcaagctaa

SEQ ID NO: 1099 - DNA, 744 bp, Cryptosporidium hominis
atgcatagctctaagcttaaaagtatttatttaatcatatatggcattgtttcaaccttattttgggctacaacattatactttacaattaatgaaataattggcataaaaagtacttatgaacaattaggtaaacatatgatagcactgcgaatttcgcaaagcttagcagtattagacataataaattcttcacttggaattgtgaagtcgcaatttctgcccacaataatccaagtatcttcgagattacacatagtatggatcgtattctatttgtctccagaaaactctcgccaaatttcgacagttttctcaaatatcatgataataacttggtcattatcagagttaatcagatatccatattatgttattttgcaatgctcatttaactttccatcaattagaatgcctttgttcctcaagtggctcagatatagcgcatttgctgttttgtatccaattggtatctttagtgaggtaattatttgttcaaactttatctctgatatttataataattctagctcaagcgatccagtttatcaaagattgctacatttccccacgaaaatgcctaatgctctaaatttcgaagtgaatcttgcatgcttatatattgttatattgtgtatatatattcctggctctatatttatgtattcatacatgatcaggcaaagaaagaaatcattaattaatttatggaaattggagggcgataatacgaaggtagaataa

SEQ ID NO: 1100 - DNA, 540 bp, Cryptosporidium hominis
atgacattgtgcgcaggtaaatgtacatatgaaactggagggagatgcatcgtcagcctttcagagccactactaaagtatagatccgttaaagagctaaaagagacaattttgcatgagcttattcatgcttatttgtttttgacatcaaacgatagagatcgaaattttcacgggaaggagttctgctttcatatgaacagaataaacagaatgtctggcctaaacattaatatttatcacaacttccatgatgaattgaactattatagaaggtatatctggcgttgcgatggtgtttgtagaaatcatccaccctattatggatacgtccgacgttcgatcaacagaaagccaggcccagcagattcttggtggaattttcataaaaaaacatgcggaggttgttttgtcaaggaggccaaaacactacctcaaataaataatttggagtcactcgatacaaagcctaacggccagacttctagtccaaatatgcatcaagatgatatattggaaattatcgaagttagtgactag

SEQ ID NO: 1101 - DNA, 300 bp, Cryptosporidium hominis
atgtccagattatctcaatccctgcacgataggcatattacaatcttttcgccagaaggcaaactttatcaaatagaatatacctttagagctgtaaagaattcaaacattacggcaattgctataaagggtaaagataccgtatgcattgtatgtgaaaagaaagtcccaaatcagcaaggacaacaagataaacttttggaccctgcctatgttacgtctttgtataaagtaagaaagcatattggggcagtaatgcttgggttggctcctgattgtagatcacttatttcaaagtaa

SEQ ID NO: 1102 - DNA, 351 bp, Cryptosporidium hominis
atgagacttttgggtgcttctgggatgtttatatcaatagatgatgaagatgggccttcattatacaagattgacccagctgggtactttgcctcctacagagcatgcgctgttggtacaaaagagagagaggggaataatgcactcgagaagattatcaagaacgagcctctaaacagctacgaagaagttatttctgcaagtattgactgtctgaaaaccctacttggagtagatttcaaagctgaagacatagaggttggtgttgttacaaaagatatgcccgaatttagactattaagcgttgaagaaattgataattacctaactagtatcgctgaaagggattag

SEQ ID NO: 1103 - DNA, 219 bp, Cryptosporidium hominis
atgacaattgaagacgcattaactctggtcacacacagagcaaccatcatggcatctacacctgctctagatggaatcatggtagcctgtagactcactgaatctcaagttgttgatacaattaaaagatttggcctcgaagaatctgcctctttggcagctgttaatggacagaaaagcgtcactatatctgggaaactttttttgagtttgaaataa

SEQ ID NO: 1104 - DNA, 9846 bp, Cryptosporidium hominis
atggatggagcaattgcttctcaaacaatggaaatgatggagtcagtatatgcacccaaggtatatggagcatggaatctacatgaatgttgtgagaagtttgaattgaataaaaatttgaaacactttgtgatgttttcttcagttgcatcattactgggtaattttggtcaaacaaactactctgcagcgaattcttgtttagattcattggttgaatatagaagaaataagggaatgtgcggaactagtatacaatggggtccctggattgaacaaggaatggcaatgaatataaaacaacatttagagaaggttggaatgcatggaatatccaatgaaatgggtataagagtgattaatgacgtgatcttatatcaaagcacagatgtagataagaactcattagggaaatacccagtaatcacttgccaatcatttaattggaatgtatatatgcgtcaattatattataactcaaaatatccatcattcttcaaagatgtggttgcatcaatgtctactggagaagtaaagaatataggaatggatttcagggggatgagtaaagaggaagtgtactcgtatgttaaagactcggtgcataatatagtagaacagattattggaatacaatcgtcaactcttgacttggacacgccattttcagaacttgggatggattctttgtcggcaattgagttgaggaatgcattaatttcaagatttggaattaagatatcttcgacagcattgtttgattacccaacattgagatcaattattcagcatttgacggactctttatatgtttcagaaacccgagacgcattttctgacctaggaatgagtatctcagaaagagagtattcagtcgcaataattggtgtttcttgtaggcttcccggtagagtaaagtcatttaacgatctttatgaaattgttttgcttaaaagtaaggattgcattacagaaattccattagatagatggccatttgatttatattatgacccagatccagataatagaagcaagtcatatgtaaaccaaggcgcattcataactgacattgatctatttgataatactttctttggtctttcatcaactgaggctacaaatgttgaccctcaacaaaaatatatgcttgaggtagcatatgaagcaatgtataattctggaattacaaaacgttcgctaactagcatcaaaaaaacagcaaaaacaagtgatgatcctgtattaatgggagtttttattggctgttgcaatacggattggcacttccttcaagcaaagtttggctttgaaaacttcacttcttatactggttctggtggtgcaagctctcttgtttctaatagagtatcatattcatttggatttagggggccttcgcagaccatagacactgcatgctcttcgtctcttgttgcgatggatgcagctctaaagtcgttgaaagaaggctcttgccatactgcattagttggaggggtaaacttaatgctaagcccgcatttatttgtagcattttgccgtgcaagaatgctttctcctgattgtagatgcaaaacatttgacgcctctgcaaatggatatgttagaggagagggctgcggcgcaattttattaactaaaagatcagaaataggtggaaaaaaaattaggccaattgcatatgtgctgggatctgcaacaaatcataatgggagatctgcaagcctcacggctccaaatggtccttcacaaacagaagttattcaaaatgccctaagaaatgctagactaactcctaatgatattgattacctagaatctcatggaacaggaactcctcttggagatcctatagagtttggtgccttaaagacggtttttggaaacaaaaaggatattaagagaagtcaacctcttattcttggagctctgaaaacaaatattggtcatcttgagggtgcagcaggtgtttcaggactactaaagttaatcttggtgttgaaaaatcgtattgcaccaaaaatattacatttccaaaaacttaatcctcatattgatactgagaacttcgacgttgaattcccaactgagttaaaacctattatttcgaataaatcaaaattagttggtggtgtgagctcatttgggtttggaggatgtaattcccatgtaattttggaatctgcctctgccagcgaattgaatactgaaagtaaccaaaataaaaattatccatatttgatatttgcgtatactggccaaggatgccaatatattaatatgtgcaaggaactgtatgatacggaagaagtttttagaaatgaaatggataaatgcaatgaacttttatatccaatattgggcagatcattgatttcaacaatatattgtgaaaaaactatggagagtgagaagttgataaatcatacatcaatttctcaaccagcaatattttcaattgaatattcattaactaaactgtgggaatcaaagggtatagttccatctgcagtaatgggtcatagccttggagaatttgcagcagcagttactagtgggatcttatgcctcaaagatgccatcactctagttgcaaggagagcagaaattatggcatctcttcctcagaatgatggaataatggttgcgtgcagggtttcagaagatcaagtattagattccattaataaattgaacttgaaagattctgcagcagttgctgcaataaatggtccaaagagcgtaacaatatcaggaagcaggagttcagtaatggaggtcttgaataatttgggtatggaagacagatataaacaacttgatgtttctcatgcatttcattctcctttggttagctctgctgaagaaaagtttgaaaaagtaatagaaaatattcaatttttcgagccaaaattaacattcttttcttccgtaacaggtaatattgaatctaaattgttaatagaaaataaatattgggcacaacatattatacattctgttagatactatgatgcacttgagactgcaatttctacagatgaagaaaacatagcaattatcgaaattggcccgaagtctgttcttacctcgatgggtaaacaggcagtaggtggcattcaattagtacaaaactcaaatgaaaatatttcaaataatgaattgacatggattccaacaattgataattcaaaatcaaatacaattgatttcaatgatgcactaaaagctgctcaggaatatataaaatatatttcagaaagcgtttgcgttcataaatggaaccactctaggttccattgggcagatttgacatctgttcaccccttattgggaaagttttattcatcaatttcagatgaaaattatcttgcttattccactgatatgctaaaatctaaagtatttaaaaacattgtagaagatcatgttatttttgatacaaatattattcccgcagcagcattgattgaggcatctgcatgcgcagcatttaaattacaaaggtctgaaaagttcccatctaaatacgtcgaaatggattcaatggatattgaaaagccattagtatcaaatcaagatgaaactacatctgaaatggaggtctttgttgcaaaaagtggagcaattcaaataaggaaaaaatgcatttccgaagcatttgaatatgaagaggaattttatggaccacaaataattgccaatgatacagtatttagtaatagtagaatttatcatcatgcatctatttcaaactctagaatacttagcaaggatgaagtagataaacaatgtttcccaaatttagtggattatttagaaaagtattcagcaaaagatacaatagaagtccccatagacaatatttacgaaatgatgaatgaaattggtctacaatatcaaaaaaattatcaatgccttaaaactgtaaaagtaaaaattgataatagcaacgatgaaaaaaaaatcaagagtccaggaaacaatcagataaatgaggtattctgctatgttaagaggccaataagtgattttgacctaactgagcttaggattcaccctggaatgcttgattcagtatttcaagcatcctcagttttgtttgcttccgatgagttattggagggcaaaaatgcgacaaaaaataagagaggccatgttgcaatggctccaattggattcactaaatgtttttatggaagaatacaacataattctgatgtttggggtctagtgaaattaaatcgatttgaaaaaaaaggaaatatagcatttattgatgtaactttgtgggatagtaaaacaaatattttggcagcgcatttccaagatttaattttaaaaggattttcgaacgcagcatcattactgtcccaagaagtcagaattccaaaccagtttttatggagaacttataataaaaagatagtagatagaactcattgtattgaaaataacagtacatttgaacaagaaaataaagaagatcaagataaagagttcaagagtgaagactctgatcatgacaaccaaattcaaaagattcttatctttggaataccaactgtaattaaggaattgatttgtagtaaaatagataataaatacaaaaagatttcaaccacatttatttgtttagaagaagatctaacgattgacctgattgatcagaaaatacaagaagaaaactggtctgctatgttttatttaggtggtttaatggataatctctcaagtaagcaagttatgggcgatattttaaaaatatcgcaggtaatttcaactatttctgtatctattacaactgcaccatttgtttgtttaacttcatttaatgattgcaaagaaaatgggaatattcctagacattcaggaattaaaggttttgtaaaaacagctagagtcgaacttgaaaatgtcataggaaaatcaataaatatttctcatattgagtgcaattcgagtttggtaaacgacccagaaactcttatgaggacaataagttacatagcctcaatatatgaaggaaagattgaagaggaaattactttggaaagagatttaactatatctgaaagtggaatttatgcccccagattagaaagtattaatttccctgtttttggtgcaattaaattaacaatgtcatctaggggagcaattggaaaccttaaattcaagccacaaggacaatctgaaagagtaaatccacctgcaaatactgttgaaattagagtaaggtcaattggacttaactttagagacgtattaaatgttatgggtttgtatcccggtgaccctggacctcccggcggtgattgttctggtactgttgtcgctgttggtgaaggtgttaagcatattaaagttggtgacaatgtatttggaattgctcctggatgcttaaaaacttatgttaccactgattcaaatttattatgcaaaattccaaatggatttaccttcgaacaagctgctgcgttaccagttgttgcaactacagttgaatattctcttagagatattgcgaacatcaaaaaaggagatattgttctagttcatgcagttactggtggtgtaggattaatggttgttcaatattgtaaagcaattggtgctaaagtatatggcacagctggaagcgaatctaaagttgaatatgcactttctaatggtgttgagagggtaagtagctcaagaaatgctgataaatttaaggaagacatgaaagatttagagggaaaagttgatattgtaatcaattcattgatcgaagactttattccaaattccttgaatttattgaaaaaaggtggttgttttgtcgaactaggaaaaagaggaatatggacagaagaagagatgaaagaaaagaggcctgatattaagtataaatgcgttgctgttgatgtaatgatggaggaagatcctgcttggttcgggggaatgctaaaaagaataaaaaatttggtagaagaaggaataatcgaatcattaccactgaaagtgtttgatatgagaggttcagatgagaatggaatagatgcattcagatatatgcaaagagcgcaacatataggaaaggttatcattaaaattccaactcctttcaagtatttagaattggatatggaaaatcataaattaaacaacgttggttctgaaaaagaagatagatacaacagtgaatatggcattcatgtgattactggaggattaggaggaattggaaggattattataaagtggatgttagaagaaggagttagaaagattgcaattttatcaagaagtgctaataatgattctttaagagatatcccagaaataaaggattatttgaatacagatattattcaaatagaatgcataaaatgtgatgtttcgatattgtcgcaagtagagaatgcatttagggagattctagttaaatttggagaaacgaaccaaatacatggaatatttcatgctgcgggtattctgatggatggagcaattgcttctcaaacaatggaaatgatggagtcagtatatgcacccaaggtatatggagcatggaatctacatgaatgttgtgagaagtttgaattgaataaaaatttgaaacactttgtgatgttttcttcagttgcatcattactgggtaattttggtcaaacaaactactctgcagcgaattcttgtttagattcattggttgaatatagaagaaataagggaatgtgcggaactagtatacaatggggtccctggattgaacaaggaatggcagcaaatcttaaacaacatttagagaaggttggaatgtatggtatatccaatgaattgggtattcgtgttttgaacgacattctatgctttgtatcaaaaagtagccctgttattggttgtcagtcactgaaatgggatacgtttatgcgccgttacaatacgataccaacatttttaagtgaagtcgattacagttctcagggtagatcacaaggtcgtgttgacataagcaagctgtctgacgaggaattggttgttgtcattgctcaagttgctcaacagtgtgctagttctccgacattaccaagcccagatactgttttgttagacttaggattggattcattgggagctgttgaatttagaaattcagtacttgaaatgacaggagttaaattgccgcaaacacttgtttttgaaaaccctacaatatatgcgatttctatgtatgtaagggatcaaaattcaggaaactctacaaaatcagattctaaaaaacattcccaggcttcaaacgaacaaggaaagattacaattgagcagtggcttctatcttcactcaaacagtcagaaaggtatattttatatgctgaagcttttgaaaaaaaataccaaacaatcagcaatttaattactgagactgatattattagtgcattagaagagttgggagttgaaaataatcaggactatgatctattatatgtttcttggaatgaattaatttcttctgaagaggaaaatagtaagaagcaaaatgatagcaataacaaaaaacttgaacaggagttaatatttgatcctattgcggatgtagaggagatcagaaattccatgaaattaaatttggatgggatattaacaacaactgacccatcagagttcaaaaccgcacttttgacaggtgtaacaggatttgttggtagaatattgctcgtgaaactaattgaagagtttaagaatatgcagattgtttgtcttgtaagagcaagcagccctgaaaaaggcttagaaagaataattaatgtttgtgaagaggcagaagtgtggaatccaacctatgcttctaggattattgtcgaatgtggaaacttcgaagaggagtatttaggactttcagaagagagatattatgaattatgtaaagaaatcgacgttgtttatcatattggaggtgatgttaatctattaagtaattacaagagattaagaaaagcaaacactctttcacttgttggtataataaatttttgtacaactatcaagcttaagcacttgcatttctcttctacacttggacagtttccagcattttttgcggtatttaccagggagtttgaaaatgcagttgttaaggaaacagaaggaccatctacgagagaaatgagcagagtgtttcctcctacaagacaagggtatccttggagtaagtgggcggctgaacaaatattagaaactgctcatcaacaaggacttccactttcaatttacagactgccaaatacatatattgcatcagatacaggttatacaaacaaaactgattatgcaacagctttattgatcgcttcaattttggagggtatgttccctattggttcatcaactgcgccattgacacctgttaacacaatatgtgaaataataatatctgcatcaaaaaagaaagaaaggaagcattggagatataacttattagacacaagaattttaggaaaaaaacatgttgaagcttgggcatctcaattagggctaggaaattataaaggcgttgctattgatgaattcttcagtgcaattaaaagtagaggaccagaaagcccaattttcaaatttgtaccattaatgcaatactggaggcactattggtttgataacactgaaagaactcaaccttttccagtagatacatcgaatgtttctgaagatatgcctgaaatttcatggccaccgttggaaactacttttcaaaactcatttttatactgcgcaaaaagaggttatttcccatcaaactcttcttcaatctccttcactccaattaaatgttacagcgatgctttaaatgaaattaaagcagaattgagtttaagaaatgttaatttcaaccagaataagtatgattttatttgcagaaaaatgcaaaaaaatgcagattcaatttacgattcattaaaaaaagtttcactcaatttctgtgctaaatattcttactacatacttctgaagcaatctatagtaaatcaatatattcttcaagagtccctaaatgattcaattttagaaaagtttaagatgatggattgctactttattacgggaacatcgtttgaagaaatattggagttgagaagaataatcagaaaattactaaataattataatgaattaaaatttgttgacattacttgcccttatcttccaacgaagaattcaagaagacttattttagaacaactaaaaatcgcaacatctattttaccgttaaaaagattcgaagctatggatttggatgaaatattgacagacgactccattttgttagaaatgtttatgtttgctccgtttaccttaccattgatatatggaaaagagtgttttgaagaatacaaaaataaaattacaggttgttcagaggtaatggaagcatattcatcgtttaaaaattatattattcaaactctaataaagaataattacaataccgaatatccgattatttttagttctccttttcatttgccttttgtaaaagaaattttacagatttttgagaactccaaagtcattgttgttgataataaaccagataattcgaccattcaagggaagttgtcaatggtaaaatctttaaaatcaaaatatacgaatttagatgttagcgaagaagaaaattcagagatatatttgttagacatccttgaggaaatgaagcatagatttgctatcaatgaacccagcattgataagaataggctaatttatctcaaagattttggagagatacacaatgaaaagataagcgtacagttacaagatttctgtttcacaagtatagacagtagattttaa

SEQ ID NO: 1105 - DNA, 1155 bp, Cryptosporidium hominis
atgaaagtgaatattctctatagcgtaacaggagagctcatctccgttgaaatccatgaagaaactactgttgaagttttaaaatcgcttattgaaattgaacttaacttagatagttttaagaattacgagctctcaattgaaggtaaaattttgcaaaatgatggattcgtattatctgatattgtaaatgaaggttcaatatttgtattatcagaaaaaaccaataaaaatacctttgaaaattctaatttttctttgaatgaccaggaaaatctgattcaattgctttcaaaagagcttttcacaaaaattaaagaagatcaatcattaaaatcagtatactactcaaaatcaagtaaatatagagattcaattgataaagatgatattaaaagttttacagaactaataaaaaatgactacttttccggaaatctgaactctattccttctagttcaaattcaagctcaaatttgtataatttggaccctttaagcccagaatatcaaaggttaattgaagagcaggtaagaaaacaaaatgttgaagaaaatttaattttggcgcaagaccatttaccagaaagttttacgcaagttcacatgctatatataaatgcagaagttaatggaatctcaattaaagcgtttgttgatagtggtgcgcagacaacaattatgtctaaaaaatgtgcagaaaagtgcaacctcgtgaggttaatagactataggtttagtggaattgcacaaggtgtgggcacaagtaaaattgttggcaaaatacacgttgctcaaatgaaaattggaaattccttctttccattctcaataacagtacttgaagaaagtcatgtggatttcctatttggattagatttacttaaaaggtatcaatgttgtattgacttacatcaaaatgcactaattattggagatgaaaaggtacaattcttatctgaatccgaaataaatagtgaaattagtcgaatagatccaaataatgaatatgatcaatgctttgaacaagggaaaaaacttcaacttttatcactagggttttctgaaagccaggtaattaatgcattaagagctacaaatggaaatactgaattagctgcgtcgttattattttcaaatgaaacttttgaataa

SEQ ID NO: 1106 - DNA, 756 bp, Cryptosporidium hominis
atgactagtgtaggatctggatatgactcatcagtttctaccttctctcctgatggccgtgtcttccaagtcgaatatgcaaacaaagctgttgacaatagtggaacaactattgcaatgatttacaactctggtattgtttttgctgtagacaaatatgttgctagcaaaatgatggtagcaggtactaacagaagagtttttgcgatagataatcagattggttgttgtgttgcgggatttgttacggattcgaacaagatcatttcaatagcacgttcagagtcgttaaactatcaaaaaatctatgggaattctataccaatacgcgtgttagcagagagaattgcaatgtatatgcataactttactctttatggttctgttcgaccgttcggttgttcaatacttctggggggacttgatcaggatagaggtgttgagctctattgtattcatccatccggctcatgctataaatactgcgcaatggcagttggtaaaggtagacagtttgcaagaactgacctagaaaagctaatagagaaaaatttatccgaggaagacgcgttatacgaggctgcaagagtgataatacaatctagagaggaaggagcatcaaaaaaccttgaactggaaatggcctttattggccctggatcagatttccaattttctataattcctgaaaaacaaataaatttgctcaacgagcgtgtcgagaaatacatagatgaccttgcaagcgccgagtag

SEQ ID NO: 1107 - DNA, 1422 bp, Cryptosporidium hominis
atgccaatcagagaagtaaatgtgaacaggcaaactatttcaattaagggccgtatcattcagaaaagttcactccagattttaaagagtgggttacggttttttcatcttgacataatagacaaagataatgatgttattagagttaagttttggcgtcaaaaggcagaggagtatcataatattttacaacatggctcagtatatattttaaaatgcacaggaaacgatgttgttgtttcgaatactaagtttaatgacacttcaaatccgtatgagattaacttttctgatagatgttttgttagaaaagttgagaacgatgatgattcaattggcaaggcaccaaaatatgttttttcaactgtgaaggatattagagaaataccagttccttcaattgttgatctgatcggaatagtcagacatttcagcccttccacaaaagtgatttcaagaaaaaacaatgatgaggtttccagaaggacaatttcagtagtagataaaacaggctttcttataaacatcacattatggggagaattagcggaagttagtgatgaaaaatttttggggaatccagtggttgcattgaagagcatacagataagggaatatcagggtagacaaggatctacattaaatgggagaagcaatatggagttttccatagatgatgggaaaatggaagagttgagagactggtatgatagtattggaagttctataaagtttgaatcaataagcaatatatcctcgaatgaatcaccaaataatttcagagttaacgataaattatactctggaaggactctcaaagatattaggaatcggatggaagataacgagttttcgtcaactcagtcgtttcaggtaattgcaagaatttcgaagattggctcaataaacgtaaatcaacaagtttctggagataaaggcggttctttgacatacgatgcatgcccaatatgtaaaaagaaagttctcttttctacttcttattgcgagaagtgtgacgaatctgtagttcctgagactaagttcctatttcctgttacaattgaagaccatacatgttctttaaccgttcaatgttttcatgaaattggctcaacatttattaaagaattgagtgcttcagcctgcaaagagatggaacaaaataacgacaaaaagttaaacttcatccttaatctgcaatgtatgtggaggcattacaatctcaaaattcaattgaaggctgaagagtacaataaccagaaaaaaactagggcaataattcaatcagccgagccaattgatcttaatcaaatttcctatttaatgctagaatcgatcagccaatcaatattaggtaaaactaacaagagatatttatttgaagataacgttaacacaaacaaaagaatttcggttggctag

SEQ ID NO: 1108 - DNA, 453 bp, Cryptosporidium hominis
atgtcaatttcaaaaagaatacaaaaagaaactatgaatctcgcaaatgatccgtcgcctggaataaatgcagaacctgatgaagacaattatagatatttcaaaattatgatgatgggccctgagggcacaccttatgaaggtggaagctacaagcttgaactttttctcccagagcattaccctatggaacccccaaaagttaggtttctaacaaaaatttaccatccaaatattgacaaacttggaagaatttgtctagatattttgaaagataaatggagtccagccttgcaaattagaacagtattgctaagtatacaagcattactaagctctccagaacctaatgatcctctggacactgtagttgcagatcatttcaaaaataatatactggacgcagagtcaacagccagagaatggaatagactttatgccaaaggatcataa

SEQ ID NO: 1109 - DNA, 639 bp, Cryptosporidium hominis
atggaaaagctaagctcatggttacatgaacgcactaaaaggagaagagatatgagaaaaaaaataaaaaacttatggaatgaagaagtatccttaaatggagagcaagataaggatatttcaagcgtagagaacattattgggtattttaaagataaaagaaggccttctttcgaaagagacttatctttaagcgaggatactgcctcaatgagtccaaatagtgatgttggctgtgataatgaagaaaagattgaagatgatcatttgttcggtccaagtccatctgatattaaacaaacagcaatcaaccaaaacctaaattatggagcagctcttctttatggcgaaggtgaagctatggcacaattcgtccaagcaggaaaaagaataccaagaagaggtgaggttggattaacaggagaacaaatagaatcgtttgagaaggtaggatatgtgatgagtggaagtatgcacaagagaatgacagctgtaagaattagaaaggagaaccaagtttatacggcagaagaaaggagaaatatagctcttcaaaacgaaaaacaaagaatgttaaaagagtcacaattattgggagaacttcgtgaactcataaaaagagaagagaaaaagctttag

SEQ ID NO: 1110 - DNA, 237 bp, Cryptosporidium hominis
atgcttagtgctatacaaggttatcactcagctgcaaaatcaagaatggaacaagatttagtttcgaaggttcaaagacatccaggaattccaagctctcacttgagccttgatctactaatgaatatggatgacaagatcgaagtaagcgatattctagggacggagaaacctatcgatccattgggcaagaagacaatcagcgacacattagagtcgatattcaatatcaatagt

SEQ ID NO: 1111 - DNA, 423 bp, Cryptosporidium hominis
atgtctgaattggaagccctgagcaaccaaagtactgagcgtggagttgttcaagagaactccacagaaaagatggatgcaacagaaaatctaaacgaaatttcagtagataacaatgccgccattgagctattaaatgttaatttgcaggacatgttcgccaactcctttattggtgctaacgttgttaatgccacaagaatgcaagagactattggtgaatcttggccatttgaccagtatcaggcaaccggcttgttgccagtagattatgcgtactggcttacgccttataatacttcaataggcccaactgcatttgttatgatgcaggccacggcaacattcccagatggcactcagatggatgcacaacaagcgagagcacgaagaagacgccatgtatttggtgtgtgttgttaa

SEQ ID NO: 1112 - DNA, 1650 bp, Cryptosporidium hominis
atgggtgattatattccaattgaaatcgagccaaaaagaagagccttatattctgaaatcttatctaataatcggtatttatattctaatagtgggaatgaaaatgaaacaattaaaaatttagaatttagaatttttaatggagaaacatctctctttattactacaggaaataaactaaaaacagtaagccccataaaaataaatgaggaaaattcaagcaagcttacctcatttaactcaaagaatttaattactgcaactactctaagaaaagatggtagactttgtggaatttcaatggaaaataatgaatgtatcgcgctagatactgaaactatgactgttgtccgcaggtttgaaaagagtagtgaacaactctcgtcaattgcgttttcatgtgacaaaagcaaaatcatttctggaacattgacaggtaaagtctcaattttagaggtttcctctggtgaaattgttttcacagctcctgcgcacaatgatatgatcagatgtatattaccacttgaaaataaattgtttagttatcctaaccatgattcaagcataataaatactttaaatatttattttgcaacttgtagctatgactttaatatcaaaatttggtgtttttcagaactcaaacaagctgaaaactatgctgcaagtaatgcttcaccaaataaataccaactaaaggttatgaaaaccttgaagcacaattttcctgtagaatgtattgatattattaatgaaaataagttaatttcttgtggaggtacttgtattaaaatttgggatctggaaaaaactgaatttgaatgtattcacagcatcgcgaactttgctcgaacaattacaacaatttcctctaatgagaatatatttgctgttggatgtttggaccataatgtatgcatttatgactctaaaacatttgaatttattcgatcttttaattataataaaggaatagtaaaagttgcaacatcaaattgctcatcgtatattgcaattgctcttgaagatggtagttggagtataagaaaaaaagtttcttcagaaattaaagagacaactagggatgttgctaatgaagatattaataacttaagaaagggatatagaacaggtacgataagatattataaaagaggtagagcggtttctgcgaatgctatggacatagagattaaaaattgcaagaagcgtcaaacaaaacttgataggttattacgatcatattcttataaaaaggcattagaaattgctctcaaaatgagctggccgcattttatttcactcttgaaattactctcatcaagaggagctctgcatttgattgcaagggagaatgaatacgaaaaaactattaaattgctaaaatatattagcaagaatatgggcaagtgcggcccttaccaatttatattgatttcagaattaattgaacacattctacatgaaagtaacattgtaagactattaaatcaaaataagtcagtagaaaataaaaatgaaatatttgaatgtattaagaaaatatctcaaaaggttagcctagagacgaaacagcatgtactactgaaggaattcaagattgcagttgagataattattcaaaactgcaaaaagtgcttggtaaattag

SEQ ID NO: 1113 - DNA, 1656 bp, Cryptosporidium hominis
atggaatttaccaaacttgttagtaaacccagttttaaattggatttggataaaatcaactataaatttgaggcaggaaataaaaatagcaatagttgcaaagccaacggtaatagaggaaaacatagcttggaatgtggaaattcatgcggcactatttatttggaagatgatgatagtcagattttggaacaattaaaacgcatagaggaggagaatataaggcttcgcgaaataaatgaacagctttcgagatcactttgcatcagtacaagatctatttcaataaataacaataataactcctttcaaatagatgatttttccaggcagtcgtcatttcttagtagtcaagcattaacaactagatcaatctctatgaacccacaaatagtaaaaaatttaaagatgacggtaagcgatataattggagatagatcagaaatagcactaagagttatgctactagaagatgagtattttttgggtttagaaccaattcttgacaggcaatctgcaagagttgtactatcaaagactccttcctactggagtattaaaaaaatacctcatttttgggaagggttttcaaacataatgtcttccgtaattaaaaaagggttcttaaatactataagctattggtcttttcttagggcacctccaagccccaaaaaaaatgtaaaaaaatgggaaggcattacgattaaatataaagggccactcaaagaatttagaggatattcattggctggcaatgatgacggattgtttgtatatcttgaatcagaagaggatgcatatgacaatatattctattgcaacttcaggaagaagaaggaaaaatgtactgaagattttagagattgtaccaatgatctacgaacaaatgtattaaatttgctacatgctaatacaagaagttttatttgtatagagccgaatataaaaagtaagggtggaaatataatgattaagttgtccgagtcaaaaaagaacaaattgatgtttgaagaaataagtgcaagcgaattacttgctaggcaattgctgatatccgctgaacagatttcccaagattttgatctaacaaatagaaatattcatcaaatgacatctttcccatcttttagaaattatgagcaaaactttcagaagacgagctcgaatagatattctcctgaagaaagctttaggagtagaactgtggaactatgctcctcggtagagacgcaaaacaaagataaacgaggttcacttgcggatgaattatcaaatgaacttttaactcaaagaaatcagttactaagtaatttttttggtgagacaaatcattcaaaatacactttaagcgatagtattggctttaaagaagaaatacctcataacaacagctcgaaaattatagatacaaaccttggagaaaattccaaaatttgctcaccaagaattcgagcatcgaatgtaatcaacgaccagttatcaggattggagtatcatgaagtcccgttaactagaaggctaaacgtggtgtacattccatctacaactgctgtattagttcatgacctagttgatagcgaggaagaactaaataacaatatagatagtggaaaaataagcgatgtggaacaggagtatttcaaggttgaataa

SEQ ID NO: 1114 - DNA, 1335 bp, Cryptosporidium hominis
atgtattgggataagtatgacgagattcctctgagatggatctccttttttctttttaaatggagattggaactggatgaatcattcataggcggcccattgcttgatgatttctttgaaaaaattgggtcgatattctatctattgttactaaaaagatatgagactactttttgtgatattgatacgactgaagtggatattaaccttttcattgacagacttcctaaagttttaattttaataggtaatagtggatctgggaagagatactttgcaagagaattgttatctagcttctcaaagatttgttattttgaaaactcgaaatcctttaatcccgtgactttcaatatattaattgatgaatattttattgatacgagaactgctgattgttttgacaagaagatttattatttgaataataaattaacgtctatatcaaaagtaggggtgcgcttacgagactcattatgcagtggatctttttcccctcctgccatattggtttgttttagaagtgcaaatccaaataaatattacacaggaccaaatagtaactactatggtgatgtttcaaaacaaatagttattcttaatttgatctctaaatttatccgtatttgggatgacaaaaatattccaatcgtttcattttttatttcagatatagacccagatgattatggcgcatctaataagattttacagtcaaagactttggatataaaatatatatttaagtatggatatggagaattttttgaaatagatttcagaaactcctcgctccagatcgataaaatttccctattaaggttcttaatttataaaagatatgatataaatgaaatctctctgaattatctgatggaaaaaatttctagcattcactccaaatatattagggctttatccaatgaagaattgaaattcattgtaaatgagattgacctggctcgcatcagcgacattttaaatgaagaactgcatgatattccatacactgtttcgtgcggcagatttattgcaatagtcctcaatggtgtaatacctgacttttttaatgtatttttacattattttaacttcgtcatcaggagattgaataaatcagtcagcaattcaaattgtgcaatttgtgatttgagctgtgatagagagagcggttcatgcaaaaatggattaattcaaatgattggttttggcgaagcaattcataaagtaaagaatcttttgctcccctgtatttcatatccagaaatatcgaactttcaacttcctatagtttttaatgaagcgtctggtattattgtttttggtgcaaggggt

SEQ ID NO: 1115 - DNA, 2994 bp, Cryptosporidium hominis
atgagtgggttagccagctctccctctattgggaagacaatactatttgagaagaataacgattgggggcttaattttgatttgggcgagctcgaaatatatgaaaatcaggacttaaaaactagactaaaggaattaatttcgccattcgaaaacacattttcttctgtatctactctagaatacttgcatccatttacattgaagttccgaagcgagattttggaaaagaaatttgaaaagaaatttagaaaaagaacagaaattggtattttttggattggattgctaacattatttttaataatcttggatatcttattagaagtttacaatcaaaaagtaaatgaagtttctaatagttcagtaactgcctattttataatttgtggtgtagttgcaatatgctcattatttctaatcatctcatttttcgtcaatttcttaaataaacatttggaagttatatttacatcaactacaataataacaacaatacttaatattacagcaggaaatttattactagatgtctcactttcccctaataataactacgatcctgctgtccagaattccagatcacttattgtaatcacaatttgctcgattctacattttatgttaccaatttcttttatgagtatattaatttattcaataacgagtatctcattctatattatattggtcccttctatgctgatgcctattcctaacgaaactcaatacgtatccacaacaatttatctttttgtgttttgttctgtatgtattttggctaaaagagttaacgtgagctcttctagaagagacttttttaacattaatttagttaaagcagaaatgcaaatattggagaattctatgaatcaaacacctaaatctacaatgatcgaaggaacattagctaacatcaataaggttcaactatttcttcgctatttaaatacttcctgcacaaagggaataaatcgtaaaatgttacatgacgcaatggtagacctaacttctgctcaagtcactttatgtaggtcagatgatatttatgcagttgatccagttgcgattttcctaccgcagtcacttcagtcaaatgtgccacaaacccctagacaatctaaggttagaataataggtagtggagatgtaactccaaaagaaaattgctctccaactgcttctcaaaagataaaacaagagttgggtatatcttatgatgttagaattcctatatctcctaattctccaaagtcaatggggcagtttttatctccaaagtcgcatgagaacaagtcaagctatataagcgttgattccatatcagccagaaggaatacagaatcaagggctactgttacatcgattcctggcccttctcgtcgaagactctcaatgatgattgctactgcaggagagaactcttcaacacttattgatccatctgttgaaaaggtgagagagtatattactgcagaatttactaaatcttctgcatctagaagagaggttttatatgcttctaaagtttttgatggaccaaccgcaaacccaagcaataccaatgaaaaaatcaagactacatctcaaaatttggatacaaatcatatagtggaaagtatgatttcccgtcaaggacccttagatgaacctgtagttggtggagatattgaagataactatagacatcttttaaagaataagcgtaagatagctcacttcgcaactcatctagcttcaaaactcatttctattaaagatccttctggaacaatctcattattaagtcaatcatattttaatgaaactaatccacataattttacgctacctgaacttcccaaaggtgttagtacagaactttattccgatttagatagggcgttgcaacttatggataaccagtattcctctaattgggatttggacatgtggaggctaaacgaattaacaaaaggtaattgcctttcagtggcaggactatatatgctacacttgattgcatcagaggaaaaaaaccaagaagctggctttgattcatctaacttgcctaggggaattactacagcatattcttcttcaattactgctccttcgaagctaattggaaatatatccaaattcaatatattttttcgagaattaaatattagatacctcaacaataaataccataacgaattacacggcactaacgtatgccatcttgcaatttgcttatcaagagcgactggattatggagccatttagacactgtagagaggcttgcctcagttattgcatctcttggacatgatgtaggccatattgggagaacaagcaattttcttgtaaattcaagacatatgcttgcaattaattataatgatcgatctgtcctagaaatgttccatgcatccctaacatttcggataatctactattatggaggcggagctgctgattttttgcaaagttgggacgcagaactccacaaagaatttagaagaatagttattgaattaatattagagacagatatgcataggcattttgaatgcgtttctaggtttagagtgagaaggcaagcagttgattgggacccatacggagatgctcaagatagactaatgcttgctaggacatgtttaaaagctgcagatatcggacatggagcattgaaatggaatcaacactataagtggtgcagatctgttgtagaagaatttttcctacaaggagatgaggagaaggcattatcgctacccatttctccaatttgtgatagggaatctacagatgtaccaaagtcgcaggttggatttttaaattttgtttgtcttccattgttccaagaattatgctatgtagatgtggaaggtgatgtgagaagatgtatcgatcgaattttggaaaatattaataactgggaagacatagctgaggcaggcattcagtgggatagtgaagatgcattaacatttgtttcagatgaaaaagctgatttgcaatag

SEQ ID NO: 1116 - DNA, 675 bp, Cryptosporidium hominis
atgaatcacatatttctaattgtcttcacaattattctttcgacaaaaaatttcagcattttggtttttattattcccatcattctatttattatttttatcatggattcttcagcttttcgaaaatttttaatctggacaattttcttggtgattttattaaatttttgtttttataaaaagaaaagaaactactatacatgtattttatcaaaaatggcaatgaaggcaagatattttttgatagatattgcaaatattttacattcaaaacatcttatttatagtcttggtttcgatattagcaaagcgaaaaattctgcatctatttggaactccgttttagggaacgagatattttgtcgtaataaacaatatttttcagcagagataaataatttctgtaataagctatcattggatggttttgaccaggtttcaaaacagtataaaataattaaaagtatccctattttgcagtggatcagttgggtggaaattaaaatagaaaaaaatatgtgtaattacaacgggaagaatttttatgaaatttttacggaaaatttatttcatttatttagggatgataggtgcttgaaatcaacaatgctcaaacatttgctgataggattactatcacccttaatactagcactatcattaacttttctataa

SEQ ID NO: 1117 - DNA, 297 bp, Cryptosporidium hominis
atgaatatactaatacttgaagtaacaaaaaatgtgatgaagaggaccacaaaagttaatgcaataaacaagggccacaagtttgtatatttgggttcagataaattggagcaatcaaataaagaattacccattttatcaaataaatgcacaaccaagagtattattggagcagttattgaaatcaaacatgctattagaataattccaataagtagaatactgctttcttttgatatttgcgctaatattccgaccgaaaatgatattaatatcagaataattgggactaaataa

SEQ ID NO: 1118 - DNA, 2606 bp, Cryptosporidium hominis
atggctaaaggaacatttcaaagttttggtttttctccaaagcttttggagtcaataaagattataggctattctcttccaactccgattcagcgtaaatgttttccgtctattttagcaggtagagatgtggttgctatggcgagaacaggttctggcaaaactgcgggtttcgtattgcctatgattgaacgattgggctgctctcactcgcaaattgttggaattaggggagttgtattgtctccaactagagagcttgcattacagacttatcgtgttgtgcgaaagcttgcctgtaaaacgaacttggttgtttgcgcactaacaggtggctcatcgcttgatagacagtttgaatcattatctggaaatccagatattgtagttgcaacgccaggaagattattccatcacattatagaagcagggctttcattaatagctgtcaaaataattattcttgatgaggcagaccgtctatttgaaatgggattagccagccaaattgagaaaatattggagtctatcccaaagaataggcaatgcgtattagtatcagctacaatgcctacagctcttgcatcattttctaaagttatgttaaacgaaccggaagttattcaaattgattcagattatatattaagtgaaacattaaagttaacatttctctttgtaagagaggatgaaaagcttgcatccttactatacttgcttagaaacactattccttctcacgaaagagctattattttttgcgcaaccaaacatcatgttgattatatcgtaaaaattcttgaatcaaacaacattatagttagttatatttatggaaatatggatcaagaggcacgtacaatgcatttgagtacttttagaaagaataagagtagagcgttagtagtaactgacattgctgcaagaggtgtggatataccaatgatcaaatatgtcataaattttgattttccattgagcccaaaattatttgttcataggactggaagaacagcaagggcaggacaacatggcagagcattttcgcttattacttccagagatttaccatacacgattgacctttgtctatttcttggccttaaaatgactacgttaacaagtaaacagactacagattcatcaaatgatagtttaaacacagaaaaaagagttgaagccagcataagagacgatgatattcatgaagaagggatatcttttattaaaccagcttctttaaatgattttcatgtggagtcaagattaattttagctagtttccctgaccttacactggagatagagtctattgaaagagttcttactgaaaattctgaaatagagaggtgcaggaggtcaatggaatctgcgtatttattgtacttgaaaaccaggacaccatcttcaaaagaaagtttaaaaagatcacgggaacttttagaaaagtgcggaggagcatcaaaaatattaatgtctattcatccagatttaaatatagataccaatgaaactaatttaaatatcgtaactcttcaaaatctcggagttatcagcgaccctcttttggaccatttgaaattattcagaccaactgagaacaaaactcacaataagtatgggtgccttaaccaagttactggaaagatggttttaaagtcatcaatcaagatgaaaaaaattaaagatatgggcaacgttgtaaaatcaattctaagtgaagataaatttgcaattggcacctctatttctgagagtcaaaatggtatttcagacgaaatatcttcaaataataatatttcacagacttttgtgaataaaaaaagaaagcctaagaaaccgtgtaatagagttaaagaatcagagcatttctttataccttataaaaatagtgaagaggaagtttctagatcgactggattacaattagagtcatcaagttttgatattaatcctgatgaagaaggcgagatgaaaagacaaaagtgcgttagaaaatggaactctaaaaggaaaaggtatgaactaatcgatatttctaaacaaaactccatcaaaaagtttaacgaaagtggtattaaggttaaaggagagttaaagtgtacggggcaatataagaaatggaaggcaaatacaaatttaaagatccagaatgttggtgaaatcgaggatatagaacttaataaaactattcgtagtaataggtttaaggataaatataatacgagcgatattaactcttcatttgactattcgaacgtacatgataaacacaaagggatcattgaggctataagtaaaggtattaagctaactcacaaacagaaacgtattgcaaaacgcattggaataatcaaggaaaaaattgttaatgaaagcaaaagtttgaaaaatgaaataagaactccacagcagattcttaaaaaacgagcaaatgatgtcaaacaaagaatgaaaaatgaaatagacaatagaagaaagcagctagcaaaaaaaaataaggagttcgcagagaagaattttaaaaaagttattcaaaaagggagaccgaacaggagtaaagttgtgctagtgaaaagcgtaggtagtattgaacttttcagaga

SEQ ID NO: 1119 - DNA, 618 bp, Cryptosporidium hominis
atgcaaaacaaagatggtggattcgggaaacgctataaagacgagtcccatgcaggatatactttctgcgcagtttcatcgatagcaataatcaaagaaataacgaaaaacaactcaattgatttgctatttaattttaacagactaaacaggtggctattaaagagaatcatcgcttctgaaagtcacgaaaatactaagtatcaatcgtattgctttaatggacgcattgggaaaaaatgtgatgtatgctactcatggtgggtatttgcaagtcttaagatcgtgaaaaatattattattaatagaaatatggactgttcatcaatcattaactcaaaaatattaaaaatattgataaatggaattctatgccatcaaaataatatttatggcggttttcaaaaatctccttttaatgccgacaacaaagatcattcagatccgctgcatacatttctttcaatttctgcattgtctctgatatttaatagtgattcggaaaaatcaagtttagaattttatgagcctacagaaccgttcgaagtatttgagcctttaattaagattgacccaatttctgttatatcggaaaaatatttaaataaaacaatttaa

SEQ ID NO: 1120 - DNA, 357 bp, Cryptosporidium hominis
atgcttggtggaggagggtttggttcaaaccaaaaccaacagtcttctggaggattattcggaacatccagctcttttggagttgggatcggccaacaaggggtatcacaaagtattaatacggtacaaccggcttcaacgggattgtttaattcatcaacttccctatttggaggaaatgcgagccctgggttatttggaagtactggctcttctaattccgggtttggaaatactgggcaatcttcagtttttggtcaatcttccaatggcttatttggccaatcaatgagtacgtttggtggtaatcaacaaataagttctacacaaccaactatgtttggctcaagttcataa

SEQ ID NO: 1121 - DNA, 315 bp, Cryptosporidium hominis
atgaattatctttctatggccataaacaaattatttcttttgctcaacagacctgagaaaaaacttacttcatttggaagttgggcaattataactggcgcaagcgacggaattggaaaagcaatggcaaaagaattgtttgaagaggatttaaacttaattttaataggaagaaatagagaaaagctgcaaaatgttgtaaatgaggtaagctttaaatatgcttcaaaaatgctaattcttgccctagttgctatccttgagaaaaccagattcaaatcaagaagtaagatattatttaatggattttactga

SEQ ID NO: 1122 - DNA, 1146 bp, Cryptosporidium hominis
atgtcaaaacaagaagggcttgagaacgtagacgacttttgcatttctgagtcgatatccaactcagaggttgttactaaatactacacagcagcagagatagtaaattcaacgcttcagtatgtaataacattatgtttggatggcgcagatatctcagaaatatgcaggaaaagcgactctatgatcgaggagaagtcaagttcagtttataacaaaaaagaaggtggcaggaaattggataagggtattgcatttcctacgtgcatttctgtaaatgaaatttgtggcaatttttcccctttgcctgcagaaagcttaaagttgaagaatggtgacttaattaagattgacctcggcgctcatatagatggatttattagtatttgctcgcattccattgttattggagctgaacgtatttcaggaaaacaagcagatgttttaaaggcagcaaatactgcgatggaagtggctattcgaactgtaaaacctggaaacactaacacatatgtaacatctatacttaacaagactgttaaggaatttaactgcaatatggttcagggagttttgtcacatcagctaaaaagacatgttattgatggaaatcgtgtaatcatttcaaaagaaacactagatgaaaaagtagatgaattcacgttcgaggaaaatgaagtttatggattggatattttagtaagcagtggagagggtgttaccagggagtctgattacagaagcacagtttttaaacgcgctattgaaacgaactataacttgaaaagcccgattccaaggcaatttctaagtgaagttaacaaaagattccctacattaccgttttcgttaaatatgatatcagatgaaaaggttgcaagattgggagtttctgaatgcattagacataaccttttgtattcataccctgtaataacagagagacaaggtgagtacgttgcgagctttaaatgtacacttctactgcttccaaatggttcaaaacgcatttccggcttacaattcacacaggaaaatatttgtgactcggaattcaaggtaacggatgaagaaattaattcaattctttcaactccactctcagtgaagaagaagaagaaaaacaaacctatagttagttcttag

SEQ ID NO: 1123 - DNA, 1893 bp, Cryptosporidium hominis
atgatcacttctttagttccgcatctgtgcgttgacttattagaagcagaattaccagaagaaagtacaagctattcactactagagaggccaacttcaagtaatatagatcgaataattgatgatctagaacttgattccaatattaattctgaaaatattgttatggatctattaagtagagaattttttgattcactttttaatctaatggaagaatttgaacaaaattctgatttgattgggctacataaaatattccaagtacttcgtagaataatagttttctacagtagcttcaatgaagtatttgaaatcttattaagcgatgactattatttaaaattttttaaagcttgcgaatatgacgagacattggaaaattataaaataaaattttctcacaagaagtttttagaaaatgttaaatttcacagtgttgttcctttaccagaagttcgaacaattcatctcaactataggttaatgtatttaagagatgttgttatgccaaggcatcttgatgagcaaagccttcaaagaatagcaacaataattaataataatttttcatcgataattagtatgatcgtaactacaagcgatatttggaaatatctcaaagaaaacattcagaaaaactttcttgttgcaaaatttattcatgcagtattgacggttttaaaacaaaacccaatgctttcgatctatgaacgacatcaaatattcataaatcttaaagttaacaatattttatgtgagttttgtggatatttaaatgaaaattgtattggagctaggcagatgttagaattatccacttcaaatgatgatcataaaaatttttcaaatactaatgatttatcattcataaattattctaatataaggccaattgatttagcagttgaaatatattcaatggtttgcgaaattaatcctggtcttttgagacacgctattcatgaatcaacttctcaatattttaaagctcataaagaaactaatatatatggctcgaatgtcaatgatattttatatgctgatgatggtctacaaaatagtccaaaagaaagcattaaagaaacggaaaatttatccgacaaatctaacgtatttcactcactatggggaactctatgcgaaatttttattaattcaaggagtgagagcatccaaatgcaaatttgtgcaatttttaaacgaatattggaccctaagactatggatgttccggaaagagatgattcgctctctttattttatgatatgggcattctagacagattaatagatagcttgctcaacgactctttaatttttactgaattcaatccattgtattctgcaagagtattattttgcgatattctcgcaacttgcgtacaagaacacaactacagaattaaatataaaatccttcaaaatcaattgccaagaaaattgctacgtatcgctactcgtccatttcataaaattttttctatttcagttattaaattcttgagaacttgcctgggaactcgagacgatttttactaccgtttattcactaaacatgatatttttaagtacattttcttaataatgggccaactaaaagtgccaagaaatagaggggagggttcaatattggaaagcgtggtaattgaaatgcttgactttatatgcagaaataatattcagttaattttaaaatatttacttgagaactatattgttgtaatttgtaatttgaaccttaaggcatctagaggctcgaaatgcagagttttttctagaatgctcgaatcatttaaattaatatctaaatctactcaatctttaaataactgcaaaaggaatggttcaaacattttatcatccaatacacattcaggtttaacaagctga

SEQ ID NO: 1124 - DNA, 207 bp, Cryptosporidium hominis
atggctttttcagagctggagtctataaaaaacatttcaatcccagagcataaagcttattgttttaatgcatggccattggaataccgtagagttaaactttacgaagtaaatcctgaaaatggtaactggattgactgcggaactggctttttaaaattaaacaaagataataataagtttaatattttggtaagcttaatataa

SEQ ID NO: 1125 - DNA, 2649 bp, Cryptosporidium hominis
atggaaagtaacgatcccaaattatttgtttctaccttcaccgactatattgagagacaaatggatattattagacaaagaaaatttactgacttaaaacttcattcaataaaaaatattatctttctcagccaattcaaacaaactacatttattttaacacaaaccccctcatttattaagtcatctaatacaaatcaaggaacgaaggtatcatcaggtttgattcaacagcaaaactctctcttgggttgtattattagcccaaatccaatagacaaagatttcaaaacaaatgtaaaccctaccattatgaaatatttttcaggattgttatctaagactcattcttatatcaatcaaagtaagatgctgattaaacaagatctttcgttggtatatgagcattcaactctagtaataaaaaatatgcttaaagcaagcacagaatgtagaagaatggtaataaaatggatgggcattatatgtacttcaaatgaagataaatcgaaaatatacaattcaatacctgatttgtcaatgtttggaaatatgcaaaattcacgagaaattcaacacaacttacggtctctaataatgagaacttctggtctttcaacaagtggattttcaattaattatttacacatagtgttgagactattacagccagttaagattgaaaaggtttcagaactagactgtttttttcatatttacgggagatttgaccaattcaatgatatttgcaatgaggttcataatcttttaggagatttagtaaatgatgcaacccttggcgagaaagaccaggtggaaattgcattaaatttagcaaagaagaaattgagtgatttaaatcaaattaatctaaaatatcaagattttatcaaattcccaactcaaatattttggatttcgtgtaaatcaatcaaatgttttatgcagccagtattacttgaatatgagagtattctaaatgatttaaatgaatataggagcggactcacttctggacataaatataagaatgaccatcatcttgagcaattaagctgcgaggcattatcatttgaatgcgcaattttccatcaaaacactatttccgcattttggcattttttgtctctgtttattcaatttattttcagaacaatttattcttttgatgaaaatggggttgagaattgcgataggaatacattactagcttctaaacaaggccgaatcacagtagcgcttaagtcaactgctccatctagcaagccttcaccacaattttcatcgctcccatcttgcttaattgaagatgtattatcagttactgagctattgttaagaattaaaggaaatgacgagattttgatcggtttcgattttgactcatatatttcattcgttatttttataataaattatggaaactatttcagaaatcctcacattaggtgccaaagaggtgtaattgggatacactaccttcttcagattcctcaatttaggcatcgaatagaagctagtgattttactgcagagtatattcttccagctttaatttctcttttcaacgatgtacaaaagtcaccatactatgatcggttctcgttgagattacctattatcatgttatttgaatctctattaaaagtagacttgcacagagaaaggttacacaaatttattaaacagagagatgaatcatttactaaattcattcatttactcgtttcagatctgaactatctacttgaagagggactttcaatgttagcggagataaaaaagagagagtctaagcgcaatcaagttcctaatgctattagtattaataataatgagtttagtaactccaacaatgaatcaagaagttctaatcatgaagaaatagagagtacaatcgaagaaatgcctatagaaagattagaacatgcatgcaaaggttatatgcagctttcacatgcgtcggcgagtttattgcagaaaattacggaatattatacttttgaaatattagactccccactaatactgcctcaaattgtgacttgcttgaattgtacacttgatcggctagtaggaccaaagtgcttagaactgaaagtaagcaattttgatgcttataattttaatcccaggcaactattggctaatgtttgcatgacctatgtcactcttgcatttaattctaaagttgaatataagccaatggagaaagatttttctaaaattttgattttggaaataataaatgaacaaaggtattttaagattcatacttttgtaaaggcacaccatattgctcgaagagaaggattgatgaataaaagtaaatctgattgctttaaccaacttatcaaatatttgcagaaagagcttgaagagaatgaagttggacagagtatgactaatatagacgaaacagacataccggaggaatttttggatccaattatgcaggatattatgcaagatcctgtattacttccaacgtcttcaaaaataatggatagaaaagtaattgaaagaatattgatatctgatggcgtagacccttttaataggcttcctcttacaaaggatgaattaatacctcagacatgccttaaagatcggatcaaactatttttagaaaacaagaatgattcataa

SEQ ID NO: 1126 - DNA, 945 bp, Cryptosporidium hominis
atgagtgtaaataaaaatattttattcccatgtatgaaaaaggcggaatgcaacatcttttgtccaaatgaagttttgagagaaaatattaactcttatggatctatagaaattatggataaaatatcaatttttcacattcctagtccacaaaataaccaaaagccaaaaaaaatattcgttactagaaaagaatgctgtaaactacttgatatttcaatagatgaatatttgttcattaatcaaaatttgtgtggattgaaaccaataattaaatgcactggaaagatcattattaaaatgtccgttacaagtgttatcattgcatgcaaagatgtttggattcttaatccggaaaatagcaaaacattagagatcattgaaaggctattagagtgcacaggatataatatttcggtagacaacaacactcccagtacaaaagtttcatttgcagatggtatcagcaaagaattcatttctcctttggtagaaaattataattataattctggtttagaatttactcgcaataattttgaagaaacagaacatgtactttcgagctcaatattaagtacatttactgatataaatactttggataattcacatgagtataaaagacaggaatcaatcgaatgctctatttcaagtgctacccaagaaaagaatattgatatctacaattacaggtttattcccacaatcaacaaagattattactctcattcatttgctgctgtatgtatagagataggattagaagtactaaataaagaattaattgaaagtattaattgtacaaaaaatgaagtactaaaaagttgtaatatattaataaagagcagtaaatggtacaaatacccttggagatttacctttagtgactttacaaataaaaaaatgatatctaagtcagtaaacgtaagttttttcttgtag

SEQ ID NO: 1127 - DNA, 462 bp, Cryptosporidium hominis
atgtcactgcaaataatggatcaagattttcagcacatccttcgtattatgaatacgaatgttgatgggcgtcaaaaaattatgtatgctcttacagcaatcaaaggtatcggtagacgcttttcaaatattgtttgtaaaaaagccgatgtgaatctctcgaagagagcagggcagttatctcaagaagaaattaacagaattgtagcaattgtagcaaatcctctgcagtttaacattccctcttacatgcttaatagacaaaaagatgtcaaggatggaaaatataagcatattacttcaaacaatctagaggcatctctacgtgaggatttggaacgtcttaagaagattagaagccataggggccttcgtcaccattggggtgttagggttagaggccaacatactaaaactactggccgtggtagcagggcagccgcagctgcaaagaaaaggtaa

SEQ ID NO: 1128 - DNA, 1530 bp, Cryptosporidium hominis
atggatcaagaattaaggttgtcaaatggtacaaatacacatcatattgagctatcaatttatttagggtccataagtgttacaattagtgatgataatcaaattaattgtaggtttttctcacttacagttgatattgaaccatcatttaatttagaaaacagtttacaagaaattaatacacaaacgcagaacatttttgattataatgattcagagatagatgattgtgagaaaactcagtttcgtactagttggtatgaaataacagatgctccattacatgcagcttatggtatattttctagtgaaattaatggcattattaaagagtgcaatataaaccaagatatatgtttaaatctgaagttgcccatatgggtttcaagtatggcaaaacaattttataatgcatacaaccaaattggttttgaaaactttctattaacagttcttcagttaagaatcacaatttgggctacaaaaaattcaactattgaatcagctgaaatatttgaagttggtgaagcaattatcaaagtttctgaggatcacatattatcaaaaaattcattttattttatacatagaattcctgagcatgacgcttttgctattaaggaatattccgggaatgacaaagaatgcacaattggtattcttaaatgtttttttaactccaggcccgtaataataaaaaacattaatcataatttaatagatatttgtaaaaataacgcaaaaccttgcgatttttcaaaaaagaattttgaattaattcagaaattgcgaattagtcaagaaaatattctaatgcagcttcatgatattgttcctttgaaatgggaatatttagatgataataatgtaattagaggaccatataatagcattgttatgatgagttggatagtaaaagggtactttggagaaaatagtaaattacgtttgtttgattttggtcaagagtgcataattgaaagtactactccaagatgtttacaaaagtttcaacctttgagcaattacctatctttgattaaatcagatgtgtctagaatatttagatgctcatctaatgatttaataaacagtggcttgatagttaaagagccgaataatgaaaacatgaatttacatactgtggaaatgattaatgaatcaagtgcacgggaagaaaatgtaagatttattcaaaaatcccaggaaagcaaaagaattgaaattgaaaacgcagtaaatatgctgaaaactcaattttcacatattgaaaaagaatttcaaaataagtttagaagaaaagtgcaaaataaaagtgtggataacaatttttcctcggaagcaacaaatataagcaaggacgagtttataaaatttgcaacaaaaaacgtatttagacaaaaaaacaatgctttattcaaaaaatggtgcgcagaatatgggcctgaattagtgttagaagcatgcgcaattaggattcaaaccgcatttcgcaaatacattaaaagaagatatttcaatgtaaaatga

SEQ ID NO: 1129 - DNA, 357 bp, Cryptosporidium hominis
atgaatactattcgaccgaattatggatttatcaactcaagctttccaaagacatgtattcaaagcgtatttagaacaagtagggggatatgtaaagtgaattttaaacactatattaagttatatagaattaacaaccctacgggattttggcttctttttattcctacttttgggagtttgactcttgcatctaactcattgctaccaaaagcgaacattactgcattgtttgcacttggatcagtagcttctaggagcgcaggatgcgtaataaatgatttggtagatcgccaatttgattcaaaggttgtttgccatgctttctttattcattatcatctgctttcaggttga

SEQ ID NO: 1130 - DNA, 642 bp, Cryptosporidium hominis
atgacaccagcaaacaatgtaccagttgttgataattgggaggatttgttaaatagtgataatgaggattcctttaacaactcagaattccagacaaattcgaataatattacttcaacttcaatttcgaacaagtgttttaatgactatgaggaacagagaagatgccaagagctcgttgaagagatggatggaaatgtaatggacgatttgtttgacggatttgtaagtcaacgcaaatccacaagtaaacttcccggaaataattctactcatgcaatttcgaatttaagcaaccaacaagatgcgtttagtaatttgaacttgaactcatatgggaaagttgaaactactgcgttcaaaattgcagaatgtatcaagccagctttggctaaaagtccagcctggctccgatttattgatatttgcctaaatgagatttttcaaaaaatagatttaaaagacctgaagaccttaaagaaaaaagttgacttacaactgtcagttagagaaaaggaggaaagagagaagtctcagcaaaagaagaagcccaacgattttggcactctttccaaaaactttagggaggaactcgacatatttgatggaatagactccctcgatgaatctgatgattattag

SEQ ID NO: 1131 - DNA, 1428 bp, Cryptosporidium hominis
atgcgtcaagatttaatttgtcgaaaaatagctcatctaaaggttgatgctgaagcatctataagaaatagctcttcaaaaattgaacggatactaaatgacggcctcccgatattctcagatgaagtaggtagtttttcatcgaatgcagagaagttttatatttcaacctctaatagagaaatggaaaatacaacaatagctgtgaagaattacttaaataatgcaaagtgggacttagttaataagtactatattaatgtcttgaagaacctagacagcctaacgaatatcattttttgcatacaaaaaaactattttgacaacatacaatatattaatatctcgcaatcatataacatgggctcaagtattgataacataaccacaaggtcgcttcgaattaatgaggcatcaaagggtgaattgctcatttcattatatagaaggttatatatactaagaccttttattgaaaaaatcaataatgaaattctgaggataccagatcatattattactcacaaatgtgcccttagtacattgaatgaactgttacctatttggaaaattagcataaattcccaggccaaaaatgaatctcagtgtctctacaatcgtgaaaataaattgtcaagtgtaatatgcctacaactacctcttgaaaatattttcttcaaacaaggaagttttgtatcaaggccaatggcacaaatagataataatagcttgttcaacgatgtacttgtcacactattttttagcaagaataaattcaatccttacggcggaaaatataaccttcgtgcttctttaaaactcccagaatttacttcttatttgatcaacaataattatcaactttatgttaaaactaaaccaagtggttcagaatctaaaaacataacttccagtactcttcctcaagttgatttcccatcttgcataaaaagcgcacttgcaaaacagatacattcaactcttcatagagttcactgggcattaattgataggctaattttccataccattgttcaacaagttgtcaatgcccaaaaggattctccagaagctatttatattaatgaactaagtagtgaacgcgttatattttctatcaatgaagcaagtccatcaattagtttttcgcatgataattcgggtctcgaagtaaaaaatatatctgtaagttataaacccattagcgttgaaaattgctttttaagtaatgatgagctgaatgcactgaaattacttagagagtcatttttagaaatttggagaaattccattaaattaaatacagataatttattagaaaaccaaatgtgtgtcattaaattaagtaaatattctaataaattacttgaaaggtggattcataaactcgcaaaaaaatgcataaatattagcgcaacatctctctaa

SEQ ID NO: 1132 - DNA, 1167 bp, Cryptosporidium hominis
atgaaaagtttttttagaaagagtttaaatcctattcataatacaaagagtgaagcttcacagcaaataaaatcaagtttggttgcaataaactatcttagtatcaatattgacctctcgagcattattttttcaagtggctacacaccgtctagacttgatattttaaataaaggttttcttttactatattacactgacccctacactgccactatggcagcatggttcttcgaaattcaaggaattcctgctgccacaatttcagggtggtctcttattcgcatatgcggccctattacattagatgaagttaccgaaattatatcattcaaaccttttgcaattaccttctttaattataaggtaaagtattcatggattgctgttcatggaattcacacaaaacaactattattaaaatacattaggaatcaaaattggaatattgttgaggcgctccacaacagaaactttcaagatgttgttgaagtattggaaatattcaataatgaagaagtcccaaattgctataataaattggaatacatgtttgtaagccttcttgaaaaaaaaagttataatatagaaaatccggatcaatataggttacatcaaaaattagttctactatctagatgttctagactaactaatgaaatttacttaaatggtgtatatatgagaaatacccatgaaagtttccaatctcctattaagagggatttgctacttgcaattagaaagtatctatatagtattccaatttttacagaagcttgtatatctaaaagctctctaaaatcattgaaaacagaagaatggtgtttaggactagatgaaaaacccatatatagaagagagaacgggtgttttaatgactgcatagaaacaaacaacaattacaaagcgcaaagcaatcattctgtaagcagaaataagttacttgaacgcatgttaagggttatattgatagaattaattacccatttcagagcaaagtataataatagcaaatacccaaatatcactgaagtgagtgaattatggaaaattagatttggaatagaagttgatattattcaattgttcaaaatggcgggactttatgaagaaattaaaaatattgtcgaagctactaaagaaattaaaataacaagagattga

SEQ ID NO: 1133 - DNA, 1335 bp, Cryptosporidium hominis
atgttctttgataaaaggatcttggcactgctaatgaatccatttaggagaaatattaagagaaattccttcaatattaatacatttaatagaaaatgctttgatttattcagaaataaagatagttttcgttttaattatacaattttttcaatttctatatcctttgcctttctcgccaaatattattttcaaaatataagaaagcagttgaatatgaaagcgatatctagtgatgaaattgaaattttaagttcaaaatctaagaatatgatagtattaaatttaataaaaggaatggaaattaataaaagcaattttattaaagagttgatcaagcaaataaaaagcaaagaattgaatagattgaacattcaaatatattatactgaaaacacttgcagtgaaagcacacctaatgttactcttttcaagggatatggaagtcgaatttctaatattgatttaaattttaaaaataacaacaatattgaacaaattaaatcattttttggcccaaaatctgaaaaaataataaatggcaattcttcaactataaaaaacatatcttatgatacttttgaaagtgatgtgataaataaaagcgacgaaaataacccattgttgcttatgtattatgacgattactgcttaatgtgttttctcattagaccactgattaattctttagcggcaagattaagaaacacgaaaaatatacagtttggtagatataatattggaagaaatgatctacacgagttctcaccgcctgtaaaggcaacgccatcatttgtattatttcgtggtagtcaagagcctgaacgattggacgagtacaagcctaaagatataataaagaaaattattgaaattaaatgcaaagttgaaaacaatgattgtggcaaaaacgagttagctgaacttagcactttggagcaaaaggttttaattagatttcatttattcatagttttaagcatttggaatctatatttaaaggaactccaaggcaaattaattaatactccaaaaagtcaattctgtgaattaaattttatgcatcttgaggaattactttctatttcatgtttatttctgcaagatcaaaatgtctcatcaaaaaacagcaaaagttttgacgaaataaattttgaaaaaataagctacgacaaaattgctgaaaacattaactttcaagagattttcttggaaaatattaaaaaagatatgaagagatctgatacaatagaagaaaatattaatcaccttctaaatgagattgagggatgttgtaatgattatataactatgaaaaaattgataaaaaaatag

SEQ ID NO: 1134 - DNA, 423 bp, Cryptosporidium hominis
atgagtagggaattattgattccaagagaacgtttcgaagtaacatctgaacaaaaatttactaattacgctgctggtgagaacttcgacaacattaaaagtgaagactgggtaattatttctggatttccaagacatttaattagtttaattaggccaaagttggaatatgaaattgggccaatagaccattggataaatggctatgttaaagaaggccatgatatttattttgtgagctttagaaataataaaatattgcaaaaatcattgcaatttaacgagacaatggtttttggaaacttaattttgatttgcccatgctttgacaatatttctacagagattagcaaaattgaagaagttgctattcccaaagaagaatattataaccattcaaatatcaaaatacagatatgctga

SEQ ID NO: 1135 - DNA, 1302 bp, Cryptosporidium hominis
atggcaagtaatatatttcaaacaagaagttggaacgaccatttaaataatcaaaatatattaaagggaaagtttagctcaagcgagagagatataattaataattcagttagagactacataaagtctcagcaatggaactgggatgaagggttagataatttattttctacaaggggtgggaaaaaagacagacattggccaattattggagagtctctaccaaataggtcgcttcagtcgatatattattgcgcaaaaaggatgctaatgcgaggaaaaaagggaaagtggacaaaagaagaggagcaagaacttattaaactcgttaatgaacatggtaagaaatggagcatgtttgttgaatttattggaagatcagcagcctctattagggacaaatggcgtgatttacatacaaaaattgtagaaaatgactcgaatgattcaggatatattttaaatcttaattcccagattgaaaaaccgcttaaatcaaaaatgccctttgtaattgacgtatttgtactttattgcattgaacgctatactggaaaatttctcccattcaaaggaatttcatggaagacaattattgaatcactttgctccccaaattttcctacagaatttatttatttttggaaaaaatgttgcagaaagataaacgaaaagttaggtattaatcttcaacctatagatggaactgatctatcaaatttttatgggaaaataagccaaggacaaattcgcttaaggtatgtttcttctctctatccaaagctcaaatatgttcaagatgaacaggccttgtccctcatttctaacacattttctcaagccgtaaattatctttatgaaaccagatataactattctcacatagatgaaattaaatataacgattggccaaaactactctctgcgcacattccccttacaactctttggtcaaggatcagattggcattaactagaattacaaaaaaaaatatgcacatttcagaccgcatatctatattatatgaacggcttaaaaataagcaattacaatgtcaggtactaggttctattgattcgacagagtctaaattcctctttgaagatgacgaatactatacgaatggaaacatggatggctgtccttattttcacgtagacactaaaaggcttcgcaaaaccgttgtaaagttattgaaagctcaatcaaaacgtgaaaaaaaatctaaaaatgcagccagactacaaaaggaatatagctcattacaacaggtatttcaatcagggaattacattacctaa

SEQ ID NO: 1136 - DNA, 1722 bp, Cryptosporidium hominis
atgaataaagtattccgaagcgacaatttaattgaaacgagttctcaaaacagctctaaacactcatttagcttgcaactatctgactattttaggctattaatagatcgatcgattgaaattagaaattggagaaggggcgaaaaatattgtacagtattacagctaatcaaaccgttagaaatttgcgatactttaagatggtgcgaatgtctgtttaatttagcagattactctgctgttatcaggatttctcaaaatatgttaattgaaaatgtgaatggctattgcccagacaagataaaaattttcatattcagatcaaaaagtgaattttttatgggaaaatattcaaatagtattgaaacatcaaatttaattttggaaacaattaagcatggactaaatatggagccagatgttaaaaaaaaattacttcttaaacaactaagagtaagggttttgcttattaaagctcgaatatttgcattaaataatatgtttgatcagtgtgataaaatttacacaggcatattattagaggatgatccaatgaatattgtatctttagaaatggtgtttttctcacataaatttacattaaatgaaaagattgagatatttaagaaatggaaacattttattccaaaatcttattactggattttaataattgtttggtacagaataatgcatgattactctcgaatgatagactgctataatggagacttcaaagaagacttaatttcattctctctagactcaaaaatatccttgaatcaacttctaatgaatatacccgtctattctaaaaaaatggtatttctaaaggacaaaattttctccttgactaatttaagtaataacaattcattaaaaacacaaatttttgacgtttcgagtcatttggattgtgaaactcacataattatgcaaatgatttcggcaatatatgattcaggatatattttgacagtttcaaatattcttgatgaaaaaattccttcatcaccgctttcaatcttcacaatgggatgctactattataaacagttagcgtattcgaagtcagcgcatctttttagaaaagtaatagagatagagcctggattttacgaagcccatctactacttgcgcattcactttcacttaataataatagtaagcaagcaattattgtttactcgcatattcaagaccaatggagaggaagttgttatggaactctatataagggcgtagaatatttgaaaagcaataactatgacatggcatcactcaatttaagaagctccctcacacaatttcctgataacccgattgtactgaatgaatttggggttttacaattttatcaaaagaaattttatgaatcagaagaaacatttagaaaagcgcttcataagttacatataaataagagtaactacttgaaatatgttttagaaataaatatgagctgttcaatcatctggtcgatactatattgtgaagaaatagtttgtaagccccgtgtagttgaggcaatttcaattcttgaaaggtgcaacaaaataaacaactcagctaataaagtgtatttaattagctttcttcttgcggttgcatatcagataagtggtgaaaaaaataaggcaagtttaaaatatttggaatgcgttagtttaggtatttttcatccaattaccttgaaatccctacacacgatctgtagctag

SEQ ID NO: 1137 - DNA, 840 bp, Cryptosporidium hominis
atgaatgcctacttaaatgcttatttttctgaaaaatcaacaaatgggttcttattcgaaaataatattgcaactgctccctgcctatctggctcaactgaacctaaaacagttaaaactggtactacgattgtaggagttgcttgcaacgattgtgttgttcttggtgcagatactagagcaacgaatggtcctattgttgcagataaagattgtgaaaagatacaccggctttcagataacatttttgctgctggggcaggaactgctgctgaccttgatcatgtaacttctcttattgagggaaatttggaattgcagaaacttcaaatgaatcgaaaacccagagtagcgcatgcggtttctatgcttagcgaccacttatataaataccaaggctatgttggtgcccatttaatagttgcaggctccgattctacaggaaattttgtattccaagtttcagcaaatggttgcatcatgcagctaccatttacatctatggggagtggttctctatgcgcaaggtcgatattagaagcaaggtatagggatggtctaacggagagtgaatgtgtagaattagtttcagatgcgattagggcagggatttataatgatctctatagtggaagtaacgtaaatattcttattatcaaaaacaattatgttaaacattttagacattttgatactaaggccagcgaaagaatctaccgacagccaaagcccatttcatttcccgttggtacaactccaattattgcagaaaagacggaagatttgagttcatttgttgtagaggtatctgaagtacaaattgatgaaaatatggattaa

SEQ ID NO: 1138 - DNA, 408 bp, Cryptosporidium hominis
atggcaaggaccaaacagacagcgagaaaatcgacaggaggtaaagcacctcgtaagcaattggcctctaagggcgcaaggaaatcagctcctgttacaggaggggtaaagaaacctcgtcgttacagaccaggtactgttgccctgagagaaattcgtcgttttcagcgttctactgaattgctaattagaaagcttccattccagaggctagtacgagagattgctcaggatttcaaaaccgatttgagattccaatctcaggctgtaatggcactacaagaggctgctgaggcatatttagttgggcttttcgaagatacaaacttgtgcgccatacacgctcaccgtgtaacaataatgccaaaagacattcagctcgcaagaagaattaggggtgaaaggtag

SEQ ID NO: 1139 - DNA, 1110 bp, Cryptosporidium hominis
atgtctcttgacgttcctattaattcaactgagcctacaaaagagggtcgttttctatccgttttggatcaggaatgtattgatattaaacttttacaagacttactttggtccggtgttcctagaggctctccgccagagttacgaagagatgcctggcagataatgctgggatatctaccaccgaggaaagatcgaaagaattcgtataaacttaaaaaaatcaacgaatatagattgcttttgaaagaacatattgaacatgataattattctgaacaagaaaagaagatattaaggcagattagggtagatctccccagaacctcaattgaatatgaatccttaaaaaaccaaataattcttgatttaatggaaagagtattattcctttgggcaattagaaatcctgctagcggatatgtacaaggaattaatgatttattacctccttttctcgtagtttttctacttccgctctctccagtaggcgacattgaacttctagatatcaataaaatatcttctgaaaggatgtttgagattgaggttgaaatatattggtgtttaacgaggatgcttgatacgttacaagaaaattatgttacagaacaaccaggaatacacaaacttattgtgcacctacaagatattataaaaaggacaaacaaacctttattccaacatttgaaagaacagggtgttgattttctgcaattttcattcagatggatgaactgtttgttgaccagagaattccccacaaagtgtgttgtgaggctgtgggacacatacattgcagaaaatactctcaataaaacaaataagccactaagatcaagctcaattacatcattagatcagattcctactggaaacaatgtaatttcacactttaatgcgtttcatgtttatgtatgcgcagcattcctgttgcactgggaaaaagaacttagaaatatggaattttcagaaatcatgttgtttctgcaaaattctcctacgaaaaattggacagaaagagatatagactcacttcttgcacaggcatttgttctgcagagtttattccatttttctccgagacatctaattgattattctaattga

SEQ ID NO: 1140 - DNA, 1110 bp, Cryptosporidium hominis
atgaataggcttaagaatgcaatatttactttacagtcaaaaaaaacagttatttctatttgtaagcatataggcctattcaaagatttggcccttcaagtagatttagtgaaaaatatttttaactgtgaaattttgaaaaaatatccgctccctttaatttaccaaagaaatttaatatgtgaaattgtaaaaattattgagagtgctggcgatgaagtttctgatgagttatatatgcatctgtctcaattaatgggttcatgccactctaatttagtttctcatattatcattactttccctagcaatcaaactgatatttgtttgaattattcaaatctagtgaactctgggaattttgtatttgggtttgaagaatgtaacttagttgggatgagaccttggtctgctggatatcgacttgtggaatggctgattcattctgtaaatcttggaagaaatgttgctaattctgatttaattgaacttggtagcggaattggtatttctagtataataccatattcggttctacctataaaaagtatctgctctacagaccacgatccgaaaattattaataaccttagatataactttgaaattaatggaattctgttaaactcggaatttgaagaacatcccaaatctaattctaataaaaaatatgcgagggtaatgtgtcttgactgggaaactataaatattaacatagcaaaagaaattctcaaacctttaaaaaatcctattattatctcatctgacgtaatttatgataatgatttaactcttttatttgttagaaccctcagattattgttatcatcttgtcatgaaaaaaaatctggttcttaccatgaaaaatgtactcgtaaggatcctaaaaataaatcggttaaatgggatgagcttcaagaagcagattttggctcgatttcaacatatgcaatctctgtaaatacagtaaggaatcagcataccattcaatactttgtcgattgctgtattgaaaatggcttgacaatctcacgtgactctaaagtcattcctatgatatttaatattgagttggatataccaacagtcattttcattattagctattaa

SEQ ID NO: 1141 - DNA, 1185 bp, Cryptosporidium hominis
atgtttcatttggcacgtttctggggaaaaacaacccaacatgtttcaatgtttagatcagatccttattctcagagtattgcgagtaataatgataataggctgttcttaaattcaaatcaccaaaattattcgattcaatatcaaggcgcatctaaaaatccatgtcaacatgtaattacaactgatttggatgatcctattactgaaacatatatttccagaacactctacctttgcaaactgccatacgatatgactgaagactctgttagagaactttgcgaaccatttggcgatctgaagaaagttgccgtatatcctcgtaaaggaattgcatttgtagaatactttgatataagaaaagcggaaggagcaagaaatacattgaaaagttccttagttcaaggaagaataattgatgctcagtattctagaggtagagacagtaggctctctagagatactaatacaggaacgttgtatattaaaccgattgtaagtaataaaactgcaaccgacccgaatactgaagacgattataaagagttattttgtgcctatggcgaagttaaaaaggttagcagtaatcgaaagcgagaatcagagaagtttgtagagttctacgacattagaggtgcagaagcatctcaaaaagccttgaatggctatgattttaatggagttatcctagagattcagtttgcaaatacgcatagcagaacgttaaattctgactccagagctactacaagtagtcggaactcaggtgtttgtaatcaatctcttcgcatttcaagtgaggaaaggtataaacagcaatcatcgttgaacacaaaaaagaagtacaaacctataaaatgcggcacttccagagtactcaaaagactagttgcaagagatgcttcacactgtgaattatattccgaattttcaaaacgaaatgtaaatcgtaatgatctacgcgttcatccggattttagattattatatcaatcatcggctccttttcaagaaacgaataatttgggtgaatttggtaaatttccaatcattacacaacgcccaagcgatgactctacaagaacaggaaatattgcggagtctctaaaaacactattatctacgtttaagcatcaaaaatatgatattgagtgtaataattctaaaaataatgcttattaa

SEQ ID NO: 1142 - DNA, 1632 bp, Cryptosporidium hominis
atgaaaagagaaaatacacaaataagatataataaatctagacaaggggatattaatatatttttccaagaaaaaatcaatgatctcgaaattaagcaaactgaactttcggatttgttgattagaagacaaaatgatgccgaccatcttattttgatcaacaaggaaaaaagtaacacaattaattcaattaaaaaaaaattatccgttatggtggaagatcataaatcttacacgaacgaaatgaacgagttaaagaaaaatcttaaggaagtgttagacaataaaaaagatcaactatcgagaattgaaacaaaattaagtaaattaaaacagttgcatgatgaagcaacaaacaaaaataatgaactaaaagaaacgttttctgagaaatcaataataaaaagagaccttgaaaataagttagaagttttaaatgaaactattaagaaaaaatattgggcaaatacggcaagattatcattagctcaacagttagagcttgcaaaccaagaaattttatcgtggaagtatcgcttgcagcgccactcaatattgttaaatgataccaggagaaagttatttaatgagctacaagatataaggggtaatatacgagtattttgcagagttaggcctcctacaatttcggagcaagatttttgcattaagtatgatatttcggaggatgcatcaacaattactataaataacacgactaccagaggtacaaatcttttaacatttaaatttgactacattttctcttcagtttcgactcaacatgaggtttttgaagaagtttcacaactaatacagtctgctttagatggttacaatgtttctttattttcctatggacaaactggaagtggaaaaacattcactatgttaggtgggaaagatgtaaatgaatatggaatgattcctagagctcttaatttaatctttgataatatagataggaattgtgaaaagggatggacatataaccttgaatattccgcaattgaagtttataacgaaactatccgtgacttaactacacctaaacagaaaaattcggaagtaaaaatagaccaatttggttctgcaactattgttggaattaatttaatcaaagtcaataatatcaacgatgtgaataatttgttaaaaatggcacacaaaaatcgatcagaggcatcaacagattgcaatgaaagaagttcaagatcacacagtattattcagttgaagatatctggaaaacactgtcaagaggcagacgagtcaaacctcgattcaaggaatataagctcaaccttatcattaatcgacctagccgggtcagaaagggtaaacaaaagcggtgttttaggagaaagaatgaaggaagctcagttcatcaataagtcattgagtgcattaggagatgtaattcagtctattaatcaggggaaggatcacataccctttagaaatagtaagcttacaatggttctcaaaaattcactcggaggaaatagtaaagcagctatgttggtgcacatctcaccttcttcacattccataaacgaaactattagctctctaaggtttgcatctaaagttcaaaactgtgtaacgaatcgcaacagagaaaaaaactga

SEQ ID NO: 1143 - DNA, 1365 bp, Cryptosporidium hominis
atggaatgtaaatatattcttcaatgtattacgcaacattttgtaaaactttgtaatagtggcagagatgaacatattcctttacaacgttttattttatacatcttagtatgtaatgccacgcaactcattttaaatcaatcagtatttggcaatcctctatataacgaactgccgaattttgaaacaaaaaatttgccaaatattataattagttggttcaactttgctattgaggaattaagtatggaacttatccaagatagtttgtcaaattatacagaaattaatagaaatattttattaattcttctgggaaatctactattaattgcaagaaatattggattagatggagaaatttttattaaaaaacttaataaagtcataacacaattaatatcactatatgggtatggctcaccaattactaagataatcgcagattatattctaaaccaaatttttctaatgttaggttattcatcatataaattttcaattaatacgattattaatgaatattctcttgaaatcattagggcactagaaattatgtactataaaggctattccgaggaaaaagttgatctaatcttgacggctcttcagcattgtaaattgggattcattttggaactatcagatttaattgaaaagtttagtgatataaatataaataataatccttggatatttgaatttattgcaataatcacaaaacgtataacaaactgcattctaacatattgggacaatttttcctttcataagatattcaagaacgcacaaatttctgctttcaaacagaaacttgaatctttccaaacattaaataccacaattaaagaaatatactatgaatatttcttagattatataactacacaagagaatgtcattcctaacttttatccaatacaaaattttatcaatagtattaaaaaccaaaacatagaccatttagatctttttgaacagaaattactggaggaaattgatatttctaatgaaatttcaaaaattcgtaaagttattgaaagaatgattaacattatctattcatatacatcagagagtgatgagaggaattttagcattcaggattatcaacatttgtctacatattcattattaaattgtatttttattctttccaccgaggcaacttgtttatttccctacgcaaatatgataattcctgggataattaatcaatggatggctataataagcaacataagaagtgataactttgacaaatctaaaatcgaagcaattaaatcacgtgagctttgccaaacaaatattattgtaatacaattaatcatttcatgcgctgaatttgcaaaaaaagttctataa

SEQ ID NO: 1144 - DNA, 576 bp, Cryptosporidium hominis
atggatgccaataatattgttcctgaaaatatagagcatattcaacaacaaagtcttaaccccacaacaacgcttaataaaaaattaatattttcaagtaacgaaaggaataatctttgggaattgttttctagtaattttttattgtttaaattttacccatcaggaaatgaaattgaggaagagctcaaatcaatccatgaaatgataaaagttttcgaaaactggaagtcactgatttcgacaaagaaaatgtctttgtttgatttttgtaaaactattgaaaaattcacatttcatacagaaacacaagattaccgtttgagaacagtatataaatacaaatcaatcaaaagtgggatgcattccaatatgagcaattacgagtttagaccaatcagttcaaaagagcatactgatcaaagaaatatagtcggcgatcaaaatgacgattcaaaatccattaattccaatcagaacttagacactagttgtgaaattgaggaaaagctaaaggctaaaagagaactggctttgaaaagaaggaaactacttttaactaataaagtattgtga

SEQ ID NO: 1145 - DNA, 5688 bp, Cryptosporidium hominis
atgtccacagcattggagttgaactctccatttagcagtaaagagttaaaaagagtatttagtattgaatttggcgtcctttcacccgaactaatacgcaagtattccgtactcgagattaaagtatcagatatttatgaaaatgggagacctaaatcaggtgggcttaacgacccattgttgggcacaacagactatcatattctttgcgaaacttgtcatatggatataaaaacatgtcctggtcactttgcgcatattgagcttggaaagcccatgtttcatatcggatttattactacagtacttaagcttctcagatgcgtgtgctatgcatgctctaagttattcgttgatacattagatcctaagtttaaacaaataaaacgcattaggaatccaagacttagattgaagaaaattctagaaatgagaagctcttcatccagatgtataatttctagtgacggctctggatgcgggtttgtccaaccaacctattcgaaagaaggatataatttgtatattaatcaaaatcaagatgaaaacagaattattgacgatgaaagtgttgattcgaagaggttgctagccgcagaagaggtacttacaatttttaaaaggatatctcacgatgacatgaagattcttggatttgatcctgtaaaatgtaatccttcttggtttattaatacggtaataccgattcctcctccaactgttagaccatacgttcaatttggaagcgatcggagcgaagatgatttgactttaaaactacaacaaataatcaagttgaatgaaaatcttaaaaaacagattcgtattgggtctcctgaacatattattagtgaaatgtcaactgtccttcaatatcatttaattacacttattaataatgacttgcctggtttgcctcaatctagaacaaggagtaacaggccaatcaaatctctcagagcacgtctaaaaggcaaggatggtcgcatacgcggtaacttaatgggtaaaagggtagatttctctgcaagaacagtaatcacaggcgatcctaacttagctgtggaccaagttggagttccatattctattgctatgacacttacttatcctgaagttgttacaccatataatatagaagagctaaaggagttagtacaaagaggaccgcatgaatggccaggagcaactagtattattcaggaggatggaacaaaggttgacctaaggttttcaaatacctcaaataattcgaataatatgcttcaatatggatggaaggttgaaaggcatatgaagaatgatgatctagtgctcttcaacaggcagcctagtctacataagatgagcattatgggccatcgtgtaaaaattttaccttattctacatttagacttaacctttcggtaacttcgccatataatgcagactttgatggagatgaaatgaaccttcacctggcgcagtcgcatgagacccgatctgaaatcaaaaacttgatgatggttccgagacaaatagtttctcctcaaggtaacaaacccgtaataggcatagttcaggattcattacttggaatttttcttcttacgagaaaatcaacttttttaactagagataaatttttacagcttttattatgtattccttattggaacggaaacattcctcctcctgcaatacttaggcctcagcctttatggactgggaaacagattattacagtgctacttgcatttacaacagacttgggcgagccaattgaattgaatttaatgcgagatggtagtattgtatcgattaagcaatctaataactcttcaaatacagataaagatgattctaaagaagctatagttaacaatccttggatatcagagctggacaatcaagtaataatccagaagggagagcatatttgcggagtactcacaaaaaaaattgcaggatcttcttcaggttcactaattcacattttatggaatgaaattggcccagaaaaaactggattgtttttgacatatactcagatggtagttaatacatggcttctcgagcacggcttcactgtaggatgtcaggatattcaaccacaaaattacaccttggaaaaaataatgaactctttagaaggctcaaagttacaagttcaacagattatcaggcgcgctcagaaaggtaaacttgattgtcagccaggtaagagcctaattgaatcttttgaggctcaagttaatcaggaattgaatagtgcacgtgaattgtctggtacgattgcaactgagaaccttgattcttctaaaaacaatattgttgcaatggtccaatgtggaagcaaagggtcaactataaatatttcacagattatggcatgcgttggacagcaaaatgttgaaggtaaacgcattccatttggatttagggatagaagcttgccacactttttgaaatatgattatgggcctgaaagtcgtggttttgtttcgaactcatatctttcaggtcttacaccccaggaagttttttttcatgctatgggaggcagagaaggaatcattgatactgcgtgtaaaacttcagaaacagggtatatacaaagaaggctaataaaggcaatggaagattgtatggtgcaatatgatagaactgttaggaatagtaatggcgatattattcaattcctttatggagaagatggaatggcaggagagtttattgaggaccaagttatcgaactactacagatggaggcagcaatgttccagcacaagtatcgtcacaatcttgaacatccaagatggggttctagctggtctggagtccaaccttccttgataaaaaatctacaatttgatctagaatctcagaatatactgaactccgagtataaacaacttgtaacagaccgcgagcagcttgggaaagacattttcccagatggtgaaacaagacaacatcttccgattaatatcaatagaataattcaaatggctcaacaaaagttcccacaaagagtaagtgatacgtcatctagcaaggattggggaccagtttacatcataaaaaaggtcgaatcattgcttgataaactattgctttggaagaacgtcgggattatcaatgatgaaggcaataaatctaattttgtatttgatagtattattgctgaagttcaaaagaatgccacaactttactagggatacatattagaagctctttagctagtaaaaaaatattagaggttgataggcttggaccaactgcatttgagtggatacttggggaaattgagcatcagttttatagaagtcttgcacactccggtgaaatggttggcactatagcagcacagtcaattggagaacctgcaacgcaaatgacattaaataccttccactttgctggtgtgggctcaaaaaatgtaactctaggtgttccaaggctgagagagctaattaatgttgcaaaaaatgttagaacaccaaccttaactgtctatcttgaaagcgggattgcaaacgaccaagaacaggcaaaagatgtattaacattattagaacatacgacgttacaaaacattacgactattgcgcacattttatatgacccggaacaagacaagactattgtcgaagcagataagagttgggttagtgattattatgaatttccggatgatgcggacattacaaacagacttggtacttggctattaagaattcagttgaataacaagcttgttactgacaaaaaactgtcaatgaaagaaattggtgacaaaattttaatggaatttagtaaagatgagttggattgtatttggactgacgataactcagatgaacttgtattaagactccgaattaaaaacattgagcccactaataatatttgcgataatatacattcttctgaagaaaacgactcgatttctccttcaattacgtcaggagtcgaagagcataaatttttggaaaaactaatgacggaatgtctttctcaaattacccttagagggataaacaatattaagaaggtttatatgaaagaggaacaggtttctagatatgatagtattagtcagaaaatggtgagagacaaccaatgggtgcttgatacagatgggtgtaatcttgaagcagtgctctgccacacagcaatagatagtacgagaacaatctcaaacgatataactgaagtctttagcgtattagggattgaagccgtaagaagagctcttcttagagagctgagaacagtcatttcatttgatggaagttatgtaaactataggcacttagcactactctgcgataatatgactcaaaaggggcacttaatgagtataacaagacatggtatcaatagagttgataagggcccgcttcaaaagtgcagttttgaagagacagttgaagtcttaatggatgctgctatgtttggagaaactgattaccttaatggtgtaagcgaaaatgttatgcttgggcagcttgctccatatggaactgcatgctttgacgtcctaattgaccctgataaacttagggatactgctactcatcttgaaattcatggagaatttaccaaaatcgggaaattctctacactttctcaaacaacaagatcttattccgacagtggagcatttgaatcagattcttttgaatctccaatgtcgcctctttctccaatgtctccgctttaccaatcttatgaaccaatgtcccctatgatttctggtcagttttctcctgttcaaatgactccaagatctccaatgagtccagtttcaccaggagggatattcagcccagttccatactctcctatgagtccatcctcaccacttatggattacacgccaacttctcccatttatgcagcaagtagtccaacatacaatacagaggtttctgagagggctagaaaaaagtataaggttaacaatacacttagctcatactcaccatcttcaccattaaattcagacaacaaaataagtaacataagtccagatttatcaccaacatcaccgcattattcgccaacatctccacattattcaccaacatctccacattattctccaacatcgccacattattctccaacatcgccacattattcaccaacatcaccacattattcaccaacatcaccacattattcaccaacgtcaccacattattcaccaacatcaccacattattctccaacatctccacattattctccaacatcgcctcactattctccaacatcgcctcactactctccaacatcgccacattattcaccaacatcaccgcattactctccaacatcaccacactattctccaacttcacctcactattctccatcatcaccgcattattctccaacttcgcctcaatactcacccacatcacccaactacaaccccgcatcgccaaattattctcccacctcacactactctcctacctcgccaaattataatcctacctctccgaattattctccatcttcacccaattatatttcaaataactctggctctcctggatactcgccatcgtcacctcaatatgatcctatagcagttacttcggtccctagatctccatcctattctgttggaaaaatggtagacgctgaatattcaccgtcttcccctctagacgaaacaaagaattcataa

SEQ ID NO: 1146 - DNA, 1542 bp, Cryptosporidium hominis
atgattcttatatgtggaggggacggaacagtaagatgggtaatagatagatgcagagaaatttatggagtaaattcaaataatctccctcctgttgcagtccttccattagggactggaaatgatctcagcagaacattgggatgggatgttacgtttaacggtgatattctgaactttttaaaaagaatatgcacctcgaatattaagcaaatggatatttggaaatgtactgcgtgggatttaaaaaatggagattctaataatactaatgaggatcacaatatgttgttctcatctacgtttatcaactatttagatattggtattgctgcgcgaattgcattaaagttccataacttaagagaagcgtatcctcaacacttcaaaagcaggcttggaaaccaactagtttatggtgaagtaggatttagagatttcttcaacaaaagcattcaattagatggtttaaaaatactttgtgatggaaaggaggtttctatttcaaatcaagtaggagggtctctttcaagcaaaagcgaagagtccataaacttactaggaaacagaacaataaatgacaattattttcaaggatattatcatttaatgaatatttataattttataattaaaaaatatattaattggttcttaattccagctgcagacatttttgggtttgggaactctattaaaaataaagtaaataataaatctatcactgaaattcataataattttaattcaagagaaaataggcttgaaggcctcattatttgtaatattcctagtttttcaggtggagtaaatctttggaaaatttcaaatcaattttttaaaaaaccacgcaaaaatagagatactaatacaattagaaggactaccactttaactagcagaaaaatggggaaaggcttgtcagatagatcgatgtcattttcaatagataatttcaagaattctggatacttatcttgctcaaattcagaattttcagaatgtgatgaaacagataatactcaattagaattgagagaaggaaggaagagatcgactaatttactcaaatcatggttttctaaagcctttaaacaagggatatctttgtcccccaaattaaataacttagaaacaaatgatgaacccactaagtttggaattaataagttccagatgcaaaagattgatgatgggctaatagaagttgtaggtattagatctctttttcatttaacccaactacaagttgggctcacagagccaattaagttgtgccaaggtagccatatagtcgtatatattcctagacaactcccttttcaagttgacggagagcctagaataataaacaaatgcaaactcataattgaacaatccgggaaaattccagttatttgttcggagaaaattgaaaatacagtatcgctctcagttcaaaatgctttagagcaagctgttcaaaaaaaaattattaatactagtcaaagagcatggataacggaacatattattcaagaaaataaattattaatttcttag

SEQ ID NO: 1147 - DNA, 114 bp, Cryptosporidium hominis
ttccttgcaattggtggcccagggcgatatatttatatatttgaagttaaaaaaagaagattagttaaaaaaatttttacttcgcaaaagatagcatttattaaaattttagag

SEQ ID NO: 1148 - DNA, 675 bp, Cryptosporidium hominis
atgaaagagattttggcaagcaaatattataagccctcttcttatactactcttgaactaatttgctccctcaacattattttaaactccgcttcttatgtatttttgggaactcgactgttttcaaatttaatctttccaatattaatgaatactagaagagaaaaagataattctttcattcttattggaaaacgtatatctaatgtattaaatattaggtattatgatactgaagaattgaagattattggagtatttctcaggacattgttgatttataaaaagaaactaattaactacttaattcctcagctttttgctttaaaatcggagaatattgtttctgaaatggttgcttcagaaagccatattttaaggtattctcatatttctagtaaatacgcttttaaaattctttcaaaaatgttcgacaaattctattataccaatttcgattctattagattggaaattgaaaatgaaatttctagtgacaacatgcaaaattatcttaattcagcaaacagaaatttattagattgcaataatatgaatttcttttccgagaacatgtatcaaagattgttaacaaagttctatacattcttatttggtagaaaacaccattttttggagtttaaattggttgaggggaaaattaatattatttag

SEQ ID NO: 1149 - DNA, 521 bp, Cryptosporidium hominis
atggattcactcttttcaagaataaatattatcttttgctcatttataatttctttggcatgctgtgcagttggaaactttgcatcttcatttatttacaaagaactcccaataggagatactgaattacactccattcttgacttaggaattagcccatatttaaggaatgatcaagcaaatattgcgctcaacattaatacaaacctttctaattctttgaactggaatacaaaccaaatcttcacatttatatatgtaagctataaaaataaacaccaaaataattatgtaacagtttgggatgatattttttcagaaaaaaaaaacaaaacaagtttttcaatgaaaggagtgataaataaatatccaattagggatatcgggagaaaccttagaagcaaaagtataaatcttaatattgcattctgctacatgccgattgtgggtagcattaaatatcaccatttaaaagtgtcgattgaaaaaaaattgccagtgaattattttcaatataaatg

SEQ ID NO: 1150 - DNA, 1605 bp, Cryptosporidium hominis
atgggtaaaaaaaaaaacagcaataagcaagaattaaattctgtactgcagagaaatgctaattttgggaacactaatgacatcacagagaataacttgaaaaagtttcaatcatcacaaaattctttactgagttactttcaaagtttcaaatgggcggaacttaaggagacaataataaatctatctatattattgttaattctttgtattttgatctccacaattattttaagagcaggggaagaattttacagcattagtgggaagctaaacaaaaatgaaaatcaaaagaattattacgaagttttgggggtaacaaagaaatcaactaacttagaaatcagaaaggcattcagaaagcttagcttggtatggcatcctgacaaaaatccagattgtgaaccgtgcttggagaagtttagagatatttcgaaagcatatgaaatactgggtgataatgaaaaaagacaagtttacgatactactcaaggcggtgagattgagataattccttcagctgcagttaccttaacatccgataactttgacaacttagtaatgcttcagaaaactaattcatgggttattcaggtttatacggatcatgatgaactttgtcaccatttttcttctatttgggaggaatctattgaagaaatggggaaatattacaaatttggaagaattcacgccaaaaaagaaaattcattacttaaaaaactaccattaagcgtaaaggtatttcctgcaatttttattatcacaaatggataccaatacgaaatgtattccaaaatttatgatccaagtttagaatctttcttggaatttctctccaactcttttccgatgactttgggtctattaaattcagagaaatcgttaagtggatggttaaaaaagaataatttgtataggccaaaaatattaattctttctaacaaaccttcaccaacattattaattcgttcatttgcattaagatggagctcaactttcgagttagcatattatcaaaataacaaaaaaaatagcatgctttataaatggggaatagaatatgataaaccatacttaattgcgcttccgcacatatttaaggattcagacttaactccagagattatcattccacttgggggcttttcaaatgaaaatgttttgcaaaccaggcatatagatgatcaattatttaaccttatcaataggtccacctccttagtacagaaactagaacagtcgctgctttatacgcaacagatttatgtaccttttattgatagcagcaatgctaagaatctatgcgagtctaacagtttaaatagaataatttgtctagttattatacatgatagattagatggaatggctcaaaatcaagaaattgttagagcgctagatatttctcgtcaaaaatatatcaatattagaaggaattctggaaatgcaagtaatatgattgatagtgaggctgacgaagatattggagaattatttatccagcctgttcaagttgctctattgagcaaagttaagggaattcctagcatgtctaagatcaaaggctttttgaagctttcacgcaacgtagctacttcagaa

SEQ ID NO: 1151 - DNA, 318 bp, Cryptosporidium hominis
atgctaataccgcaagataatttattttcaataatggaggaaaataatcaaatatcgctttcccttttaacttttttaagatatgagtatttaaattattgtatcaacaaatcatctgaattaatttcagatgaaaagaattttcagactggaaaacactctaaaaagctgtcaataagtggattacaagtttgcaaagactcactgataagggaactttctatgtcaactctcgaagaatctggattttatttgggaattagattagttgaaaggttagtgacacggttattcactgcgcagcaacacatactttag

SEQ ID NO: 1152 - DNA, 2625 bp, Cryptosporidium hominis
atgcgtatagctggaataaagagtaactcaattacgcctttgaggcagccatttgaaacatttgttacagggaatgatggaacgtataagagtattgatagatggaagtcaaaatattactcttccaacgatgattatttgtctccaacattcttggatgactcgtgctcgttatcatcatctccaatatttcatgatgaaactccaaataccaccataggtacgccggttacctctccgcgtaaaaagagtagtagtacaagaaaagtcagagtttcaattgactccgtgctcactaattctaatgaaaatacacctacaaacaacctaaattataaaaggccaccttcaattggtactccaatactcacccctccatcagcaaaaactgctgttcatgacaatgagggatttttgatacctgacctaccagggacatcaagaacgaggaattttaggagcaatcaccggaacgatatctcaagaagctgtaataactactcatctgcagatcccgttcacattacaatgccgccaagactaggactgccatcacaaactccattgaatatgaaagaccaatatagaaagtcccctcttcctgttgtatcagcaaacttggattacagaacggtttacatgggtgacaaactggcagcaagggcaaaagatgtaaggaggaattacactgtatctcttcgtgattcttctcccttttttcgtaataattatgagtatgatcattcttattcagaaaaccctacgattcatgaggatgaccttattttgcaccacggagaaatacttagaaacaaatactcaaagttacacaaggttcggcccagtaaaaactgtgtggctagtgatcaaaggagtagatcgctttcttcttattactcagaaagcacatctagaaaaaatttctctccaggatatagaagtaactccctatataataactatcgccactcgattttcgggaattttaggtggaataacaagagacgaagattaggaagctatattgccagccaaaatgatatcttacaacaacatattcaaataatcgacaaatctttagatagatcatccaatggtgattttgctctttttgaaggtggaatgctcgactctccagatagtaataaaaattgcacgcatgaatcaagtagtccgataaagagtagatatatcaattcacaagaacttaactttaatttagaaaaaagatcagtaaaagccatctcaagtgcaagcaatgaggttaaatcaagtaatataaactctcgtgaagcaaacaactcggaggccataaactacacaacgaataatatgaagaacttagaagagcattccgattcgggaaagcttattttcaaacattttgactcaaatgatccagacaatcctgcacaacccgacgatcaagatgtttcatttaattcagattttggctcttcgcaagccaacgaatatggagaatctgacattcaagacctatctgttgttgtaatgagtagttcatcaaaaaagcgtttgccctctgcaatatcaaattcaagtttagatgaaattgtgccacatccgattcccaactcgtctgaaatatccaatagagatatatatggagcaccaaatgaagttgaatcatttaccaatgatcatagtcactttaatgagaataagcctgacaagagtaaaaatgtaaaaaacaaaaggatcagagctgacggccaaaaaaaacacgctagaggtaagacaacaaatagaaggcgtcacattgactatcatataccgatagatcaagtcaaaccaccacctggaataggtacaaaaccactgtctgatgaaccttcaaattttgagaactcatccagaagatatcctaagagactcaggacagctccgcttaaatggtacttgggtgaaaggctggaataccatcgagatgaaaagaacgaacttggctacacaattgccgctatacacaaggttgcaaacccaaagatgcttcctaatgagcgtgggagcatctatcctaacagtgatatttctacatacccagcttcttgcaaacccaatactgatgaacttgaatttcacaaaaaaaataaccgtgacgtttgttccgccaaatcaaaacctagagctgacaatacaaatatatcaaagaaggtcaagtctaaagtaaagcgcgtttctggaaacgatcaagaaaaaaaatctaatgctgttattcttaaagattatgaaacaaatgaagaattttcaatgatatctgtatttgacagaaatactctatgctgggctgatgttgagtacactgcaggtaaaccatatagtgtcgctctttcttttatatctagtcaagcaacttgctgtgaaatatgccttcctcctctaactgagaaagggctcgatgaaagtcaagataattacatactagggcatgtatatatggccccagatagtaaatctttacaaataatgataagtgataacaatgtttacaacattggtgttggagactggttcctaatacctgacaatacgaactacaatttcagcaatacttctgatcattcagaaatttatatctctttgtatgttattaaggatagttag

SEQ ID NO: 1153 - DNA, 216 bp, Cryptosporidium hominis
atgaatttgattgaagatattgttttatttaatttggggaaatctacatcttttaatacactaaattgggttggatctttacaatacgatcaatatattattggttcatcaagaagaaaaaatgatataattaatattgcaaagagtaagttgatttttttaataatttacttaaacaatttaattagttacctcaattgcgaacgttttacatag

SEQ ID NO: 1154 - DNA, 3537 bp, Cryptosporidium hominis
atggtaaaaataacgaataatgaaaatgaaaggacgattatattgaataataaaaatgaagaaagctgtatccattcattcaaaagacttaatgtgataaaaacagcaagatattctcttttattttttttaccaaaaaatctatatgatcaatttaacaatgttgcaaatatttactttttggcaataggtattatgcaaatggtaccttcaatatcatcatctggtggaatccctacaatagctcttcctttaatatgtatgttatgtttttctgcggcgcaagcagcatatgaagattggaaaagacataaagcagactcagaaataaacaaccttcctacgtatgcatatgatccaattaaaggtaattttgcaatcacaaaatggggtgaattaaagaacggagatcttgtaattgttaaaaatagagaaatttttcctgctgatatggtattacttgcctctagtcaaaatgataatcgagtgtttgtcgagactgcctcaatggatggtgaaacaaacctaaagcttcgagaaagccctagaattctttttaataatggagttagaaatattagtgatctccttactatttcaaaaggtataatgtattgtggagagccaaatgatcacccaaaaaagatacatataaattcaaggtttgtgttgaaaaattctaaggacgatgaaaaagaactcaatttttcgtgtaattcatcaaatatgttgttacgtgggtgtaagctaagaaacacctcatgggcacttggcgttgtggcatacactgctcatgaaacgaaaatttatcaaagcagttttagatcagccccacataaaatgagtaatgtacaatctttatataaccaagtaactattgcgtcatttatcttcttgttgtttatttgcctttcttttggaattattgtagcttgcattgattactttggaggaccagaattgtcgaaaaagtttattccaattgggaaaatggagcccaacgaaagtgtgattaaaacttcaataattactttttttacctggattattgttcttgcaaatctaatacctattggaatgtttttttatttagtaatatccaaagtttcacaagcaataatcattgcttcagattctagattaacaagtcaaaattctactgttgtaaggaattcagatttaaatgacgagctaggtcaggtatcttatatttgtactgacaaaacaggtacattaacaaggaattacatggaattcaaaactgtttgtattaacggaaacgtatatggaggtaaccatcacgaaatgaggcaagatacagatcaattgagtattgaacacacagaaaaacaaaaaataactccacatgttgacatggaagatgaattactaagaaaaaacctaaaggaaggaaataaggaagagatagaaatactattgaattttgctctaaaccatacagtattaatacaagaaaatgaggttgatatagatgaaccacctctttattcggcaagctcaactgatgaggaagcgcttgtattagcttcccaccactttggaatatcactagtttcccaaaactactcaaaaagtacaattaaattttctgggataggaactaaccaaacttgtgttgagtttgaaacattattaagatttgaatttgaccatacaagaaaaataagttcagtattggtaaaattcccaaaaaaaatctttagttacgagtcaaatgattcagatggttataggtatatcctattttctaaaggatcggaatctgcaataaaagaatgttgtgttaatcaagaaagtttggatattgctaatgaaacatttgaatatgcaacagaatttgctagtaatggctataggacactctgttttgcaaaaaaagaacttagtgaaaatgaagttattgatattttaaatgactttaaacatgataataagattcatttagaagaagttagaacattttttgaaagcaacttgactctacaggggtgttccggaattgaagatatcttacagtaccgtgcccaggaaacgattgagtcatttattgcttcaggtatcaaagtttggatgcttactggggatcgacaagaaactgcaataaatattgcagttagggttggaataatttcagatgaaatggaagttattatttttgatgaaaataaacttgaatcattttcaaataatctaattaaagaatttcccgatagatcaagttttttgaatagagaaaatggttcattcaatttctcaaatgtagtattagtcattgattccaaaatattagaaaaggccctagtaattgatgaagctaaatttgcaaaaattgcaacaaaatgttcatctgtagtttgttctagagttacacctcaacaaaaagcacaagttgttaagttaattcaggagtttacaaagcaaagagtactagcaattggtgatggcggaaatgactgtactatgttacaaactgcaaatgttggtgttggcatccatggttcagaaggcatgcaagcttataatgtatctgattttggaatttcccaattctgtcatcttcaacctttggttcttatacacggaagactctgttatagaagaacatctattttggtgctatataacctttacaaatgctttactctaaatatcgtgagtgtttattttggctttgcatcgcttttcacggggtctaaattgttttttgaattactattccagttatataactttctatatacttcaatacctcctataatttttgcaacatttgattcagatattccaattacattaccatatgattatcacgaaccactttatttattaggcataaccaagccattcttttcattaaaaatatttgggatttggtccatgaatgctgttttccatgcagcggtatcattgttcattccttactttattttgggaggtaacaatccaatatcaaatgatggatacgttccagatttttggactacagggctagccgtttatacaaatgttgtaattgttgtaaataccaagatattactcgaagcatttacttcatggagtcttgttttattctcaataataatatgtgcatttctattttttctatcaattttgtgtttcccccacattttccatataccagaattggaattagcagctaaaagggcaatcattaccccaatgttcgtcattacaattgttatatcaattacagttactatttcactagattggatattaaaaatatataaaagaagcttataccctgaaatatctcacttgttgcagaataagtggtataaaatatacaaaaaaaaatatgaatctcacaggcaacttcttctaaaacacttatcacttaattggctcgagtccatgagaagattaaaaagaaagaaatcggtagaagttgaacaaattcaaataaggaaaaagtcatctgatataattggatatgcattcaactatccagatgttaacgtgagtcagctatttttatcaaataaaacaatataa

SEQ ID NO: 1155 - DNA, 1629 bp, Cryptosporidium hominis
atgggcaatattaaaagtactgaagaaaataaattacttgaaaacagtaaaagtggtggcgtatgtaataactattcctggtgtaatttggatcaggcagaactcaaaaaaataggtaatttatttggaattaatgacttgaatatcgaaactataaaaaaagactttagaatagatctaaatttaatagagaatcggtttcctgccattcttagaagattttatcttgattttttttctttttgctgcaaagatgattttggggaggtaaatttaactgattttgttaaatgcgtggattctattttgtattctaacaagaaaggaataatcaacaaagtttctgaatatgtaacatcaaatatatcagatgaattggatgcacttagagtaatattttctattgtttattttgagataagtttccttctatgtgattcaaaatcttctattttatctttggaaccaaacaataatgatcaatatttgatctctcttacatcatacttggactttgaatttattgttaaagagtattataaaaaaaaaatgactaattgctcaaaacaatcatccgttggtttaatctcagattttattcaggaatacctccctctttttgctttttttatgaaactatcaattcgagttcatttcgacatgatttcacatccgaacaatgttcaaaactcttttatggaagatatcaacttaattcaagatgaatacaacaaacataatgatagccattacaataggcaaaaagattgtcacaatgattcccaaaatggtggatgcatttcttcgctagacctctttaagttaagccgctggattgacgataatagccgtgtgctctcaactgaacactgctgcattttacgatgccagtattttggtgatatgtcaagcggagaatgtttaacactttttcagccatggaatttgctatatgctagttggaaacatggattaagcttgaataggctagtgtcactaatcgaagggtattcatctaatgttttattattgattaagaccactgacaattgtatatttggttcagtttgcactggaaattggaaagaaggtaacggaaaatattgtggagatgaaacgtgttttttaacatctctcagaccaatattttctataattggacagtctggcaaaggtagaaattttatgtatattaatacaagatatgatttttctccgaaaggaatagggtttgggggagagccagagtactccagattatggttggactctacactaggcactggaacttgtttgaaaagcgatcttacgtacaatattggaatgctttatcagcctagtaataattctggtaaaagaaatagttgtttattattaggtactccatattctggagagaacgatgaatcaacaacagaaatcaataaattcagtgtcgcagatattgaagtttggggtttaggaggtgaaagcattttaaagaactacttagaaggtaaggcaacgaatgattatttcaagcaagaaagaaaagtgattgataaatctaagtttattaagagcgaatttgataaagaatatctattgggaaatacttattcaagaggtaacactcattcgtttaattaa

SEQ ID NO: 1156 - DNA, 911 bp, Cryptosporidium hominis
atgaggaataacttcatcgatgaagatatatttaaaattgatgatatcagctcactaattggtagtgatacactactaaatagcccatgcgtagtcatccaaaatgttgactatacccctttgcaagcatccttaattcacaatagcataaaaataagagattttatattaaaacaaaatagtattgatattaatattcaaaactccaaaggagaaaatgttttgattactgcaattgtaaataaagcacccttgacttttattaaagaattgtttagaagaaatatcgacatttgtttacctaaggactctaaattttcaagtattattgattttgcggacccaaattgggaaggttattcagagttaaaacatatgctccaaagaagaaaatcgtataatttcaattatagggagcaaaattctgaaaaacaaatcgaaaataaatctaaagatgttgaaaaaaaagaaactgagcaatctgattattctattaatactattcaatttggcagtgaactagctgaagtcgataaaaaaaacagccctgataataatatatttgatttaaaaagcccaaacactatgaatattgatgacaaaaatcttaatactatcgcgaactacttagaaatggtggaaggcaagaatgcattggaacctattaatcaaattactaacaaaaaaaatacaagtcggagtatttctaaatctatatttattccaaaaagcgtaattaagccgaatgctcatagctctgcaagtgaatcgaaaaaagatactaaagtaaaaaatgacacacaggaaagtagttccttaaaacacgagtcagaaattttttcggaacctttggaggctgaaaagaaaggcgaagaaaataaaagaaatatagtccacatgaaaaactcaac

SEQ ID NO: 1157 - DNA, 702 bp, Cryptosporidium hominis
atggattatactcaaagaaatttagaacagacggttttagataatcaccatatttgtttaaatttaaagcgaaaaaataaattaaattccgaaaataaagaccatatttattatgaattacttgaaaataaatatattaacccatatttagatcagattgattatagtaaaatttttaaacgatttttttctcagaaagatgcaatcgaatattatgattccataaactctcattttggccaaatagaaggctcagacgattctagaatattacccattggagtttttgctgaagaaactaccataaatgggagtagaaattatattgttagttcttatgaatcaatctggaactatatttcttcgctatgtaagtatgaaagacatatttatgaagtaatacttgttaaccagccttgctggctttacttcgatattgaatataataaaagccaatataatttagatgataaccgaatattgattgattttacaagtcatcttaaattgtggattaaattgctatttggatactcaattaaaaaaaacgatatcatttacctctgttcaagtaacgctgataagttttcatatcatatcataataaaaagaatcgacatggttcaaaatttttcgacattattcaaagataatatatcgatgaaaatttttggaaccccattttatttctttttggaataa

SEQ ID NO: 1158 - DNA, 231 bp, Cryptosporidium hominis
atggaggtttcaactgaagattcttcgctcatttgtgagaaaagcagaggagaccgggtatatattgatgcagatactggcgaatatttttgtgaggaatgtgggatccagcaacaggaaaatagagaactagaaagagatattgacgatgtgacatccacggaacaaacgggccagatggtagaagaagcaatgttaggcgtgcgagccagtcaactgaaaagctattaa

SEQ ID NO: 1159 - DNA, 3288 bp, Cryptosporidium hominis
atgagtatatcagaaaatttcaaactaattggggagggcatatcaaaagaagagtatgaaaatgcaaaaaagaatatttgtgcactagactctattatggacgatgatataatagaaagtattcaaacatatatctcatttaaatcattttcagaaattaataaatcgtctgaaggacgtccttttcaagacagccaacaagattcttcctttaacatacagaagttaattgctgaatgtcttagtttaatagtgcaaaattacataggctatgcacctatgtgccagattttgtctgaatggatagatattttggattataaatcagattcatttaacaatagtgacactataggtattaattatattacgccaatccaatctaaaattaacagtaaaaaaaaagtaaaaacacagaaaaccggaagtaattctaacaaaaccttattttcagagaatatggtcgaaccaatggcaatgctcattgaaaggtattttaatacagaaactttaaggaaatatatggacaacaatagagatctacttgggcaaggcggttggcaaccacctccttgttattggagtttgatgaaacatcctgcggttgtaaattctattcaaaagctgttcgcaaggaatagaaagtcggaatttctattggctttcttacaagacttacataacttctctaagacaaatccaaatatcgactgtttgccaaaaaaaatgaacttctcttcaacaagtaactttagtgtatttactaaaaatgtaacggaattgcttgcagactttttattaactgatgaaacaatagaggcagcgctacaaggtacaaatttattaccactaagtggaacaatcaataaccccttgtattctattgatgggaaaaataattcaagcgattattatacttctaacatcattcaagaaatttgctctacattaagccaatcagaaaatgcatatttttatgcacaagcattactacactatatgattgtttggaggggcgattattcgggatgtcgaaggttgagccaaatgctttatcactatgtaagagtcacgttaaaagaaccaagagtcgctcagttaaatcttttgtttacaaacttgacaaattttcctgaattattcaaattgtgtaaaacgattttcaagatggacatatctacaatggaagaaaaaggatcagctaacggtggattaggaggttttgagtcagctattaaattttcaatgaatccaaatcaaatttcttcactttatgacatgctaagcggaataattgataggttcgaatctttgcaaatgctcctttatgaaagaaaaagaattaaaaataccaaagacaacgaaatagattcagaaaaaaaatattcaaatgtatctattaaaaaaaactcaaatgaaagatttaactccacccaaaatgaaatttctgccaacaccaaagaatgggcatctttgggatctttgcaattttctcttagagacttagaattgaacatttctccaagaaactgctctttagagagttttctacagacgaattgtttgaataaaaatcaggacccatctattgatctatcagaaacctttcaaaggaaaatcagcgattgttccagcgattccgaaaataatacttatggttcacaaaaacatgaaacaaaaaattcgaattgtgaaatcaattcttacaatgaaacaatctttgacatgccatctgtaagtagaatgggcgatatccctggttcagatgaaattcaaagattgaaaataggtcctgaacgcccaccaatggatgcgttgagagaaagcgcattattagacacactaattgatattcttgtaaaccaaaccatttggctaactcctgaagagcaaagcaaaacaattgatttacttctattattatctgtctattcaccatatgaattgcttttatttttagaagaacaaaaggagtggaatattgttacaaaagaagttgattctcatattaataatccaattcaagatatctggagtaattctgaagatgaatttgagtgcgatgagaggataaaatacaatgttgacacactttcagattttatttcttcagagtcatcaaattcaattgattctatttcagaatcgaatagttctatgaataaagaaaaaaaccactattggcttccaaataaaataaaaaacacagctaccaatactaggaatgcaagttcaataccagtagaatccaaaaaacaaacggattctacaattggatgtaagagcacaattgattcatgtatttaccgaaacgttcatactcaaaagattttagggtcactacaattattaccgaaaaataaagcgaaaaaaatgaaggagcaatttcaaaatattagggatttatgtgatcgatttaaaaatagagctaggaaggagttatttagaatttacaatataattcatgataatttaataaaagatgagctaaaatgggcatacctagatcatttgattactacaccgattggggccagcgctgtattgaggtatatcgaaattttccttttttcaggaatgaatggaagtagtccgctaattactctttcttcttcaatagttgtaattattaagcatgttactcaatggcacccaaagaaaaggatctgtgttttccaccttctcagactatgtttagaacacggtttacaagatcaaacttcaattagcgtgtgtacaattaactctttggcctcaacgaagtctgaaaaaaggcgttggatcattgacttttttgtttatctgattgggggtggattatacggagcagtacttgcctatatgagtaaagtcgggattaaatatctagataaaaccttaattagagattttacaataaagttgtcggaattttgtggcccaccttacagcgttgacttttcagtttcatatttagattttttggttgatgccaatgcaattggggctcttgatttaaatgcattttgtgaagggacattaagttcatcatctcataaagtaaaattatcaataattgaaattgtaactatattagattacttagaaagcacggctacttcaaatggagcattaaatattagaagtaattcaataaataaaattagtgagtcatacatacatctgaaacatgatttacaaaaagttatgagtaagtgtaaggttcttaagcaaattttaggaaagtcaatgaacaagcaggtttttagaggtaaggggcttggaaaggcgtggcatcaatcatattga

SEQ ID NO: 1160 - DNA, 384 bp, Cryptosporidium hominis
atggaaatggacttgatcccaacaaatattagttttaatccatttagaattgaatctttaattgacgatcatactgcggtttcattatatagaggtatttatgaatgtcttgaattaatcaaatgcggagaaactcacaaattaagttttgaatttttatatagaacatgttatagacttacaataaacaattatggtgggatgctctattgcggtgttttggattttattgtagagatgttggacaaagaaagaaaagacgaaactttagatgaaattgtaaatttttggaaaacttttgaagtaacaatggatactttacatgatgtcttaatgtatttagaggaggaattttattatttcaaatacgaaggttcctattaa

SEQ ID NO: 1161 - DNA, 591 bp, Cryptosporidium hominis
atgtataagagagttgcattattttcgtcagatttgctttcaaactcattaaattgtaaatatttacgtgaaaatattgaaaggcaaataaataaagtttatgaagatgacttttcagatgaatccccaaagaacgttgaagaacattcagattctctattgaaaagtgaagatataaaaactgaaagcattgattccgttgaatatgactttattgggaaatttaaatgcattctctgccccaaaaaaataattattaatgagtctgatcttgataagcatatcaaatctaaacagcatctaaatatggtagaaaaatggcaaaaaaaacaggaatacgcaaggaaaataagagaaaaattcaatattcttcataatttgacagatagagataaaattatagatgagattaaccctaaaaatacattaagccctggtttgactcccaacaaacaatcaaatagaaaaaataagaaacgaaaaagctctaacttgtctgaagagcaaattattgcaaagaagatgaaatttgcgagaaaaaaagaacgaagacttgcaagaaagtcacagctcactgaaaatatttgttaa

SEQ ID NO: 1162 - DNA, 735 bp, Cryptosporidium hominis
atgatctttaatattggcaatgaaaaacttttggtttcacgtttaatatcaaagttagctccaaattacaaaattttagtttcttgttttaagcaattcccatcctcttatctactgataaattcaaattttaaagcgaatcaatatttgagagataaaagcaattattcagatatgagaaaaactttcaaactattaaatgaggaaaatttatctggaattttaaacatgaatgcattccagttatttggtcttgaaaataaattttcaattaacaaaaaaagtgttgatttaagttataaagaactaatgagaaaattgcatcctgatgtaagtaacaatgtaaacgaaaatatttctattcatatcataaaacaatataacactgtgaacgatccatttgaaagagctctattattgatatctttgaagagtagcatgacaagagataatttaataaatatcatggatacaattccagtaagctcaagtttattagaacagatatttgagattgatgacaaaattatggaaatttcgaatgctggttttaatattacagactttgatgagatatcacaaaaaaacaaatttaagatcaatcattgtattaaatctttagaaaacgaatttgagaaagataatttttctataacaaaaatattatctattttaaaagagcttcgtatttatcaaaaacttagtgatcgtgcctcatcaatattagataattag

SEQ ID NO: 1163 - DNA, 432 bp, Cryptosporidium hominis
atgaagctaagaactttagtgctagtgaaaattacatcacaacgtaaaataaatcataaagcgcatatttacatgtgcaacaaagatgatatcaaagagattaaaaggaaaaattatttgactgaagagcccaataaatatggaaagatttctttgaaagaaaatgcaacaaatcaacttgaatttttcaatttcagtaaccctggtttttccacaatgaggaaacttgtgggtattgttacaagcggaggatactccatgcttttgagaaaaggaataggaataggctatatttcgcttttctcatttgatgaatcttgtctagaacaaaacaaagaatcatttttctggattagagatcgctgccttagatatactcctgtcaatgtagaaaaatacagtgcaacaaatcttcatttcaatatttattaa

SEQ ID NO: 1164 - DNA, 795 bp, Cryptosporidium hominis
atgccgttcccatataaacacgagtttttttcgggcttaattaaactaccttttttatcatctgaacctgaatatattaattttccaattagccaagccaatattcaagaataccttacaactctatatgaatgtacacagaatttgcaaataaatatgatccctagacttaatgcaggcttttcaaatgattcaattaaagccgaagatgcaattgaaaatccctctcataaaaatcatatatcatcagatgatttggcaataatagatgaagaaataatcggagtttattatggcactaaaacaaatgaatgcgatattaccagtcagtcagtttgtatggagaggggtacaatagaaactgatgatcaagaagtaaaactaatgcatccaataaaacaaaatgttacagctgtatcaatactagacattatacctttagacatgaattactgttcaacattccaagtgatgcttgattctcaggaagaaggcatggacaccattcttgaattggacgaaggttggaatcatcccacgacaaggttctcactttataataaaattgaaaacaaattatacaaatatgttagagactattcatcaactttaccaaaggaatatacaaaaagctatatcattagccttccgagacattttgtagagtgtaaagaagaaagtaaatcatctgaaacttttggttccaaagcatacttaatatctactaaatccccaaaattattgttatcaaaagtttcgtcaatgaaaagaaaacctaaaattaaactattataa

SEQ ID NO: 1165 - DNA, 651 bp, Cryptosporidium hominis
atgaaaaaaaataacaagtcaacagaccaaaaaattagaaaacttgacaattactgtaatgtttgcgaaaaaggatttatcaacaatgaaaaacatgcacaacatattttaaattttcatgtcacttgcagtgaagaaaattgtaactactctgcaccaaaagaaataatgcactatcataaactaaaacatattaataataatgaaggtaatagcattacagaatcaattgaagagatcgaaaaatggttaatttgtaggaaaatgaagtttcctagatctgtatgttcaaagaaccatttgattaaaagtcaagattcaaatgagattctgcaagataataacaaaaaaaaatgtcaaagtactcaaatttctgcattggaacattatataaggataaatatgagtaatcaattaccgttttcctgttctaaaaagctaaacaaacctttaaataaaaagaataataattataattcaaacttcaaggtacgtaaaaataaaatgtatgggaaagcccttccagaaaacaaaaaaatacagaaatctcttttatttaggctatttaaaagtgaaattcatatatatgaaaagaaaatgatatccgccattaatcacataatagaacgttctcattgcaaaatctgttaa

SEQ ID NO: 1166 - DNA, 294 bp, Cryptosporidium hominis
atggatctttccgaaataacttttaggaattctctagatgaagatttgaacatagaatcttggatagatacaactgttaatttcaataatgaaagcctattagaggtatctttccttaattcaaaaaaggataaaattaaagttgataaaaaaaacattattagtaaagcgattgaaagaaagaaatttaaaaagaataagaaagctgtgaataggaaattatccgataatcgtaagaaggatgatgatattataagcagtggaaggacgtcattaattttaagaagtttataa

SEQ ID NO: 1167 - DNA, 1110 bp, Cryptosporidium hominis
atgtcaggttttaatattgaaaaactaattaatttaaactcatttagccaaggtatttcggaaaatgaaacgttggcactatctttacccacaggaaatacagtcgaccttgattttgagagttattgttactattatagtgataatacatacaacaacgaagatatttcatctattttaaacaaaaaaaacgaaattaatggaatcaataattgggttaacttcaatagtgtagagaacaccaaatattttgaagaatgcataccatcaaacattaacacaaatataaacagaatgaatcatgtaaatgatgctgagtacacttgccatgattattttaataaagataattttctgccttcattaattaattccaattttgttacaaattatttccacaacagtgaagtaaaagttaaaagcaaagtaaaatcgattgtattatttttaagagcaaatttagggattaatgttgcaaaaaatttcaaagaagaagtagaggcgcttggagcgtatgttttcattgcagataattgtaaggagttgttagatgttaacaatgaactggatggttgtaaaaggttgattgttacatctgcagatgtagctttgaatgagagattagctgaggaaatatcaaaaaaaaagttgtcaaattttcttggggtggtactttattgtggtcctcatgctgaatatcatattaagtggtgttctaaagtttcctccataaaatttctttcacaaaatttaatagaggttaggcgtgccatttcttggttgttttctgaatccttatcaaatgcaaatgaaatgccaaatattggacgaagaggaaaaaaagttgctcttcaagacttgaaaagatcttcacaaggcaaaataaactcagttgcaagtagttttccaagtttagggatgcagacaataggaacccaaagcattaatgaggaagatggaaacatacattcgacaggaagctattcaccattcggaataaataatggcaatccacatgataatattgcaagcatgtttagaacactagcgcttgaaactaaaattgcaacacaagtgaataacggacaatttttcagtattgacaactga

SEQ ID NO: 1168 - DNA, 1545 bp, Cryptosporidium hominis
  misc_feature (26)..(26): n is a, c, g, or t
atgcacataaaaataatttatttaantatagaaaagtcttgctatcagttaaatactacagagaatcaaaatttagaaaaggaagtcaaaaatgacatctatttaagatcgaatttaattaaagtatttaaagatgataataatgaagttattatttctgttccatgtaaattaaatatggatctagagagtttattttactacttttcaaataactcaatttatctaaagtgtaaacaatttgcaagcatgcttcattttagtaagctttatcataaaagcaagcctattgatattttgggtaggatgtttccttcaagccaagaggacttaccaagtgaggagagacaaatagaatataatttatttctcaagctcttgcatcgtttttctcaatttaaattcagatcgattggggcaactgaagatgaaaaattgaatttagtggtttcttttttacttagttgtgattacgctgatataatttcgaataagttggttaggtctgaaagatccattcaagtaaatgatccaacaatgcaaagaaaagataaagatatacaaataaaggctgaattaagggatagctctatccaaatagaacaaagtttaaataacgtagcagttgatgcaaccttttctgtagcagatgctagttgctattgtgacatagaacaagagttaaatttaactaacatccagagagaactagatgatccttccaatgaagaacatcaaaatcaagtatttgattatttaaatgtttataatatacaagatcagctaagacttcaggagattgttgtaaaacccgagctcgaagaactaaatcagcaagatttaaaaaaaagcgagaagaaaaaccttcaaaagaaaaaaattcagaaaatttcagacccagaatcagaaattttagtagcgcttacaagcattaatcaagaggatgataagaaattatataggatatttgtatattactctgggcccaatagcgagagactttcttatcgtcaattttacaatttaatgaatgattctggtttactaggagggaatttcgaggaatatattactccaattcaattagaaagatgctactctgccgtcattactaatccgaaaggtttggactattgggaatttaaagaaatattgctttattgcggcgaagcatcttcttgcggaaatgatcctatttctgcattccaaatcataataagaaaatatataattccgttgattttgatgatatatcaacctaacaattttgaaaagtgtgaagatgtagtactggatcaatctgtttctggggaatttgagaatgtaaaaagtttacaaacaatgattaataaggcaattttaccttggttcaggctcgggagccgtccaatattaagtgatgaaagcgatgaatattctgaaacctgcagctgtagctcatttgattcacattttgatagttttgaggacaaacaatcttcaatatctagttcacatatctctagctccgcgacacaaggaattaatacacaaacaccgaaataa

SEQ ID NO: 1169 - DNA, 219 bp, Cryptosporidium hominis
  misc_feature (190)..(191): n is a, c, g, or t
  misc_feature (193)..(193): n is a, c, g, or t
  misc_feature (195)..(199): n is a, c, g, or t
ggagatcaaggctactggactgctgagaaaattaataacaattcaaagcaatcaaccgtgtacatattaggtgaagaaaggcaggtagcccacattaataaagattcaaatataattattgaagaaaaactaaatttttgcgcatgctgtaaagatagtatttttgtagataatatatttttattttggnnancnnnnncttttttaatcataaaataa

SEQ ID NO: 1170 - DNA, 510 bp, Cryptosporidium hominis
atggataccttgttgactcaactgtcaactatttttctaaataagataaacgagtcgtattcatttaatattagaaattcaaagatcaaggcatttgataatactggaatacttaaagatcaatttgaatgcattgacttgagtgataactcaatttcatctcttagctatatttcgaatttaaatagactgtcgacttttattgcgtgcaataatgaaatagaatatatagagtctggatttactaagagtttgccaaatctcgagagtttggtattaacaaataatcatattaaaaatatcgagtcaatatcagcaatattctttcttagaaatttgaaaagattatctttggttaataatccaattacaaaaattcctaattacaaaacaattttaatagggatgcttcctaatttaatttatctggatttccaaaagatcaataaagtagataggaacgcatctgagttatttttcgaaactaatagtatcggtaaggacttatta

SEQ ID NO: 1171 - DNA, 7026 bp, Cryptosporidium hominis
atggatttcaataacgctcttcaaaatgaacaagcgaggcagataaatttgggaataaagcacttaaattggtcgaagctaaatgaagcccgatattgcagacgctcaaaagttaatggaaatcagattgtgagaaaatctaaattaccacctgaacatttaaggaaactaattaatattcatggcgatatgtcatcgagaaagtttcagaatgagaagagaatctatttgggtgcgctaaaatatatccctcattcaatttttaagttgttagaaaacataccaatgccttgggaaagagtaaagtatgtagattgtttgtatcatactacaggcgcaataacttttgtaaatgaaataccatgggttattgaacctatctatattgctcagtggtctacaatgtggacgatgatgagaagggaaaagcgtgataggaagcattttaaaaggattcgttttccaccctttgatgatgaagaacccccgatagattattgtgaaaatatcttaggtgttgaaccacttgattctatacagatagttttggatagtgaagaagatatttctgtttatgattggttttatttagattcaaaacaacaatttaagtattttcataaaaaggggaattataaaaaacataagtggcatttaacatttgaacaacttgggactctttatagattatccatgcaaatattaccaattttattagaaaataactcttattatttatttaataaagatgcattttttactgcaaaagcactaaatattgcaattccagggggacctaaatttgagccactaaatagtacttcatttgatgaggatgaagattggaatgaatttaacgatcttaaccgagtaattttcaggtcgatcacaagatctgaatataaaatagcctttccacatttttataattcattacctaaatttgtttctacatcagtctatcattacatagttaatatatttacaaggccggaaaacccgaattctccaatattcgagttcaatgaatattaccatccaatttctccaaataactctttgttggaaagtatttaccaaatcgttgatgaggaaatacatgatattaaaattcactttagcccttttttctacgaatatagccttgagacaagttccacaacaaatggaattttattattctggtcgccatttccatttaatgttagatcaaacccaagaagaagaagttatgacatttcattattaaaagaatggtataagaataacaatatttcttctgagcagccagttaagatccgtatttcacaacaaaaattattaaaaaactggatattaaactctttgcataataaggttgcaaagaactgtaaaagacgtaattttttaaaaatattacaaaatacaaaattctttcaatctactgaaatggactgggttgaggtcgggcttcaggtatgcaaacaaggatataatatgttaaatttactaattcatagaaagaacctaacgtatttacatttggactacaattttaatctaaaaccaattaaaacattaactactaaagaaaggaaaaaaagtaggtttggaaatgcttttcatctttgtagagagatattaaggttaacaaagttagtagttgattgccacgtacagtatagattagggaatattgatgcgttccaacttgcagatggcctacaatatatttttaatcatgttggacaacttactgggatatatcgatataaatatcgaattatgagacaagttagaatgtgcaaagatataaaacatattgtatattataggtttaatactggttcggtgggcaaaggtcctggagttggattctgggaaccaagttggagaatttggatattttttcttcgtggaataataccaattcttgaacgttggattgggaatttattatctaggcaatttacaggacgtcagaattccaacccatatagatctattagcaagcaaagagttgaaagtcattttgatcttgagttaagagcttctgtaatgcatgatatacttgatatgatgcctgagcaacttcgatctagtaaagcacgtccaatattacaacatttgagtgaatcatggcgatgctggaaggcaaatcttccttggaaagtacatggaatgccacccgcagtagaaaatattattttgagatatgtaaaattaaaagcagattggtggacaaattcagcttattttaatagagaaaggattcgaagaggggcaactgttgataaaactgttgtaaaaaaaaatttaggtagattaacaagattatacattaaggcagaacaagaaagacaaataagctatctaaaggatgggccttatatatctagcgaagaagctgttgcaatttatactactgcagttcattggctagagagtcgtagatttattcatattccatttcctccattaaattataaacatgacacgaaactacttattttagcattagaacgcctaaaagaagtatatagcgtaaaatcaaggcttaatcgttcacaacgtgaagagttgacattaattgaaaatgcttatgataatccacacgaaactctagccagaataaaaagacatttattaactcaaagaacatttaaagaaacaaatattgagtttatggacttatattctcatttaatacctgtttatgaaatagacccattggaaaaaattactgacacatacttagaccagtatttatggtatgaatctgacaacagaaaactgtttccgaattgggtaaagccatcggataatgaaccgcctccactgcttgtatataaactatgtaatgggataaataatcttgacggattttggaagtttgatgatgattcagttggtcttttggttgagactcaatttgaacaaatcatggaaaaaattgacttaactttgctaaatagacttttaagattaattaccgatcacaatattgctgactatatcacaagcaaaaataatattaatgtaacatataaagatatgaattatttgaactcttatggaattattcgtggtttacaattctcttcatttgtttgtcagtattatctcttgattgttgatttgctattacttggattgactcgagcaaatcaaattgcaggctcaccaagccatcctaatgaatttttaaagtattcagataaaaagatagagctatctcatccaattagattgtattgcagatttgttgataagttatacataattattaaacttagtaaacaagaaataaaagaaatagttcaacgatacttatctgaaaacccagattttagcaataatcaaaatttaataggatataataacaagaaatgttggccaagagaatcccgtatgagactagttaaaaatgacgtaattataggcaaaagtgtctattgggaactatctaatcgacttccaaagagtataactacattagaatgggaaagatcatttgtttcagtatattccaaaagtaacccaaatctattattttcattggctggattttcagtgagaatacttcccacttgcaggataggaaaaagaacttttgaagcaagcaatacatcttttattggtaatgaagattcccaatattacactagagaaagtacatggcaattgagtaataatgtgacaaaggaaattacatcttatgtctttttaatggtagacgagtcagaaattagaaattttgaaaatagagttaggcagattctaattacttcaggatctgcaacatttactaagattgcgaacaagtggaatacgtgcttgattggtctaatgacatattttagagaggcagttatttatactgaaaaattattggacttacttgtaagatgcgaaaacaaaatccaaactagaataaaaataggtcttaattcaaaaatgccaacaagatttccgcctgtagttttctatacacctaaagaacttggaggacttggtatgctatcaatgggacatatattaattccacaaagtgatttacgctttactagacaaactgatttaggaacaatttcacatttcagagccggaatgactcatgaccaagatgagcatataccaaatttgtatcgctatattcaaacatgggaaagcgaatttatagaatctcaacgtgtttggctagaatattcacttaaaaggcagcaagctcagttgcaaaataagaggcttacactagaagatatagaagatagttgggataaaggaattccaaggataaatactttatttcaaaaagataggcatactcttgcttatgataaaggttggagaattagacagattttcaggcagttccagatattaagaaataatcctttctggtggactcaccagaaacatgacggtaagttatggaacttaagcaactatagaaccgacatgatacaggcattgggaggggttgaaagcattttagaacatacattatttaaaggcacatacttttcaacctgggaaggacttttctgggagaaatcatcgggctttgaagagagcatgaaatataaaaaacttacaaatgcacaaagaagtggattaaatcaaattccaaaccgtagatttactttgtggtggagtcctacaattaatcgcgcaaacgtctatattggtttccaagtacaactggatttaaccggcatttttatgcatggaaaacttccaacattgaaaatttcattgatccagatttttagggcccatttatggcaaaaaatacacgagtcaatcgtaatggatatctgccaggttttagataatgaagttgatgcactagggattgaaatggtacaaaaagaagccattcatcctagaaaaagttataaaatgaattcttcttgtgcggatattttgttattatcatcttataaatgggtagcaacgaatccatctcttttactggacaagaaagatgatatttcttctaattcattaattaacactaataaattttggatcgatattcagttgagatggggggattatgattcacatgatattgaaaggtattgccgtgcaaagtttctcgattatactagtgacgcaatgtcaatttacccttctcctacaggagtattgattgcagttgacctagcttataacctttattctgcatatggaaattggattccaggacttaaggaattaattcagaaagctatggcaaaaattatgaaatcaaatcctgcattgtatgttttaagggaaagaataaggaaagggcttcagctatattgctctgaacctactgaaccatatttaaatagccaaaattataatgaactgtttagcaaccagaccacttggtttgtagatgatacaaatgtatatagagtttcaatacataaaacatttgaagggaacctaactacaaaaccagtaaatggctgtatattgatacttaacccatgcaatggaaagctatttatgaaagtaatacacacctctgtttgggctggccaaaaaagactttcacaattagccaaatggaagacggcagaagaagttgttgcgcttatccgctctttacctattgaggaacaaccaaaacaggtaatagttacaagaaagggtatgctagatcctctggaagttcacttacttgattttcccaatattgtcattaaaggttcagatctaagccttccgtttcaagcactcctcaagatagaaaaatttggcgatttagtacttaagtctacacaaccgtcaatggtactattttccctatatgatgattggcttaaaacaatttctccatttacagcatttagcagattagtgttaattttaaggtcaatgcatataaaccccgaaagaacaaaggtgattcttaaaccaaataaaaatattattacaatgcataatcatatttggccatcattaacagatgaagaatgggctagtgtcgaagttgcgatgaaagacataatattggatgattactccaaaaagaacaatgtacatatatctgcactgacacagagcgaaatacgagacattatattaggaatggaaataactcctccttcaattcaaagacaacaaattgcagaaattgagagacaagttaaggatcttgcgaacaaaacgactgaatgttcggatattactagtttaactactaaaacggtcaacgttcatggccaggaaattgtagtcacgactcaaacacaatatgaacagaagactttttcttcgaaaaccgactggagagcaagagctttagcttcaacgactttaagcttaagaagcgataatatttatattttatctgatgattcaattcttaacatttcaaataactcgattatcccatatattatcccaaaaaatttattgaaaacatttattgaaatttcagatttaaggacgcagattggagcatttatgtatggtaaaaaaatcgttgaatcaatcgggaaaggaaaatgctattccgaaaatagttgtgaaatggaaactgttattgagataagatgcttagtattagctcctcaacatggcaatcaaaactctattaatatgactgacattctacccaaaaacccggaaatttcagacttggaatttattggattaataaaaaccaaagtccaagaagagttttctatagctatatctgatattgattacttatggaggatttctcaaaataatttggatgttcaagtagacaatatcgcgatggttagttgcagctttaccccaggatccactaccctttctgcaattaaattagatcatgactgtattgattggtataaaaataacattgaaaataaggacttgaactatgaaacttttaaaacttgttcatcagattatacagaaaaaatcaaactgatactttcggaaacttataatgggttttttctaattccggaagatggcgtatggagctacaattccatggtggttaagtacaattattcctctaaatgttcatatatagtggataagccctag

SEQ ID NO: 1172 - DNA, 1899 bp, Cryptosporidium hominis
atgcagcagattcctaccatactaaagaattcaaagtcttggtcaaattcaacacagagatctgaatataacaaacattctaataattgggtagattttaatctcaatgttgaaaaactgaataattgttcgaattctaattttatttacaagtttttaaatacaaatctttctaggaactatcatggaaatttgaatcatgctagatcagaaagatatcagacaaaaaacgaaggggtaattcaaaattcatcgataaaagaaaataaagttttgagacaaaaattagtcaattcaaggccagttgaaattgaatgcaaaactttacttcctaatttattttctgtgaatgggcaaaaacatattccttttgacattaatttaaatcgatttgatacttttgaaactgagagtaaaaattctcataaaaacaaaccacaaataattaataggaaattaggaaacgacttgaattattttaacacaaaaattattaactcaaatcattgcccaaagcttgtaccaatagcttgtaataatctatttcgtgcaacttcttttttagaagtcaagccaaatttcaataatttcaacaataactcaagttttttgagaaaaaattcaagtttcatatcagagaattatagaaacaacggtataaaatctaatatcaatgtgtcttgtattcaagaaaaaaattacagttcaagtaatctaactaatagtcaaaaaaaaattagttattcagcgaatcaagaaaattcttcgatattgttgaatagcaaatcaaaaaatctaaaaatgccaaattatttcagttctaaactctttataagaaatcttccaaaagtttcaattaataatttaagttcaaagccaatttaccatatagatggtcttgaatccaatgataatggaatggaagtaaacttgacgagtataaagatgttttcaatacttgggtttgggtcaaccagtttagtttattcagcagtttggagagggactgaagttgccgtaaaaatattgggtaactatgcaaaaagtattaaatcatccgattgcaatcacttaaatctaagtattaataaagcaattaaacacatggaaattaccaaaaaagattgccaacgttacttagaatttagaaatgagattagaatcatgaatctgttacgtcatccaaatattgtacagtatatgggaggcaatattagttcaaatccgccatttttgatatgtgaattttgctctggaggcactctttttaacttattacatggagactcaaaaaaatgtttagaatcgaacagtttttctttttctggaccatctgttaacttatctttgtaccaaaggataaaaattctgcaggatattgctcgagggatccattttttgcactcaacaaatccaccaataattcacagggatattaagtcattaaatattttcttatcattgccaattaaatctaatgctgacgtcccaattgctaaagttggagattttggcctctgccagcaattattctcagacaagggttttataaatggatctggaaatttggttggtacataccagtggatggcacctgaagtgttaacaagccaaatctacaacgaacatatagatgtatatagctttggaatgatcatgtatgaagttctctcaaacaggacacctttttttgaattaggagttgatgtaagcccagaaatattggctgatgaaatcattaaaggtattagacctacattgaagtatatagttaacgatgtacctatcgaaataaaaaacataatgattcgatgctgggacccgcaaccttccaagagagggacgatgcttgtaataattaatgaattacagcattttattgaaaaaatagggaattaa

SEQ ID NO: 1173 - DNA, 669 bp, Cryptosporidium hominis
atgagttatatcgaatgtagtaaagtaggtagagtcaatattaatcaacttgaggaccttcttgacctgttaaaatccttatgcgtagaagttaagcttgttaagtggcgtgagaacacatggtgccctaatgttatggagtcgcattgtttttctagaaaattagactttacaaaggcgcaaaaacacgctgaagcagaagctcgtatattacagtatatttatcctacagaaagcaaagacttagtcaatatttcgtaccaaacgccaattattgaacccacaactaatagtttggaaatgtctttaacaagcgataaagataaaaaagcgactatactggttaataaagtggttgaatgcttttcatccaaatcaatattggaaattatacagcatttgaatattggttctttaaattcaacaccccctacgctttacaatacgctttatatcagctgttatatgtgtacttttaaccctctcaaagcagatgaggtggtgatttttgttcaaactgaattcaaagatataaattttaattataattccaatgaccatatactagttattctaaaatctaaatgtttgaatgaaaatgtcatttctacgaataaacaagcaattcttaatctaagtaagaaattagaaaaaatagtttcattttaa

SEQ ID NO: 1174 - DNA, 783 bp, Cryptosporidium hominis
atgtatagagtgacccaaatgtcgatagctcacggtatatgccaatttatgaagaggtctctgggcaatttaaatatcgaaaaaattttgaataactttcaagataatgaaagtgcaaaattttcaattcataatatggtaaatattggtctgattgaatttggaattgatcctacatcttggattggaccaacaacatcatcaatgatcgcaaataagctgataaatgataatagaagcattatatctaatattcagattgcgagtattacctatgcagaaggcactatttatagggatcaagcggttaaacacttttcagaagtaggttcagatagctgtacttttgtatggctttgcatgaagttgggtacgtccaaattcaatattaactcatataagaaaacagtaatttcaatgagtaatgtctcacagttcatatgtattatgggaggtaataattatttgtcaggagctttattaattgttgcatttagcaattcctttttgtattgcttagatccgcatattaaagtacttccatcattttccgataaaaactttattagggatgactttattcaaaaagttccgacaaagatttattggggggaactgaatccatccttatccatggtttatatttgccgaaaccttgaggattttgatgatttgtgcagcaatttaactagaattaattctgatttatttgaagtcataaataattgtgattttgaagtaaagagtataaatgaattagattctgggtttttagttgtataa

SEQ ID NO: 1175 - DNA, 1275 bp, Cryptosporidium hominis
atggaagggcttagtaaccatgccttaacaaaagtttgcataaatagcttgagatacaaccttcaacaggatatttctatatgcagaaatattttcttgttttatcagagcaacaaatattatatgaatttcactcaacttaataatttaaattttagaaaacgaagatgttattcaacatttaattcatattttaataaatttgtttcacaattaaaaagtgaaattaagagtgacaaaatactacaggatgatattgcacttttgaagaaaaaatttgataatttatatttcaagttttacagtaatttaccatttagaaatttctattcttcggtttatttcataaatattgcagaattgtataaaattaatagatttttatcccatattaaattttttacagctaaaatttcttcaattttctctcgattcctttcaagcaaccttttttcaaggcaaatagaaataataaaagttttattttatgatgaaaccaataggaatgtgatagaaagagagctttcaagctggaagtcagattgtaataaagaaagtaacagtgagattaaaactagcaataagaaaattataaataagaatattgaaggcaaaactatagttccaatagtagaaaattctgttgcactacacaattattctttacgggacaggcttggcgtaaaacttaaggatatgctattattgaaaaatatatttgaaaatgaatattttaaaactatatataatggaaataaaatatctaaagtcgttaaagaaatgaaggcgatcaatccaaattttaaattaactgactttatgtcattttttgaagaatacattctcccaaaattcatggaatcatatcttaaatgcgacgagcataagctgagattgcattgtggggatgtagcatatagacaactttgctcaaacataaaaaaacttaaaaagatggggctttgcttaaatacaaaaattcttcaattaggagatgtagagctgataggagcagaaatctcagatttaatgttttcttttaaggattgcaaaatacaagcaaatcaaccggaatttatgtttacatttaaaacgcaacaaattaattacttgaaagactctaatggaagaataatttccggttccatagacgatatcaaagagttacaatattcaatcaaagtaactcctcatccaaatgccaatgttcctggtctggaatacccctatttgataactaatatggaaataataggttcaatccccattttttaa

SEQ ID NO: 1176 - DNA, 1398 bp, Cryptosporidium hominis
atgaaaagaaaagataaaaatgaaattataaatgcgaattacattgcaggtaagtcttggttagctgaggaggttaataatagattaaaagaaagagacaaaatctttaatgtttgtggagatgagtttgaaagtaataaatggtttcaattaatgaacaaattttctaaatatggagaaataactagagggaacaaaataaaattatttgaaaatagccgggattcatacttgtcgatgattgaaagtattgattcagcgaaaaagagagtatggtttgaaacatatatctttgaggaatgcgaaactggagaaaaatttgttaattcgttttgtaaagcatcacaaagaggatgcgaagttattttactgctagacgcttttggtagctctaaattcccaaaaagatgggaacaaaagttactaaaaaataatgtgaaggttatatggtttaatcccatttctcaaatttttaaggatacctttttattcagaaatcacagaaagttattaattgctgatgaaaaggcatattgcggatcaattaatattactaaccgaattaatgactcatcgttgaatgacgaagtcaatatcaaaaattacaacataatttgtaactcggcgtataaacaactaatttttttatttaaacaaataatttattcaatttcaccaataaaggttaataagctttgtttctacgatgtacacacggaaatagaaggccctgcaacttacgatctcggaaaagtttttatcgactcactcaaagaatctaaatgtgaacaaattccaataatattccaaagaccgaaagaaataaaaaatggcactatattacaagtactatacagtaatacaagaaggcagcatagaggaattcaaaatgttttaaatattgcaacaaaaaattcaaatagttatatttatctcacaacatcttatttttttcctccaagttttctacgtagagccattcaaactgcaattaataataatgtaaaagtttcgatgttgttatcaggtagatccgatattccaggagatacaattgcaacaaagtatttaatcaaaaggtttattcaaaacaatgtaagatttttttttacaagaaatattcactgtcacgctaaatacattacaatagatgggatatggtcatcttttggaagttttaactgggatgggttttctgcgaatcgaaatttggaagtttctgtagcgtcattcgattcaaagattgcaagccagttaatgaaaatgcactcaaaaatgacgcattcatttcaaagtacagaacaaacaataaatcaatggaatgagcaatctaggctcaccagagtttgctcaaaagctgcatatatacttatcaaatttgtaaataagtatttgtaa

SEQ ID NO: 1177 - DNA, 1030 bp, Cryptosporidium hominis
atgagtgtaggtactccaatggaaaatcaagagattatttccaaaaaaagaaggtatagaaaggataagccgtgggataccgatgatattgatcactggaacgttcctaaattaacacccgaagataatcctcatggacttttagaagaaagtagttttgcagtgctatttccaaaatatcgtgaaaaatatttacgtgatatttggccagatatacgtaatgccctgaaagcccatcatattaaatgcgagcttgatttagtagaaggatctattactgtaagaacgacaggcaagacttgggacccgtttattattatacgcgctagagatatggtaaaactcttatcaagaagcgtaccatttcatcaagcagttcgaattctaggtgatggggaggatgataacaatcttggctgcgacataataaaaatcggacataggaataaggagaagatggttaaaagacgtcagagactagtaggcccaaatggatctacattaaaagctattgaattgctaacaaattgctacgtgttagttcaaggtcaaacagttagtgtaattggatcatataaaagcttaaagctcgtgcgccgaatagtagaagattgtatgaataatatacacccagtctaccatatcaaagaactcatgataaagagagaattagaaaaagatgaaagattaagaggagaaaattgggatcggtttttaccaaaatttaaaaacaaatgtgtaaagaggaaggtgaagaaacaaatgaaaaagaaaaacaagtcaatattcccacctgagcctactcctagaaaagaagatatgttactcgaaactggtgagtacttttatagtgaattggaaagaaaagctaaacaaattaaagaaagaatatctgagcaaaaagagaaaaaaaatgaaaaacataaagaaagagaaaagatttatgttcctccgaatgaaaaattgtttttaaaaaataaaataagtaaccaaaacgaaattaattataaaacttttgggcagaatctcg

SEQ ID NO: 1178 - DNA, 3924 bp, Cryptosporidium hominis
atgatagacaaaatggatcacgataagaattgtttaataggaaaagaaattcaagacaaaatgacgtatttagaaccaattcaaaacaaaaatacattatcaaatccatttggaaagattgaagctgatttgtgtaataaacagataattgatgaaagttttatttctgaatggagaaacggttatttccaattatataaagagtcttgttataaaaagctatgcgaaattttcgatgagtttgcacagccatattttgaaaaaaagatatcggatgagaaaaaaaaaggtatctttacaaaattgttaaggctgggaagtttgattggagttgatgaaagctatattagaaggactaatatacggaattctttaagagatggtggaaaattatgtatttttcgaaggttaacacaagaattatttaagaccccatcttcaaaaaatgcaattataatagttgatgaagtgcaaaatattattttgaatttacttacggttgatttagttgataaaaaaaaaaattatgcagcaaaatttgacaaagaatctcgtattgatggactggagttaatttttatattttcaaagttgcttcaagtagttgcgacttgtattccttattgccccattaaattaatcagttttgtactggcactatcttcggatattttatgggtacacgattttcttttatatgcttcagattcgattgataatattgagaacccaaataataaattgattaaaaatcatttagataatcaccttttttctaaaattatcatgaaatcactcaaaaatttacattttttaccattggactcttacaaatcatattataaagagatttgtactctttatccctttactgatgcaaagcaaattgtaatggcttttctctataccaaaataagaattttcaaggagctttcaaaacagatttcaattaaaaaaatgtacatatctccatttttaatttataatttctggactgatccaacactttggacaattcaaactaacgaaaactatcctattgatgttgggaaatatattcaagaattaagagaaaatgttgatgtattagcaaaacagctctatcaatcagaatgcttaacattagcaatgagcatatatttaaagcatcctcttctaatttctgatgtgaaattagccttgaatattaacaccgaatttttccgtaaagtactgaagggtagagatcctatagacggccaactttgtatggcattatcttcttccctggaaaaaaaagattcatggaatgtttttgtacaatctttaaacccatcaaatattcttgataactattataggacacagaggatggcaagaattggatgggatttaggaattttgttcaaccattacagcatgaggaaggagatggaagatcttcacaaacaatctaagtggtgtaacagctttaggcaactaaaaattgaatttgatcagtcactcttttttcagaaacaagatcctcaaaataacaatcacggatataagaaaagtattatttgcaagctgattcataatagtgattttgacttaattctttgtttacagtatgcaaaggattataatattaacgatgaatatatcctatttctttggtcgaaacatatgatactttacaactttgatcccaaattcgaactaataatgcaaaatattctttcatttgtgacaccagaacttggaaaggagatttttgaaagcacttttgaattaatttcttcttttgattatgaaagactaaagttcgtattaaattggtataataaaaattgtattaatactattgaacttcctaactctatgaatgattatttgagaacagaagcaaacaatgaatattctacaagtagtagctcgagtgaaataaataaaggattttttgaaaatcaaaaccatacaaatatttccacaatttctaaactagaagttctcaaaatactatcaacttataaaagagtttgccctgcagataaggatgaaaaactattcattaaaaatgaagccgagcgtattaatggaaatattgagttggataaaaaagttaattttaaagtggaatctcataaatatagaattcctttccattatctcattaaacatccgataaatgcattaaaatatgaaataaatgacgagactatatataaaataaagaaaatgtcagaatacttgggcataaagaatatatcaattgatattcaatttgtctggaatattgtattatgcagaaagtataaatatctatcagaaaataatttatcaaaaacggaatcaaatgaatttcaggaatactgctttaaactagtggagagtgacaaaattttattgagatatattgaatcaattgcttcaattgatttagaagctggcattgcaatagttttacttgttgtcgacgagcttcccctttcaaaaacgaagattaaattaatagagtggtgcgaaagaaaatcaggatcaattgcaagagtcgaattaaagaaagggtatccaatcataaatatggaattcttattatataacagatttaatgaagtcattataaatattgaaaactacttaaaatcaaaaaagagcttaatttcgtcaaagcttattttaaaaaaacataaattagacatcattttttcaaaacttatagaagagacaaatgatattagtattttcatcagctctttatactactatctcacaccgcttatttcagaaggaatttactggaaatttaagaacaaattacaggaatcagtttgtcaatctttttgtattgatcctaaaccagaacgaggaatttatagttttagtcggaaaaattctatagaaaaatctcctagctcttcaaattttacgttgaaagaaaattttaatttttttattgatgaaatatcaagcgtatattcttctgatataagaaaaatcagagtgagaataattaagaatctcttaagcaagccatttgaaacgccttatgaagctttaaaaaataaattcccaactactataaaagatatttttaaagatattgagagttctggaataattacaggatttgatcattggtacaaaatacaattactcaactcaaaggcttatgactgcacatatattgataggatctcattcatttgcggaggaatatctttgaacgatgcaataatacttttgttatctatttcgtttaaaaactcatcgaattatagctattcaactaagtgcaatgctttaaaaactctatttcaaattgcctctatcaaaaacattcaaaagagatacccaaagtatgatgatctgcaagttatatggcttcacaattactatatgatttactttaatgaattgcacattccacaagattttagcaagttttatttatctgaaaaggttggattggccagatctctctggagggagtttaataatagaagggattcctataaatcgctaaagtcaaaccagacacaccttgaccaaattgaagatacaaaagatgctgaatttcttaaagatgaaaatagaaaaagaaaggtgagatgtatagttggtaaagagaatgaatattcaaacgctttatatctcagctctaatactcgatgtcaaagtgttgataaaaaattaaaccatatattatatttaatcacaaaactttgtttagattttggaatctacgattcaaacctattttcaaacacaataaaaaatttatatttgcagctttttgacgaaaatgatgtaaaaatattcagcaatttaatttttgcaacatatgttagcggatatatatataaagttaaaattaatcaatcaatcattgatgtatggaatttgttagttttagatccgtatttttactcaaaaatacggttgaatacatttcaaacctaa

SEQ ID NO: 1179 - DNA, 1074 bp, Cryptosporidium hominis
atgtatctaaaaaaagtaatcgaactgggaagtctgcctggtctaaacttgcaaaaatatacaaatagtattcgaaaagtaaccattttcaatgaaaggctatctatcattgtggaaaatctagtatttttctttataattacgaaagatcacaagaacgcgaaattaatttattcttggaagatcaattcagaggaagaattaatattaaatggtatatggatagataacaattcatttataatattaagtagcagttcagtgtatttacttgcattggaaaatgaatcagtccttgaagtaaaaactgtgaaacatggtttaacaaaaactattgaaaactccgagattatactaatagataacttctctaatataccaattgatcgtcaaagaatcattgctatagtcaatttttcttctggtttttttcctgtttctattgatcgcttcaattcaggttattccattgaaattggaaacataataacaaccgaaaataaaggagcaacgccatgcgagaatgggatatttgttgtaaattcgagttttatacaaaaattttatatcgatagcaatacgattaaatgcacaatgatagactctttgtctattggggagatcttaaacatatctttggaaaaatgtgattttaaacttatttcgttttataaagcagtaaaaggcaatattgtgaatgtaatatttttgaatatcgaggatggaattccatttaatggaattgagatagccatttcaagtgataaccttgttccactaagggctaataaaatcaatatcaaagatccagataatattattaatatttctcagactaaatttttagacgatgttttggcaaacattatagtatacaattctagtgtagtggtttttagaggccacgaaatttcttcagaaatatgcatagcaaattataatgatttaaacacatcttttattccttttgtctcacatggtttgtgtgaaacaactattttttatgcaggttgtactttagaagagaaaaccggcaatattctcatcaatattttggaagaagaaccaaattaa

SEQ ID NO: 1180 - DNA, 3579 bp, Cryptosporidium hominis
atgagaaatatagatttttttgaaatttataaaagattggatattaattatacaaataaacaagtaaattcatgttcaagtattaatttaaaaaaagacactattcatcaagaagttatttcaaaagaaaatcaaccacctgaaagcggtggatataaacatcgtgaaaatgatggaatatatttagacattaacttcaactctaactctattgcactccagccatgtatcgcaattaaagagaaatcattcagattaccaatatttgaattgacgtatgattttcaaatgcctaatactacataccaagttaaacaaaatagtaggctatatgaagaaatttactcattagtatatgcaaattattcaaatatcataattaatgagattactccttcgagaaaaataaaaatttctgaaacaaaacctatttttgaaatctctgaaaaagaagggaatccatattctatattttgggatgatgaagatataaagtccaactcatcaattttacttggtgagtttactggattgctgtataataacgaaaaaaaatactataacaagtattctttcaaattgcccaacgtttcaaatgaagagttaaatgttattttggatgcgtctcattattgtaatgaatttgcttttctaaaacattgtaggctcccctttccattcgatgatcaaagaataagaccaaacactcagttacagtggttatttattgacaaatggccacatcttgttgtattaactattcctggaatcgaaattaaacaaggcgatgaacttgttgtcgattttgggaacaattatcatatgtattacgtaaataatttgaaaacaatatttaaaaacatcatcaaaattaaagcggagaatacgcaaattttccaaatttgcactgtatgtagacttgaactagagaaaagcattattgaatgtaaaaagtgtataatttgccgtgaatacatacatgataagtgtggttattattataaaaacagtggaaactcggtttgttgtattacttgtttaaaaaaatcttttaatattatctttggcattaataaaaaatttgattatcccttcagcggaacaagtaatttgagtaaggactcaattattagtatactaaaaatttatgatggggatgcatgcgaagaatgtttatcattgtttcgtaaaaaagacttggaattagaaagatgtaagtctgcattcttttgtaaactactccatgaattttatcagatagataaacaccctgataatgttgactctttttatgcagaatataactcaaaaaacgagacagaaccaaagtcaagcattaatatagacattaaagcccttgagaatatttattatatttttgaaagactggtgaaatacttaaaggattttaatgatgaaaacagtctttgcgaaagattaaaatttgaatcatatttttcccaagataattatgttggtcattcaaaccatcaatcaaaatgtttatttccagattcgttgatctacgaaacatggggaaagtcgaaatggaaagattttattttttgggataagacaaaaaattcttgggtcggattactaagaccaaatgggatattttcaagattcgattgctgtaataaatatccaaccataatcgaaagtttttatgagacagaaaagtgggtggaacagagaataagcgaaactacaattccaaaaaatttgatttctacaatattgactaattctgataaaggtcccaattgtaatgaaaaagattattctaaaagtcaagatgatattgtttcacatacttattaccactcaccgtatttacctactgacctagcatcacacccagacttcaaaatattcaacaatgaaaatgaaaacaagtatcaaggtaatttacctccagtcaacgaaactaataatctattttcaatgaatgataatcagttgttattgaatggaaaactcaagaacgcaaatgctactcatagtgttgaatcagaattgttctcattttcaaattcacctgaatttttattaaatgatattaggccacgtgtttctaccacaggttatattcaatgttgttcgccagtaaacagaaaacgtagaataaggtcgactctccccttaacttcgaatgctgcaaaatgcccaactgaatggagagtaagagggatcacgtggcatgcagaaagaaaagcatttattgtaccatatagaagagataaagatggtgggcttacttcaacaacttttggtgcaatgaagtatggaagccctttgactgcatttttaaaagctttagaatttagggaaaattatttaaaggagcaggcgacaaagttaccagaagaaataaagcagccaagtgttatttgtgatcaagcattattaattagaaatttaccaaatataatttgggattcgaacaaacttgtatggagagctcttgcagatgaggaactcctatgcaataataacttaacacagaaattaactttttatacacaggatattgaaataaacgcaatgccttatggagcaagaattgcatatgaaatagccgaagtttgttatattcgtagaaaagcattacttcttaactcaaaggtaaatactatacaaaattcatctgtaagccgtttaagaaataagagtaattcgttagagggtcatggagacgagtaccaattaatattagaggatcaaaaccatttacttttaccgaaaaattcacaaatagatattacaaactcgcaaagctcttgtttcaaacaaatcaggttgaaaattatttttccaaatggagaggaagttattagaagtgacttgattgcatggcattttaggagtaattcatggataattacaaatatgattgatggaagtacatctaatcaaacgaaaaatattagtttcctcaattattcagattctaatataaaacaaaaatctcttattcaatcattaatttacgcaattgaatgttgtacatctatacctccaaagtgtcaagtatacgttcatgcagaggaagctgagtcaataattgattctgaggatcttgcggaattgttgaaaccttttccaacagggatatcatggtattgcaaaaaaagaaggttttatacatcaaatgggcttgatagtaatggaagaggacaacactttagcattgcattatatggttcacttatttctgcatttaatgccgcaattgactatagaaatatttttttgaaaaataggagaaaggctattttgccaaaagttgaatggattctatgttttcctgttaatcaatgttcaattaatacaggttcaaatgaaagaataaacgattcagatattattaataatggagatatagtaaaggaattagatagttgcaacatttatcatttatccgataattatatggggagttgtaacgatagaaatattgatcgaataaataatcaaatatcatcattaaatacatgtatttcaggagattcatatcattctggaagtgattggcttcaacatccaacaacagttcatgtttggacgatcagataa

SEQ ID NO: 1181 - DNA, 1266 bp, Cryptosporidium hominis
atgagaataaactcttatatttatattcctgctaatttgttacttttgattggaatttattatttacctatggaggaaatttgtaacttgatagaaataattataagaaaaatggcacaaaatggttttttagatggaatatcaattttaggatttaatacatttactgatgaaacatttttgttaagaagttttcctgataactacaactctgaacaatttgaaacctttcttgggaatttcaatttaaacgaaaatcttgattcgatatttttagagccagaaaataatataaataaaaattttggttataatttgagctctcaagtatttctgaatttaatttttcgcaaatacttatctctttcatttggagatattcaaacagttgcattaattggctcgtgtattcctaatctctctggtggcctcaaaaaaaatatggaattattaaagatttgcattgatgaatacaaagatttattgaagaataattctttaatatattatctaatttatagctcaaacataatcagcctttttaaaaatggatctaaatccgcaaaatttacttataataatatatcgggcatactttatgagcttaatattctaagatcgagttactataaaatgattcatattgaccaggatcaattaaagccactattaccaactgggaatatattattttgctattattgcgagcagccattatgccaaacatatttcgagcagagttgcttttttgataaaagcagttcaaacacggattgtaattcaataatttctcaatcattcaatacagacctttctgaagttcaattagataaaaaagaaataggttttaagaatatttataatagagactatcaggtaggatattcgttacgttggacgagcaataataaatcaaatataaatagtttaattcaacctgaagctattcaaagtttagagttatcatctatgatcttaaactgccccaataaatattgtaacaaacctctaccaagatgcgtaatttgtttgacagaaatgtctatcaatgtgattagtaattcaatcaatgatgacgctgcgcacaaggactgtgctcaacaatgtaattataataaattgagcaaatggtatacttggtgtttgcattgtcaccatggcggatgttttaaacatatcagtgaatggtttgagtgttttgatgaatgccctgtaccggagtgcaattgttggtgtaattcagtagatcgttggcacaaattataa

SEQ ID NO: 1182 - DNA, 3213 bp, Cryptosporidium hominis
atgtctgttaaatattgcataacatccattttttgtatatttatatacctttttggtaaagttgaggcctccttaacagatataccatggtcagttagcactccatatattttatctagccttgaaaaggcacagcaagttattaattattccagggtttctactctggaagaatttgtctctaaaaactgtgggaggtacgacaaacttcaagaaagtgatttagcttataaaaaggaaatgtgggaatcgttcaaatcgtggcattcagattatagtgtcttagcaggaataatttttgaaaatgcaattattgcagattccaataaaactcacataaatcttaaaccgctgatatccagctatttagatgcattgatttggagagaaattgctagttgtataatttttggtatttcaatctttacctttattgccgtatctcttgggtttgttttgtgcagagtaatgaacgacagagttgtttcatttgaagaaacatcaaacggattatggaaagtaaaactaagtatatatatattgagtaccctattatgtggactatgtgttatttatattaccctttctattgtgattattgtaaacttttttgccttttctgattcttttttaaaatcagtttgttggtttgcaattggagcggatgcattttcaaatggcaatataaatattaacacaacttcaggttcattcagtattgcaaaatcatttttgaaaacaaatacaacagttccattcattggatcattaccactttacggtttatttcaagaattgggttcagttgaaacattaattgaattttttaaagacacaattaattacattagaagtgcagggtttccaacagctctaagtataagactaaatgaattagcaaatgtttttaccaatgcatcagtaattaatcctaatggaatagattggtatattccggccaaagaattacttaagaactctgtattaaatgctgtaaattcattcatgccagtgaatgaaactttatttaactctatgattccggttttaattaaaataactgacattataaaatcagtggatacttcatcaatgtcatttagtgttgatgaatattttgaagttttcaaaaaatttatttcttacattttattatttttaaatgcatctaggactgcaagcaacatcgtttttgtaataattacagtgttatgcgtttcatctacaataattggagtaatttcaattattttttcaattcttcacacaaaactatttttatctggaagaagtcatattggatttttccaaagtaggtcagcattggttgctgttgcattcatatttatgggattgtctacatttgtttcatttgtttcatatattctaacggtttcaggaacagtagggaaagactattgcggttggatagttagtgacttgtttagtccaatagggatgaattggatttcaactgtaagtcccgaattaggaatgattatgagtatatgtatgtatcctcttgcatcgtatattaagattaaaagtgataacaaaagatatcttaatgaaaaagattttataactgataggataagggttttagaatatcatggaataaaaaatcatatatatttagatttatttaataaacttcagagtgatgagtccaaagatagcgaaaatattaaagacatatttttcaactattcaaataaaagccctcgattgttgttgaatcagaataacttgtttagtaacgagagtttaaaaagtgaattatacttgggagatttgagtacgaaaagcagagcaatgaataaaaatgactttatttccaatttgtttttgaattataataatgaactactaaaaagcagctcaaatgatattttacttgctgaaaggttcggtaatcaggaagtagttggcttgttggacgatgctccaatagaaagcagtctgtcctatttattagttcaattgctaccaggctcttttgtcaatgatatgtcaaaaattgttccagaatatatcaatattatttccaccagccaaacaatagcagaacaatgttttaattacatgaatatatcagactacataaaatattctctaatgtactttccagacgtggagaaatctacaccagatgaacaagacgtgcctgtattagttttaataactcagagctacaaagaagaaaattggttaatgaaaagttctatattcggctacactacatacactgctctatgtagcagtcctaattctgatgtttcagctttaatgatttctcagtcattgccaattaaggttcctggcttggaagttctcgaatcaataatatacccatttaaaataaaatacttggtagatacttcagatactattaacgaaaaacaagagaaaattgaggagaatcctacttcaaaattatctagtctagaaaatatatttgaaccaacatcttctattacagaggataatacaaattcagaagagaatttaatcatttcagcagacacagacattgatcagctagccatagaaaaatatcataaagataataaacattttaaggactatccaatttcgagctttaaacatacgctagtatgggtaaagaaatcaatggaattgtataatcacaattttttttgttatccattttcttggatagatattgaaggaataaaggaaattcccaattttggaaataacagcctttatattaaatactataataatacatgcaaatacgttgaattccaagagtacattgacagtgttagttacgattatttaattaacccaactaactttgcagctaatgaggtcgagagactaaatttggttctaaacgatagaataaggaaaatgtttgggagtgcaatgattttaaatagtataaagacagaagctcataattgtggacaagtttcagttgactttacaaatgggatcgttacgttttgtgggatgatcggtaaaaccaaagacactcttatcgttattttaaatattgctacgtttataggttttgcaattagcattgtaatcggaataatatggttaatctcgttgagatatgaatcaagaattgctgactcaattatagagatggaacagtcaagcaatgaatcgcttggcaatgtagagcaagatgataatgtcaatgttaaaataaacgaagcagatactaatcattga

SEQ ID NO: 1183 - DNA, 1632 bp, Cryptosporidium hominis
atgacagattttgaagtttgtgagaatgacgagtactattcaaaaatcgaagattcaagctttatagatttttttgaatatttgaaaggtaatccaaaacaaaactttattaaatataccgaaaaagtttgtaatgtaaaatatgaacaaggaaaaaatgaaaatatattggatatcccacgtcttaagtggatgattctacttagaattatccctgttgattttttttcgctttcaattcatgattgctataaaaaaattcacgaattattagaaatggagagaagcaattattctctctcttttaacaaaaataaattagatattagtaaagttacttcaatggaccctttaaagtttcatcctctatctcagattgctaataacccgtggaatgaacagcacaaaaatggtgaattattagatgaaatttggaaagacgtcacaagaacctattctgaacgacaacttttttctggctcaaatacgagacaacttttgcaaagaatattgttcacatggacacgcgagaaccctgagctgggatacaagcagggaatgaatgaaattgctgcaattttatttttgataaatcacagtcagaaaattgttgataatagagtttattctaatggtctagagtcaaagaatgaatacaacggagataatttcagtttagaacacatttttaggagcgattcaatagaagcagacacttatattatgtttaattctgttatgaatgtttttggtttaaaatacatgtttaaatccacatacaatgaatgtaattcaaatgataataattcaatgaacaacgatgattcaaataaacctccgatagtacatagatgtataaatatttatggcattttagaaaaggtagattatgagctgtttattcatctatataaagagcatgaaattgaaccccaacttatttttttaagatggattagacttttattttctagagaattttccgatttgaataattcaattataatttgggaaggcatcttttgtgatgccctccaaaatgggaaattctctggtagcgaaattttaatagatggttttgcgagagggagaaaaaatataaataaagaggtctgtgaagcagttgaatcatctttaccaatagtaaactttattgctatttcaatactacttgcaagaagaagtgcaatagtaaattctgactttaaccatacgctgaaattgatagttaatcaatcaaacttatctattagtccacttgaaatattatcaaacgcaaaatcactatgctacagtgtttctgctgaaaacgagtgcttaaattcgcctaaattattaagtggttcagcttttgacgataaaaactacaaaaaggtcctattatccaatcaaagaagccatttttttgaacatagagacatacattattctcaaataaggtacaacttaaattcagagcctgaattaaattcaaatgcgcctaaacttaatgaaagcttattagaaatcactaagaatttgtacaatagtgcgaaagatattaaagatattgagcaagttaagtgcaatgtagttagttcatgtagggaattacttagaatttgtaaaatcttacaagaaaaaaatatttaa

SEQ ID NO: 1184 - DNA, 4911 bp, Cryptosporidium hominis
atgaaaaatttatcagaaagaaattgcctattcaatgaaatggaatgcttatacaccattatttgcaatattaagccattaaatatctgctcgggggttttgtctcgtattatttcaatatttggtcaattttttattttaagtaataaaatattattgaataagactttttcacttaaaattaaagatgtatactattcatggttacataaaatattcaatttcctaagaacttctattggactccagatttctagtgataaggttgacttatatttgcctatatttcttctgtttttagaaactttctcctttgaagatttaaatggagatctatttgactgcagtatcattttcaagaaatgtatcgttgagtcagtaatgccaaatcttcaatctcaattattttcatcctcaaacgaatgcaggaatttagtaaataacctactaatcaataataaaaaattttgtaagatttttgatcaatttcattttaatactattcaaccatataatttaccttcttttaattgtgcattttcaatactgaaaaaactatctaaaataattcggccgagagaatactatgtgtccaatattttactatattactatctgaaaaaattatccattgatttagaaaaccagaaagaaagcataatattattaaaaactttattcaacttgaaaaactttgaaatgttggatatacttgacaatatttacttttttttaagtgaagtaatattttctgagttaattacaagaattcagaatttctgttctaaaaattttgatattaacatattgatatttgggaataacaatattccattacaaagcatcataaacttactcaacatgttttttatttcagaatttatatttaactcagaaaataattttaaacgtttgtgtttgaacttattgaagattctttatttatttacgttactattatttattttatccgattctgagtttatttctaactattcaaataaatttcacgatgggttaattcaagaattagatccttcagaacgattttataaccaaaacttaaatcaaaacttttctagaattatcgaagaagtctgtagttttattaaaatcattttggcaaaaattaccatttattcaatttttgaggaatctcataatcaactaaattcaattcctaacgattttatcacatcaaatttatacttgaattcatttttgaatcgtcttaatatcgcattaaactctaaaaaatgctattatttttcctataagctatgcttaatttatattaattttattttgaagtgcgaccatccaggaagttccgaaaacctattagaaatatttaacgcaatattaaactcatatagtacaaaattatttgagagctctcatgaaaagcaattaaaaaataaaggttttaagctaccaattacaagaatccatatattgataaataatgaaactgctaaaactttcaatgattttattttaatgaactcacattcaattttaaataatgcaaaaattcaagatgtaacagattataaaagttccttgaacaaacaaacagataacctgccaaaaaatttgcttttacacattctttattctttattatcatttgatgagctcagctcagattgcaataatgataaatttaattatctagaagttgaaaactgtattttagattatgaacaaattgacaatattttttttcagtttttcgacggttatacaaaatctggatattttaacaatgaattcattacaacaaattcattttatgatactaataagctatttttacttcatggcaatttaaataacaatcttgaaaaattatatattcctcctccaaaaagaaaatcaaataatctttgtaatatagtaaatattttagtatcgattacagtcaaagactttaaatttcataagctcgttaaatatacaattaaattattaataatagctagcctaaatgttaatttatttaatgggattattaataagcaagattataattctgattatattttattccagcgttatagatgcagtattcattctaatcatatcctcgcaaaattaatttctaaatcaaaaagcagttctggaacaaatactctttgcgaaatttttgatcttagtttactttgtggctctttattttcagcattcaataatattaaaatatacgatttgaaagttaaagacgaaaacgggtttgctttatgcaattcttcattgaatttaatgtctgcacttttgaaaaggtttagtttcaaagcaaatggaatagaaagtaatattgaatatattagtaagacgaaccatcgatgcgaaattcttaatgattttaaaactacaatggggtcagacgaattgcccattttatttaataaagtgctcaaagatgttttatcaatcgtattaaataaacaatttgattataattgtgttaattctttgatatctgaaatcaatacttctacccgtttttcactaaaatcgattaaaagaatttcaggtatttttgagccatgcattattgatattttactaaattctactcatacgcaatttcaaggaatggttctgttactacttactgaaatatctatttcatgggtagattgctcatacgagcttgctatttgcattattaaatcaatttattcaagttcatatttcgttagaatgtattcttcaaagttattgggagagattatttttttaacattaaatatccctaatttgagtttacatccactaaatgaaatttctaatgcaaatttagatggaatcctgcttgaaatttttatcattaactcgaataatcaagcttctaaagccaattctttactaaatttaatttttcaatctatcaaattttcggttaacaattcagagaataaatataacttaattcatggaattttaaatttgggaattgttctgttgaaaaaatttaaaaatcaatcttgttggaattctttcaaatctatagacaattcaatttacgaaaatttgttggtttttattagagatagctttacatcatttaagcacccactattaagaataacggcgttagaactaatgagtttgctatttgaacttgaatttcctataaatgaaaaattaaattgtttggaaaatctaatttattattggaaaaatgtcagttcaaaatctagaacattttatatagatttctctaatctagacaataatctgtatttatcaataagtcatccaaagaactattttaatgaaaatctatcagagtatatatacttgataaaaataattgttaataatgtttttaaatatattgattctggagaattaaactcattaatttgtttatctccagcctttgataaaatcattcatccgaaaattttatttgaattctactcgtcaattattgagattctatctatatcagaaaagaaggataccttcgttcagaaacttttcaacttaattgataacaatttaaagtccataaaacatttaatttcagcaaacaataaagagcaatacataaatgagaagacgaaaattagaaaattatcaatattaacggacttagttaaagtattgacagggtgcttgtcttttattggttataattataatttgtcttttgtttttttagaaaatgaacaatctgattcaacaatagagtctgtttttgacctgatctatcaccaagagctttctaaatataagattagcaaagatgagaactctgaggaaaaaactgatatagatttaataaacagcaaaatcggaagattttttttcgaagatcaaattgcaattttggaattttctattttttttattaggttttacaaaaacatagcaagacatgatagtattccgtatattatagtatacgaacttgaaaagatagtatttgataaaattttaaagatggtttgtaacaacatatgtaatcgaacacagttaacacttgaaaaaaaatgtttgatttgcaaaataataagaactatttttgaatctctggaaactgaattatttctggaaataaaagttgaaaaaaatgatcgaattaaaaacttattctgtacaaaaattggcattaatgatattcataaaggaacaattctttttttgttgtgttttaaccacaattattggtacaacttaatggtttgtttaatttatttaataactgacgaagctgcgtccatcgaaaataaagcaattcttacttttaattcgtttgtccatattatcaaatatttctgtagtaacttcttacatcaaaatgaagattctcacagctgtggcttaaattgctataacgaatacgaaaatcaaattaaacaaattgtcttgcttaatgaccaaaattcttgtttattttcgataataatcttggacgtaatatctgaaagtttacggagtatggaaactcaaaataactccgtatttttcccaagggagattgataatatttgtaacgaatatttgaatatttcccaggtagcaacttgccagattttcaaatattttaaagctataagtcaaagaaaactaaattcagatgaaatatcgaaaattgagctccattttgaacaatgggagacgcaaataaagagtcaaattaatctgtttaaaagagtttatgattgtataaaggaatgtccaacccagctaataagtatcgaactttttgggagcgttttaattgatgaagtaagcattttaacttttgtgatatcaattagaaaattgattataatttccaaatatagggagattaataatagagaagatatatttgaaaacagcagcttttatataagtttatttgaaaaacgccttgatttcctattatcaaatatccatgaaaaaaaataa

SEQ ID NO: 1185 - DNA, 1074 bp, Cryptosporidium hominis
atggagaaaaaaaatgttgtacaaaacatatttaattgtcctatatgcccatactttggtaggaattccatttcacactcttttatttcgatactggatcagtctaaaattcatcctgctattttgagattgggaatgagaatgaaagacaggaaaattgttggtacaaatatgaggagtaaatgcctgctaattgccattgggcaaatgcttgaggattattactgccctccatacaaaagtattgaaaagcatttaaagatggttttagacgtgcatatctcatatataacatcgcagagacaacacaacattgcgatggggaacgtgattaaatggctaaaaaaacaaatatgcaaaattaatccgtctctcccaccaaatgaaataataaaccaactaatttctagtataaaaacttatatttatcaaagaattgtgaacgcatgtgaaagaatttcatatttagtttcaaacaaatatattactgatggtgatgtaatagttacatattccaattctagttctgtaatcaaatcattatttaaggctgcagaaatgaacaagaattttcaactaatcgttgttgattcaaagaacaaccttgattccagtagtcaagacattgctaaaaaactatctctaaaggggataaaaataacctatacattacttaattgtttagcctaccatttgaggtacgcaaccaaagtgattattggttcgtgtgcaatattttctaatggatatgtaatgaatcgttctggatcatcacttgttgcaatgcttgcaaatatacaccacattcctgtaatgatcgtttcagaatcatataaactatgcgaaaagaattactttgagtattcaacagttttcaacgaagttgttgaacaaggcatatctgataacctccaatatgctccagaaaactcggaaagtttgcctaaaccgcaaatagctacatttatcccttgctacgacgtaatcccccccaagttcataaacgcaattgttacagaagacggtattttttctgctgagtcattttcaatacaaaataaacccataaattag

SEQ ID NO: 1186 - DNA, 1701 bp, Cryptosporidium hominis
atgaaaatcacaaaaaatattactgtaaatgtagaagatggaaacacgtacacagttcctgaacattacaagtttattaaaaaagttggaagtggtgcttatggatgtgtagtttcattttacgataaatctcgaggatcttatattgcagtaaagaagatatttgatgcatttcaggacttaatagatgcaaagagaattctaagagaaattaagcttttaaggcagcttcaacacgaaaacattttgggtattatcgatctccttcctccagactctccgaattttgaagatatatatattgttactcagttaatggagacagatttgcaccgtgtgatatatagtaaacagacactaacaaatgaacatatacaatattttatgtatcaaattttaagaggattatcttacctacataaggtaaatattatacaccgtgatctgaagccatcaaatatccttgtaaacttatcatgtgatttaaagatttgtgattttggcttagcaagaggaaatgtttgtgatattgataaaagcaaggacgaattaacagattatgtagttacgagatggtacagggcacccgaaataattttgtgtgtaaatagatacgataaagctgtggatatatggagtgcaggctgtatttttgctgaattaattaaaaggagtgctttgtttgctggtcatgaccatctagatcaacttaaagctattatttcttgtttgggtaccccaagcagagatgacttagattcctggcttccttacaaggggagtaccgagaatgcgagaaagtacttagacacgcttccaaactataagggtaggcatatttcgactttattccccggatttaattgccctgaagctattgaccttattgaaaaaatgctaagctttaatccaaaaaagcgaataacagctgaagaggctctatcgcatccatatttcaatggcattaatattaactcagggtacgactctccaaaatcatcaagtgcacacaaaattcagtttaaatcgaataactctattgaaccagaattaatttcattggattccaacactactgattcaattgattggtctttcgacaactttgagccaacaaagagactgttacagaataaggtatacgaagaaattgcagattttcatccagagattttaattcgagactttccgtttattcaccatttaggtatcaacgtcccaaaaaagcatctacaaatgctaaggtcaaagtatgctacaaatacactgaggggaaaagatagaataaatgcatacatggttgattctcttatgagtacgtcatcttctacttcaattaccccttctaacagctttgatattttaggtacaattgatatggttaaaaggctgtcaatagtccacaagcaaaatagaatgtcaaactctcaacctgcacaatcagggactattattccctcaaatgagtacgacgttggatctgaaggacttctccttcatcgttcgcaagaattatgtcttacaacgccagcgttacaaaaaagaacgtatccatttatatcataccccagtgactcagaatcaggtaatgatgcaaacttgaatatggaaaacacggtggttggcgtgggtcaacatgtcaagagtactactgacaatttaaaaagaattgcctatggaaaaacagaaagcaatatataa

SEQ ID NO: 1187 - DNA, 1179 bp, Cryptosporidium hominis
atggatggaatttggaaaagacttgtttctggagggaagaatcactcctcaaaagagggcggcaatagtcagaaaaatgcagttgctgctaacaatcggacatgtgaaaatggccgaagtttagattttaataccaataataagtcccacaataatccaaataatgacaaccgttatcctgctacttcaaacatcaacaagcatgacacggatatatcggggaataaccagaaaaaatatagcatcgacgattttcagcttattagaacattaggaacaggctcgttcggaagagttttcttatctaagcacaaggaagataatagcatttatgcaataaaaagacttaaaaaaagtgtggttattcggcaaaagcaggtggaccatattacaaatgaaaaagcgattctttcaagaattaaacatccatttttagttagaatgtttggaacatttaaagatgaccgatatttatacattatgatggaatttgttatagggggagagtttttcacatacctaagaaggtgtaggcactttgacaatgaaacttcaaggttttatgctgcgcaagttgtgttaatgtttgaatatttgcacggaaaaaacattatatatagagatcttaaaccagaaaatattctaattgacaaagatgggtatttgaagctaactgattttggatttgcaaaggcaatcgaatataggacgtttacactttgtgggacgcctgaatatatcgctccagaagttcttttaaacaagggccatggaaagccggttgattggtggacgctgggcatattgatatatgaaatggttgtaggcttcccccctttttatgatgatgaacctatgggtatctatcaaaaaattctagcgggtaagatttttttccctaagtattttgacaaaaattgtaaaagtttggtgaaaagactgcttactccggatttaacaaaaagatatggtaaccttaaaggcggtgttagtgatataaaactacataagtggttttataattatgactttaattctttgatatcaaggaaagttgaccccccgtatattcctaaggtcaactcgtatgatgattcatcgaattttgaagaatatccagatagccatgaacaacctactactgttacaggtaatgctgatccattcgttgactggtag

SEQ ID NO: 1188 - DNA, 963 bp, Cryptosporidium hominis
atgtcaatcaaacgtgaagaagaggaacgtaggttttgtcaaaacattagtactagagggtgcaggaaagagtatataaaaaaagatcaacttgaatttgaaggaacagatggggatgaatttaaggatataaaccctgtgcatggatgtttggttccgtgtcttaagtgctgtatttatccatgcagagcttttttccttactggaagatgtatatcacaaaaaagaagagtgaaaaaagctaaatatagcaaaagaaagtataataataacaatgcatactcgtacaacgcaaataatcaaaaaccccaatataatcaattttacagtgcaagcagtaacataggagtaagcccaaatttacaaggttcaataaatgctgatggctcagttaaaggaaatttaagacacccaacgttaacagggaattgtattacacctatttgttcgggctcatctgcttctttctgcactattcaggctgaatatccctctaatagacgttccgtattgccttcttcaagttcttatggaccaaggaggtatgttgaaaaaattgttgaatcacctatttttaatgaaccaaataaattgacttgtaattgtttagggaatagtcatcaagagatagagtttgaagaaagacacgataacattgagtccaattcattccagaaaattgttgacaacacgttttctcgagaaataattgataatgagaattatttcacaaaacataatgagaatcaaagtaatgaatttaaagatttctttccggaaaattctgaaagagagtacttccgtattgaagaatattttgagcacaacgtaaaagataataaagcttaccccaataaaggaaacctgtttacaaatagcatattttcttcctgtactccgtgcgagtatagcgatcacgttagcctaaaatatagtcagggaaattgctttgttgataattga

SEQ ID NO: 1189 - DNA, 2178 bp, Cryptosporidium hominis
atggaaaagatcattttgcaattacttcaagaagaattcgatgttgtttgtattaattgtggagttatttgcacttgcaattcctcttctgggaatcaatggaatcctataaaacttaatagactatgctgggcagttggtagtattagcggaagtttgagcaaaaacattgaaaggagactaataatagaggtcattaaatctttgttgatgctttgcgaaagaaaaagaggtaaggccaataaagcagccgttgctagttgtgttatgtatgtagtagggcagtatccaaggtttctcagagaccattggaaatttcttcaaactgtaatcaacaagctatttgagtttatgcatgaaacatttcctggggtaaaagatatggcatgtgaagcatttttgaaaattgcaactaaatgtaaaaaatcaatgagttcgaataattttatcgatggaaataatagaggttcaagtaatcaaatgctgtccgaaatcattgacgggggttcacaagaaattaagtttttaaagtatatgataggttattctcacgagctaaaacagcatcttgatgacaaacaaatacttattctaatacagggaatctcattaactatctcttctctaaaggatgttgatgagcagtatctgtacgtaactgaattactactcatttttgatagtttatattggaaggacattatctccagattggttgaattgagatctaatcctgataaccgaggtataataaatgagttatgttcgatggaatgttcacaaaaattgattattattgtacgcattatggaaacaattgcatctagctgtggagttggatttgcccgtgtacttattgaaagaagttcgttcttaattgaactctataaattatattctaatttcatagctggagaagttcagcgaaaaggggttgtaattatttcccatgctcatattaagcaattaagaatttccaaaaaagaaataattaaattaattaactcttttatttcttttatcgcacctagaaaaaaactcaagttaagcgaaaacaagaatctttctggatatataacagatatacaatcgattttgtatcacaatatcacagggacagaaatgctgcaatatattatacatccaattattattccagttttagaagattaccatgcatgtatttctgagattaaggaatctcaagtacttattttatcgagtacaattatcgtacgtttaaatgatattgttaaagcgaataatgatttgtttaatgctatcatttaccatctcttcgaatgcactttatccatgattaaggacaattttcatgcatacccagaccatagagagtttttttattccttcctggctgattgtaatgaattttgtttcttgcaattattcaacttgccaggaaatatattaacgctttatattgagagtattatttgggctattaggcatgaacaaccaaatatggcggaaaaaggattaattgtattatacaactttttaattaatttgattaatcataatggctcgaaggataacggtattcagagttcatgtgctcaaaacaatacactttttcaattttgccatgcattctacttatcaataattagagagatattttgtgtattgacagatacattacatacatcaggttttcagtaccaaacaatggtactatatgagctgattaaaatttcagaattctctctatttgaaggaaatcaaggcaataagcaaacaaatatagcttctaactcttcactaatatgcgattcttgccaaggaaccacatgtaaaatttcaaaagtaggagttatggagtatattgcagacttactcatcaaatcgttcattaccgtccaaaaagagcaagttgaagtctttgtacttgaacttttcaatagtgttcatagcaaaaccatctctgactttcaaagacttgtacatgatttccttattcaaattaaggaattcactaatgaggagagcaaacaaatgtttgaaatagaaaaaagtattgcattaaaacgtgcaattgaaattgaaaacagcaagcaatggatgattcccggcctaataaaccaagaaattgggctaaactctaatagcggtgagggtgatgatgatgatattgaagatgacgacgaagacgaataa

SEQ ID NO: 1190 - DNA, 1470 bp, Cryptosporidium hominis
atgaatcttagtgaaatggaaaatatacatattttttcgggtgatataccggcaattgtttgtacgtacttcaataaaatctatttaaataataattatatgggcgattttaaatctaatgaatctaataaaagccagcaaaatagtattaaaccaggatcaattgccatttttgactcaagctacagtcaaaataattttttcaagtttgaagatgagctttgtaattgtttaggcattgaaaattcaattcaaaacaatatgttgtattgcgcaaatgataaaaatcaaacttctgttgtaaataaagggaatttgattgaacaaccaccttggaatggggaaataaatatatttgaacaaagaaataatgatagaatttatttaaataagttgaatagcctattctttttaaaaaggttaataggagagaaaaatgttcacaatgcagcgatgaataggaaaaagtgctcagactcaagtttcatgccaggattattaaaaaattcttatggcttaagtggtataaatttagatcttgaaagtgatgaagtattggagattgttcgtcataaactcgaaaactctgatcaaaatagaattattcacctgtctactgaagtagactctatatttagtaatatttcaaacgagatactagagtttttagacgaagaagcacctcatacatataaaccatcactgtcactattaatgaatgaggattcaatcacaaaaactaataattttaatcttattaaaatgtcgaattttgcaaacacaagattcctattggatcaaagtaacttctgcaatgatatttggttaatggacttgaaatacattgaaagtttggcaaatggaaatttgaatagcaactttaaccctttggctgcattagcatttgctgtatatcaaactagcattacagtaggcgatataaacagtatacatgcgaatccacttagtatattaggaagagctgtaaaccatccgttcagaaatattgcggtttttgatcgaagtaaagccagtaatatcagagataagactagtttttttgtggatgaaaattttgagtctttttgttcgaaatattttttggacatttgccagagcgaatattttggtttggaattacttgataaatcagaagttatttccattataaatgaaaatccttgcattcttggaaaaggagctgaacaaataattgattatttgaacaaaaacactcataaagttattcctaattacagtaattcgactacaaacaatatgtttccaattagtatacttcacaccatttatagcataaaaaattgcaagcttattaatagtttgtttaagagtatattaggatgtaaaagcgattctaaattcctaaatatgacgagagattattacaacttggagttagttgaaatcaatgaaatttttgaatctgtatcgacttggttggatacctga

SEQ ID NO: 1191 - DNA, 351 bp, Cryptosporidium hominis
atgtatttggttgatatttctaatggagaaacaacaagcctaccaattggggaaaatataataaaaaatttgcttttttctacatttaactcaaaaatgagcattattatttgtttgctgaagaattctaaaatagcaatttacgatatcataaatcagaatattaaatatgaagagataaatattgaaaatctatgtgaaaatgagcaaattcttatggaccagatcagtggaaatattgttattactgctaaaaataaattaattaaattatattacaacaatcaggtatccaaccaagtcgatacagattcaaaaatttcattgatttcaactaactccaagttgtaa

SEQ ID NO: 1192 - DNA, 1122 bp, Cryptosporidium hominis
atggatcgcgtcactttttcaaacgtaaatgtgctcaagttaatcctccaatttttgctggaaagtggcttgttagaaagctattctactctatcatatgaaagtggtgttagcctaaattggattgaaagcgttgataaaataagaacaataatttctaaagggcattggaatgagctaattgaagtattaaaatatatcaaaattccagcaaatttacaaataattctctttgagcacattgccctagaattgttagagttaaaagaaccatttgttgctcaatatttgatagaaaataacgaatcactatttttgcataatcaatttgatgaaaaatataacactctgctcgagataattgaaaaatcaaaaaatataatttcaaatgtaaagaataattcagctgaattaaactattcctcaattttaacatttgtcaaaaatagctatttagaaggagaaagtaaagaaaaatctagagaaagattgtctagattaattacagagaatttcatagaagttagaaaatctttgttattagaagtaataggcgattccttgaaatataaaaatactttaaaattagacaatgaggaagcatgtgagaacttaggctttgagcataatgaaaataattttatacgcggccaaaaacaattccaatttaatgagacgaaagaattcaaactttttaaaagctcttctactatcattaatacagaacaatttggagatctgtgctgcattacattcactccctctggagaacatatatttgcaacgtcaaaagggtatattattattggaaatgctaatctgtacggttttataaataaaaacgtaaattcaaaaaatatatactcacattgcgaagaggaagttaaaatattgggtttatctacaacttgcattaaaaatcaaattagttttggaaataaatttgaaaatgatcgtaactctgatcgtatcataattgctagtacgagcgaaaaggcagatataaaggtttgggtctattcaaactcgaattttattttttgtgttaatgcatatgaaaattatataactgatttggtatttaacaaagatgcaacctcgtatactttcctcatcaattga

SEQ ID NO: 1193 - DNA, 1533 bp, Cryptosporidium hominis
atgtattgtactgaggcttttataaaagaaaaaattcaagattatgaattaaaagttgaggagttaaattatcctgaaatattgcaattatttagtgcagataaaaggttaataagaagccttcaatctctagaaggttctgcttctaatatatcaactaaccgaggttatttatccaaagcttcatcccataataattcaatggaaggagaagatattgaagttacaaataaatcattacgtcctgagaacaataagaatcattatgaaagagaactattgacgaatgtttcattcccacctaacaaaataaggctgcagactaatagtgatgcagaagattttttattcgaagatgagtactttgacattgttcaggaagaatctgagaaaagcatcaatgatagaaatactgcgccttcaaatgaaagttgccagaaacaaaatagtagagcaataaacgttagtattggatgctaccctgttgtaaagaatgcgttgttagctttatcatatattgataattcagttcctaattccagctatttatttttaaataagttgattattcaaaagtgctgcgataaattggtttctgcgaaagaatttatatgtaatgaattctacttaaatgataaaatctcaaggatatatcatggaaatttatttattgttagaaatttactttatttaaaatatgagcttataaatttaagtaggcaaaacaacggtaaagaaggttttgatgtatttgaaagaaatctatgcgagttagaaagtaatgaaaaaaatttatccaatacaaaaataacagaatcaaatcttttaataaaaggttctaaccttttatgctttaaggtgacactagattcaattgttaatatagttgatgttctaataaattcaaatttagaagaaatgatcaacaatatttgctcgaatatctctctcccattaacgaaaatcgtgctgcaagttcatcctgaaattcagtcaagtgatattaaagaattacaatgcacaaatcataagtacatccgagaatctattgaattattttggaaaaatttaaagtttcatacaagtaattatattttaaagtatctgaacctttacctttcaattgcaggcaaagaagaaatggaaacattattttactctataattacagaaattggttatgaaggtgactcaaaagtagatattgattgtaaacagtcaaatgaatcatgcaatggtgagccaatcaattttaggaattcaggaaatctaaattcgatgggatatgaatatgacaaagcgcatttaaactcggttgtttcttctattttacccagtccaatgtcaatatttctatctattaaggaagttttaattggcgtgattttcgagttcgaccatgtattgaataagagattaggcattgaaaaaagtgttatagaagaagaattggattggaaactccaaaacattataaaattcctaaactcagtagaaaataaactcgattcttacgaaaatactaattcttga

SEQ ID NO: 1194 - DNA, 1905 bp, Cryptosporidium hominis
atggaaagagttcgagttgttcttagggtacgacctaatgctgatgggagcgatgatgaagatattgtagatataaggggccagagaaaggttataatatctaaacctggaaaaaaaaacacatacttgctttcacaacaaactagatattatgagtacacatttgatcatatattcccacctaacgctgatcaggagactgtttacaatatatcaacatgtaattttcttaaaaatgcaatatcaagtggaattaatttaactgtatttgtttatggtgcaactggtactggtaaaacatataccattattggaaacgagaaaaatcctgggatagtaattagagggatcaatgaaacatttgaatgtcttttcagtgatgaaaggtttgttaaagataataactccgatatgagctgtagtgaaaataatagctcaaatgaattaaagcctaattcaaatttctttgtaactgcatcatacatggaaatttacaatgaaacaattagagatttgctgaatccatccactagctcttcaaattgtcaatattcttgtgaaatactagaagatcaatcaaatatacaaattagcaacctgactcaactactaattgaaaacagtaaggaaggaattcaagctttaaatttcggaaacaaataccgaaagattgaacaaactgtcgcaaataatgtgtcttcaagaagccatgcaattttccaactatctatatttttagaaagaaaaaagttatttaatgtatctgcaaataacaatccacataaattcattagaagtaataactatagaaatgatcattttcctagtgaaaaactgtacaagccctcaataaacaactcagcaaatcctcaactttggtgcaagatttcgtttattgatctagctggctctgaaagagcaagcgcaacgcaaaacaggggaattagattaactgaaggtgctcatattaatcgttcattactagctctagctaactgcattaattctttggctttatcaagttcgagcattgatgggcagtccattcttaaccagaataatgataatagataccatgttaaatatagagactcaaaattgactcatatattaaagaatagtttagaaggtgaaaaatgctttgttgtaatgattgcaaatatttccccatcatccaaagcatttgaagaatctcataacacgttgaaatatgctaacagagcaaaaaacataaaggttaaaatatctaatcaattactaaatgataatgaagaaaatgatctgtcatgtacttgcaactgtaatatcgggactaactattttgatcagaaggttaaatcgaaaaaaaaatcgcagattgaatcttcttcccaaactataatttccggactagttactgttgaagagaagaaaatttttcaagatgagaataactatggtctgaacttgattaatcacataaataataatatacatgatgtaattaattccttaagtgaattttcaaatcaaatatcaaataaaaaagttaacgaaactattattgaaaataactccttttcagaaaaagagaacaattcactatttcagcaaaatgaaataaattactcggataagcaattaaacagagctagctttgtttcgacgcaatctaatgatgaagttaactccctggaaataagcaaagtaggtgaatcattgtgcattgtagagttatttaaggaactagaatcaaaaatatttagtattatggcagattcactaaacaagttaaaagaaattaagttagagtacaatgaaacattaaatagcgaagctttactattaaagaaaatacaagaattagctgaggatttctcgattaaacgacaaaaaaaatatacagaatcttttataaatgaataa

SEQ ID NO: 1195 - DNA, 1251 bp, Cryptosporidium hominis
atgatacaactttcaagttgcgttggaagagttttcggggctgttctgactacttcgatttcacagaaacttattgttggatttcaaggatggagatttgcattccttttagtaggagttctaagcgcgatactaggaggaataatagtatttcttatggatgaaatccctcatctacacctacaccgctttagatctattcgctcagatccaaatagtgagagcgaacaagaaccattagagcaacaagaacaaagtgaatttagtatttccgttgttgcacgcccggatactggaggggcagattctgatactcaatctgttattggtacaatgtcgcgagaagaaggacaaagagatagtcttttgaatacatttaacactaatagaatatttttacatgatgaaaatgaggaaatttcggatataattgatgaaaacgtatctacacttcaatttatgaaaaacgtaatcactcaaagtctgatagtaaaaagtgttatattaatgattttagaaggtattagcggaacaataccttggagttcactaacatttatgacgatgtatttacaatactgcgacctttcaaattttcaagctgctctagtcattgcaactatgcttgcaggatctatgattggtggcccaatgggggggttgctaggagattgcttaaatcgcatctctgccgaccatggaaggccccttgttggtcaaatttctatggcaataagaattccaataatgtgtattctattcttagtaataccaaaagaatcttcatcattctattactttatggttttatcttttctaatgggattctttgcaattgcaggcgctgctgcaagcaggccaattctttctgatgttgttagagcatctcatagagcaactgtattctccatagccgttttatttgaaggtatttcagccgcaacatttggggctcctgttgtagggattttatcagaaaatgtgtttggttataaaactactgcagaaaatgtaagtcaaatgaacgcagattcaagacttataaatgcaaatgcgcttgcgaatgcacttgtattccttacagtttttccttggtgtatttccttattattatattctctcttgcattttacatatggaaacgataagagatcactaaaaattgaactatccgaaatatctggttatacaagaactattagaagcaggttagaatctaacggatcggatactctttcaaatcgatcttag

SEQ ID NO: 1196 - DNA, 1272 bp, Cryptosporidium hominis
atggattttgcagagaaattggcagatacttcaaataactcactggatgagcaagaagttgtatattcatgggaacaaggccttataaaaaattgggagagattagttgaaacagagagtgggcttgttgtaattgatgatgaggctcgctttgattcgaataatgcagacgaaagctataatattgagttgttgaaacgtgccccaaatacaaatattaggcgtggcctactcagaaatattgtaattattttagatatgacttctaatatgctggagctcgattacaagcctgacagactacaatgcatggttaaatgcaatgaaattttcattaagcagctattagaagataatcctctaactcaaatctcggttatttctatttacgacggcattggcgaagtaataataagctacaattctaattttcttgaaattatgacgagcattttgaattacttgaaaaagggatgtaagggaagcatgtctattcaaaatgggcttgagaaggctaagtatctgctagtttcaatccctccgtatggtacaaaagaaattattttttttctaggaagcatgagaagtgtagataattcttttttattcaacgaatgggtagaaggtttttcttccaataatattataattaatgcaatactcttcatcccagaattatatataattaagacaattacaaagatgacagggggtgtttgtttatgcgcaatgaataatgaccacttacttaagttgacccttgaaaatttcatcaaaccgcctccaaataacattgcgagcaccccattgaacattaacttggttacaatgggatttcctgaatatttaaataatcaaacgcatcctttcggttgctcatgtcacgggtccttaactcatcgtgggtattcttgcccgaagtgtaaatcaatcgtttgttacttaccgacaaaatgtccggtttgcttgatatatcttatttccccaaatcaccttgcaaaatcattcgcatatttatttcagcacccagatattattcctattaaaaatggtgaatattcaaagattgagtctagttctataaaaacaaagtgcgaattatgtgagagccagttctctaataatgtatatttgaactctgggtcaagatcgaatataattaacaaatatttatgtacaaattgcaacactcaattctgtaatgaatgctgcaaatttatatttactactctacatcaatgtccaatttgctgttcattgagaatttcatag

SEQ ID NO: 1197 - DNA, 1008 bp, Cryptosporidium hominis
atgtattatgtaagaaacctatcgaatacaaataaattgagatacttttatggaaggcatctttggttattctcttcaaaagtaaatctgatcaatttgtgctctatagtccattcaaataaaggccatgcaatcacttcaaagctttatattactttagaaaaagataggtcaagtaataatcaaggagatttttccaaaaaaaggactttggaatgcaaaagtgatcagattaataaatttgaagccgaaaatgaagaaaaagtaagaaaccactttatgaagaaatcaaaccatgcggcttccatattagaaggaaaggagtacggatttaattcccccatttgggacttagaagaagttaataatgtacaaaaaactcatttatgcccaaatgggtttaaagacaaaatgtcttactatcttgtgattgcattaagaaaaagtttcgatttattaactaggtacaataaaggacataatgaatatcaatggtgcagaagaataatttttttggaaacagtagccggcgtcccaggtatggttggtgcaatgcttagacatttttcttcactccgaaaaatgaaaagagataatggatggatacatactctacttgaagaggctgaaaatgaaagaatgcatttactaatatcactgcagctgataaataagccatcgatattaacaagggtcagtgtaattgggactcaatttgccttcttaatcttttacacgatattttatataatttctccaaaatattcacacagatttgttggatacttagaagaagaagctgtaagcacatacactcatctgatcgaggaaatagataagggtcttcttccaggatttgagaaaaaagccccgaaatttgcctccgtctactatggtttaccagaggatgcaacaattagagatttatttttagcaatgagaagagatgaatcgcatcacagagatgttaatcacaaccttgcagatataagattaaatggagaatag

SEQ ID NO: 1198 - DNA, 669 bp, Cryptosporidium hominis
atgttttgcagagttgcaattaagattggattattggaactgttaatccgaatttttaagaaacaaaatgataattgtataacccatagattgaagaatgcactattacgtacaataataggattaattcgattttccccaactgcagcttcatacacgtgggttaaattaaaaaatgaaatatctgagttaatattttctgacgatatttcaatgagaatatggggtattaaatatatttcaactattattaaaatggtagaggcagacagtgaagattgtctagcattagattttatccagccattggaattatgtccttcaatattcgtcttaatgtatgatgaatgcgtaccaataaggttacaaacaattaaaattttatgtagaataattattactcaaggcagtgaaaaagaatgcaaacaattagtttatatgggaattatcggattacttcttgatgtattaaaacaaaacgatttgaggaattgtacaaacagtattgcattcccaattattatttcattaattaggctaataaaaatatcagaaaaatggtgtatgatttttatttattcgaagggagtcgaaattacattaacatatttaaaatattctgtagaaaagataattattccggtaattctcctaatatttaatgcttgg

SEQ ID NO: 1199 - DNA, 1008 bp, Cryptosporidium hominis
atggaacttgttaatcaagcaaatgaaaaaatttcaaatatgatggatttgaaagaagcaaaaaagattgcatataattcactactaaagggtatggcagtacaattacttgatgagactctgagagtgcactataaacaaaattatttgaaaaaaggatttgaaatcttgaaaaaacaaataagtagaccaaagattgtttcaacaaacgaagatgggaaaggattaaagggaaatgatttaactttattcttattaagaaaagaacagctttcactttttgcggaaaatgaaaacttaatgagccaagtagaggatttaagagtcaagcatttggaagaacttaaaaagacacaagagtcttttatgatgtataaaaaagatttagagagagactcaaatacagagacaaatgttgcattgtatgaaacatctatgctacactttgcatatataatcaatacaaaaattaggttacaaatggttgatgcattctggagaatacaaacacaacctagcaaaagaaatcttgttgaaacagaggaggtaaagagggaaagtttaacaaaacctatggatctcaatagtagggacaagctatttggaaattttttgagttcattatacaggatttctagaataaagttgatttcatttacttggagaaaaatagttctaaatgcaaagttctcatcgttcaaaacactacctactgtacctttcaaagatatgaataataatagaggtttaaatatcgactctttccatttaagggactttattaacagtatggggaaggacggtgtaatgaacttcgcgcatcagcccaactattataataaactaccatctgttataaatgtacagaataaggcagtattcgtccctctaagaagagataatccaataacatatggaacctacttccaatataataaggaaatattatccgaaagctgtgttacaggcaaacctatgggtagttacgcaaacactgattttaattag

SEQ ID NO: 1200 - DNA, 657 bp, Cryptosporidium hominis
atgtctcagacagcaataaaaactccaaaaacattgcatctgaaattggtcttgttgggggatgcttcagttggaaaatcatgtttagtagttaggttctcaaaggatgaattccatgagtatcaggaaccaacaattggtgctgcctttatgactcaatcggtaaatgttgatgatgattatactgttaagttcgaaatttgggatacagcagggcaagaaagatacagaagtcttgcacccatgtattatagaggagctgcggcagccattgtggtttacgacattacaaatgtagaaacgtttcaaggggcaaagtcatggatatcagaactacagaatataaataacaatgatattgttgttgctttagttgggaataagtatgatttagaaagtagtcgaactgtggactctgaaacagcacgtaactacgctaaggaaaaaggaatactgagcttcgaaacatcagcaaaaactggatataatgtccaagaactatttgaggagattgcaagaaagcttccaaacaccaaaaagctggactctaacaatatgagcacagaaaataatggtaaaactggagggtttcatttgtttagatcagatagaagaggaggaggaaattgcttttcaaatggttgttcttcaaactaa

SEQ ID NO: 1201 - DNA, 936 bp, Cryptosporidium hominis
atgactcctgaagaagcacagaaggagtttttagaatatgattggtcaaagagcacattatggcagcaatattataataatctttacccgacgccatctgcatctcaactaaccacttttaaaagaaaatggtttaaaaagaatgtgaaccctaatcttgagttacaacttaaagaacataactataataaatatcaagaagagagtaaattctcgagctttaattcacaagccaaaagtaatgaatcaaaactattactttccacaggatacaaacaatggatgacattatcactttctatttcacttttgctttcatcaataattccaatcttgaatttccttccaatcattcgcggatctaaatttacgtattttcttgtacgaataagctctttattttacattctgggtcttggattacacttatatgacatttcaattaaacccatcaaattactttccattgacttttggcaaaagatccttgttgaagaatcattccactcactaatttcggttgttgcatattttggtctaatctattcatttcctatgatacttttcattcccgcaattacttcattattcattgtatcaaaataccaaccagttgtaaataatattcaaataattaatattttcgacctcgctagcaaaaacaaaaacaaattgtatcaaagaaaagcattttttgaagtatttgtagtgggaatttatattttcttcgcagtacttacaagaagaatcagtatagtttacatttccatctactggagtttgataagattgaaatatcctattgatccttttgttcaatatgcatttagagttgctaattctcaaatcaatggttttatgaaatcacattccaactacattccaggttttattcctagatcgtacaattgggtaagttcgaataaagtgaattaa

SEQ ID NO: 1202 - DNA, 1134 bp, Cryptosporidium hominis
atggaggaagctcaattaccgtgggttgaaaagtataggccttcaggactgcaggacttactgtcgcacaaggatataattaacactatcgaaaaatttattagttctggccagcttccacaccttttattccatggacctcctggaactggaaagacttcaactatacatgcaattagcaaatgtatttacaaagatagaaagtatcagatggtgttggaactcaacgcatcagacgaccgtggcataaatgttgtaagggatgcaatcaagagtttttcagaaagcgcatcaacgacattaaatcactcaggcggaacaaattcaaatattgaatatatagaaatgtctgatgtaagcacaagaaatttagactgtaataaaagcttgtgtgagaatattaaattaattattctagatgaggcagatatgatgacaagcacagctcaaatggcactaagaagaataatggagcgttattccgaacatgttagattttgtatcatttgcaactatgttaataaaataactcctgcattgcaaagcagatgcacacggtttagattttctccacttcctattgaggatattaggaatcgaatatcagaaattgctctgtcagagaggatttttgtaactcgagaaggtcaagagtcgctcataaagtcttcaaggggagacatgaggaaagttttaaatgtattgcagtcatgcagcatgagtaattacggaaacattcaaaaacataaagattccggggaactaaatggggtatctattgaaggacttatcacatatattaatgaagaaatgattcacagaattcttgggatacccacaaagagtgaattagattatatatttggaattctctcaagagagagtttttcaagtggctttagtgcgcttcaaaattcccagaataagaacggatattctacccaagatttcgtaaatggtctttacagcaagtcaatggaagcaaattggcctgatgaagtcgttccgttacttatgaggcgccttgcagatatcgagtataggctttcaaggggggctagcgaaagcatacaactggctgcaattgtttcttgcttccatgaagttagaatggaaatggagaagctcgtttaa

SEQ ID NO: 1203 - DNA, 2028 bp, Cryptosporidium hominis
atgcatgaagaactaagaattagaaacggctctttaaatgaacaaagggtagcgaatataaataaaaaagggaattctgtgtttttcacacaggagtgcagttgtaataatagcgaaaattgttttgctctggcttctcctcatgcgtcttttacttctatggcatcatttgccctgtcatcctctacttcaaattcaattcaacctattggaaatacttctcctcacaaatgcgagcagagatgtaatgctggaaatgaacatttgaaaaaacattgttacattccatcaacttctttatcatcaacttcagtttctcttggtgaaacctctaagttagcaattagttccggaacgagtaatggcaaatacagcataataaataaacagatcaactgcaatatcagtacaataattaataataatttgacaggtaatcccgaaaaaaatgtgcagaatacaactctaaaagtggaaaatgggaggtatacaagtaatactgtttcaagttcaaataagtcacatactaatggcgtttgttattcaaatattaatgcattttcacaagaagaaaacgataaactcataatgcaacaaagcagaaatatagacattagtaatgtaaacaccctgaatcatcccaaagttacaacttatgaatgcgaaaatacttattccaggtgttcttcaggtatgttaaatggaaatgagaaagatatcgttaattcatcaaatacaaacccaaatcctgcaacaaattcattctctgcaatctcaaaaatctcaaaaccttcaattttaggaaacaaaggccaaatggtctcaaaaaattactcattagtatacaaacgtttatatgattgtctcggcccagtgatgtttcccatagctccattaaagggaattaaacatccaagaggtgaattaaagctatggccaactagttacgatagagtaatttcacagaattcatcaaagaggaaagttcacagatctttatggattcctccaaaaagctatgaacacgcatatgtaaatgatttaaacggcacagagaccatttctgcatatccaatggcattgaagtttgttgaggatggaaatgcgcgcgatggaagaagcattaagagagaaatagaatgccacttatatatatatcagaggctatcacaacttcaacaagatcagggctacgataacttggaggatgcatggccatgcgcagagttgatcggatattatttagataagaaaaaccctggaaattctgtattagtaactagaaagctttcagggccagatttttttgacatcataagatctgaacactcgtcttctgccaattcagtgtatagcaagtgtcaagctctttacgaatataataaacttcagtggtgtacactagcattaacaagaattgcgcaatattcagcacttggtattaggcataacgatattaaacctgacaatatagtattggatttttattacaatagcacaaataacgaaaggcatttagacgttaaaattattgatttaggcactgcttccatgcatagcgctaaggatttcacaggaggtacctcatggtatgagagccctgagcagaaaatgctagagtactatacaaaaaaaagtagagatttgaaatcagcaaagacggttgaaattggactttcttctgattcatggggtgcaggaatttcaatagcagaagttttaatgggcagaagagttgtagacagtatgaaaagcccatatggcccaggcccattggaatttaaaggaaaagatgggtggttaatagaacctcaagagtggattgagtttgccaaaatggcattggggtttgataattcaaactacccatacaaatataaaatatgtgaagaagctgcaaaatatgtattcaatatgcttgtacaagttaattcaaataaaagagctaatattaaagatgtaatacaaagaatggactactatactcaaaaggcataccaggctgttaagcaaaaacatcaaacgtga

SEQ ID NO: 1204 - DNA, 1968 bp, Cryptosporidium hominis
atgtttattgaagaggcaaatgccagcattgatagggggatccgcacaattatcttcgaagaattttcgcccttagtcgtagaaaatattaacaaggactacttggaagaaatatatagagattactctgatccaaaattattaaaattatgtaataactctggttttgttgaattcctgaagttatccaacgaacaaggggatttaaataatgaattaatccgaatttttaaggtaactttggaggagatattttcagcagtactttctattattaatatacaacaatggctcagtattgaagctcgcgaacggggtccatttccaactattaaaaaagatgaaagagcaactgtaaagagctttgttatgaactatttgcctgatgaaaattatgaaaataactacaattcttggaagctgtttctcaagagagattctcctgcaggtagaaaagtctgtgaaatgtttaaactttcatttttaaaatccttattgcttacaaatattggagtaattcttaatgatattgaaacttcgggaatatttactaaatttgcgttaaaaagcaacttaagtaaggctatttgcatgaagtttgctattaaattatgcatagcatgtggtatcgcttccaaggaatctattgatcatttgaaaaggcaagcatgggaccatctgaggtatatttctgatgatgaaactcttcagtccagtctattgtctgaaactggattaggctttcttcatagagatagtggtagtgcaaaggaagaagctctgggtattatttcatttgaatgtattaccaatgacagagagccagaacatcttgttaaacttattgcattaaaaaatgttttcgcaaggcaattaccgaaaatgccaagagaatatatagttagactgatttttgacagaaaccattattctttctgtttgctgaaaaaaggaaaagtaatcggtggagtatgttttcgcccgtacttcgagcaaagatttgctgaaattgcgtttttagctgtaactagtacagagcaggttaaaggttatggtacaagattaatgaatcatttaaagcagcatgtcaagaaaagcaaaatagaatactttttaacgtatgcagataactttgccacgggttatttcagaaaacaaggtttcagaaaagaggttagtatgccaaaagaaagatggtttggatatattaaagattatgacggcggtactttaatggagtgttatattaatccagagattaattatttgagattatctgatcttttccatgagcaaaaatctgcattattaagggctattaatactattagacctttaaaggtttatccaggtatcaatttatgggaaaatggagacgaaagtatggtcaaaaaagatttaaatagtgagttaactaggaatcaaaaaaatattgaatcaactatatctgaaccaatgaatgatggtgatccagctaaaaatttccaaaatgacccttgtgctgaagattttactccaattatagatactaaaccagagaatgatttaaacataaacacaaaaaaaattaagcccagtgatatacctggtgttttagaggttggttgggtagaaaagataattgatcctgtcgagcaatctaaggtcgacctctctatgaacgatcaaatttggcagttacttgataccctatcaaggcatgaaaatgcatggccgtttagaaaaccagttagcataggggaagcatcggactactatgagattattaaagaacctactgatatccaaactatgaagcgtaaagctaaaaataaagaatataagacattatctgagtttagcagcgagcttaaaagaatgtttgataactgcagattttacaatgcaaaaaatacaatttatacgaagtatgcaaaccagttggaggcatttatttggccaatgctacaaacgatacaggaatcataa

SEQ ID NO: 1205 - DNA, 876 bp, Cryptosporidium hominis
atgttatacaaatacacacatcaattactattacagcagatggagaaggtaataaatgaaattgcacgtgtcaaatcattgattggcccaaacatattattgaaagtagtactagaaataggtgaaatcaacgaagcatctagattgtcgtcattagttagatgtgcaattcttggtggtgctgattttattgtaacatgtacaggaaaagttaaaaaagggttaaatagccaagatctaaaacaacttcttatcgaagtaaaatcttccatcgaaggagaatctccctgtgataaagaaattgctgctggtgatgatgaagaggttttggaaggattacaagcttattatgatgagtgctttgttaaaggaacgctaatccttccaaatagattgcgatatttacagaagcgcaaagtaggtataaaacttcaaggaggtgttagttcgttggatattgctagggaatttatcaagcaagttgaagatgttcttggtaatgaatatgtttcatcaccaaatacatttagaattggttcttcaactttacatccattaattatccaagaattacttggtattgacgatgaattaaggatcattcatacattaggtattaagccaattaacgctgaacaagttaaccaagaagataatatttcatcacctgagaatgaactggtgggtatctcgcatccatctgcacctatttcatcaaatcaaacacgcgaaaaaattggttctcaagaagtcattgatattaacaaggacattattaaggtagaagctttgaatggggacaagactattatatcagatagcgaccttgttggcaacaaatcaaaagttatttctgttgagtatcttatcaactag

SEQ ID NO: 1206 - DNA, 330 bp, Cryptosporidium hominis
atgaaagaagatcaaaaagaatttttaagaaagattgcaaatgtttgtgagcttacactttacacttcggaaatgaacaataaattattgaggaatgcaataagagaggcatcttcagatcaacttttagctcctgtttctatttcaacctatccacaatttattccatctgtcaaacattcactacctgaaaatagcagcacagcattatccaccgttgtcgcttggccaagaggtgatggttgctcggaggctattgatgctgaaatatataatgcagttgagtattacaaagtacatgaaatcgaatatgttgttgattataggtaa

SEQ ID NO: 1207 - DNA, 240 bp, Cryptosporidium hominis
atgttgagtaagacaaataataacactatagatataaattttcaaagcaaaagtgaagcaatagatgtcgagtgcggtggtggaatagaagacaataactctgattgttcaatgaacataaattcttataaaacagcaactgcaatgtcaaactacttctcaagtatggatacatctgaaatagtttcaaatttccaattctcacacacaatagaatcaataattgaaagtgaattgtga

SEQ ID NO: 1208 - DNA, 213 bp, Cryptosporidium hominis
atgttcccaccgcttagcgagtctacaaaaaataatttaaacaaagatacatgcaattttgttgagaatgatgacaatcaattggatattttggatgatcaggttcgtcgaaaatataaactactgcaacattctgctttggatggaggctgtgactggttgacatgcacctgtaacttagaaaatattgatcgggatcaaattattgtctaa

SEQ ID NO: 1209 - DNA, 1728 bp, Cryptosporidium hominis
atgtggggaaggatcgtaagctcggttagctcagtattggacataaaccaagcaaccttaagcggatgtattgatatcattgtggtacctcaagcagacggaacacttcatagcactcctttccatgttagatttggtaaagcaaagttacttaaaagtagagagaaacatgtctcaattaatgttaatgggaatgatatcccattaaaaatgaagttaggagctgcaggcgaggcatactttattcaccaagatgatccccctgaagatagttttgaaaacatttcttctccgacggattctcgtgaatcatcattaagtgatgtggaaattagtacgccttcacagccagcaaataattcgagtttaaatatgtcccatgctaagtcgtttgaaactactgtcgagtatagaaataaaacagatagtactgacccttcaaatttcacaaatatagaaactgaaaatgaaaatagtcaaaatataaatgaagtttttcagagatacaacattacgctatctctctgcggtcacttactatatggaggtgaggaagactcaagacatgatgaatatgtatttcaaagtaatattatctcctttgaacagttcgaaaatgatccagacctttggtatcattcgtgcctagttgcagttatagatggaaagcctccgtactatccaattaaagcgttttatccagtaattacatcaataattgcatttggcaagcctccatcaacgcaagcattgaagaagttcttaggaatacccgaaaaaagctccaaaaaaatccgctcgtcttcagactgtggaattattgactctaactttgatcgcattagtgggaaccaccgtgcaaataggtgcatctcatcaacattgccactttcttctaaatctcatattcaaggctgtcttacagcgcctgtttctgttgacaattgtgaagtatcttcatttgaaagtattgaaagcatatcaagttctccaaatttaataagaatggataatccaactaacacaccaaattgcatatacttatgcagatcaaaacctccggtaaagtacctcagacactctttgagaccaacatctgaccaattgaaaagcatgaatttgaaatggggcgcaaatcgagtaacttatactgttgagtcttctttacagggtaggaagactgtaagtgggactatctatctttggcctcctgattcgaggattgtagtatcagatgtagatggcacaattacacgctcggatgtattggggcagcttatgccaattgttgggaaagattggtcacatcagggtgtagcggaacttatgactaatattgaatccaatggctacaaaattgtttacttgactgccagagcgattggtcaagcggatgcaacccgtgactttttatttgggttgaagcaggtaggaaattctggtaatgtaactttaccggatggacctgtttttttatctcctgatcgactctttccatcatttaagagagaagtaatagatagaaagccatatattttcaaaattgctgccttgagagatatccggaacttattcccaatttatagaaaccccctttatgccggatttggaaatcgagataccgactatcgttcatattctcatgtaggaattcccgaaggaaaaattttcataatagatccaaaaggggtgatacatcatataaataagacctatgcaaaaacgtaa

SEQ ID NO: 1210 - DNA, 972 bp, Cryptosporidium hominis
atgcttgcgaatactattcacaaattcatgcaatcgaaaaaaatagaattacatgatacagattcgaatgcacccttgttaccatacttaaggaggctattcaatacactaaatagagaaatatgtttattctaccttccattaaatttaccttgcatgtactcggttccttttatagaacaagagcatttaactaaaaacctatcaagcgctgacaacgttgatatatctagttcaaaaaaaagcttctttaacagaaataacaaggtagagttaattaagagtctctatgtttatagacactcaaaagagttttgttatattgaaagctgcattgatagtgtaagagttagtcttaagttctactttaaatgcgaatttgaaagaagattgttcaatcagctaacgatttttatgaagaagaattcagattatttgcaattagtgcgaaaaaaatcgattgaaggatttgatattagctttttaattacaaaccacattttaaattcatacagcaataagatttgtataagtaataaaagtaactatgatggtcaaatgggtaaatatgatgtgatccattttattttaaagtttgttgttgatattgatagacaaattcaagacaaaatgcttcaatcaacatatttctcgagatattatattagaaaactacttcaagaattcaatgttaatgttctatataagcagaacagcataaatattcctaaacataaaaagcaattagacgaaacaaataaatcagaaataaaaggaatagatcctagcaaaactgaaataagtattagtgagcagaataataatttattagagactaaaaagagcctaacatctacgaaaaatatcaattcaggaagtatagcaactcaattaaatgattcaataggccgagatgctattgtgctgaaagcattgaaaactaggaatcgaataaaaaatttaattaactaa

SEQ ID NO: 1211 - DNA, 1086 bp, Cryptosporidium hominis
  misc_feature (1076)..(1076): n is a, c, g, or t
atgtctgcacaactaggggatggacatggattaagaatgggagctgtaattaaaagattttatatagattcaatttatactcaggataatttaattaatttggatacgaataataataaatacgcaactactcacggccatcctaaagaattgctttttggaacatacgagattgtagtaaaaataaacgatcgtattattgaagaatttgatagcattagcaatttctttgaattccctattgaagttcaaaatattagtggcaatttaaacatttctccaatgtggtattataatattgtaatttattatgatattgaaattataattacagcattagatacgcttaagccttatgagaggttcattggacaaccaattttagtttggggagattctcaactatttatctcattgttggaaagttgggttggaatcaagtatgaaaaggtaaaatatattcagatttggttacataatttaattccaataggaatttcaagagtgaaattactcaattttttacaaaaaatcacattaatttctcttgcagagttcgtaaacagttacaattttgatcgtgaaattgaaggatcaaatataattaaatctgagcttccagaaccaattttaaaatattatatcggattaaaaatattatcatacccttcaattttagaaaaagtggtagaatatattttatatatcataaatgatttcaagggttcaatacacgattttattgaaataattaataaggggacaaatgaaatttccaacttgtttgaaatagaaaagaaaaaatttatcatcacttgcaaaaatgagtttttcaaggaattagcgaaagttacaaaatatccgctttttatcaacttagtaaataataaaggctataatgacagtcttgcattgaactttaaaacaacagacaattttagtgaagaaaaaatgctaagtcagaatgaaatatttataaatccagaattatttactcctaatttactgaaggttatatatagaatatttttattcaacaatttattaaacaacactaatttgggtattacaaaaantattttttga

SEQ ID NO: 1212 - DNA, 660 bp, Cryptosporidium hominis
atgatatttttgtctctaattggtgcatttgagccctttataagcatagataacctcaaatttattgtgaaaaaccttcagattttaacagggaaagaaatcaagtttattaagcatgcagaaactaatataaatttggttatgaagggaaggtgtagtgttggtaatatttctggccttaaggactatgcagatttgaaggagcaatcaaatccaggaaaccatcatcagatctctacaaattctatgctggaagtattgcttaagatgaaaaataaatttatcacagaaaattcaaaaaatcagatggattccaacttttttttaattggaataacaagcttggacatatttccaacaaataatcatgaatatgtattcggtcaaagcgacccagaaaaaggaattgcaataatatctgcatataggctatatcaaaataataaaaacttaatgaatagtcgaatattaaaagtaataatgcatgaatatggtcatttaatgaaattagggcattgtaaacatgtatgtttgatgtctgttatatgttcgataagcgaacttgataacagaacactatattgctgtgaaaattgtctaaatcaaattagagaaaaaagttctacatcagagtcagtgaagaacttgtttgagttttga

SEQ ID NO: 1213 - DNA, 369 bp, Cryptosporidium hominis
atgggtacttatttgtcaagtaattttgggctatgggagttatatattcacaataagagtgttgtacctgtaattagacatttatcaaatactttaactatgaatgcaagcaatgcaaaagtcaaccgacatcttcataacttgaattatgaagatttaattggtttaagcacagaagaaatcttggctcatgaaataacatcccccaacggtattttacataattactcggcatgttttaataaagataagaaaaatattgttccttacaactatattgaatacagcaaactgtcatctacaaacttgtttcaaaactcaaacaagttcttcactgactctgatgtagaacttttttctctaatttga

SEQ ID NO: 1214 - DNA, 288 bp, Cryptosporidium hominis
atgaaatctcattcccaaacatccaaaaagctcaataaggcttctaaatctaagaaggttaaattggaaattgttacgaaaatgttgttagatttgaacaaacaaatctctgaagcaagaaaagctacaatggagcctataccaattgatattctgtctatgggagatcctgatcactcttttatagatttctctcggggaattattgttagacgaaaaataaggacgttgatgaattccatatcttcacttaagccattagggcataaatttcgtaaaatatccttc

SEQ ID NO: 1215 - DNA, 540 bp, Cryptosporidium hominis
atgctaggtaaaggtagaaagcctaacatactaattattggcacccctggtacagggaaaacttcattaagtaaaaaactagagaaaaaactggaaggctacaaaagaattgaactttcaaaagctattaaaaaacataggctctatagtgaatgggatgataaaatgggagcaagcattttcgacgagaatctagttagaagatacctaaaaaatcaattggataaatataattctaagaatgttggtataatactcgatttccattcagtaaatttcattaagagaaaatggttcgacattgtcttctgcttaaactcagaaacccatgttttatttgataggcttgagaaaagaggttacagccaagataaaattaaagagaatgttgaatgtgaaattttcaaggttattagatttgacgctacagagatattcgatgaggaacaaataattgatttacaaagtaatgatatctgtgagcagaggtcaaatataaaatttatattgaataaaatatctagcattgaaaatagttaa

SEQ ID NO: 1216 - DNA, 1050 bp, Cryptosporidium hominis
  misc_feature (117)..(117): n is a, c, g, or t
atgagaatttcgaataaccaaattgagtgtatttcaaaagagaattttttaaatttgaattctcaatttaaacaatcatcagatagtttatcttttgatatgaaaataagaacaganaatattaatttaaattctattcaggaaccatcaaaagttgaccattattataaaattcaacctttgcaaggcattgagcagaatattggcgaaaacattcaaatccctgttgaagatgaagttcagagttatacaagctatagcaatttcaaattagaatgggatcatgaaaataaagcattattcgtagtaattccttcagttgatagtttggaccattggatgatgctgtttttgcaacctttaggtattacttgtgattcactgagtttaaataattgttgtttaaaaagaaattgcgattttcgaatacggcttgatgatgaaagactgttactttatccagatttattaaaagatatttctgattttttaagtacacagtatttaaattggcaatattatagggaaaacgtaattatgagggattttgaggtgatggactctgagcaagaagagtatattggtgataacttaataaatggcaataatatcggtccaaaatgtcacaattattggaaattccctgatataaatgtattcgtgaataatgattctcacttaaataatgaaattaactttgcagaggatgaaaattccagtaaattttacgaaaaagaaaatttttctcaaaataatggtagctttgaaaggaatattcaaaaatcaatcaccaattacaacacagacatttacggaaagtgtttattagttccagaactgtgttcaaaaggtgatgaacctttggtacagaataatacattatcatgccttactaccaacatttctgatttaaatgtcctaactacagactctggcgtacttcaagtattgacatctgagaattctaatcatgatgataactattttgcattaaatacgaacagttcaatgggaacaaatgacaaggagtatttccctattgaagcttag

SEQ ID NO: 1217 - DNA, 504 bp, Cryptosporidium hominis
atgcgaagttttatcaaaataatagcgctatttttttccattatagcttttaatataaattttgaatatgacctatctttaaatttactatcaaatcatgcttattcttttgttagaacaaaaaagaacgcatgggatatcgtaaatgaaaaccatgagatattcaattctcctggaagaagagcaaatggagaactaaacctttccagctataaatggaatatcagctatgatcaaccattttcatctcaaataagtcaagttattctcgtaattcttgtaatagttttattaatttgcgttattttaagtttaatttgttgtcgctattcagttcccaaagaagaagacttcacaaaaaaagaagatgggatttattactttgagaacgaaaaaaggcctgaagaatttgctctaatttataataaaaacgcacaaaacagaagatatatattaactggagaaacaccaaagaacatagaatactgcgaagatcaagattag

SEQ ID NO: 1218 - DNA, 360 bp, Cryptosporidium hominis
atgttaagcgatgaggaaagtgagttattaatagaagacgaaaaccctattgctagattctctttggaattagagtttgtgcaatgtctttcaaacccagactatcttcaatggttatcaaaggagggatattttgaagatgagtcattcgtcaattacttaaaatatttattgtattggtgtgaattcccatatgtgaaatatatatcttatccccattgtattaaaatgctgagactacttcagatagaagatttcagaaaaaacttgtcgaaggaagaagtgattcaaattattcgcgaacaacaaacatatcaatggatttactctgacataaaaaaagaacatttaaagtcataa

SEQ ID NO: 1219 - DNA, 2133 bp, Cryptosporidium hominis
atgagggcagcttggggagctttgaaaggtgcggttcaagaacttaacgatgccttgttagaggaagatgatgacgaccatgagaagagcagaagaaacaattacccaggacatatttcttattctagggagagaaatgatcatgttataaatgatcattttagctcaaatattaatttaaaaaagtctaatttcggatcgaaaaataatctacgttctaatgataataatgaaggctttattagttcaaataaagaaagaaatatttcaagtttatcaagctctttaaatgatagtaaaagaattgacttgaaaggcaatctgcctttagaatataatcagtactcaaatcaaaatataattatgcttcaagactcagaaagttcgaaagaaagtaactcatttactgatgaagaatttgactggggtttagatacagaaagtaccttaaaggggaaattagattctaaaactaaccaattttctcagaaaaaggaatataatgaagaattagcccaaaagacttataaatttgattcaggagaaactgagagaaaaagttccgatatatatactagaacaaataaattaaataaaatagtccagcaaagcgattattcggagaatgatgattataaaaacaatgatgaattaactgtagagaataactttccaaatagctgtaaaggcgaatcaattgtagttacggaagatgatgagggatctaatataactgatacgcttgagtactgtgaaaataagtttaaagaagaagtgggagaagaagtggaagagaaagaagaaaagaaaaaagtaaaggaagaagaagaagaagaagaagaaggagaagaagaagaagaagaagaagaagaagaagaagaagaagaagaagaagtaaaaacggtaagcaactcctcggatcatgaagacttgggaatattgaatttacctaataaatactcaaaagagttttctgaaatatttcagatggaaattggtagtgctgactatcttttggaagttattcaaggatattattctgactggaatagtattagagattctcttatttcagatagagagctgctaattaagttggctccacctcactatgaatcgtatttaaaaaacacaattttggataaatcaaagccattttccttggggtttactgttttgattgggcagtgtatttgctcatttttacaagaatttaaaaagaaggcttcgttaattgttaaacaggaaaataagattaacgaactttttcagaaatgcacagagtatacaacaaatgttcaaaacattgaagctgaaaattacgaacttagtaagaaaatttcaacattggaagatgagataatttttctaagagaaaagaacgaagagcttcttaataaaatagaagatgataccaaagaaaaagaccagatatttcgcaaaagacttgaggatcttgaaatagagaggaataatttaatagaaaaaattaatctgatgattgaagaaaaatgtgaatcaaaaacagaagttgataagctctacgaacatattaataatttaacaagtattattgagggatatcaagctgaagaggaacaaattaattcgaggtatgaaattgaactcgaaagagcccgttctcaagaaaaaaagttacaatcgaggttaagtgttttagattcatgtaaagatgaaattacttccttgaaggataatattacaaaattagaagaagaccgaaactcactcgaaaagcaaataggcgaattactagaaaataataataatcttataaactcaaatgaacaaataatgaagcaacttcaagatactaaagaggaacaaaaggagttcatgattgataagagatttatcattcagataattcagaaacataatgaagatggatcaagaattaaatataggaatgatttgttcaacttattgtgtgatgcaattggtctttcacaggacgagaggtccaatctttttatttctgacagaagaaatagtggtagcaatagcagagaaaatgtgattcatgatcttaatcagggaatgggatttgctgacttattctacaatttcctcaattccgaagtagaggaaagtatgcaagaagctaaatag

SEQ ID NO: 1220 - DNA, 1530 bp, Cryptosporidium hominis
atggaagtggaacctgtaacaatattagaaaagcttgagtcgctcaattgttctttaagcagtattagcatttcagaagaactcaaatgtgaacatgaaagagtaataggagtaattaaaagtttggagtcccgtaatattattaaaacacaatttatttcggacaatatgttatctcttacagatgagggaaaagactatttgttgaatggatcacccgaatacagacttattaaaattattctggaaaagtctgatcataaaattaaacaagacgaggcaatgacatttctgggaggctccatatttaaaatagggctttcaaaatgtcttcagaaaaagctgatcaaattaaataaagaattgggactaatagagattcctgctgattccaacatggatttattaaataccgatgagttagggaaaaatctttttattgtgggggtaaatggtattaaagagagtcaactaactaaacaagatttacaaataataacagaattaaaaaagagaaagcttgtggtctcacagaaaatgtcttacttcatgattaataagggggaggactttactgtgaagcttaaacctatgattactgatttaacccaagaaatgattatgaactcaagttgggaaaacaacgagtttaaaccctataattttaatgcaaaaggaaaaagactgccaagaggaaatattcatcctcttactcgcacttcaaggaagtttaagagaattttatctcaaatgggatttgaagagatgcctactaatcgctgggttgaaagttcattctggaattttgatgctcttttccaacctcaaaaacatcctgcaagagattctcatgatactttcttcttagaaactccaagtaccttcagaaatgaaatggagttgtcgaacgatcacattgataaagttaaaaaagtacatgaggttggcggatacggatcaattggtttatcttacaactggagtattgaagaagcctctaaaaatcttcttagaactcacacaacagcagtttccgtaagaatgctttataaacttgctcaaatgtatttatataacgagaacggattatcttttgataatttccagagaaaggcttacttttcaattgaccgtgttttcagaaatgaatcaatcgatgctacccatcttgctgagtttcatcaggttgagggattaattgtcgacaagaatcttacacttgcagatctaatcggaacattaaagactttctacgaaaagattggtatttccgatcttaaatttaaacctgcatttaacccttatactgagccttctatggaaatctttggataccacactaccttaaaaaagtggatcgaagttggaaattccggcttatttagaccagaaatgcttagaccactcggatttccctctgacattgttgtgattgcatggggactttctcttgaaaggccaacgatgattagttataatatcccaaatatacgcgatctatttagctttaaagcaaaaatattttcataa

SEQ ID NO: 1221 - DNA, 2892 bp, Cryptosporidium hominis
atgaacgacgcagaggaagattggcaagatccgcttttggatgtgagcattccatataattcgcttgcaccctatgcactgacttgctatcaacttgatgaagatcttcaggatttaatatcatttttttcaactttgagcaaggaagatttagctcatcatataaacgaaacatcttttgagtccagcttacgtttattgaaggatgttctactcgttcaaccaaacaaattagacagttctaatgggaatgcactcgcatatgaattacttgaaagcacggaagatcttcaaagagacttgagttcttcaagtgctgatattcttacaaagtttcaaaagaatgattcagctggaactgacctttcaatattggattctcctaatggtattattagagtagcaaatgaaaccaaagttagaacagatatagtgggtggcgatccgactttaaataattctcaatttcttgagggatctattccagcttctaattcttcatacagaattgtgagtaatggtgaagaaaataaatttgtagatcaatctaaaatgctaatggcatttttcaaggagttggaggctgccaaactttttgagaatttggaatcattctctggaatattagcagcacattctattcacttgaaaattcttcaagatgttgttactgacatcttcagagtagaagagcttagattaagactttgttcacagcttgcggccttattaaaccccattattctatcaagatttgaatcctacaataattcactattcttcactgcatttacaattccttcaaacgaaggctcatccattgatttaagagaaagtcattgctcattacctaatccaatcatttataagtggccttcaaattctgtttgcattgaagattataaactgtatatgtcaaggcttcctcttttatgtttttctgaagtatttaaattgggttcatgtatcagtcaatcgttaaaagttcatgataattatcaaaaaacaatagaaaccgatgttgagcagactgtagatttctctgacatctatccagataaatgctctataagaataaaatccttagactcgatttataatcaaagaaatggctctcagatagaccatcccttgtttcatgtagattatggttctaatagcaacttggatgctaatagtaattttgttcatcatcctttatgtactgatattgctcaggattccaaagatattgaaagagacgttatatttgttaatggcaaggagtatagcggagctaatggcggctacgagagaattgtttatattgttgcaaacctgattgaaaactattggctgaaatcttccaatggatttgaggactctaattcaaatgctgagactaaagaaggtaccctacaaggcagcagtaagaccgttgaactttgcagcggatcaatcttcaacttagttaacaatgatccaaacgaaaattatgatgagagaaacactgaatctgtcgtaattgcaacaatactacttcatgtattgagtagaacattttcaggcggtgcatgctttgacaaagtctctcttgtatataataagccagattgtattgtgatttctccaaatagtaagcgagcaagaccactagagatgcttatactcccaaatgttgctctaatgctttcgacattgaggtttagactatatgaagtaatggagaatttaactgtaaatacgcaaccctgctttctggttgatacacatgtggtatctagacttgttcctgactctgggttgattgaattgcttccattttattcctttcacattctatcaagaactccagtaagtaagatcccatcatccatataccagcaccttttaaggtgcgcaaatttgtttcttgctaagaacattctttttacaagagttaaaatcgcagagaaagtggaagcaggtacgcaatcggatcctccagtagagatagaatgcgaaaagctacaactaaatgttgatcaaccatctgaagttcatgaagaactgtgtggaaaatgtaacacggctcaaaatgattcaaaggaaagtgatcaaaatgttgcagaggcttttatttccaatagtaaatgcctagacactgataagatcattgaagtcactggagacgacttaacaataataaccccaggcgaagcagctttatttagaatgttcacaaatatacaagacaaggaagctatacataacagcagtatagaaaacattaacttgagtaactctgaagtctccactaataaagaggctgcggaagatagagatcgctatgattgtgattctaatgaatctattaaagaagaaataagggatagtgatgctagaatatccaattcggaatcaaaacctcaacatacagttgtagaacaagatttcccgatgacggtagtgcctgatagatctgttcaaattcacgcctcagtaaattcccaccttgaagaacaagaaggtaattcttattcaaattacaacactttcagaactcaacaacaaagcaactcaggaggaaatcaaatttctgataacaccaagaattcttcgtactctgattatatctcaacagaaagcaaagaaaatattgataaaagctgtattagttttggcctgcaatccggtaaaaacattcctaaactatatctttgccataatgttgaaattccagattcatgttctttgacatcaaacatttatattgcatcgtctgaaaattcgtctaatcttgcaaatgacttatgtaacttgccagctgattcaattggagccattgaccaagaaaatcaacagcttgctcttttcttgcaatccaagagagttatttctcaatttggaatatttaacattattaatacttga

SEQ ID NO: 1222 - DNA, 4329 bp, Cryptosporidium hominis
atggaaaacctcctagataataactttgagctactagcaagcgagctgtttgacgttcctagggacagtggagtagcttatctacagattggtacctcttatagtggcaacagcaataataataataatagcaataatgggcataataatggcagtggaagtgcaagaggtagccaacaacttgtccagcagcaatcccaacattcaagaaatgctagaagcgactcactaattggtgacattaaaaattcaaatatcacggtttctgctgtggatggttctcttatagattttaacagcattaggaatattgaaaccccttcaaaaattggggtttctggtcatattgtggaaagatcaaatagaattcgaatggaacacgctaacaacgtcgttgacgagcttcaaggatttaatattgcatcgagacattctgggaatcgtagttttggtcgtccagaagaatcatatcttgatttggatggttcaatgaaccgtagatcttctgatacatttagtgatgtgtgtgcttatcaacgacaaaatagtatgggaaacagtaagaataataataataataataataataatattaataatagtaataatagcgttatgcattcgagatgccataatggttccttttcacaaaattctcacttgggttcaactggaggtataatgaaaatggctagttgcaataacaataatggcaataccttccatgatgaacaggctgaatttgatacggatcaacgcattcaaggactaataggcagatacaattcaatgtgtatggatgaccaaattttaaaaatgggtacttactctaattatattaacaattgtaatatgaataatggtaatgttaacactaattgtactacatttgataccaactctattaacaataaaagcactaataataatggggctaatgcaaatgtagatgcatttcttccccaaattgaccattgtaatacgggaactagtggctctataattggaaatggattctctcatgaagtaggttccatagagagagattctacagaatgttacagagctcaccaaagctatattcagaggagattcgcaaacggtgactttgggacctgtaatatgaccaacactaccaccgtttcatctgagatatcatctttgtctggcgtggcaactcctggaagtgcatctctcaagagtgccaactctgctgatgctctatctcagagatttagaaactcctctaatattagccttagctcatatgacatatcagatattcaagggtcgaatggagtgaattttgacaagttatcagcaggcgcaataggtatgagtagttattcaaaacacttgaatgccataccactggatgataacgctattcctttggaagactctgtttctgaaattaattcgaatgggaaactaagattcagaaaaagtagtggttctacatccaatttatcaaatcccacatcaataatgggaagtatgaatgcatcagggaggagagccattggaggtagcgtatgtagcagtgggagtagtagttgtagcactggggttggagggagcacttgcagtttagcaggtaataatagcagcggcgcatatggaatgaaaaggtcgtctaagagtaattctcttattcattctaattttagttctaatggagtcaatcctttaataattgatgaagaagatatatatccctcaataggacactttgcattacttgggtcctccaattcacaattattgggtgtcatgaataaccagacggaaggtttagttagtagttttaaatcaagatctggatctgcaaatactgattacatgtgcagaagtggaattgatacttcgccttctattaaaggaaattatatttcatacggagattccattaatgggatagagagtagacactcgtctcatccagctctcagtaacggggatattggaggcccatttgagatggagggtaatggaagtcaattccagaatatgtttaatagattgatggaggacagcaatggttacagaatggaaggctctttacagggaattgacgaggttgaatttagaggtgatggaaaatcatattggcaacatacatctccatacaaattttcttcttcccaaggagttattgactggaaaccgcaacatcaaaaactttctatttttgaaaagaatgagtttaatgatgactttggttgcgacgttccctacaataattatttgattaaccgtggtcaacagcttagacacaagtattttggccaacagaaattatatggatttccttctaatatgagtaataaacagcaaaaacagttgaaacagcgtaatggtgtttctccgaatctagagaatttcgaagcaaatcaaagagcaccgaatacttaccgaagtggaaatttacctatattatataatgaaaacaatatgcttagatgcgaatctaatatgttacgtcaaacgagccgttccggtaagaaaaacagtagtggtagcttaactggtagcatgccaaatattcctttaaattctggtttaaacattcagaatctgaatgaccagggatatgtaggggttaaccaagggcaactacagtactgtaggaagacttgtcctcccaactgtacaattcctactcatattaatggaaatatgtttaggaggaaatctggctcaggagttattccatttaatggaaatcaattgggattgggtgttggtggtggttctatgggagtgattggtaatggagtttcaagatctctgaatgatttggcttattctggtatgcccaatattcctatttctggtctaagcaatcagggttactctaaaaaaacttctgaggatgcttattataataagaataaccggaagaatgccattaatcatatcaagaataatagcaatgcttctcattcgtgtaactcaaatatgacaggcggtatggcaggatttggtaatatgaacattcacaacaactttccagctggaagtaactcctgtactgctggtttaagtgcctcttctattgataattctggcaatgacgcatctaaaaatgggcttacaccctcttcaattgctgctttatgggcaaaggcaatgagcaagactggcggtagaaccggatttagcaatagaaacaaacacggcaactcaaattctgcttcaagtaacacagacgtaaataacaatggcacaaactctggctctgcaaatttgactgattctaagaatggagccaatgaaattattacatgcgctagattctcctcatttttaaggaataactctggtagacttcattggcttagagttatgtaccattacttagatactgtggatgccagaaaaattcgtgaagttaataaaggcgacaatctttgtatggttgcagtagatgatatcgcactagaagctgtttcaagatcatttgacccatctgaatgtgcgtactggtcagaaccagaaaatggagcttttgtacataagaatattagacttgctgttgctcataaagttgggcatagaactgttgcgtcaccacaaaactatgtaaatcagatacttacggcatcattagatcatagcgtctctatcttattaaacactttaagagctattgatgatcgcgttcgatggatgtctactgttgttaatagtaaaaatggaagtggcttgcaaattgatctcaagtcaaacaaaattagtaattcatgtgttattccttcagaaggtgagtctaatcagaagatctctgattccaaaaacactattgaaactggctatacaatcactattaatggaagtgctatttctatttcgaatactggaaacgctttaggcggtattgaggaaagcaccaatgaatcaaacacaaacctatcaaactctacaaagaacttccctggaagagtattcactgttggagttagagaagcaatgagatgcttaagacacaaaaaactaaaggctctaattgttgctccagatatcgagggagatggggtagaaggaagccttagacaccatgtaatacatattcttttacaggctcaggaattaaatattccaacaatttttgcactgaataggcatcgtattggaagagcaatggggaaacacatgagaatgagtgttttaggccttctttcaattagaggcgtagagaaacaattccaagcaatttctcatactgcccagttattacgcaaactttaccatttttgcatagagaataatttgcctccgactgaggaaacattcaaaaaactttcctcttcagtaaatatcaattaa

SEQ ID NO: 1223 - DNA, 1512 bp, Cryptosporidium hominis
atgatcgaaacaacaatatctgagaaaaccttttcaccgtcctctagtgaaattatgaggaaggcaactaggctggttgaccaattattgataaaaactagcaacgatttttcaaatctagaaggagctgctctgaagaacaacaatgtttctgactcaaaattagcaatcacagaagatagtatcaatattgattcaaattcgatcacagactcggaaacattttcagctctaactagtgcaagaaagaatattccgagtattgatataattaagaggcttgcaggacgcctaaaaaacaaagattccgatactataagcgaacttaactttccgaataagaaaacagtgtctaatggccaggatgctggtgattactgcctccaaaagtcagagaactgtagatctaagtctgcctcaccaactagtagtgaaaatagagaaaagaacaattatgggttatcgcacgactttgcccagatgaacgcgaaactaagtgaaattaataaaagagttgaaagtttgagtagcaatattgaagatattcaagatgctgacatcttggaagatggaggctatactaaggtcgaaaataaacaagaatctggtagatttgatgatgaaggaaacgcaagccgcagaatttacgagagggacactgaagataattacttaagccaactaaatgtagcagttttacaacaagagagattaagaatgtgggcgaaagataatgcaaaatatacttcatctataagtaatacgtcggagaacggcaataaccaagaatctgaacatattcctttctcagatgtttactatacacaccagtctataaagtataagaatggtgaactgacaagttctaatgatgccttaaattcaagcgtgctttccacaacagtatctggtacagctggccaatttgctcacagcaatgatacaacagtgtacgaagctaagacaaattgcaggaatgcattttcagactttcccagaaccgtaaaagtttgcgctggtggtgaatactcagaaaacaaagattcagaggttggaggtgcttctgaaactatttcttttgaaaggatttccggtagattcactgagcccaaaattttaaggtttattcgtgtcgggaaccagctaagaaggtcaataacagtaacacctctagtggaagacctacagagagtcttaaacgggggagcagcgaatctgggattctcttctaacgattctgactttgattccagaactcggttcaataacaagctagagaaactaagtaactccaatatttcgcctttcaacccatctaaatcaacaagttgcctttcaaacaacatggttatcattacaataaaagataatggtactggattcaagagatctactagatcaaggacaatggatgatacaatctctgtagacagtgcagaaagctacgaaaaaagtttctttagctgcagagagtgttcatggaatcctacaagtgcatgttcaattcagtaa

SEQ ID NO: 1224 - DNA, 1656 bp, Cryptosporidium hominis
atggaccataatcttgaattggggaactactccgattttgattttcaaaccacttcaaaatggatagctaagcactcaaaaggcaaagaaaggctagttgttgcattgcaattttctgtatctgatattaaatatgccccaagaattcaatatcttatagaaaagcaagtaaattgcatagtttcaaaagaagatggttctaaagatcaatgtaatattcgattttttgttttatctgatattgtgaacccagcatgttgtctggatgttttaaatatcaaaaagtcacattcagatttattaatacactttggttacagttgttatcataatattagaaacttccgcctacctgtttactttgtcccatcttcctctgactatttttatgtttcagaatctaatacgctctgcaatattacaagctttctctataaacagctaaataataggcttcttgaggggaataattctttgaaaaggatgaatgtgatactctcattccaaggcatattagagaacaactctcaaacgatattgttggataaaataagaagttctgaattgaataaaactagcaatgatgtagagatttgtatataccaactttctcctataaatgttactgactgtattcaagatcaatactcggaatttatttgtgatttacttctaacaaaattgggacacgacaaagagttaaaacttgatgatttggagaagcgttttgagagatccaaaaatatggcttcaagtgaatctgtaattttcttccactttgtttctaaagatgataaatattctaatcttcctaattcttttctggaaagaattttccttagatataatcaattatttgaaatttttttatgccaagtaaataactcagattctagcatagaactaaatccaaatgctttgaatgagttgagttctataatatctaaaagatttgttgtcattgaaaaggcaaagtcaatccattctgaaaatcgtgtcgcttttgtaattactcctggaataacgcaattagagtggaaacttattgaattttttaaaaggcataattacaggataaacgcagataatgggaaaaaaataaagattgaaactcacattatttctttaactggtgtgaatgaagtaaaattaagaaatttcccagatattgatattttctgtttttttggttgttccgagtattttttatcccatattattaaaaatcttaatttaaaaactccaattattcttacaccctttgaataccaagtatttcttggaattacaaaatggagtacacgttatctaaatactccagacttacaatctcatggcttaaatgacaatgatctttcttttcactcttccatatcagattctgaagattctgaattagatcaagatttttcaaaacttttaattgaggactcagaaatattgaataataacacactttccacgaaaactgaatcttattctttgcaaagtatcgacaagaaaactaaaaagttattgttatcattaaactcaattaaaaataaatatgggcgttcttattttggtctaaatcccttggaaaaccctgatcatatacctaaaattactcaaggaagagatggaatcgcatccatgtacaaaaatgaaataatataa

SEQ ID NO: 1225 - DNA, 4524 bp, Cryptosporidium hominis
atgaataggctccagaaatattttggagtattcctagctgggttgtttctcaacacccttctgggatccgcttctgtttcagcatcatcagaaaccgaaattcctccagctgcatctgttccaagagaaagttgtagtttaggtttctcatgccaaccaacatcgtgcagaggtggctctgtaattggtttgtgctcaagcaagctcgcaaatggttatacattaagattaagaggtaaaattccagattctatcaatatatttgctagtaaatttaatgggattccagtcgaccaaaccaaactcgtcttgagaattattgatgataacaagaagcccttcattgatatggttattacaaaggagactattggatttggtcttgttggtcaggttgatacaacgcatttcgttgattctaaacgtattagtaaaggtataaccattgaaagaaacccttctaatttcagagtcgagtcaggagacgaatttgactattatctttactacaacaatagttatttgacatttttattcaagcataaggatggaaaatactacgaagtaggaagtctatatattttgaacaaagctattagctcaatagttccactcactggtccaatggattataatattcacttcgaacaaactatgactctttccgctcccaaaacttttgttcagcacactatgcctggtaatccaagcccgcaaatatattctggcccattcactgtgagaagaggtactaatgttgtatatccaggtggaaacattttcgaggatggtgttaagattgtaattaatcaaggaataggaagctctagcaatgtaaagcacacgttcattagttacggcgattcaaaaactaaattaacaataaacattacctaccctggtaacaacaaatacaaattccttatccagaatgcttacaacaatgaaaataaagaggtaactttcgatgcaacttcactgaaatatcatgtgagttctggagatatcgtacatttgggttattttttcactgacggacatttacttatctgtattggtgatacctgtttcgcatcaaccgagattaaaggtgctcgaatacataagattcaaaccacagcttggtttacaacttcagtaatgctaagtattccagagcaaaccttaatgggttctgcaattggtaaatacaaatgtagagttggagaaacttcttgttatggttctgaatttagactacaaaacccattatctcccggtcaaaaagtagaaatccaatctctttatgactctggtaattactttaatgattatgcaaacatttcacaaaaagagctctttggagcaattgtaatgggtgacgcagaaaatatgagagcagcagtattcttatctgtaaattcagtttctttaacgttattctcagaaagtggcatcttaacagacgcttgttctgtttatttatctggtaatagtgtgtttaatcaaaaaaatgaaataaaaataattgttggtctttcaaatagtaacagattaggagtatctggatatattggaaacgaagtcttgttattctgtgatttaaatctcggatccatatcaattaccagattcaggccagtaaaggataatatcaattcaggaagttctaaatacacactttctaatgattatcctgccgaaggatatgaaggtatcagtggaggtagttcggcttctagaacacagcaacaagctgcaaactgttatttggcaacaaatggagagtgtaatgcatctcagattgttcatatagatggctcaggttttgttgatggcacttacttgacagtcaaatcttcatcagtcgtattcccattcactttctacgtgaagtcatcagataataactctgatcaacttgactttacgtttatttcaactggtaaatttagcatgagaaatgttaatacacaagatattatttatacaaagatccctccaagttgtatggaaagaattttgcatgaaggtctttctatccttctttcatcagatcaatctaaagtatatgcttccatttgcaatctcttgctcggaagtgttccatctacatctttaaataaaaagcttaaatttatcttccataaaaatatgactggaaatagcgtccgagtttcaacattcccagtatttggtggtagttctgttgccttggaatacgaaagtgaaaaatactctgtcaattccgataatattaaaaaggatgatgacttatcattccattctccatgtgatgcaagaaagtcggtttcaaccagtctcgacaattgttcttccttaattaatatgagtacaaatcatttaacaaatggttactctattattattacaggtactgttgaaaagccatcttctagtctcgaacaagcctttaatattggtattccaattgaaaatgctattcaagttttcaatttgaaggcaagtaatggacgtactatacttcaattctttattacagaagatcaattgggtctatcaatccataatcccatgaccattagagataataatggccatgttggtgccccaatcccctcgagcgtgaatttagaagaaggatctaaatatagaattggtattgggttcaaagataaggcaattaacttattaattgaaaatccatatggctcaggtaaatttgccatgctgagaagaagtcttgtttctgtaatttcagcatggggtgaaactacatataatcgtgacttcactaagtttgagccaattaactctattgtccctgaattattagtaaaaagcccatacagttactctttaagtaacaatgttaatacatggttcccagtttctaaggaattctatgctccaagatttggcgataacagctgcacattaagcatttatggtgtatgtaccacttcaaaggtttacatgccaggtaacaagccggttaataatgatgctaagttctttatcagattttattcattccaaaagaatacattttcactctctttcaaaagagaagatggtactattgtagcgcaacttgaattttcatctacatctacattgtggtctggaagtgttacagtcaaattttctacaagatttgaaagttcaacggatacttatagtgtgaataattttggttctaaagaatttattattcaatttgtcggtaatgctattggttatcatttggatagccagtggagggtattattagcactcgaaaacaaggataactttaatcaggtattagtatctcagctggatggttttgttatagaatatgtcaaaacagatagtagtaacccagctccttggcaatatattaaatacggatccgctacagcaaaagcatctatggtactagcttataatttgtgcaatgcagaaaatccaacatatggatatttctctaaaccaggagtatatttaccagctagttcaattgagaacttatgctctacttcattacatccaaatcatttttctcttattttcaaatcacgttacccaaattatgttaaagatgaggtagcaaagactttccccaatttcccaggtttcttacattcaattgtactattgtacaacggatcagttgtttacacactagttattgccaggaaatatgtttcattcttcagctctttatattctggtgaagctggaacattctcaagttgttcatcacaagtaccagatgaaactgaattccaacctggtaataaatattatattacattcttcgtagatggatccgacttacatgtctatttccacagttacgtagtagaaaagtctgcattattatgtaaactaccatacaaccaacatttcaatgctgctaagacatttggtcaagtatttattgattcaagtcagaccactgcagcaatagcatatggtcttaaaagaacattgtacaatccaagtttaaacgcaagcaatttatatcctatgggcactgtagtttctaagaatgcaattttatcttctggtatgccattttcacccaatgaaagtttgagtattgagatgacttgtggtaaggatttaatattctcaggtcaaacaggaaaaccgcaattgagattaaaaacaaacggttctaatttcactttggaaaatgtcccaggaaagattaatgctactggtacattaagtggaggctgtgtgtgttctaccaacaagaaaattgttgtaaatcttgcatatgttaataaccaattcagattaattgcatgtaaggtttctgctggatccatattcactacaggagtttcaatctatcagatttctagtgaggtagaattgagtgtcacttacagaaccgatttacgtttagcctcggcaacttcactcacatcttcacaaatttcaaaggttgaagagcaaccagatacttcgaaggatgaagagaatattgcaaataatggtaaatacattccagaatcattttcagtacaggctacattacatgttattccaaaatactctgcatcttaa

SEQ ID NO: 1226 - DNA, 1986 bp, Cryptosporidium hominis
atgaaaaacgaaaatgatagcaatgaattgctttcattttctgaactctatggctcaattcttgatagaaggattattcaatctttgaccaataacaattacttggtaccaactaaagtacaagtcgaggtcattaaaaagattattgaaggtaaggatttattaatcaactcttatacaggttcgggaaaaacattggcttatgcaattcctatttgccacaatttattaaatatatcaaatagatcagctaataaggtgtattcattagttttagtaccttcaagagagctagtaatccaaactcatgaagtttttgagcagctgttggttttctgtgagaataatgtttctgttggaactatatttaatgcagatgataatttgttacataaagggaaggatctgaaatatggtagctttcgttacaatatattgatttcaacccctggagatatcttatgcgctaaaggaatgggctcaaaggagatgatttttcaaaatattgctcatttagtaattgatgaggctgatttgttatttgcttttggctatgacaaagatatgagcaaagttttggatctacttccaaattctcaagatagaaagtatcaatgtatattgctttctgcaacattaaacaaggaagttgattctctcaaaaaaatggtccttcacagacctatttttgttgatattaaacctgaaattaaggaagatgatttcaatcaagaaggtaatgattcaaagtaccaaacctcaggattgttaagcgagtactataccatttgcgacaacatggtggataaatggttgatgctctacattcttctgaagatgaatgtaattcctagaaaatgccttatttttgtatctgaagtagatactgcatactcaattaagctctttcttgaaaggtttgggatgagttgtggcgttctcactccaattattcctgctgcaactaggagaatgctaatacagtgctttaaccaaggaagctatgacattttagtaactagtgacacaataaatgaaaaggatgaatcagtattaagtattttaaaggataattcaataacatatagaggggtggactataaggaagttgcttccgtatttaattttgattgtccaagtagtgttaggtcatatattcatcatattggtagaacagctagaggtggttcttcaggagtttcaataactattgtaaatagtaacatacctaacgaaatggaagtattggatgagcttttaaacgatagcaaccgaaaaatgaataaattgaagatcacatccgaagaggttgcctgcttcagatatagaattgaagattgtatgcgaattttaacaaaaggtaacatacaaagacacaaactccaggaaatacaagggcttatcctgaacaatacccgtcttcttaagtctggctattttagtaagcatccaggagataaaaatgtacttaagtcttaccataagcatattacaaatgctttaaatatttcaaattctggaagggagcacattaagaatatccctgattatttatatgatatggttaataataatattttcaatactcctgattttgctttagatcaatcttctatgccaaatgtttcaatggatagtgtactttctaataccaataatagtagtcatggtggaagtttgacagaaaaggtacaagaggctattcgtagaatgggaggcaaagatttccagtttgttaaagaaaataatcttaacccaacaaatgtaaacaaagctggaaatttaaattctggcaagaagagaattataagtcgaaagtctcagcttaagaaggaaccaaagtcgtacgaaggtactgttccagatgagcttccggctatttcaggccgtaagttatggaagcttaaacacaaaaaacgcgttaagaagtacaaagactttattgatgataacaaatacaggaagaaaaggagggtaagaagataa

SEQ ID NO: 1227 - DNA, 3717 bp, Cryptosporidium hominis
atgcaaataaatgcaaacactgatgattttaatatagtggaggaggaggttggcagcttccttgcaagtgagaaactccaatctaaacatccaaatacaggatttcctgtagtatacaatcgaaaaaaattaaaaaagaaaggtgaagaaggaagtaaagaaacagatagagcgaataaaagtccaataaatgagggcttcgagtcaaaaacccctttaatttttaactttactcaaaatgatattttaaaattgcgttggacaaatccattaggcgaggatgtaaatgattgggaatctccaggtaaatccgatatgaatcttcacaaccttaggtttgattttgaaggctgcctttgcgataactctaactctgaagaaaagtataagaacgataatttatatttttacaaaggactgcatcaccactctgaacaaggtgaatatgaaggatacaccattcctgaacttatgcacctctctagaagcagcaatgtgtctcaaagatgtatagcaattcgtactttaggaaaaatttttattaaaataagagagtaccatacttttaaccaccaattcgggaaaacttatcataaatacttgcttggatatttgtttggaatacatagatggtataagtatttaacaggagatctttcaatccactatttgttactgaatatgctatttcatgaatcttatgcttcaagaactgcagaaaactcagtaatagctttaaacaatttacttactggtggacaatttcccatcagatcaaccaaaaataatataccagaggcatgtcaattcaagctcttaagctactttttaaccccttcagagtttgtttttgaaattttagatgaaaaattggtttacttcccttcttatttcagaaacaacattattagtcagagattagagttctttacgcacttgatgcaaaaacaatctcttggtataagatataacgatttgcaagatgaagaacatcttatcagatttgacctacctgatggaaggagtctagagctactaagagatacaatgcaagagatatttaagtatgtaccaactaaatacgataatagtgagttatcagttcagaagaactatttattctcttttctttgtagaatggctcaaaataaatgtggagccttggaatctcgtatatccagcataaatattattaggctctttattcaaagagaatgtatttatgaccaaagtatttctcttcaatcattagaagatatgataaatgctcttggagatgaagtttttgatttttcttcatccgaactagcgtcccaggagtactctaactctcctatggccaaattactcttcagctttatttatttaattagtacttatactcagtcgctttattgtattgataatcgtattgaaaacaaatttgtcagtattcaaaatgatttcttaagtaatttccttatcaaatcagtactcccaattttaagaatagttattttagctgtttgggatcctggaaaattacactcaagtggaataagtgaatttattcaattaagccttgttgaaggagtaaaactgattggtataatggcattgaagaatatttatttagaggatttgtccattttttgcaaagatctcattaattacctcacatttgtagatcttaaagactcaattcaatctttcataatatatcatttatatggactaggatgtaatctattgcttttttctaaataccatgaaattgaacacgaacacttacaatttattcaagttctgaaccaactcattggaaaaatctttgaaaaagttaaaatgattagaggtaacttatctcttggtagctatgaaaactttaatttcgtccttttatcaacatcaattattagattccaagttctcttaattgaaagatacaactccaactccagctttgccaatgataactttgaaccacacctcgaacttatcagtttttgcgaaagttacctcaaaactcattcaaagcaggattttaacatagatttactcacattggaaagtggttttctactcgaaattgaaatgggcatcacaaattctcaaagtattttgtcaaataataaaacctatggagatttcttctttataattctgatctcaacttttttaaaggaagtatctcggatacacttattaactggtaaaaaggaaatcatttctttaaatttcaaatacatgaaaccatcatttgatttactatcagaaatgtatcaaatacttactgaaaatcatatttttccaaattacataagaacagataactcagacttttatttgaagtcgaatcagcttttcagttacgaattatgctattttgaagctcttaatatgaatgatagtcagacaataattacaaataataatgttgttaagaaaaattcaatttacttacagtccttaaactctaatttgctttatatttatcttcttttgtcaacatacaatgaacacattaaaaccagtaacattgcaatacttgagtcttcagctcctaaatctagtaaagtaactatttctaaaaataataaattgatttttgaaatcgaaaattttaactataactccaaaattctatatgaaaaactatttatacttcttttcgctagcaaaaatcttgaggagtattctattaccttattttggattcttaaattggataagcaaatctcagaaccatttgatgatttctatggtagagtattagacgaatactcgctttgcttgaataatacaaatttattaatattcaatccatttatttactccgtcaatattgtatattatcagattacagccatatcccaagaaacaacttctatagaaaatccatttcttttctccttaatgaagagagttttgaataaacaactactttctttggaaatttccaaatcaatgaaagaattgattgatttcttatcaaagtatatatttgaatgctcaataaatcaaattattaatatttcaagatcaaagtatttagagactgataactctaattataatttaatgggaagcactattttagattatttaaagttttcattagaacttcagaattatgtccatatgaataaagaaaagtctgttaaggaaaatgaaaacttacaggattatttattagagatgattcatacctggagacaaaacaaaccaatttgtgccaaaacaatgtacaacataaacaataaaactgataatgaatgcttattaaagcttattgactcactcatttcagccttttgtgactcaaatatatacttcccagaacagttgcttgactgcttttatttcatattcattgtttttatatttgaaaccatttcagatactggctttatattaaaaattctatctaatattaagatcatgaaatttctactatatcacaataagactgatatttcatatatattttggcaatttaaatcaaatacaaaaatgattgaaacttccgataatggaaaaataattaatttaatttcagaaattgtcacctcatttaaagattcagtttgcaaaaatacattcttggtatttttggtagtttatattaactatttttcaggctcagagctagaacttattgaggagatgaaaaaattctataaagaaacgaaattggagtatttaaagcatgtattagatagtttaaacgaaaattaa

SEQ ID NO: 1228 - DNA, 1101 bp, Cryptosporidium hominis
atggataatcttgaaattctttcaaattcaatcaaatcaatcccagattctttaaatcattttgctattaactcattttattcgtttatttattctacatgcaatactatccccttcaaggaatcagaaaatagctcaacaaaactctattatagtttgggaaataatttgataattaaaccatttaatttgaatgtcaatccaaaaggagatttgggtgattacttgtcccaaattcggggtgagcataaccttacagcaattacttttgaaaaccataaatcaagtttagaagcaattactaagatttggaatgaccataaagaatcactggaagaggccataaatcatgattctgactctaaaggtgttggttacaaagttataaaattagaagatattccaaatgataaaaagcatgttacttgctgcttttttggacatactactgattcaaatactaaagataagtcaaatattgaatctttgcttattagcaaaaccatttctaatttacaagttttgctttctttaccttttattggcagaagttatgacttccaagtttcatatttgatttttattcacggttggaaattggcattcttgactgtttctcctatgtcaaaattatttgaaattccatcaaatgagactaattatgatattataattaatgaaaaacttcctaatatttcagtggaaaatgaaagtgttaaggaatttaattcaaatcctgagattgacgaatttgaaggaattggtaaaaagacaagtttgtttttaacatccttattaccttttagagaaaatgggcattctcatattactttaatttctgaaaaatttaatcctgtaatctcaaacgttgcaattaaccttttaggtgaagacttttcaaaattatcaaacctggatacgaatgaacatgggatacagactttggaagttcaagtaaatgaacaaccattggagggaattctgaaaaaaggactaagtgaagatgactctaaactggatcctgtgaaaactctaagaattttagcaattagactttgggataagaggataatgctaaaaggagatttaggatatatgtga

SEQ ID NO: 1229 - DNA, 1203 bp, Cryptosporidium hominis
atgagaagaaacaatcccgaccataaaactccagattccgacaaaaaggagctcagatcttccaaagattccgttgttatttacgaggatgaatatgaaagggaaaataatcaggaaaatgaaaacaataggggtaatcatagcgaaaaaccgagagatatcgacaagggaagtaaaatcaaagtaaaccttggaaatataaatataaatgggaagaaatgtgactgggagatagagagtgggaatttaaaggaaaatggggaacctggacaggggaacctcagcaacgacgaaagtgctcacctcctgaaaaaagaacggcatgaacaaaaaattgatatccaaaataaaacagataacgaactttttcaaaacttaaagaaagaagcggtgaattcgtttctagaagtaaaacaggacctattggagcagtatttagagttcagggatcaggtttttaagggacagaaatcattcagggtcttatctcaggtagcaaccgcaaacctgttcttgatgggtaccctaaactgcatttttggactgatctcaataaacttgctagcaatagtcatctcgctatatattatatccatatcctctgtggttttaatcattgaagtatctaaaaagaagcgaatcaagcacatagagatatttgttcgcacttggttcaaattcctagaactatcagttggaagaggatctatacaaattctgctctgcaccatttctctatatttaactcaatctacatacttctcactcatgtcactatttgtagggcttacaggaatacttaacattatatttgggatattagcagcgtcaaagctaagaaagattctaaatatcctcaagtattacgggagcagggatttagaagatctaggtatttataatagagatgaaatttcccattctgaattgggaaatattaaaataagcaaagatcatgaccctgaatataagcttaaaaaaatccaccgtttttttaatgctttggatgaagatggaaatggccaaatcaaccaggatgagctattcaacggattaaagtcattgaatttccctttcagtatttcaaaaagtgaaatagaaatcatattcgatcatttggataaggattcagataatatgatttctattgaagattttgaacattggttcatttctaataagtgcccctattttatattgtaa

SEQ ID NO: 1230 - DNA, 5316 bp, Cryptosporidium hominis
atgcttcattggttaaagttcttgcttctgacttttttcagtttatctgaactaatttgtagtcaaataaatgaagctgatgcttcaaatccactaactagaaatgcgggaattcttccaagtatgaatgaaccttcagctattgaagagctattatttccagaaagacaagaacaatctaaaggcagaccttcgctaagatctttacaggaaaaatctaacaatccagaaaaggcaataagctctgataaaaaatccgaaaaaggatgtgttttgtatttgtatacccaagattctccaaatcccacagaaattatagatggtgcctcctcctgtccagaagaagggaatagaggctatatgttacaaagtggggttgaggatgaggcaatatctggaccttctaactcaattgtggaaatctctccaattgttcaagaatacttttgtattaaaagatcaaattgtatagttgctatatctggagtaggtctaacacaagatgattcaatttacctactaaaaaatgaagattattctccagagaagagtattaagcaaaagaacttattacttagtgatattctaagaaaatgccccccaaatagaattggcttgggaccgtttaaaggagtaagatcatacgagacttcagagctcgttattggtgataatatgcaaaaatctgctactaggcaggcgacagtaatcttcagtataattgggattaaagatgatgctaatagttttacaatttgttattctcctgcaagaagtagagcatttaaggataccatgagcccaaaattacatatttattcagctggtttattaactaccaaagaaaactcatcttttaattgtgattttgagctccaaggttaccttggttgtggattcagctctcttttagactaccaaacaaagacaagatttgaacttggagttggtgaagaaactatagtggggtcgagaccagaaagtgatacaactacaggagtaaagggagaagggcactatattttctttagagcaccaggatatatgccaggagcttcagcagtattgataggaaatccaagggtatatagctttggtagtcattgtctaactttaagatatttcatggcaggagctgatgtaaatgtattaaggatgtatatggcgtcaggtcttttgaactcagttcaacttgatagtaaaggaaatcgtctggaaaacaaaatcccaaaacctacattgcattatggacgtccaaactggcttgttgtaggacagcagggtccatcatggtcatggcaatttggggggtttgaattctattctgatggtataactcccttgagaatgattattgagggagttggtggacgttctgaggatagcttgattgctttggatgatattattgtaaaatcagggcattgctcaaatgaggtaatgagatctagtgagagagaggaccaaagatgtgtatggggagaagtgaggcttgtaagtagtaacttcacaactgagaagtcttgggaagtagagggagctttgggatgtagtggaagaacctactctttcaataatattaatgtaaattctgaccttgtttcaagtactgactggattccatgctgtctaccaggatatggaaactacactgtaagtttacatgattcttacggagatggatggaatagtggaagctacttggaattcaggttctttgatgaagtgattaaggttggagaaggattcaagcaaggatctagccttaagactgaattaagcattggttcaatacagatagaaaaggttgaagcagatgaaaaaacaattagagctacaataaagtccaacagagagggagtggatgtttggtgtggaattaccagagcaggagctattacaccaacagtatcagttcttaagaaatatggacaaagagccccgaaatcgttaaatataaaggagagtcatacatttgttatttcatcattttctaagggtgaaattagaccaaatacagagtacgatctcttctgcttctctgaggaagtcagtagaatcattaagaataagggaaatactgaatctgcttctagtgtggatgatctttctgttgaatactcaagaataagagtaactactgattcaaagagcccagaacttgaaataaagcaatttaaaacattagaggaaagtgttgagcttactttaaagattaatgaatcaggaacgatttggtgtatggcagacaataataacaacttttcaagaattagagatttggcaaacaaagaccatattgatgaacagagacttgtaaaacttataaaaagtagtggagttgagaaaaatatctccagtaaggatattattggagatattaaactatcaattcggaatttaattccatccacagaatatgatatagtctgtttggcagaggatttagcattaccaagatcaaatagaataagctttgaaaaagtgttggcaaacttaaccaagagagtcacaactaaagatagagttccgaaaattgagatcacgaggattgtaccggaacttggaagatttaatattgttgtaaagagtgatactcctggaaagataacttgtgtagcaactctaccagaaggtatgtatccaagtccaagcgaaattgaaaagtatggtcaaaatactgaagtgagtgatcctaaagaagaaaagcaactaattttgaatggaattgaaggcaaccaaaagtatattatttattgtatggctcagagtaggacaggactaacaatgactatctcagatatatgggcaacagcaaaggatatttcttcttttggaaagttttgtgatatcccttcatacccttcagaagtagaaaatggaatggaaacaccttttgatcctttgacatatttagaagaaatgaaagttaggagctactttgactcagtaaaggagtcagttgggtcaaaaggtccttatagggtcacattatttgtgaataagaccgaggcatatgaatatttggattccctagatctccataaaaggactccagagctttacccaaagccaaaccctccagagagatatgcaagagttaggtttggatcttgcaatgaaactgaaaatatggttgattctcttggattgaatggtctttaccaccagtggaaagttggacctattattcttaccaaaaaagagactgagaatataggcttatggaatgtcgcagattcaaatgctactagcaacgtaagtgaagatgagaaaattatagcaatgaaacattatccaatatctgagccaagaccagtagaatgtgatggctggaatcctactggaccttttgggaggaggctggagcagattataataaatgatgaaggaaaaacaagattctcaattcctatgctgaaattgggagagcttttggaacagaattctttggataagatagtattcgaaacttgtggaaattatcttcccagagaccaagtagttggaaaggattatgtcaagttaggtccaataatttatcaacctcacaacgttacttcagagaatgaggaagaacaggaaagaaaagatgtagatgaagaagatgaggatgaagatgcagagccgaagctatggataggcttgaaaacaaaggaaggtaatcagtgtccaatatttttcgaattgaaagcaccttatacaacattagagagcattagaaatggccacgcaaagatagagtttgacaggatgcatcagatgttggtaaataggatttggtacgatggaacttcttttaaaactcttcaggacttggttagtacttacaatgaagctaaagcaagtattgaagaaagtcaaagctcaggtaccccatttagcaaccttcctttaaaacttgtaactccaaatattctacaagagagaagaatacaaagagaaaaacatatgaatgaactaaggctaagaaagcttcagttccttgaaatgtttagtagaggaggattggaatccagagctaaacctgaacactgtgaacctggaggtagaagattccaagttttcaaatcccctaatagagaggcatatacagtcaattggatcggatgggagctaactctcacaaatgatcgtgatagtgggctgaaaatatggaatttaacatttttaggaagaagagtggcatttgaagttgcaatggtggacgcaatggctcattataccgtatttgaaagacagtggttcttcttggacagttggtacggaggtttaggtacagcagcaagaaaagtccatcctggtcttgaatgtgcaaacactgctcagactatcttctgggataatagtgcctgtatcttcgagttagatactggaagaccaattagatcccattggaaatctggaggtattaaagatgctgcaccccttactagtctagttatcaggcaaattattacagtctccaactacgattacattgtagaccttattttgtataatcagggatcatttgaaatgggagtcagctttacaggtgaactatatgcaggtctggaagtaccatatttctctgctaaacaaaagaaatacgggactcagattactccatctggacaaatggcagctttacactctcactttgctgtttggaaggtcgactttgatcttggaccagactatacggataactctgtagcgtgggtcaaagtaaggagagatcctgagaaagaaggacaccatatgttggagagaattatagcagaaagagaaacgaatgcctattctatgctgaatgaaactcatcatcatcctaaagcatactttgttgttgatgaaaaattacaaacttatgggaatgttggtgggtttatgataaaatctattaaatctattgcagacttgatgcctgaacacgagctttactcaggaccagcatcttggtcaaagtatgatttggcttcttccgtgtttaagtactcagaacttgatgcagatcttccaagagataataaattcgcttcaaagcctgctgtcaggtttgattcgttcattatggatgatgaagttatccgacatagagacgttgtaacttgggttacatctgggatttggcatattccaacattggaggatgttcctcaaactacagctcttggaaatactttaggatggtatgcaagaccatttaattggtggcctatggatccaagtattactcttcacaatgcagtcaaaggtgactttattgagccaggtacatgtgcactacagaggaaaggaaatctattccagctaataaaagtggtcgaataa

SEQ ID NO: 1231 - DNA, 2052 bp, Cryptosporidium hominis
atgtctatgataattaatagtagctttaatggggtggtgaattcgtctggtattgcagctggaatacttaaaaggagccttccgttagtgttttcaaggtatatgagctcaaaatgtgaaggtaaaaagtcttcaaataggagaattactggtgatattgtaggaattgatttaggaactacaaattcttgtactgccatattagaaggtactcaacccaaagtattagaaaattctgaaggaatgcgaacaactccatctgttgtggctttttctgaagatgggcagagattggttggtgaagttgcaaaaagacaagcaatcacaaacccagaaaacacagtttacgcaacaaagaggctaattggaagaaggtacgaagaagaagcaatcaagaaggaacagggaattttaccatataagattgtcagggctgataatggggatgcttgggttgaagctagaggtgaaagatatagcccaagtcaaattggggcatttattttggaaaaaatgaaagaaactgccgaaacttatcttggtagaagtgtaaagcatgctgttattactgtgccagcttactttaatgattctcagcgtcaagcaactaaggatgctggctctatagcaggcttaaatgtaacaagaatcattaatgagccaacagcagcagctcttgcatacggaatggaaaaagcagatggcaaaacaatcgcagtttatgatttgggaggaggtactttcgatatttctattttagagattcttggcggagtgtttgaagttaaagcaactaatggtaacacttccctaggaggagaagactttgaccaacgaattttgaattatttaattcaggaattcaagaaaacgcaaggaatagatttaagtcgtgataagcttgcattacagaggttaagggaagcctcagaaactgcaaaaaaagagctgagtagtaagactcaagttgaaattaatcttcctttcattactgctgatgcaagaggtcctaaacatctacaaatcaaactaagtagagccaaatatgaagaacttgttgacgatttattgaaaaagactatttctcctagtgaaaaatgtattcgtgactctggtatccctaaggaaaagattaatgacgttattttagtcggaggaatgactagaatgcctaaagtttctgaaacagttaaaaagatctttggaagagagccatcaaaaggagttaaccctgacgaagctgttgcaatgggagctgctatacaagctggtgttttgaagggagaaatcaaggatcttttgttactcgacgttacacccttatctttaggtattgaaactttgggtggagtttttactcgattaattaacagaaataccacaatacccactaaaaagagccaagtattctccactgctgcagacaatcaaactcaagttggaattaaagttttccaaggagaaagagaatttgctgctgataataagttgcttggacaatttgaaatgatgggaattcctccagcacccagaggggttcctcaaattgaagtcacctttgatattgatgcaaatggaattatgaatgttggtgcaattgataagtcaactggaaagaaacacgagatcactattcaatcttctggaggtctaagtggtgctgaaattgagaaaatgatcagagaagctgaagaatacagagcaaatgatcaagccaaaaaagagcttattgatctcaagaatgatgcagaagcctttatctactctgtacaaaatcaaatttcttctctagctggccaaatcaatacccaagaaaaagatagcttggaatccaagatttctaaattacaatctattttacaagaatcttcccaatcttcagactatgaatccgctattcagagtattaaatcacaactagaagagcttaaacaagcttcttgggcaatcactcaaaaggcatataaaccaggtaattcagacaatcaatctagtgaaaactatgctaatcatgaggataattcctatgagtctcaagattcagattcttaa

SEQ ID NO: 1232 - DNA, 615 bp, Cryptosporidium hominis
atgaaaaggtattacaagaatggaagttcaggtttgagtagtgtgttgtccattccaagaacaaatacagattttgaagttgagacagctgctaccaagagagaaagtagagagttcccaagtttaccgagtactagtattgagatagatcatgatgaatattgcgatatttcaagcgcatctttggattcagtatgtatcaaggatttatctagattggagtcaaattctttagtaaaaaagggagacagattaaagtacaagactgtttggatgggtccaggaggaggttattcactaatggaggagtatgtagaaccaagaaaatgtatggaaagggaagttcctaaagaatctgagatggaacttaaaagatatagacagcctggatcttgtaagaatagtaaaagcatgaccaacttagcaagtaactcaagcgttcaggttatggaagaagctagtattttaaaggaagatagctacatattcaagtcttcaagatctctagcaaatgttgattggaacaagcaggaatttgttggaccacttccttttcaaaataaagtagccataggaaacagaagttgtttgggtagaaacttgatcccattataa

SEQ ID NO: 1233 - DNA, 1755 bp, Cryptosporidium hominis
atgtcggtatattatcgctttttacatgaaaaatcggattcatatcgtgctattgagctaaatgtaacttcagtcagaacttcagacttgaagatgcttgttgctgaacatgcaggtttgggtaaggaatatatgaaactttttgatctaaaggtatttgacaacgatgaaaaagaagcttttcctgacgataagttattgccaatttactccagagtagtaatacagcgtataccttggagggagcttaaagagatacaccatgatgctcagagaagtattgcagaaggcgaggagacagaagttgtagaagaaacaaaactgaccttaccttcggaatatatctgtaaattatgtggatttcctctactaaatccagtacttattaaatgtgctggaagctgtggagcatctgcatgcagggactgtgtaaagaattatcttgagcaaaataaagctgtggccgttaagccttgtccttcctgtggacaaagattcagaggtagtgtacctaataagagtcttgctaatatgttagcgaccatagactgggataagtttaactaccctgttagaaattctgaagctgatgtttctaaggattcagattatttgctcaaaaaccaggacactagtatttctggagaagcgttaacacatgattctgtttccgtagcaaaaactgatcctgaattggatgaagtcaagataagtatggaagttagtactttagcacaaaatttaaatcaagactctagttctattccagtgggagaaagtttgcaaaaagacttatgtgttgccgaaactaatactaatgagagctctgagcacaaacttgcaataccacaagcttctaatgttgactcaacttataggaatgaaggaaatgtggcttcaataaatgttcaaagtacaacagacgagagcctaaacgcaacttcttctgctatagctacaaacttaaccgcagaattgaagcaactctctccacctaacattactaatttgaatgaacaaagtattgaaacttcaattcctataatttcaaaagcaaaagctgctgctccttcatactctggtttgcctgctcctgtattacccccacaccatgctcctccccttatagctactcaccagcttccgccacaccctggtattcatgcaccacccccttttatggatccttggaacatgcaaggacatccctatccagcatatgctccagatggtgcatcacaccatttccatcctggatatcctggagctcctttcccacagacagggcctacccatccatatggatatgtaattcagcctccaaatatgataaatcctggtatatacggtgctcatgcacacttccaaccatttgttgagccaattttgccgatttgcggtccttacttgacagaagaacaacaaattcaacttgcaatgtcgtttccaatgctatcaaaagaaaattttgagcttatcaagcaggcccaacaaagtgttaaagatatttgggggttgctcccaaaatctatccgctcatctcttctccaagaaacacaagattttgggaattcaaatgaaaagaagagcaagctattcaagaaaagaaaagattataattataatactcaaaataacataattaacaataatggagtaaatccaatcaataatcaccataatagtaataatagcagtagtaactctgctcactcatatagtaagcatccaagccttaaaaagaggtctgtataa

SEQ ID NO: 1234 - DNA, 786 bp, Cryptosporidium hominis
atgtttgaagctagattacagaatgccatgctatttaaaaaaatagcagaagctcttaaagagctttgccatgatattaacatagattgtgatagcgatgggctacatcttcaagccatggactcttctcatgttgctttagtatcactgaatatccaaccagatgcatttgaacattatagatgtgatagaccagtagttcttggtttggatatgcaacaactctctaaatttatgaaattctgcgataaagatactagtatgactcttaaaaaatatgatgataatgaagataatagaattactatgtgttttgaagataatagcggaattctctcgtcaaaggaatgtattttaaggttaatggatattgaacaagaacatatttcaatcccggaagaggaatacgaatgtaatgttacaatgccttcaaatttatttcagtcaattgttagagatatgtcaggtattggagatgaagttagtcttgaaattagtggaaagtatatcaaattttgtgtggatggtgatgatggaaaaatcgatcttaattttcctcttaatgatagccctgatataactaaagcagtacaaattcatgctgatgatacaatttcccaaaaatatgcccttagatacctctcatactttacaaaagcatctcctttaagcactactgtcaatattagtatttcaaaaggagtaccacttagattacaatttccacttaatgacaaatatgaacatggaaacatgcaattttatcttgctcctaaactaagatga

SEQ ID NO: 1235 - DNA, 933 bp, Cryptosporidium hominis
atgtatgattcttttataagattaagattaagtatagaagagctaatatttaaagatataaagtatagatcaaattatgatgaagaaaagacaatgattacaattaatagaccagattgtgttcatgatttatattctgctttattagtaatatataacatattatttgattggtatatgatagatttgagatcaatagaaagagagctggatatggggattaataaaatgatttatgatacaataataaattcattaaataaattatattttgaattattaaatggattaaatttagttaagtttgatctgtttcaatataatatttatttggtattatggattcaattacatgttagaaaggaattttcactacaatttaaagataatttacaatactataagaatgaattactttctcaatgtgaagatatattggagaaatatgtaaaaattgagaaaagcaaaaataatgcattggaaagaagagaaaaaggtctccattctgatgattattatgaaaagaagagattaagtagtataattagtccaaatatacattttaaccatcattttaattcaagttatgatcgtattctcaagaataaagtagatattgcctattcatttaaggcagttttgaatagtttattaagtgatcttaaagaaatgaaacaatctgaatatataatgaaaagttctcgtttttataaggtattattggatataactctattggaagatcaaaatctacgaatattatctagagatattctaattgaattcgcaagacaggagaaagacacaattaaatcttcttccttatcatcaccatcgccatcaccattacctttatcaccatcgtctttaattttatctttgccttcagaagaacaaatcttaccaatgataagtgattattcttcatcttag

SEQ ID NO: 1236 - DNA, 2136 bp, Cryptosporidium hominis
atgaaaggtagtttgataatggaattaaatcataaccgtttggttgaagtagctttgaatgaagaaaatgagcttttgatacttcggaataaattaatggaggttaatgaaagcaatgtgacatcaactgaatctattgattctttatacttaacatatataactcttttaggttacggtaaagaaatggagttgggattgagttacaaattattatctgataagatcgtgggtatttccaaaatgatggataatacgccattttctataggaaaatacttgggttttacattaatattgagtatttggatattaaagagtcaggattggtataatttagatgatctcagtagtacagacatctgtaatgttattataaaattattggttgaatgctgtaatggcgaaaatgttatttctaatgaatttagagataaggaaaaatgtgagaatttggtaacttctgacaaaagttggatagaagaatggggtgaacctacaaattcttattttggagcaagaattaatggggaagaagaaactgttgggttaattgagatgaatgatgaaatagatatgaatataattaatattcaaagtcatccagattttaaaataaataaaaggagaagactaaatgggatgattagtggtgaatatgaagatggatttaaatatattatttttgagataaccaaaattaatactgagagtcttaatttactatttgataaggagtttagtgatgatttatttacagcttttcaaaatattaatttccaagatattacccaaaaaaatattttttttaataagatattttttttaaattcaatgatttgcttttatagatgttctggatcatttttaacaacagctcttcttttcaaattaccacgtggaagatatttacttgaaagtggtgtagaaatggttgcagatcatcttttgaaggatataatatattcttaccaaggtaatacttctgataagacaaaaagaatggaagatcacgcaattttagctcttgatgatatttctacaatactttggtttaaaacatttgaagccaaaatttcaataattttggaaggcaagatacaagaactttcaaatgaatctttagaaaaacaagaagttgacaaagaataccaaaaattggaacttttaaatgaccattctgaactaattaacaaggtcttctcgaaatttattgattataacttaaaccaatcaaatcaaattgagtttcttccaaaaatatttaatagaataagagtaaaacaggttaaatctatacttgaagtaataaatacaacatttaatattcccttttcatctagaaaccatttcatggctcactttcatgcaagtaatatctcaaataaacaaatactaaatctctttttcaacattggttattttgctcagctttctatacaaaattgcttttcagaaatagatatcataatcccaattcttaaaacttataatagcacaatttttttaatttcaagatttggagaaagctctacaaaacaattatttattgaggaattaacaaatggactaaaccataaattaacttcagttgattttattcaaaaaagaattagagacttattattttcagatggaaaaattgaactatgtaataaatcaaattctcttcagtattcactcttcaaatttgcatattgcattatcctagatattaaatcaattattttgaaatttaattacaaacaaaaatctccagattcaaaaatgactaaatcttctcttgtatttaatcgcattaacacaagttctcaaaatacctttaattttgaaaaagttatttattataaaatcgcatcttttttttacactataaactttattaatattatcttggatcgttattctatggaccctaaatctcaaaaaaaacctctctccatttttattgaaaatttttttttaaattttctttctcaagatgaaattaagcaaatatatcacttcattaataatgaaattaacctttataacactgaaagaaaattttttgatcctaatctcaaatttgagattgatttcattaaaaaatatctctcaaaattttccaataaaaactgtttattggaatattaa

SEQ ID NO: 1237 - DNA, 1050 bp, Cryptosporidium hominis
atggaaaaggctgaaaaagttacttctattacggatataattgccagaaatagtagatccaaaggaactactgaggaaattaacccaaatattgaaaaactacttagtgaatgtagtgataatccacgcattttagctcttaaaaatcaggaaaagaatagatctgaaaatgtagcaaaagaggaaaaacctaaagaatttactaaggttaaatatgataaaaacaatgatccaaggattgaaaacacactatttgttggaaatgtagctctacatatttctgaaaaagaactactttccaaattagaaattaaacaaggtgaagtagaatccatgagatttaggtctctacctatacatcctaagtttgcttcaaagaaaaaagttggtgcagctttggagtgcttttctggaaatagtagtactaaaaatgcttatattgttttgaaagaaaaagaaaggatgaaaccaattattgacaaattttctggaattattttagcaggaaatattcttcgtttaactccagcatctaaaggtaatcaattcagcacttttgatcgtaagagaactgtatttattggtggattaccaaagttttgtactgaagatgaactacgtagatttgttacaatgtcactaaatgaagactgtgttcattccgttcggattataaaatctgctactactggtaagcctaaaggttttggatttgttttatttaatgacagaaagtttgtcatctcttccgttaaaatgcttaatggtgctcaatttaaagattccaaaatatcagttactagagctttatctgaagaagaagcaaaaagtaaagctaattcaaaaaattctagaagaaggatgatcagtaatggaacacaaagtaaaaataaagaaggcgatgactcaatgagagaaaagagatttatctccaagaagaatgccaaaaataaggtcaataaaattaagaagaaacttaagaaagttgtcaaaaaggccccaaatattaaaaaaactcccaaatctaagaaaggtaaatcaaaagcatga

SEQ ID NO: 1238 - DNA, 366 bp, Cryptosporidium hominis
atggcagagctaatacttaatagaatcagtgaagccttagggtttggaacaaagtgctgttcaaagtgcatttttgaaggagaaaaagagacattacaatgttatgacttggatcctcctcagattgtcaatgaaatttcaaaaattaataacaagaacactgtaataggacttgattgtaatcaaaaggaacatgaagaggatttagctcgagatgcagcaagaaaggtctttggaacagatttagaaaactcatcaacaatgaaaagggaagagagaattattcaagaggagaacaatgtgccaaaattagatttattaaaacaggaaaatcagaaaacaataaaatttgaagattgtaattag

SEQ ID NO: 1239 - DNA, 2823 bp, Cryptosporidium hominis
atgaagactctttttatgcttttactatttttcatatatttatcaaatgagaagtatcaaacagggggattttcttttccagaggaatgtgaatcctatagtagctgtagcgcagatgaccatggatcagaacttaacattatggaccaatcccactggattagtgaaatatcacaacaatctacactaattccctactccaaaatcttttatacttatatttttgaaccactctttgataatgatcaaccaaatgaaagaaattctgcattctttggattcctccttaacaaagtaacttttgctatatgcttacttgtatggtcctgcattctttttattgcttgtggaactgttgctgatacttacatttcatctctaatgattaagctagctgaatgtttaagcctatcagatacatttgcaggatctacactcttagcatttagtaatgcagccagtgatgttattctcggaattattagtgtatcaattggagagaaagatgctgtagatgtgtttcttggggatgttattggtgcttgcttatttattatcttggttgtttttgggtgtgtaatggttttttcaaagagtagtgaaaattcaaattatattaacattccaatatttaatcacctaagagatacaattgctcttactattggattaattcaactacttattattcatcaccttggattcatttcttcaaaaatgtctgtaattccattaattgcttatggattttatgttcttttacttcaatggagtgagaagtctacatctctttcaatgccagtaaacctaacaattaaggaagaatatgtaggtccagtctatgagcaagtaactgactcagatgaagtaaggggaggaagtaaattaagccttagaaatgttgctatcactagtgatattcctaattatcgctattcaaatactattccttcaattcttccaataccttttactcctcctgattcaattagagatgttcaaaaagcagataatggaaatactccagatttagagatccctccaattaagttatctttttctaacttacagttttcttatgatgaaaaaagccagctcctagaaaaaggaacagttattaatagtgatatctactgggatagaattggctccaagtctaggagtattaaaaagaccttacttttgcttactccgactcattctccctctcctagtctaacaaatgatgatctaagcggtaaagttctgactccttcttcaaattatggatttggaagagataaagataatgaagactttgaaaaagcatatggtgttaataatgcacaatcctgtaggattccatttcctcagagaaattcatctaagaatcttttaaataaagagaggaattatgcaaatactcttgagcttccaaatccttggaattttcaaagccaaagatctaaatccccagtctactcacagctttcagcttctcacttaaaaggtgaccaaagcagtcaaattggaaattctaattctatatcaatttctgatgcctgccaaagtaacaacttctcagccacctcgtcatcttcctactcctcaaacctgggatcaatcacaattcctaattatgaaactaaaagatccggttctcagtcacaacttgtgttactaagcgatgactatgcagtcagactctcaagaaatctttccatgagtgaagttgtttatcaaactgagtcattacacaattcacttctacctccacctgctcatgaggaaaatgttctcaagctacaaaagagaggaagacaaagattaagagaggatagaagcattattgatggtcgtacaaatttcccaactttacaacttaagatacctcaatccaatgaaagaagtgaaggatttttccaaggaatgagttttaatactgacttcgagggacttttagatggcttctttgaattctgtgatttctttagacaacttttaatgacaccaatcatgtttatattgtatttaactgtaccatctccatcacttagaagatcagtacaaattatgcaacctttatttattgttttggctgttggatttgaaaagaagatttacgtcagctacccattattttacttgattgctcttcttctttcatctattatatctttggtactctttttcatatatacttgtattcttaatacaagaaaagatgatcagacaagtgaagatgacttaaaagatgatccccagaactatagactctatcgggttagatccttctcaaatattaaacttccagaagttcaattatcatttaaaaccagaaagtttataactgacattttaatgtactgtgatatgttctttggcattattatgtcaatatattggaatggagtccttgtaaacgagttagttgaatgcattaaagttattgggcttacccttggaattaaacctgcaattcttggactcacaattgttgcaatgggtaactcaattgctgacttatttgctaatgtagcagtttcaagagctgggcatgcacatatgggcctcgctggatgttatggcgcatgtgtatttcttctcctatttggatttggaagttcagtatttgtaagagcaatccaattaggattctcaaaagatatccaccttcactttgaatctcaaattattactgctacttaccaactcttgtacttccttccaatatcagcactggttgtcgtactatctaaagggagagttcatcgcatttggggtttagcatttattttatactttatcgtttgtatgtcctacgttctaaaaggagtcatttaa

SEQ ID NO: 1240 - DNA, 216 bp, Cryptosporidium hominis
atgagatctatcagaatttctgatattcaattccaacaaaaaaaaggtaataagaaaaataaaaaaaataatatttcaggtaatgacaataaaataagtgattcaaatattggcgccgattcatcggtattagtagaatgtggatgctatgcaaaattgcatgcaatttatattacatgcatacaatgtggtaagttacgaataaaaatttcttag

SEQ ID NO: 1241 - DNA, 306 bp, Cryptosporidium hominis
atgataaatatagatattgaaaacaagcagattacaatggatgaaggttataatgcaaggaatgccttgcattatgcaaaattattagaagaatttgaacagagaagagaaaaaaagacagatataagtactggaaaaactgaaacaaatgtcgagaatgtattaagtatgttgggacaaagactaaaatttgaagaagaatccaaaattgagggtagttttaaattacctaataaagatactataataaatgagtttttgcctttatcactgaatgatccagtttggtcagatcaggatgattaa

SEQ ID NO: 1242 - DNA, 348 bp, Cryptosporidium hominis
atgattcttgctgacaagtcacccaatttctggactagacatcttagaggtggaaatagaaagattatcaagattccatatttggcaaatattactgatttctcaacaattcaaaatgcctttgatggaaatgagatccataacttacttggaactattcagagtcgaaaccataatgaatcatctgtacttattgatcatatagatggtgataagaatgttgaaaatgtatcattatgggggaattcattccaagagaaaacccaatatcaaagtcaagagcagagtcaaaaccaagacctatatcaggaacaaagtcaatatcaaaaccaattagggaatatgtaa

SEQ ID NO: 1243 - DNA, 237 bp, Cryptosporidium hominis
atgcagattcatttggctacaataagaaacaactttctaaaaggtgaaatcagcttagatattgttggagtatgtgttggatttgtttcagctattgcttcaatttttggaatgaatattcaaagtggattggaaaagaatgttgatattttttggtttatggcttacacaatgattacattatgcgtttttgcaggaattgttgttatattaatgtttaggagactacaactttaa

SEQ ID NO: 1244 - DNA, 4264 bp, Cryptosporidium hominis
atggcagatagctttggaggtaaaaataaggcaggaagagagtttatttataatgtgagagatgaattaaagccaccaatagaaaatgcatattcgaattaccatccactattaagaagggaaatatttgaagatcagaaaaatgatcttgcaagattgtatttcaggattcaagatcctatacaattgtcttcttctggtcagattgaaggagctcagaatgtttttgtgggtgaattatttggaatgtgtacaagagaggaaatgatcaataaacaacagacttctacggctaatgattttgagagactttctggagtaactttgaatgatgatttagaagctagaatagtgaatgagtttcttacaatgaaaagctttcaaagatctgatgcatccagggtctttcacaaagaattagtcagaccagtagtttggtgcagaatggttgtaagaagattattagtttatttcattgaagctgatcgaatttttctcaattatttatatagaaaaccacaagggcaaggatataagtacattgatatatataactttcttagagatagactgagagcagtttggcaagatttaacagtacaacatgctacacgtcatagagcaagtattgatagttttgaggtatcattcagatttctattattttctgaggagtatttatgtaatttaaaagaatttaactcagtacagaatggttctttaatgtcaacttgtttggacaagcttatgtctggatatttggatgttttatattatagaaagaagagcagtagttatttatatgactctgaactttccagaatattggtttatgattctccttttcaaccagaattctggtcttatcgtatcttaaccagtatgagcattaagattaaggatgcaaatgataacagaattatggatataattaatttaatttctccagaaatgattgaacaccctctaattaagctttcacttggaattcattgctcttttagatttgtaaacattgttagatattttagatacttcagaaagtgttttggtatcatttctaatctaattaaagatgagaataattctattgaatcttttcaaaataaagatgaccaagatccagagcaatatagacaatttggccatgctttgattcttatttgtatactaattaaaaaatattcaaatatcattcgtctcaaatatttaaatatattattatcatctaatatgagtaaacgccaacttatgcctttaaatagcttcattgagatatttgggttctacatagaatctattgaatcactaaaactatttactgagagatttgatattaagatctttaacaaggataatcctaatgtctttctttttcaaggaagcaatattggacagtttcaatcaattcggcagatttgcaatctcaccacaaaatttgtggtatcatttaaagactgtataaatctctcaacaatggaatcattaagtattttaaactccctaagctggccttctgagattctgacttctcttttggaaaagatccccagaattgacattctagaccctattttagggaaaatttcaaaagttgactttgaaaacaagacgcacacagaagatttaaacaaaaacaagatcgctgattcaaattcaaaccagttttcctttacttctctttcatcaagcaatagggatataattaataacaattataagagcaataatctttccaacactttaattcaaaacttaaaagaaatagatatcaacaaagctacagcatatcgtaattatatcacaaactcaaccaaacaaaacaaaagaaaaggattcttcatggaagaagaggtaccttccgttttctcaaatccaaacattacttacgatgtacacacagactctacttctaacatgaataccaataatagcaataaacgaaggtctattactgaaaatgacactcttctctctgaaaatacgacaaacacaccatataatctacaaacacaaaacaaattagctaattttcagatagattcacccaaattttccttccaaactaccaattctcacgatttattaaataacttaattccaagtgggcgccaaacgccagaacctgggctttgcgcgccaacatgtcataaattaccagaaattaaagaaacagaagaaagaaaacagagtgagaaggataatgtatataattacaagaaagaagtcgtgaatgtaggagaatctattccaaaagatgatttggatttaagtattcagaagaatggccagttattgaaatttgggaaggagatttctgtgaattatgtgggggaaggcgatcttgggaatactgaagctaatattttgggattagaaaaccaaataatagaggatggacttgttggtttgagcggatggaaacgttttagagtcttctttaataaatatcaagcctcggaaatggagttaaaggaggaagttgagaatgatagaatacttgaagatgataaagaaagccaaaaacgtatcaatatacttttatccaggataaatcttccagaaaatgaaaatggaattaatcaatggttaaatttatcagtttctggaattttggagcagattaaaactgatattatttcaagagtgattaaatctttaaaatttagctttgtatttttttataatcaattggtaaatatagaagggatatcgagatcccatataagccaattgaatacattttacaccaaattggagctaatactttcaaatttaacaaatggggatttcttggataaaaaaacagttcagactactaaccaattgaaaactacagaaaatcatgattttatttttccatggaattctgtaatggttaaatctgaaatattatcaggtagcaaaaaagaaaaagatcaaatgattatagatatttacgaaattgacttttctcatgagaattttgaaagatttcaaggaaataaacaatctcagattcctgttcacgtcgaaatgctttcaatatggcaaaacaatacaagaacctgcttaagaagccaacttttttctaatgatgatatttcactcttaaaagagaaagagagagaaaatgttaaagaagctgaaaatcttactttagagagacttttatatgaatatctaatcaataatggagatgttattgtttggacacttccttttcttgtaagaagttgtgagaattctatcaatattccactcaatagttctttttatgactctgaagatacttcaaatgaatatatgaaaaggtctttagactcttttgcctttccaatcacatcagaaaagggaaaaaagcaacttattgcagaatttgaatcatgttgtaaagttttgaatattaaaagttatccaattgaagttaaaagcaaaatacctattctgaaaacaattactatagttttatcttttgttacttatattccaattgatcatttaattttagctagtggtaatgaaatctttcaacaaaagcttaaagatgaaatattaaacttggaaaatactatcgaggaaattatcttgaaagaatatcttcaagaatctcaatcattagttatttcagatgaagccattttggaagttggagatagactacagtcttttaattatggtaataatgaatctgctttaatctcaaattattcaggagtttcttgtaatttgaaattcaaatgtattggaattgctcctttagaagtattaagtgactctactattaaacaagataaaatttctatctacgttcctggtctaaattcattaattaatacaaagttaaataataaaagcttccctaataatcttgttgtatcaaatcactatcaagaagatcttgaaattaattctattagtttcttgtctacaatgtggcttcagaatttccataaagtattgaatattaaggataggattggtattaatattaaaggatgtaatggcaataaagaactttcgttatttaaggaggccatcaaaattggttttatagattgttttagactatttacaaatggaaatatagattggatcttggtttctggaaattgttcttacacggaaattaaggaaatcattatttggatttatgacttatatattaattctatggcatgctttgataatggtttattggcttctttaacaccaagagtaagttcttttccaggcactttatcttgggattcaagagattcttacaagattagagatttattag

SEQ ID NO: 1245 - DNA, 1107 bp, Cryptosporidium hominis
atgagtttacttcagaagattgccgagatagaggccgaaatggccagaacccaaaaaaataaggcaaccaattttcatttgggtttattaaaggcaaaattagcaaaactaagagcacaggtaattagtggtggcgatggaagaggaggaggtggtggcggaaatgaaggttgggatgttagcaagacaggagaagcaagagtaggacttattggctttccttccgtaggtaaatcaaccctattaaataaattgactggtactttcagtgaagtagcagcttatgaatttactactcttacatgtgttcctggtgtatttaattacaaaggtgctaaaattcagctcttagatttacccggaattattgaaggagccaaggatggtaaaggtagaggtcgtcaagttattggtgtaggtagaacatgtagtttgattctcattgttttagatgctttaaaacctttaacacataaaagaattattgagagagaattggaaggttttggaattaggttaaataagcaaccaccaaatatatcatttactagaaaagacagaggtggaattacaattacttctactgtacaacttaaaaatattgacgaggagactattaaatcaatctgttcagagtatagaatcaataatgctaactttgttatccgttgtgatgcaactgctgatgatattattgatattattgaaggtaatcgtatatatttaccttgtatttatattctaaataagattgatcaaattactattgaagaattggatgttctttcacaatgtccacattatgttccagtatctgcccatcatgaatggaatcttgatggtcttattgagaaaatatggcagtatttagatcttattaggatttatactaagcctaaaggtcagattcctgattatgctgctccagttattttaaaacgtgataagtctactatagcagatttttgtaggagaatacataaacaattactccctcagatgaaatatgctctagtttggggtcagtctgttagacataatccccaaagagtaggaaaagaccatgttttaattgatgaagacgttgttcaaattattaaaaagtag

SEQ ID NO: 1246 - DNA, 198 bp, Cryptosporidium hominis
atgaacgaagatttaagcgaatataatcatccagaaagtattatttcattattatcaccagtttcatggctacaaatggacgaaattaaaataaattctgattttaacttaaacaatcaaaatggatatattaagaagaaatctgaaagaataattaaagagctaacttatggtaagtcaaagatctatggaacttaa

SEQ ID NO: 1247 - DNA, 1881 bp, Cryptosporidium hominis
atggtatatataattattattgtttttaggatcctaaattcattatttatccgcacaacttataatccagatgagtattggcaatctttagaggttgcacacaaaattgtgaatgggtttggatatcttacatgggaatgggaaccatgtgtatctttaagaagtattattcatccactaatttttactatatgttatattatcatcaatttctttaaaaagattgtgaaattcttctgtaaaaataattaccaatgtttatatcatacaaattattatttcattattccaagactttatcagtctatatttgctatattaacagatattggtacaagtaaagttgcttattcaatatttcacaaaaattattatgctcgaatggaaactaaaattgaagatagtgataataaattcaagaataattatttgaaagattctatcttcttaaaaattccattttaccaaaaaatatgtaataaatatgaattagattttgtgacattatttatttcactatttagttggtataatttctatactttatgtagaacttatgcccaaactgttgaaaattgtattaatatctggagtatatattttatcattaaatcagaaaaatggatgaatggtagttactcagataataaatctcttataattgggatatttctttcttcattaagtgttttggttagacattcatctattcaattttggctaatattatatttaattttgattatttttcaaattaaagatattattaataaaggtagtaaatattcaatttttacaatcgtgaaattattaaaaatttgcatagttgttgctttcatcacaataccagtaatgctttatttggattatttgttctacaaaaaatttacaattccaatgattaactttgttaaatttaattttattggagatccgggacaaatatatggttcaaattccagactttattactttactgaaacgccgattgttactttactttcttatctaccatttatgtttcttggaatcattgaatcatttaatttaaaaaatcaaatatttaaaatatcacaaatttctactttaattactatgatcttgctttctactacgtcacataaagaacaccgttttattatcccttattttcccatattgttaattaccacgagccttggaatatataaactaattttagaaatacataagttcttcaaaatggataatattaactttacgggattattatttagtagtattaacatttctcaaatatatctcaataataagtaccttctaataacattactagctcaaattattccagcttttttctttacaacaatatttcaaagaggtggtgaatctgcgattagatatttatccaatttgaatttgcagaagaatgaatccattttctttgtttctcaatgccatatgtatccagcctactctttcttgaaccaagacgtgaaatttggattctttgattgttctcctaatattaatcaaccaatcaaacataagaatatgaatgaaatactttgggcaaatccaaatactacacagttattggaggagatttttgttattaatcccttgttgaatacatcttaccccagtccatatatttcatcaaatattactaagttaaatacttcaaattctgagaattgtttgaattacagatttaatagaaaactttctggggaatttccaaaattctttgtaattaattcacactttaatgaaaatctgcaagaatggctccataaacataattataaacttattcgcagagtttttgattcattttttcttgaaacacccattggattacttttttggtcttacttgtacatttatgagaaaatttaa

SEQ ID NO: 1248 - DNA, 1581 bp, Cryptosporidium hominis
atgtcattaactccttggatgtcaggggaattcaggggtaaactcccatccccaagagctgcacatacgtgtaacataatagaagataagctatatttatttggtggttggaatggatttcaagcactaaatgatttttatgtattatatacgagttcagaagtaatgttttggcaaaaattgataccttctgaaaagaggccaaaaaatagaaataatcatgcatctgccgtatatgggaattcattatatatacatggaggtcacaacggtgaattttggcttagtgatttgtatgaatttacagtaaaaggaacagatcatttaaatagcgataacttgaatgcatttaattatactgaagaagtgaatgaagaacttttgggaagctggaaacgtgttaaggtttcaaacaagttaaaaaaaccttcagccagggcatgccattccttaacacgaatttttggaaggctctatctttttggaggttttgatggaattcaatgttttaatgatttatgggtttatgatattgcaaaaatgacttggaatgaaatagaatttgaaaattatattccaagatgcagaaatggtcattgtgctatttcttcaagtaaaggaatcatattttttggtggaaacactggtaaagagtatattggtgatgtttcattatataatccagaaaaaaaagaatttcaaaccccaaaagtctttggtgtctgtccatcagcaagaaaaggtcacagtttagctttattagatgatgtttctgctgtaatgtttggaggatatgatggaaaaaataggtgtaatgatttatttattcttgatatttctgagttaccttcaatagtacgttgggaaaggataattgagaagaactctccaagtcctaggcaaagaaactccctaacaactattccaggcggtaaatgtcttttatttggtggatatgacggtaactgttggaaatcggatacttatttattagatataagaaagttctcatgttcaatgcatagcaaaaatatttcattaccaatgctttcaaatttggaaagtcttgttgataacccagaatttagcgatattattttcattcttgagaatgaagaaactttatatgcacacaaatgcattttagtcgctcaaagtcaatactttaaatcaatgttcaaaaatggcatggctgaaacaaattcaaaagaagtccgtcttgaacatattccgaaaaaagaattcaaagtcattattagatttctttatacttcttacttggatgaaactgatctccaaacattgtgtaatgtattgcttattgcagattcctataacttatcagctctttctgatttatgcattaaaactgttaaacaattagtggaagttggtaatgtttgcgaaatccttattattgctcatcgttgtaaaattgatcagcttgtcaagttttgcgttgattttgcatcctgtcatgtagatgtactaattaacagtcctaaattcgttcaactttcaaatgagtttcctaagcttgctttaagcatttcaaattctgttattagcaagttgatctga

SEQ ID NO: 1249 - DNA, 1398 bp, Cryptosporidium hominis
atgacaaaagagttttctgataaatttctcgagtttctaaataatacaggttcgccatatcactcagtagatgaaacaattaagatacttaaagggagtgggtttaaaaagttggatgataatgaggaaataaaaaaaggaggaaaatactatataactttaaactatagtactattttagcatttaaagtaggggaagaatttgatttagaagatgaaaggagtatggtgattataacaggttcacacacagatagtccttgtttaagagttagaccgagttctataacttgtaatgaaggttatactcaattgagtgtttctacatatggtggaggaatttggcatacatggtttgatagaggtctaggaattgcgggaaaagtggtagataatgcatgcaatgaatatttaatcaaaattaaaagaccaatatgtgcaattccaaacttagcaatacatttaacaacatcagaggaaagatcttcatttgtatatgataaggaaaagcatttacaaccaataatatcaaagacagatacaaatgataaatatggcgaacaacttttatcccttccacgtagtttgcttgatgagatttgcagagaaattaatgttcaacctcagaacatttcatcatttgatctatgtttgatggattcagttgattctagatatgtcggtattaatgatgaatttattgattctccaagacttgataatcttggaggtgttttttcatgttttacagctttaattgatgcatcagaatcaaatagcagtgatttattaatttctgttgcatttgaccatgaggaagtaggaagtgtctcattttcaggagctcactcagactttcttaaacaaagcctaaagttaattttggctggtttggaaaattctagtttgaataattcaacacctaaaggaatggtaaatgctaatcgaaattctgacttggaattctgtaagataatgaagagatctatctttttgagcgttgatatggctcattcaatacacccaaattatcccgaaagacatcaatcaaagcataaaccttctccaaataatggcattgtaattaagacaaactttaatcaagcttatacaacagactgcacaacaagaacattcttaaagactattgcaaataatttcaatataaagactcaagatttcctagtaaaaaattcttctccatgtggttctactataggcccaatagttgcctccaatttgggaattcgtactgccgatattggtgcatgcatgcttgcaatgcattcatgcagggagttcatgtactactctgatatttacgacttgcaaaactttattaaggtattttacatgacttggtcaaaagtaaaacttgaatcaaaactactagaataa

SEQ ID NO: 1250 - DNA, 2958 bp, Cryptosporidium hominis
atggtgtgggtgagaggggtggtagagatttttcgagtgatggaggggattaaggggggtagatataaggggggagaggggtggttagggtacatggaagaggtgcccaaattgtctattcaggagttgagagatactgtaaggggcattgagaataaaaggttagggaatatctcaaataatttactatcagaagaaaatatccataagagtatatacgaagaatttaacgaggttaggaataaattgccaaagaataaagaatttattatagatatggttgatgaaaacaaatatgattatggatttagttttgaagtatttaaaaaagatgataatatgaaaattaccgatatgggaatgaagatacaagagttttacgctccaataacatcttctttagattctaaaaaaagagaaaaaggagaaggcttagataaaagtcattttattaatattccgaatattgagattgaggaaattagtgagagtgatcagaatgaagtaaatgccagtttgaatgtacaggagctaaaaattgtggagaatattcatggggtttttaaagatgaaaaaattaaaggaaaaggaagaatgaaagaggaggaggaagaggaagaggaagaagaagaagaagaagaaaaggaagaggaggaagaggaagaagaggaaaaggaagaggaagggaaagaaaaagaaggagatgatgaagaagatgatggagaaaaggaggaaacagaagaggatagagattttgttgaaggaaaagaaggatattttaatacaagtacaagatattataacagtttggggctaactgaagattttctactagttttcatgaactttagtttagtaaggatactatcatcaaattcctatgggaatacatctaaagaaatgaaggaattgaaattattcgaaagagcaaaagaagatagaaaaattattaataggaattggaaacaaacaataatgaattatgagaaattgggaatatttgcagaaaagagaaatttaatattagtttttgctattttagtaaacattatattaatttcaatggcaaatataattattccaatagtttatagtattaaaaatgcactatttccaatattaacagtaaatgcagttattaactttcttatattttacttaattaatggtactttaatttacatattcaccagaaagatgaacagttttaacaaatcaattttgaatgactatttattacttttacagagaattaatcaaatgagaaaagaaaggagaaagttggagtatgaagaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggaagaggagaaggaagaggaagaggagaaggaagaagaagaggaggaagaagtctataactacgatattaatcacaagggaataaaagaaagtagtgagatagaagaattggaaaagagagaaatagaagaagatataatggaatatatctatagtgaactattgtattgttatattcaaactatgcaagatttgaatactgaaagtaataaaaattataaaaagtcaatgtggttattttttgggattggaatagttcaaatgactttatcactatttttggacacatttgtaattaataaatttaactttaatggattatttgtgaatatttttaatgttataaatttattaatatcagcaacattaaatttaatatatataagtaaaaagattggaagatgggatcttttggatatatttaataagaatttacttataattatggatggagttattcaagaaaatcaattaaagtttttaacttattcttctagtattgttgaacatattttattttggaattatatatttaatcatagtaatgataataatgttaattggagaaactttgtttcaaatatatcattattagaaatggaccaacataaattacaaaatattaaaaataataagaataaaaatattaatgtattatgcagaatacatttagatattaataaaatactaaaaacccccaactccaataataatattaatgaattatggccattcttttatttaaattataattatactcaaaaaaaattaataatatcatctcataatttaattttatataaacaagagaataaagttcatcaaaaaagtaatcatttaatgtcaattcctgttaatttaatttccattgaatctattcaatcttcagtttttccatgggcatttatatataataatagtggaaaaatgatagagaaggatactcatttagttactaatattaatatggaaaataacaatttaaatttcaaaaatcaaattcagcaatatattgaaatattagagaatttcattttctcatcagaaaatcaaagtcttacaatcaattcattactagaatttactgacacttttaaaaagaaacaccaaacaaataattttcaaatgtctaaagaatttcaaaataaactaagtcaaattttttataattataattttatttcattttacgataataataatcatcattcaggcgccaaaacaccttataaggaggagtcagtcaactggcgcctggatgaaagtttggaaataattaagttaaaggatgatccattatatattttaaattgcacaataccaatagaatatttactaaatatggatataaatatcagctttgaagacttagttacaaaagatgaagttatgaagttacaaattgcctgtttttcttttgctgacctattgagtatatatacagcgattagttag

SEQ ID NO: 1251 - DNA, 513 bp, Cryptosporidium hominis
atgagcagaaaacattctattttaaataataccaaaattattatgaacttattttcattcctggaaatctcggatttagttaaaatgaggaatttgaattcctgttgtaaactaattagtgaccattatattaaaatgtctattcatagagataagtcaaaatataaaaatattgagattgagaataatgatgaaagtaatagtagtaataataataataataatatgaacaatattgccaattatttttgtccaagtaaaattaataataataataatatttcacaattaagaatgaaatttcttcaactttggaatatttattcaaacaaaaatttaatagaaaaagtcaattactatgattataacttgtgttttataataaagatattaatatatttaatttcaaatgtaaaagatggacttgatttaagtttgatttttgcaacaaataatttttatttacaacaaatttatggatatggattagatgattcaaattctttatcttaa

SEQ ID NO: 1252 - DNA, 1086 bp, Cryptosporidium hominis
atgaatggtttaacggatatttcttttaaaaattggtcattactagctattttaaatatattactattcattacaaaatttcaaagtggtgcaactagtgctacagatgaattatttaatgaaattaataatatttattcaccatgcgaattcgaaaattctccttttacaggatgtgtatcgttaaatcctataagaactggcaaaaaaagtggaaaggaaattagaattcattcatcattattatatttagcaaattatagaacaaaaaaggtagtattaaaaaagcctataaaatttcatacattaaaaacatttcagtctttggatgaaaataatgatgaaataaaaagtgaatataactatggatatgatcgaaatgaaattgatgatgaaataatgaaagaagataagctgatcggattgaatgatattattaatgatgaagaaggtagaattatggagtatttgcatgatcaagtaaagttttctagtatgccaaagttaatcagttctaattgggaaaatactggttggatagttatggaatattatgatggaatatctttacaagaattctatcaagcaatatataaagatattgatgatattaaggtacagaataatcataagtttcaagatagaatgatattaaaaaaaggaattatttataaagaattacatgaatttattaaagacagagtaaataataataaagatattgataatcatatagaaaatggtgagataccttatgaatataaaaaatcaaatgattctttggattatttagaattaaatggcgattataaaagaaataactggttttttaaattattaatttctcaatataatgcaatatctcaagtatatttagagttattaaagaaaggtgtaattcattgcaatccaagcccttcatcaataatgattaaaaaaggcaaacttggaatacacccaagtgaaattatttttctggattattctcaatcaattaagtggaatattgaaacttcacaaatattttattcggatattaaacaatcatgtataccagatttaagaccatattatcgtttttacttg

SEQ ID NO: 1253 - DNA, 840 bp, Cryptosporidium hominis
  misc_feature (830)..(830): n is a, c, g, or t
atgaagacaatttttgggaattataaatctaagctaattaatgaattattaaatataaaaaaacgatatcaagataaaaatttatatttatcagaagtagcaaaagaaaccaattatattttaaagtttggtttaagtcatttagagaaggaacagagggaaatagtctcgaaaattaaaaatactaggaagaaagtacaagaattaaatactacaaaagataaaaatatagaattaattaacagtgaattatcaagctttggattagagaatattattaattatagtaaagttggactaaatacagattattttccaagagacaaaatttcagatggattacaaaatttttatgatataaagcttaaacatttctcgtcagaactatttgaagaaattaatgaactattaaaggatgatattttatttaatttatatcttgaattaattaaggaagcaaaagtagatcttgttgatagcgataaatatataatggaacatttaataaatttcccaactttgaaaatgttgattggaaattcagaaaaaattggaagtgaatctgaatcaagcgataatgaaaaagaaaacaagtattctattgaattaattgatgattcaactatagaaaattcagtttccgatgaaaattttaaacattttgaaattttagaagaagaatcaccgcttcttattcaattatttgaggatcgtcaactctttggaaaattactcatggaactttatgaaattgagtcatttattaagacgagtttagttgagagctttggtacggaatggaaccaaaaaattaattataatactgaccncaaaatataa

SEQ ID NO: 1254 - DNA, 261 bp, Cryptosporidium hominis
atgagtatccaagaaactatcaatgaaagaatttccaaatctttgaatcctacacttcttgatgttgtagatatcattttttgtaattgtgggtatatgtttaaagttattgttgtatcagactgttttgttggtaaaagaatcttggaaagacaaagattggtcaacgaagccattggagaggtttataatgaaatccattctgtcactatgaagtgttatacttctgaggaatactctaaatctcagaattcagcatga

SEQ ID NO: 1255 - DNA, 870 bp, Cryptosporidium hominis
  misc_feature (739)..(739): n is a, c, g, or t
  misc_feature (747)..(750): n is a, c, g, or t
  misc_feature (752)..(757): n is a, c, g, or t
  misc_feature (763)..(764): n is a, c, g, or t
  misc_feature (769)..(771): n is a, c, g, or t
  misc_feature (773)..(777): n is a, c, g, or t
  misc_feature (780)..(784): n is a, c, g, or t
  misc_feature (787)..(787): n is a, c, g, or t
  misc_feature (789)..(789): n is a, c, g, or t
  misc_feature (791)..(792): n is a, c, g, or t
  misc_feature (794)..(794): n is a, c, g, or t
  misc_feature (799)..(799): n is a, c, g, or t
  misc_feature (801)..(801): n is a, c, g, or t
  misc_feature (810)..(810): n is a, c, g, or t
  misc_feature (818)..(818): n is a, c, g, or t
  misc_feature (833)..(833): n is a, c, g, or t
  misc_feature (842)..(843): n is a, c, g, or t
  misc_feature (848)..(848): n is a, c, g, or t
  misc_feature (854)..(854): n is a, c, g, or t
atgcagaatgaattggtgaatatattgaatcttaataataaaaattttaagaaaaagaatgatattgattctttaactcagataataacaggaaagaaagttatagataataaattacacgaacattttaatgaaacttatgacccttataaagataaagaattaaaacctttacccattgacaatgtaaatgaaattattggaataatttttggaattaatggaaatttattggctcaggatgaagacattaaaagatggatctatcattcaattgagtttacatgtaattcaattccaaaaatagatgataataaaactgatttttttaaggaaaatcgatcaattttcacttttaaagaaaactttacaagtatgaactactgtttaattcaacaaggaggtggtccctgtggagttttagcttccttgaatggatttattataagccaattaatatttaatcctttaaggcttaaaatgattaaggaaaaatatcaagaagatctggttgagtatttgaattctataagtgaggaggattgttgggaagctttaattcaatcaatatgtatgatatttttccaatcatctcctgaaagcaagtatcgtgttattcagtataaaccatatgaaaaaatggaaacacttcaacagaatagacattttgacttgataagtaattgtttaattggaaatggaaacaatttgtattattatgttgaatatgatgatattntgggaagnnnntnnnnnntactgnngacgnnngnnnnntgnnnnnttntntnntnttggntnattattttnaatattanttttaattggtggtntaagaattnnaaatnagattngtttggatatggatga

SEQ ID NO: 1256 - DNA, 867 bp, Cryptosporidium hominis
atgactgagagagattggaaaatatttagagaagattactcaattaatgtacgtgggaaagatgttccaaatccaatacgtaattggaaagattgtcatgttttagaaatacaaacagagttaattaaaaatattggttatgaaaagccaactccaattcaaatgcaatgtattcctattggattaaaacttagggatatgataggaatagcagaaactggtagtggtaaaactatagcttttctaattccacttattagttatgtggggaataaaccaatacttgattataaaacaagtcaagaaggaccatatggacttattcttgctccagctagagaattagcactacaaattgaagatgaagctcaaaaattattaagtaagactcatgaattaaaaagaatacgtactttgtctattgttggaggaagaaatattgatcaacaagcattttcacttagaaaaggagtggagattatcattgcaactccaggtagaatgcaagattgtcttgaaaaaacattaacagtattagtacaatgttcatatgttattttggatgaagctgatagaatgattgatttaggatttcaagactctcttaactttattcttgatcagataccaccagagattcaaagaactactcatatgtttagtgctactatgcagaaagagcttgaaaacattgcgaaaaggtatcttaattcgccaattaatgttactattggagatattggagcaggaaaaaaatcaattcaacaaatactcaattttattagtgaaactaaaaagaaatctacgttaattaatactttaaataataaagaattggcagtaccacccaattattgtttttcttaa

SEQ ID NO: 1257 - DNA, 213 bp, Cryptosporidium hominis
ataaagaaaacttactttgcatataatttcaacaggaacttttacagttttaatacaaattttatcactttttattgcatatttcttctctctattagttctcggtctaatttcagattcaccatatccaagttttttactagggattctctattaacacctcaggtaattcatatccactcttacattgtagaactttttgtaattttttct

SEQ ID NO: 1258 - DNA, 1938 bp, Cryptosporidium hominis
atggaaaatgtaattaaaagaacgaatcctggatgtgttattaaaacagtacatccatggtttaaatctacagctactgttgaatgttataatagtaataatggttatattgtaggtattacagaggatgattgggttaatgttataccaccaacaataaaatgtccaagagattttgaaataatattcccaacatatccaacagaagatacaattaaaagtaattttacttttcctccaatatgtcttgctagaagatattttccaagaagtataagttgtccaggcatattattaagaaatggacttatagtaactgatagatatattgttgataacgaattgaatccaactccatttaagcaaaaaatagatgtttcacattattcttgtcaagtacaaagtagggtgaagccaaatatagtttgtccaataattaatatggattattactcaagattaagatatgttttcccaaataatgaatattatttgaattcacatttcaatactgaagaagttattaattatcaatcgggactttttgattttacaagttattcaaattttttaaatgagaatccaaatattattaatgagttaaaggaaaatcagttaagtcaattgagtaatctttctgatactaattccacaatatccaatagttctatttcaaattctaacttaaatgactcaactgtatcaatatcaaatgataatgataactcaactttgaaatctagtccatattataacaataaggcctacaaaaatgagtttcatgaatataaatactattataatgatactttaaataaacatttaaagtccatgaatgattacaataaccatgaatactcatattatccatttaggttgaatactactttggataatccttggaatacaaaaactggtaataatattaatagtaatttgagacgggaggatcatagaaaagtacattctattcattcaaaaggttcacaaatagaaaaagtggttggaacaaagcaattcgataaagaatataataactttctacaaggattaaaaaaggatttatcaaaacaaaaaaagtactttaatgattatcaatgggatttcttaagcaaattctatagagtttatatatcagatcaatataaatttgtatcaaatattccagtttcttctatttcacataaagcattgacaatagatggaggttatcaactgaatattaatttagatccgacttatcaaagctttgttaattatacattggaaaatatgaaaatgatggattctgaattggaaattaacaatttaagggataatctgaacgatacaatgattaataaaaatgataatgttactgatagtaatattagtaatgataataataccaatagtagtaataataacattactgagaataatatgaatatgaataattctcaattaatagaaaagttattaattttaaatgatactaatataaccaataatcttaattttacaagagatcatgaatataatgcttgggaaaaatctgcaagaatatattttatggatttagatttgatgaaaaagaatcaaataatttattcgagtattagtaactataaacacaagagaaagtttccatttctatattattatggaagacaaccaagtattaacaatgattatggccatattagaagaccagcaatttccgaccacaaatatagatatggaagtcctgcagaagattatcacaaatacagtggaagacatgaaaatagtgatttactttattatattaacaaacatttaaatcagacgaaaccttatagacattctccagggccacaaacttatcataattgtatatctataaatgagacaactccaataatagaatgtccaaattcgaaatattattattccaaaaatgttttatacttgatataa

SEQ ID NO: 1259 - DNA, 1641 bp, Cryptosporidium hominis
atgagtacttttttaagaggtcaatctcagattatgggaatcaaaccattattcccggtaaaaccgttactatcaatttcttcaccagattttgagcaaatttggaaagaggtaaaatgggatacaaaaagagtaaataacacattagatttgttttcaagattttgcaaggatgatttagatattttaccatatgactctacttccaatgatattaattcaaatagcgaaggaggaataaaccattcacagttaatgtcaaaccatagactaatggcattattaaagtcaatagctatagttggtacagatagtgatgattttaataacatggactttttcacaagaaatgacttatgcgtaataatgacaggaattccttatattgataaaaagaattttctaaggttaatgtgtcttttagacagatctactcctcacacaactacttcaccagctggaatttcaagattaaagttggttttttcttattatgattggggttggaaagggtatctggatgagtttgattggaagagattaagaagtgatattttaaatttgacttattatggaaagttatatgatacaaataataaccatgatttaaaatctagattaaatggaacaaacaaaaaaggaggcccaatgccagaaactttagaggaaggacttaaacaacttagtcaagaaatatctattagatccttaaaaagtaccaataatggatcaaaacttttaaagaatgatagtgtacatatttctattaatgctagtagtactagtaatatgaatagtaatggtggccattcagaatatagctattttgataataatcatcataattttactgcatcagttccttattcagttcaaaacagtgatttaatcattgatttcccactttttattaaattggttgaatatagaataattaaaggaacgtcacaaatcttacgtattgaacttcctggtagagatcaagaagaatttattgctagaagcatcttaatgaatggtgggagtattttcttagataattataagaatgataatgctcattattcccctgataagtctagtaaagcttctatatataatccaatttcatcttcagcacaaaatattaaatctgaaatgaactcaccatcaaaaattaacaacgttgaaaatgaagaattagataatattgaaaagaaaaaacaaatcattactgaacaaatccaagaactagataatgaattaaatagtctcaagatttccataaaaaattcacatcttccatcaaacaccttaggtattgatatttcaaatttgaatggagatgctacttcaaagagtgcaatggaatccatttttgggcctccccctgaagatttacatggaattttctgtgatcagcccaatgatcaacaagatttggcattttcctctattgtagttccttcttcttccacaccaattaggaagtcaagatcaataagatcaaatgcaattcccataactcctgttacaaaaaatgattcaatctcagaacacgcccatgactctaattctttcattgttgaaagtagtaacacaaatgactttccaaataatgttaataatacagaacttgcgggcccgcctattttactttag

SEQ ID NO: 1260 - DNA, 354 bp, Cryptosporidium hominis
atgaatgaaagtattggagaattaacaacaattccgattatatattcgaaacaacacaaagaaagactagttctacttgaattccagggatctttaagtatatctaaattgaatacagaaactggggaaatgattaattctgaaaacaatgacgattttaatgacacagttattggtcaattaattaactttgataaaatctctcagagtttaaaaaatcctgaaattgttaatcgaatggaatctgcaattcaatattctaaaaacagcccaatagaacttaaggtgggatccacggaactcattggtacagtaaatggagtaattcttttcgctaatgaagatacgcagtaa

SEQ ID NO: 1261 - DNA, 669 bp, Cryptosporidium hominis
atgaatactatgagcatagactcaatttgtttggatgatatttcacttttatctatggaaatgaaggaacatagctcaattattaatatagtaaatgttgatttaatagatttaggggatgttattattttgaaaaaggatgaaattgtaccatatgatggaattgttatttctaatgatatcgcagttttggatgaatcaatgattactggtgaaagtagaatcattgaaaagttatatggaaattttatatccagtggaagtagagtattatctgataatgtattcatatttgttactgaagtaggaactgaaagtactcttggaaagattcaaaagttaaaaataaaagcaagagagagtcaaatagagttacctggaattattgatatattttccagatattttgtaccttcaatcatattattatctttattggcttttgttgtttggttcttattagcttattatgacaaagtggatccagctagaatgtttattactgccagaataacttttatacagaatttgataatatatttaaggaatttccaatttcatctagagttatgtttgcactgcatttcacactttcaatattggcaatatcttgcccatgtgttattggtattacagttcctattgctgtacttatttcaacttctttaa

SEQ ID NO: 1262 - DNA, 441 bp, Cryptosporidium hominis
atgagtcaggattggaatcaagtggtatggaaaaaaggtggttctagaccaaaaggaatatcaaaagaacaagatcttaatcaagcaagaagaaaaggtgaagaaatcattaccgagaaaaaatttcttggaggtagaaatgcatcaactaaacaaaacatccctcaaaatgctgccaaattagacgaagatactggtgattatcgtatcttcagagtttctggggaattttctagagctttacaacaagctagagttgccaaaaagcttactcaggctcaacttgcacaaatgattaacgaaaaagctagtgttgttaatgattatgaatctggaaaggctattccaaaccctatattggttcaaaagatgtccagatgtttgggagtcaatttaccaaagcccgccccaaagaaaaagcctgataataataatgattaa

SEQ ID NO: 1263 - DNA, 2100 bp, Cryptosporidium hominis
atggtagagacttttgcattcaatgctgatattcagcagctgatgagcttgatcatcaatactttttacagcaataaggaaatctttttgagagaattgatttctaatgcctccgatgctttggacaagatcagatatgaatccttgactgatccagaacaattaaagagtaatgaggaaatgcatattagaattattccagataaagttaataatactttaactattgaagattctggtattggtatgactaagaatgagcttattaacaatttaggtactattgctcgttcaggtacaaaggcattcatggaagcaatccaagctggtggtgatgttagtatgattggtcaatttggtgttggtttctattctgcttatcttgttgctgataaagttactgtaattaccaaacataatggtgatgaacaatacatttgggaatcatcagctggtggttcattcactattactaacgatacatcagacaataagttacaaagaggtactagaattatcttacaccttaaggaagatcaattagattatcttgaggagcgtaccttgagagatttagtaaagaagcactcagaatttatttccttcccaattgaactttctgttgagaagactacagaaaaagaaatcaccgattctgatgtcgatgaggaggaagagaagaaggagggtgaagatggtgaagatgcaccaaaaattgaagaagttaaagagaaggaaccaaagaagaagaagattacagaagtaactcaatcatgggacttacttaacaagaataaaccaatctggatgagaaaaccagaagaagttacttttgaagagtactcttctttctataaatcaatctcaaatgattgggaagatcctctcgcagttaaacatttctcagttgagggtcaattagaatttaaggcaattctcttcattccaagaagagctccatttgatctctttgaaaccagaaagaagagaaacaacattaagctttatgtacgtagagtattcatcatggatgattgtgaagaattgatcccagaattcttaggatttgttagaggtgttgttgatagtgaagatcttccattaaacatttcaagagaatcattacaacagaataagatccttaaggtcatcaagaagaacattgttaagaaatgtttggaattgatcactgaaattactgaaaagcctgatgattacaagaaattctatgaacagttcagtaagaatcttaagttaggtattcatgaagatactaccaacagaaataagattagtgagctcctaagatatcaaacatcaaagagtggcgaggaactcataagcttaagagaatatgttgatagaatgaaggaaaatcaaaaggaaatttactacattactggtgaatctatccaagcagtgcaaaactcaccattccttgagaagcttagaaagttagattatgaggtaatttacatggttgacccaattgacgaatactgtgtacaacaaatgaaggaattcgatggcaagaagttgagatgctgtactaaggaaggtcttactttagaagaaactgctgaggagaaggaagcctttgaagctctccagaaggaatatgagcctttatgccaattaattaaagaggttcttcatgataaggttgataaggttatcacatctcagcgtatttctgactcaccatgtgtactcgttacatctgaatttggatggtctgcaaatatggaacgtatcatgaaggctcaagctcttagagatacaagtatgacatcttatatgatgtctaagaagactatggaaattaatccatataactctatcattactgagctcaagaccaagattgccaatgacaagtctgataagactgtcaaagacttgatttggttactttacgatacttccctccttacttctggtttctcattagaagatccaactcaattctcatccagaatcaacagaatgatcaagctcggtctttctattgatgaggaagatattgttgatgatctcccacctcttgaaccagttaatgatgcagagctccaagcatctaagatggaagaggttgactaa

SEQ ID NO: 1264 - DNA, 648 bp, Cryptosporidium hominis
atgaaaagatatataataccatgcaatatcgaggttagagaagacctcaaagatgggatttctttaattagtagagaactagtgaataaattgactaataatgattttgatgatattaagaatgatagaattattttactcgagttaaatttggaaaatttgaaatttctcattttttttaaaattaataatgatattaatccttgtaaagaagatatagtgtatattcattctgggcttagttgtattagccattttaataagggatatattaaatatataaagaatgagaattgcttcaatattataaataggacaatcatatcagatattgtgttttctggacctcttttttcacaattaagtactcaatcagatatatttctactaaattataagaatttattagtggagggtctaaaaaggcaattctattactacttaaaatttatttcaacagaatataatttaaaagatatactcaataatttaatcctaccttttttaataaatgaaaaatactacttttttcaaattcaatatattaaagagaataaactaacttctgaagaatttcaaaatacctacatgaaattaatttcaaacctattaattatcccaaatgtgaatcaattaaactctaaataa

SEQ ID NO: 1265 - DNA, 450 bp, Cryptosporidium hominis
atggacacaatctcaacagcaaattctcgtcaaagtatccgtaaattatacaaggatggtttgatcttgaagaaggctgttgctactcattcaagagctagaattagtagagtccatgaggctaagagaaaaggtcgttctatgggtcttggtaaaagaagaggtacaaaggatgctagaagaccagagaaggtcttatggatgcgtcgtcaaagagtattaagacgtctcttgcgcaaatatcgtgaatctggtaaaattaataagactatgtacaaacaattctacttaaaatcaaagggtaaccaatacaagaataagagagtcttgattgaagctattcacgtcgctaaggcagaacatcttaaggagaaggcattacaagatcagcttgatgctcgtaaggctagagcagccaatttgaaacaaaagcgtaaggttcttcaatga

SEQ ID NO: 1266 - DNA, 1206 bp, Cryptosporidium hominis
atggatggaatacaggaaaatttttcaaagactttagatattgattgtaattcatccatttcatctgtagttttgacagaactttatgcatttgttggtttaataggagaagagtcaaatgtaaatgtatattgttacaaagatcatgaagataataaagacaagaattataaacctaaatatatattagaaaataaccatggtgggatttcaaaacttgttttatctccttgtaagaatttattgatgggattaacatgttatggatggatatatatttggaatattgaacaattaggtaataatacaaataatgatgttgaaatgagtatagaagaaaataataataaatccaatattaagagtaatattaatgaattaactgaggaaattccagtgataaagccggacatattctttatgaatggccatcctggtgattctatttgtgtagaatttattaattcaaaattaataatagcagctggaattaatccaggttctagtattacttttatatcagtaaaaactggaaaaagagttggtcaatatatttctagaaagaatgaaatatcaggtctagcatggccaatgtactataaatttgatgagaaagaaattaaagaacaaaattttgaacttgcagtattttcttttacaaacattgccatagaaaggtcaagctcaagtggaggatgttggattgctcttggtggttctaatggatttattactttaatatacttaccatgtgcaactatttcaaagattgaaaggttatatgaaaccattaatattgaaaatgaggatattaacttgtcaaatacagaatttctatggaaatgccatcaagttagtgaattatctacagaaattaaatcattaatatggagaccacgtaataataataatactggattatgtcttgtatacggtaccgatgattcattattacgatattgttttattgaggccgaaaataaaaatattatgattaaaaaagttaatttagtaaaaataactgatggtacttcaacttgtagtgagattaattctatttcttttcctatggatggacaaaataattctattttggcagtaggatttaatagattttcatcagcaaaaaggcatccaatatttgctacttcagaaaatttgaccaagaaatctcagtcattttcttcatttaaagtttatattcaa

SEQ ID NO: 1267 - DNA, 1179 bp, Cryptosporidium hominis
atgaccggtaaatgcctggattcattatttaatgaggaagatgatataaatgaaattattgaaacagaggattcaattgtagattcaaaggaaacaattattaatgaaaaaatatccctagatagtattttaggaagagaattaatgagtaatgttaagaaagatgagaaaagatccaaaaaaataaagttagactcaaatattcaacaaaagttatcgtttaattttgggactggaaacacaccttctagtaataataaaagtaagcctacaaagcttgagaaagttccagagaatgaggaaagtggggattcttctaccaagaatgaatctgaaagtttaagtaaaactataaaacctagtaatgcaggtctcttttcaccattttctattaatattacaataggagatgatttttttcaaagtccaatgttagatccttgtaatattagcaaggaaaagataatggcaaaagggaaaagtaattcaatattattttctgtgttaaccgatgccttttcaaggatagagcaactaaaaggaagtggatctggtagtaaaaagggttgtatagtaattctagcaaatttatttcgactgataatacatcataatccaagtgatttaattgatgcagtttatatttgtatgaataaagttgctcctgattatgaagggaaagaatcaggagttggtgattctattctaataaaatgcatatcagagtcttctgataagtcagagaagagaattaaagaggatcaaattagtggaaaatttgaggatttaggtgaaattgcagcaatctgcaagaaacaaatgaggcttctctttgaaccacaaagactaacaatacatgatgtttatagtgacttgtattcacttacggagatcacaggtaaacaatctcaacaacttaagaaagataagatcaagaaattattagtttctggcaaacaggatgaagttaaatatatcgtaagatttttacagggaagattaagaattggaatacaacaaaccactgtttatcaggcattagcaagtgcatttgtgttaacaaagaatattccaggagataatttggctagtttttctgattatagacttgcaaaaaatgagaacaaatttaaaaatctacaagaattagattgcgaaatccttgaaatggaaacctca

SEQ ID NO: 1268 - DNA, 1254 bp, Cryptosporidium hominis
atgttctttaatctttgggctcaatcaaagaattcaaatccacttggtaattgtggtattacttttgttgattcacaaagtttttattttgatgttaaagtattagaagccaatagtgaagaagaggaagccatggctagacttgcatcaaaaggagctttaatgaaaagaactgtaataggagctttacaaccttttagaagcttttccaggcaaagcactactatttatgaaagtagtaatgagctagcttttaaaaaaattaatagtagtaaatattcagatgcaatattaagatattcaagaacaataaatagttggcttcttgaacaaattaataataaggtaattgtactttttgatcatctttgggaaggaaatgcttcaataagaggtgatcgtgtttcacatgaatcacagacttttcttgatataatgaattgttgttcttgtaaacctgagcgtattttcattttagctggaggatttgcttcacttagtccaagatatgaaggatgtattgatgaaaatccaatttgttcagaattctctgataataatttaccattcagatttgcatgtgaatctattcctttgtttcctattctcactcatttttgtgttcttacttgtgatattggaatacttgtacataatgattgggataaatataaagataagtttaacatatcaaaaattgttaatttgacaaatcagccagaaatcttcaatttcccaaaaaattcaaaaattaaatattatagcgttccttgttataatacagaaactccagattattggggagttgttaatattattagacaaacacatcatttacgtaaatctgtattattagtagataacactggcgattaccattcacttaatattgtggcattatttttaattgaattaggttataaaccatctgaagttattcaatttattacagaaagaaaatttggattcacttttgatggatttattcttgatttgtttgaggaggtttattgtaaaactaaatcaactccagaaaaacttcgtcctgttaggcctcctattcaatttccaattgataaagttgttgatcttgaatttgaagaaaaagttattaaaattattcaaagtattttttcagaaagagctttcaaaaataaagaaaagatttatgaatgtcttaaaaatattggaattatacttaaaaatgtgatttcatttccaaataaccccttctatagaataataagtctttga

SEQ ID NO: 1269 - DNA, 2376 bp, Cryptosporidium hominis
  misc_feature (2293)..(2293): n is a, c, g, or t
  misc_feature (2295)..(2297): n is a, c, g, or t
  misc_feature (2302)..(2303): n is a, c, g, or t
  misc_feature (2305)..(2305): n is a, c, g, or t
  misc_feature (2307)..(2308): n is a, c, g, or t
  misc_feature (2310)..(2311): n is a, c, g, or t
  misc_feature (2313)..(2313): n is a, c, g, or t
  misc_feature (2316)..(2318): n is a, c, g, or t
  misc_feature (2320)..(2322): n is a, c, g, or t
  misc_feature (2324)..(2324): n is a, c, g, or t
atgacaacattttctgtagtatcagaaagaccagattttcctaaattggaagaagaagtccttgaatattggcgaaaaatcaatatattaaaactaactcttgaaaaaacaaaaggaagaccaaattattcattttatgatggacctccatttgctacaggattaccacattatggtcatatacttgcaggtactgttaaagatgtagttacaagatatgcaactcaaaaaggatattattgtgaaagaagatttggatgggattgccatggattaccagtagaacatgaaattgataaacaattaaatatcacaagtagagaagatgttttaaataaaggtatagatttttataatgaatcatgtagatcaattgtattaagatatactcaagaatggaaatcaactgttgaaagagttggaagattaattgattttgataatggttataaaactatggatttaaatttcatgcaaactgtatggtgggtatttaaacaactttttgatcagaatcttgtttatagagcttatagagtaatgccatattctacagcatgtgctacaccattatctaattttgaatgtaatttaaattataaagatgttaatgatccatctgtaattattacatttccattattagaagatccaaatattcaattcttagcatggacaacaacaccatggacacttccttcaaatgttgcaattgctgtacatcctgaaaagaaatatttatattttaaaactaatcattctaatgatattacttatgttgttgctgaatccagattagaatgggtactttctgaacttaaaattaaagaatataatatcatttctgattgtattggagcagaattacataataaaaaagttatacctttatttgattattttaaaaatcatgaatcaagtcatcaattctggaaaatacttgctgataattatgttactgataatactggtactggtattgtacatatggctcctgcttttggtgaagatgattatagagtttgtgtaagtaatggtattattgataatcatggtacaaatttaccatgtcctatggattctaatggtagatttactgaacctgttagtgatttaaaaggaatatggtttaaagattctgataaaattattaaacaagaattaaaaaaaaaatccagattattaactgataatacatgtatgcattcttatcctttctgttggagatctgatacacctttacaatatagagctgttccttcttggtttattaatgttgaatctttaaaagataaattattaattaataatgaaaaaactaattggattccaaattatgttaaagaaaaaagatttcataattggttacaagatgctagagattggtgtgttagtcgtaatcgtttttggggaacacctatacctatatgggtatcagaagattatacaattattaaatgtattggtagtattgaagaattaaaatctttagcatcaaatttaaaagatgaagaaattaatgatatacatcgtcattttattgattatattgaaattcctgatccaagaggaaataattatccaccattaaaaagaattgaagaagtttttgattgttggtttgaatctggttctatgccttatgcatctattaattatccatttgaaaatcaagaattatttaataatatatttcctgcagattttgttggtgaaggtttagatcaaacaagaggatggttttatacattaatggtattatcaacagcattatttgatcaaccagcttttaaaaatattattgttaatggtttagttttagcatctgatggtaaaaaaatgtcaaaaagattaaaaaattatcctgatccattagatattgttaataaatatggtgcagattctttaagattatttttaattaattcaccagttgttagagcagaaactttaagatttaaagaagaaggtgtaaaagatgttattaaagatgtattactaccatggtatcattgttatcgtttttttgtacaagaagctattagatatgaaaatactaatcataatataaaatttaaatcaaataaacaagtaataaagaatactaataatattatggataaatggatatattctgaagctcaatcattattaaaatttgtaaaaactgaaatggatgcttatagattatataatgtaacaccaagattaatatcatttttagatacactttgtaattggtatgtacgtttaaatagagatagaatgagaggtatttatggtatgaatgatncnnngaatnntntnnanntnctnnntnnngntttaatgttaccggtaataattttattttatattaataagattaatatgtga

SEQ ID NO: 1270 - DNA, 1557 bp, Cryptosporidium hominis
atgggcaaacgtaaggaattagaagagatgagtgacggcaagattgaggctgtaataaagccagaaagtaagtctcaaccgattgatacttcaaactggccgttattattaaagaattattcgaagttgaatgttagaacagggcattatactccacttccatatggtaattcgcctttgaatagaaatttgactgattatttgagttatggaataattaaccttgataagccagctaatccatcatcccatgaagtggttgcatggattaagaagatcttaagatgcgaaaagacaggtcatagtggtacattggatccaaaagttacaggctgtttattggtttgtttaaatagagcaacaagattggtaaaatcacaacagagtgcaggtaaagaatatgtctgtattgtaagatttcactcaagtgttggcggtaagtcagcagtgagtagatgtcttgaaactttgacaggagcactatttcagagaccaccagtaatttcagctgttaaacgtcagcttcgagtacgttcaatatatgattctaaacttttggattatgatgaaaagaggaacttggctgttttttgggcaaaatgtgaggcagggacatatataagaacaatgtgcgttcatatggggttgcttttaggggttggggctcatatgcaggaattgagaagggtaagaagtggttgtttatcagaaaatgacaatatggtaacaatgcacgatattttggacgctcagtatatgttagataattatagagatgaatcatatttaagacgtattatttcaccattagaattacttttaacagatttaccaagaattgtagttaaggattcgtgcgttaatgcaatttgttatggcgcaaaacttatgattcctggtgtattgagatttgataatggaatagatgttggtactgaggttgtaatgatgacaacaaaaggtgaagctatagcaattggtgttgctcaaatgactacagctgttatagctagtgtagatcatggagtagttgctataataaagagagttattatggagagagatacatatgatatgagatggggacatggtcctagagcttctgaaaagaagaagcttattttaggtggaaagcttgacaagcatggaaaaccaaatgagcaaacacctgaatcctggcttaaatacgagggttatattccaaagcttactggcgatcatgatgatcaaaacgatgaggggaaaagtattacaggattaggattggaatcagaatctaactctaatatagaatcaagctcatcgaaaaagagaaaagaaaagaaagaaacaaatgatgaggaatcatcttcatcattttcttctaagaacaaaaaagaaaagaataagagaaagagtactgaaccattaagtgaaaatggaagcagtagtagtagtagtgatagtagtagtagcaacagcagtagtgatgatgaaaagagtaaatccaaaggaaaaaagtcatccaaagataaatcaaagaaaaaaaagaaacacagtcgtatcagtgaagactag

SEQ ID NO: 1271 - DNA, 1446 bp, Cryptosporidium hominis
atgaggttgcaatccaaacaaaaatatcagtttcctgatttggagatgggagagctgatgaatgagttggatatgttaggatttgaagttggaagtaacttttgggaaagtattaaccatgaaatagcagtagaactttatatgaactgcttgtcaatagcattagagatagatacagaggatattcgaccggaagagttaataggacaacttccatcttcagctgctggaataatatctgaaaatggaaaaagtcaaattaaaccaataggaaatttgagatttttacgttactgtaagatcctttgggtaatgataggaatcgatgattttagtatgaatgacatttatagaccaactccagatagaatttattcgttcttatgtggatttgtgaatttgatgcgtttcaaagaagatcgttggatgacttataagaatgagttttatgaaattgaggaaattttggactctgtagataaatctaatgaacagattaaacaaaaaaaagaagatttgaataatattagagtaagatataacgaacaaagtggtgaaattgcaaataggaggagggataatcaggaataccaggaaaagatgagatctttgcacggagaatttttgcaaaatcaacaagaacttaagagattaacacagtcagagcatgatttaaaggagcagcttaaagatgttgagtttaggattaccactggaaatcaagatatacaagatttaaaggatcaagttgttcaatccccagaaagacttagaaatactctggaagaattgaataaatctttagagaatgaaagaaaacaaattgatcaaattagtatcaaaaataatgaactaaaggaaagacaaaatctattgcaaaagactgaaaaaaggcttggtaaggcaaagacattccttgaacagactattagcggaattaaagatgcaaataatattaaacaatcaatcaaagaaatcgagcatcatattgagaaggataaatggacaattgagcaaactacagaagaagaaaggttacttttgcaaactgtggaacagatttcactaagaattcaaaacaatcaacaacactatgagagtttaattgaagaggcacagactttgcttaatcaagagaaacaaaagtttgaggaaggacaggaattccttgatattcagagtagtgaagcattttcatttgaacgacaagcagaattgatggaaaaagagattcagaattcaaaagtatctcatgaaaaggtaattaatgcactcaatattcagcatagccaactactaaatgtccttaccaactataagaaacatttaatcagcaaactgaatgacataaactcgaggtataacttaaagctattagatgaaacatccaaggaaaattcaacaataaactctatagaaaacactattgtgatgcaacacaactag

SEQ ID NO: 1272 - DNA, 591 bp, Cryptosporidium hominis
atgtttcgttgtagaatctgtactgagccaccttttagccatttttttaatttgagaatttttaatggatatttttctgatgaaaggtctaaaaaaaccccttaccaactgagtgaaggagattctgtctatgatactcaatcatatggaagctcacttttagccactccatccaacttaaattcatttgagccaagaagctctgaggaaattaattctatctgtctcaaatgggaaaaatgtgtacatgagagaggtagggaattttggaggacttcagaatgtttgatggaggtgctttcagcaatagcccggggtgttaacaataatgatgacccaattttgggtgatccccagagatgtattatgtggtacggacaggtttcggcaattgatgggtgtccagtcataaggatgaagagaccagatgaagttgttgagactcatacatatgtaaacagagcgttggtattcttgtatgctagcgatgaatcctttgaggagttacaattgaagccaagagtggcattcaatatggcttgtgggaaccgtagatgtgttcacttgcgtcatatatctctggacgactaa

SEQ ID NO: 1273 - DNA, 438 bp, Cryptosporidium hominis
atgtttttagcatcaccaaagattttggaaccaattagtctagtagagataatatgcccatcgggtttggatgaatttattaataatatagtatcaaaaagaagaggccatgcaggcaaggaaattccaattcctgcttcaccattagttacaatattagcatttgttccagcaatagagacttttggatttgaaacagatttaagaattcatacaagcggacaagcattttgtacaagctgttttgaccactgggcaatagttccaggtaatccattggataggaatatttcattaagacctttagagaaagctcctattccacatttagctagagattttcttcttaaaacaagaagaagaaaaggtttaagtgatgatgttaatattcaaaactttatcacttgtccagaacttattaaagctttgaattattaa

SEQ ID NO: 1274 - DNA, 1452 bp, Cryptosporidium hominis
atgagttataattccaaattggatttgaaagctcaggaaaagtcagtatttgaatccaatcctatgatgacttccattgctgatgtaggttacaattcaaaaccagaaatgaacttgaatgagaaatccgtctttgagtctgttccatccaatgtttcaaaagccgatgtgagttataactcaaaaataactaatacttctgagaagtcaatctttgaatcggaaccaataaaaaatgttaatatagacgtgagttataattccaaattggatttgaaaggacaggaaaggtcagtatttgaatccaatcctatgatgacttctattgctgatgtaggttacaattcaaagccagaaatgaatttgaatgagaaatctgtctttgagtcggttccatccaatgtttcaaaagccgatgtgagctacaactcggtagtagccaatacttcagagaagaccatttttgagtcagaaccaagaaggagctcagtggcggatgtaagctataactccagtttgattcctatttcgaaggatgaaaagactgtatttgagtccaatccaaatgttgattcaaaggcagatgttagttataattctaaaatagaattaaaaaacgacgaaaagtttgtatttgagtcaaatcctaatgctgattctaatgcagatgttagttataattcaaagcttcagccaagaaaagacgaaaaattcatatttgaatctaatacaacagttaactctaaggcagatgttagttataattcaaaatctgaacctaaaatgaacgagaagttcgtatttgagtccagtccagttcttagctcagttgcagatgttgggtacaacaccaaaggagttggtatgactgaagaaaaatctgtttatgaatcagttccaattagtaaatctaaaatagatgctggctatgatacaaagttggactttactcatgaaaataataaaactatatttgaatcaaacccatcttgtaaatctatggcggatgttggatacaattcaaagattgaaacaagaacagaagaaaaatcagtttatgagtcaaattacgataaagtttctaaggctgatgctagatataattcagattcaagccaaatctatcctccagagaagatggtatatgaatcaactcctgttgttggattaactgtggatgcaaggtttggagatcaaaacaatacaaacgaagagaggcaaacagtttttgtatctcttccaaggtctgagtcagtttttgatgcaagctactcattgaataacgaatataggcaggaaaagacaatatttgagtcagtaccaaatacaaaaggtattagaatagacgcaagatctagtgatacctctgaaataatgaattttcagtctaagacagtttttgaatcggtacccaaacagtcttatgctgatgcaaaaagcgggaatatatag

SEQ ID NO: 1275 - DNA, 2157 bp, Cryptosporidium hominis
atgtctgaaaataattcaagcgttaatgaagaaacaaagaatgtcattagaggagtcacaccgccagaacctaagttattaggtacctatattaatatggtacctatttcagaatcagatacttcaaaattagaaactaataatttattacaagggcaaactagtggaacaggaattacagctgataatgctcaagtaggaaagccaggaagtggagttacagtaacgaacatccccacatctcaattcccaatgtctgcaatgaatatggaacaattacaacaatttatgttgagaatgcaaatcaatgcatcaaaagaccagatacctcccggtacagcaaatactccaagtcttggacttggtcttagttctggaattccagctcaaaccttgggagcaaccttaaatttgaataatatgattccaagctctacaaccacaagttataacattccaccagttggagcattagaccccaatgtccttgcttctttaggcttaaatgttcagaaaccaactttacagccaattcaatttcccaatatgcaggcaggagtacctaatttgtgtggtattcaaggacaagatttgaacttggctacttggatgcagaagcaaaagattgctttgactttatccgaacttcaaaataatactcagaccgcttccaatactaattcagctgaaagcaagcaatccccatcctctgcttctgcttctaattctgtttctgtcgctccacaaaacttgggccaggctaccaatgctgggaattccttgggttctcttgctggaatttcaggaatcccagggaatttaggggctccaacaggagtaactggtgtaatgcctggaagcgctaacttaccagttggaactgcttcagctgcacaatctcagctaactcctcagcttgctgcattcttgggaaaccccaatttaatcccaacaaaagatacaggttcgtcttcacagactgcaaatcagatttcaagtggatctcttggatctcttggtggtattccaggaattggcactgctgcagggatgaatatatcaggaatgaatattccaggaatgaatcttggagctggagctattccaaatatgggaaatgccgttattccagagtctattcaaccaaatattatgcagccaaccactgacatgtcaaagattgaggcaatgatcaaacaacagcaacaacaatttatcgctagtcaactaagtgctgcagctcaattattaagacaacatggtattcaagcgacaatcggtaccgagccattaaataataattccgaaattgatattagtaaaaacaagaagcctgctcttttacagagaatagttgccagtaaggttaatcctaagatatttattatcccaaatgctctaaaccaagatgaatgtgatgagattatttcccttgtccaagatagactagaggattcaaagatatcaatagccaaaaaagaaagcaagaaatccgaaatcgatgaaattaaagatgaaaaaacagatggtcaggattataaaaatgaacaagatgaagataaggatttttgtagatcttcaactgcctgtattcaaccagaagaaactcctcttattagacagattgaaaataggcttggaattcttgtagactctagcaatctttatatggagccaatcctggtacacaaatattccgtcaatgattacattaaagaacaccatgatggagataatagaactcatacaatttcagttttcctttctgatgttgaaaatggaggagaattagacttcccttatgctggaatcaaaataaaacctaagaaaggtctcgcagttgtctggccaaatattgattctcaaggtaaattagactatacaacagtacatgctgtaaacaaaatgactcaagttactgtggaagattgcaaagatgaaaatcaaacaaaagaatcaaaagaacatccagaatctcccccctcatcctatctactctatcttcatgtaaataaggaaccagttagactcggttttgaagcttcccaagctatgcaacaagtaattcaatctgagaatctcaaaactgatgatagtccaaaggttattacacaagttacttaccccacatcccaagacaaaaaaactgaggaatag

SEQ ID NO: 1276 - DNA, 1560 bp, Cryptosporidium hominis
atgtctgtggaggaacaaaaaaagaatgaaaacaatacaaatgaaaatgaaaagtcatcaggatattttagtgatgtaaaatttgaatcatcaaatatttgtgaccaactaaaaaaagcccttaaagaaatggggatggaaactatgacggaaattcaagcaaaagcaattcctcgaattttaagtggtaaggatgttttaggagctgcaaagactggttcaggtaagactttagcgttcctaattcctgcagcaaatctactatataacgtagaattcttacctagaaatggaactggtgttattgtaatttcaccaactagagaattaagtctccaaatttatgaagtatgcagagagctttgtaaatatttaccacaaactcatggtttggttatgggaggagcaaataggagaactgaagcagaaaagctttctaaaggtgttaatatattagtggctactcctggaagacttttagatcacttacagaatacaaaacaattcttatttaaaaatttattgaatctagttatagatgaagctgatcgaattctagaaattggttttgaagaagaaatgaatcaaattattaaattacttccaaaagaaagacaaacttctcttttttctgctactcagacaactaaagttgctgatcttgttagactttcacttaaaaatccagttcttgttgaatctaaaaatacttcttctattgcaacagtttcaggacttgagcaaggatatgttatagctcaagctaatcaaagattcttgctattatatacatttcttaagaagaatagagataaaaaagttatggtcttctttagtagttgtatgtcaaccaaattccatgaagaattatttaattatgtagatttaacttgctcatcaatacatggaaagaagaaacaaacttctagaatgcaaacttattatgacttttgttcagctgataaaggtttattattatgtactgatgttgctgcaaggggtttggatattccaaatgttgattggattgttcaatatgaccctcctgatgatcctagagaatatattcatagagttggaagaaccgcaagaggagctggtggtactggaaaagccttattattccttcttcctgaagaaattgccttccttcaatatcttagaaagatgaatattccattaaatgaatatgtttttggaaaaaataaagttgctaatgttcaaaatcagcttgaaaggcttattgaaaagaactatcatctccattgttcagctagagatgcttacagagcatatttgcattcttatgcttctcatgcactcaaagatgcatttaatgtatattctcttgatttacagcaaattgcatttagttttgggttcagcacacctcctaaagttgacttaaatctaaaatcgggtggaaaagcttctagaaatgcaggtaacaaatctaagaataaaagtagcaacccatattttaaatctggccataaattctctgcttctaatccatatggtgttagagataaaaatgacaatagacaatttgttagataa

SEQ ID NO: 1277 - DNA, 279 bp, Cryptosporidium hominis
atgagatatttccacaaaaggctaaacaagatgtactgtcctactgtcaatgttgaaaagttatggactttggtgtcaaagaacactcttgaacactacaagtacaataacaagaccgacaaggctccaattattgactgtactaagtctggtgtctttaaggtcttaggtggaggtaatctacccaatattccagttgttgtcagagctagacacttctctaagaaggctgagaagaaaattaaggaggccggtggtatctgcgtattaagtggataa

SEQ ID NO: 1278 - DNA, 1320 bp, Cryptosporidium hominis
atgcaaggtgttaatgtaaatgtttataatagacaaaagtcctatggaactacatcagcaggacatgcttatggcatgacatcaggactttccatgcaaacagtacaagatatggcaggagtttctggaagttatatgaatactgatacattttcaactaaagattatgctgatccaatcatgtttgacaataagaaatcattcttcaatagcattaaatttaaaagatttaaaaaaagatatgcaggagttttaggatttgctattttaatttgtttcttgattggtttttacttgattttattttcagcaaaacatccaacttctaagatatctaaaaataactctgtttttgaagatgaacatatacaatttactcatgatgattttcttggacatagtggtgctagacatggattaaattcaaatgaaaaagattctcatagtaatgattggtcagattttgaagacgattggattgatgaacatgatttcttagaggaagagattgatgatgttgaagattctgaacatggacattctcattatgctaaaatgattaatgaaatggataatcatcatcatgataatggttctcctatagaaacttcatttgatgcatcaccaaagccactcaaaagtacagatgatttggatactcataaaaataatgagcaagtcatacaaactactgataaacttccaaatgaagttcatggaacagttccaccaaaaccattaactgagataccttctcatgaagaaagtattgtttactttccaaaaacaattcatttacttggaagaattggtgatgactcagtagttaatggtaaatacaatgtaatgatgcatccttatcatgaagaaagtccttggattcatggtggaagactaatttggtataagacaggaaagaactcttctaataattattatatattttatgaaaagaagttacataattgggttttgacggataaatttgatcttgataatccaaatcctatagcctttttaccagatcatggagtaatgccagttaaaggagttggtaggcatggatgcaaagctcaacattactggtatttcagagagaaaacttcagataattctcacaaacttgtaatggatagatcagttttagttactgacaatggaattttacttgattcacttccagatcacgaacatagaaaaggatcatctacaaatcaagaagtgataggactcaaattgcacaaaaaccaaatacatatagatcacaagtactatagtgacaagtattctggtagacaccaaattgataatccctactaa

SEQ ID NO: 1279 - DNA, 900 bp, Cryptosporidium hominis
atgacagatactgaaaaattaacaaatattagtgataattgtgatgatataaaaaattacgttgataaaaacctacttaactctttaatggaaatgggatttggccaagtagaatcagaaaaagccattttctttactagaaataaaggactagaaaatgcagtaacttggcttgaagagaattctaaggatgattctattaaggaacctataattgaaatttctggttctgatagcattccaggggcaccgaaattaacagatgaagaagctcttgaaaaagcaaaagaattgcaaagaagagctagagaattacgtatacaaagagaaaaagaagaagaaattgagaaagaaaaacgtagaatagcttctacaaagcaattattagaagctcaaagaaagcttgaagaagcagaaaggattcgaaatattgaaaaagcagctaaagaaaagaatgctcatgaagttgaaagacaacgtcaattaagcttacttaaggaagaatgggaagaaagatttggatgtccttatcctgaagaaaaaacaaacgaagttccaaaaggaaataaagaaaaggttgcatattattgtaatcgaatgaataaagaatatagatcaaaagatttacaaggtataatgacatgctttaatctacttaaaacatatattaacaatgttcatagtcatccttatgaagaaaagtataagagaattcgtttaaagaacccaacttttgagtcaaaagtactcaaataccaaggatcattagagattttaatggcatgtggctttgttaaagatagtaatgaagaatttttagttataccaccagaaaaaatacctgatacatttgtatgtagtcaagctattaaattcctaactttactgactcaaaattag

SEQ ID NO: 1280 - DNA, 1020 bp, Cryptosporidium hominis
atgaataaaggagaatttcataatgagatgataagctcagaaacagcctctcaggattctaattttcaaaaatttcaaagagctgcagtaacattggaagcatcagctagaatatatggatatagagtagattcgacatttgataatgcttataggattttatctaacataaaaagtggacaaattttagctagaaatgattcagattgtgaagaagatgaaaaagatcagcaagaagatgatgatccttccggtaaaagattagaagaatcgagtaagaagaaaaaatacaaaagaaacttgattttttctggagaaaataatactatagtaagcaatccagaatctatcacattaaaagagtttgaaaaaactaaagaaatgagtgagaagccattttttgttaattttttgaatgataaggttaaaatagataatattagatttggattagactataataatattggttcaatttcatcaatgctaatgaataacttggaattgaaagattcattatataatagagacaaatcagcttcacttacatttaatatatcaggaaggaataatttgataaatagtagtaacttttcatgttcaacaatttgtcgagataaattattcaaagtaaataagaaaacattggatttacttcttccaaatccaaataaaaattttggcagggatattagtaatattgtttgcccaaatttgtcaaggatttttgattcaattcaagaaattacagaaaattatagtgatattaaacaagttaaagattcaacttctattgaggaatatcaactaaatgaacaagtaattaggagattttttgaatttactgatccatcatttgagaatgattcattagaatctgagaataactttttgaagaaacatagccagagcatggatgatattgaatatgtgaatgaaaatcaagatcttgaatttttgaataattttgaagaggaggagaaggtagagcttaatatgggattacaagattatacctag

SEQ ID NO: 1281 - DNA, 438 bp, Cryptosporidium hominis
atgaatgaacaaacagatcttatggtaaatcattgtgaaattgaagatcttatgcaagttgaaagttatctccaaccattaagccaagaggaattctctatagataatggcaaagatattcttattcaaagtaaattattattaccatttgatgaagataatatttccgatacagatatccttcttgaaaaaagttcaaagtctcttcatgttagagatgaatacaacagctcattaaaattctccaagtcatcaaatcatgttgatatcgatttaatcaagaaggttttaaagaattcgattcagattctacaatcagacgattccaattctttgacattatttaatattataaatcaatcagtaagttttttaaatagtaatttgtggaatttaatttatgtatttatttcgcaaattgttatttttatatattaa

SEQ ID NO: 1282 - DNA, 540 bp, Cryptosporidium hominis
atgcttaagaaattttcaactgaaaatatatcatctcagaatcaggtaaaatcatctgtacaaagatcaattaaagctaatattcttgctttatatcctttattggagcaagttattgatgatattttaccaaaaaaagaaaatattattttatctaaatgttctggacattttcaatttattgttttagattctattccattattctttcaacaaagagatggtccatggtttccaactttacgtcttcttcataaatatcccgatatgatgcctactatgcaagttgataagggtgcaattaaacatgtattaaaagggtctaatataatgtgtccaggtttaacttcaccaggaggaagaatggaacaagttgaacaaaaacaggttgtaaaaattgttggagaaggatgccaaaatgcatgtgctattggcataacaactatgagtactgatgagattagacaaataaataaaggagtatgtattgaaaatgttcattatttaaatgatggactttggaatgttcataaattttag

SEQ ID NO: 1283 - DNA, 2361 bp, Cryptosporidium hominis
atgagtggttccaaagtattggaaagtttgaataatctccaaactgaaaattccctctcatatataattgaaaatgaccaagattacggtagtaaattatcaaaactattatcttacaactctacgggtgttcctatgttaggaataaataatattagatttaatgaaaaaacggatgtggaaataaccaaaattggatcttatattcaagactttatttcaaaatccaaaataatagatggttctaaagtgcagtttaatgcatgcaacaatattgagagtatattagaatgtgaggaacctaagaaatataaagatgatttggataataacaaagttacagaatttgatgaaaatgtactggccataaagaatattgataaatatgatcaaattagtaacaaagatatggacgaaatttcttattcagatgaaattaatgttattaataagaacgaaaatataaatgaggaatataatgatgaattaactgaagaaaaagatcaagaattagaagaatgcttacaaattttagacactattcaggcatcaaaaacaaatacaatggaagaacaaactacaagtagaagttctaatatggcttcaaatcctttaaatttttactttgaaaatatatatgaaaagagtcttaaaacattgtctaatgcattagcttttgaccaattcgacgctgacctccaaagcagagaatttctagatttgaatctggactattctttcgaatctaataatgtgagtatggagaatctgaatggtaataatgtggattcagcattagatgcaacttattttttggaccctgaatttgaaataaaacccaaatttgagtctgaactcgagcctgaactcgagcctgaactcgagcctgaactcgagcctgaacctgagcttgaacttgaacttgaacctaaacctgagcctgaacttgaaattgagcctgagcctgagcctgagcctgaatctgaatctgagttcaaacctgagcctgaacttgaacttgaatttgagcctgaacctgaacctgaacctgaacctgaacctgaacttgaacctgaacctgaactcgagcttgagcctgaacctgaatacaatcttgaagaacagtgcattaatattgagaatgaacctgttgaaataaaaacagaaaactacttacttgagaacagtgatactttgagacttacagataaaactccagtaatgatgaaggaaagtaaggaagcaacacttactgaagatcaaaaagagattaatgggttaagtttaagtagtgaaaagaaatggagaatgaaaattgagaatattatgaaaagcaatgataaaagctctcaaaatattaactatgttgttaatatgggagaaaactataacaaaaatagcagcttccatctcagagacaacagtataataagtagcattaacaacaatagcaccacttctactactgctactactactactattggtattaccaacgctattaatgatgtaaatgaaaatggtttattatacaacaaagacctaaaaataggtgtaattaaagaaattgagcaagaacttagagaatgcaagctttctttgaatactaataaagaacattcaaatatattaaagaaaattagtaatattgacttaaataataaggaattcgattccagctttgatctgaaccttgatcttaatttagaactagatataaaccttcaaacagatctagaatgtgaatttggttcagaatctgaatatgaaaataaacaagactttattaataactttgactacaaaaatgatactgaaaatgattacaatataccaatgtcacataaatactctcctactgagataaaaattcaaccaagtatcttctcatttgatatttcattagatactaaaaaatctaacctcgataactcatacttaaacaaagaaatcaatcaaaataatagaaattttaacaaaacatatattaacaatcttgatgctcgatcatttgaaataaaactatctgataaaaaaattgaggcgccaaatcaagaaattaatttcttggaattaaataattattacaaagattatgacgaacacgcaaaagttaaacctgaagattcgaactatttagcaaaaacattgaatttatcgtgtggggtagatgaaaaaattcacccatctgatacatcaaagactcctgaaaatattatcacagctattaaattgctagctatagttagagatattaaaaggcaaatcaagcttattaaaaatcaacataataaatttaaccaagctcactcacccagaaaggactttgcgcgcgcaatgcaaaatctgacaaatttgtaa

SEQ ID NO: 1284 - DNA, 1542 bp, Cryptosporidium hominis
atgccaaaaataatgaataactatggaatttttgagttaaatgaacatgctgatagggttgtagtttatctttatctggataaagatttatctatacaatttggctcttatatggattcttttaatacacttgattccaaagataaatgtttagaaacaagtataatatttaataatggcaaattatggttagaggtaaagggagctttagataaacaaaattcgaattctaagtttggtaaatctatggaagacataataatttcaaataataatcagtttaatttagagaagcaattatcattttcaaattttaaaatttttttaaaacttccaaatcgtcttcaagtacaagatgttttatctgttagttattaccatgataatatttcaagtaaaatctccactggatctgaaattaaaactcaagaggctactcccatcttgttttcaagaattgttttaagtttgaaaaataaactttctctacttaccttatctactttagttactgatcaaagctgggaccagccaaatgaattaacttttattgaaaaagatgagtctatttgtctagatcttgaaacatcactattaaatcatctattaatcaaaaagcctgatgatcacgaaaatttaacaaataaattaaatctaaactgtaaaaaatgtggttttttgctttcagaatactgtgaaaattgggtaactgctccacttccaagtgaaatgtttattcatggttcagaaatgcttacatgtgataactgtcatcctgtactttcatcaaattctacaacttattgccatcatgattttggagcaagaccaaattggatatgcttaggaaactatcatatttctattcatacaaataacgcttcacttgatcatctactttttcagagagagagtgattcaaatctagaccaaactttagagactttttttattaatgatatcaacaatatttactattctggaaaaaaagttctctattcattattttgtcaaaactgtggtgataaactcggttggaaaaattatcgagataatcacatcaatttttggaaatcaaaagttctacttaatcttatctctaatcaaaaagttgtctcaactctttttgcaaactattccattacttctctagcaatacattatattgaaaagtacttaaaacaatactcaaagttatatattataaattcaaacgaaatgggggatatgaaaaataaagacgccatttctatatatattattaaaaagaatgttattaaactaaagactcaggtctttattggctgtttatttgaacatattgagtcacaagctcaactatataataaaagatctattatatataattctatcaaaatctcctataatttagatactggtgacatcattaagtctaatgaacaccaaattaaacttgaaaaagaacaattctgtcaaattgtgagaaatattcaagaaaatactttatttaacaaaaattcgtatcttagtattcctattttatccagtgatttagtatga

SEQ ID NO: 1285 - DNA, 360 bp, Cryptosporidium hominis
atgaaagaaaaagaatcaaacatttcagaaaaagagaaaattaatagttggcttgagaaacaaattctaatttggaatgggattccaataaataagttatcaggaaaaaatagagtttctcaactcagctcaaatattaaagttaagaatgaagaaaatttaattactgaaaaatataaagaaacaaaaaagcttgatttggacgagaaaaagaaagaaaatataaggcaagaaatttcatgtagcaatacaaacaaagtggaaaagaatgagaagaatcaaaatggtgatatgagactaagattcaaggactggtcagatttacataattacttattggtatcaatgaaacaagggtag

SEQ ID NO: 1286 - DNA, 738 bp, Cryptosporidium hominis
atgagcaatctaagtataatacaaggcgacttaaatgaattgaaagcattgaaaacacaatgcaaaagagatggagttaaaatgattttaagtaatcagatcagattgttagaggagaaacaaagaaatatgtgtatttctgatgcaggaagaaagaatttggaatataatcaattgaatgttaataacgtacctgaaagcatttcaaagaaacaaagtgaaaaccttccactagaagcttatacttctataacaaaatatagctgggatcaatctgataaaagtgttaaaatatatattgatttagttggagttcaagagaaacctgattgcatcgaaataaaatttgggaaagacaatgttgaaatgtatgtcaaaaatttggataacaaattctactcttttactgtcaaattacatgatactatttctcccgaagagtgttctcacaaagttaaaaaagatatgattgttatcactcttaaaaaagctaataattcaagtaaatggccaagactatcttataaagatagccctctcaagaagacttctgccacctctgatccaagttcaggcatgggtaactttggtgatatgggtggagctggaatgaaagatcctatggccggaattcaagaccttatgaaaaaaatgtatgaagaaggagatgatgagatgaagagaactattgctaaggcttggactgaagcacagagtaagaatttgaaaatgccttaa

SEQ ID NO: 1287 - DNA, 690 bp, Cryptosporidium hominis
atgacacaagttgatcagaaaattacgagtttacttaactcagcatctagatatgatgtctcaaatttggatatattcgagaattgcgtgagagaccagattaataaaggtcaatatagtattttaaataatttagttgttttactacaatattcaatttaccctaaaagaaccaatctagaaattgtacaggatattttattgctctcaataataaggggtccattgtcatctgactttctatcatgcacttatcaaattccattgtcagttcaaaatgacccaaatataaagcaaattatacaacttaatgatttattaactagttgtagatatgcaaatatgtggaacttattaaaaacgaatgatcaactcagaagcaaagttgagaagatacaaggattttacgattctattcgtgacattattatctattcagttaattgttctcacagttgcattagcactgctgttttaagcgagttacttgatttccccaaagattctactgagcttaagaatatcattgaaaagaataaatggattttagatagtgcttgcgaaattattagaatcccattaccagaaaacccaattgaaaacgttgactctaatgcaaataaaaacaaatcattgggatccaatgaagttattttcaaaaattatttgaatttacttagcaataactga

SEQ ID NO: 1288 - DNA, 750 bp, Cryptosporidium hominis
atggcttcaactaatatacatagctgtcgcaatgaggacatagatttggaaagccaagagtttgaatctttttctaaaagtgtaagacatggcttcattcgtcgtgtgtacatgcttgtagctctacaagttttgtttgatttggctttatcattaatggtcttaaatgttccatcattgaaattattcatgctcagaaacttatcagttattaaaatgactgcttttgcatttgcattaatttcatctttgttgttcttcttcttgtataactattcaaatttattgcaaaatcattcaagtaagatggcatttttctgtataattacaatttcagaaggagtgcttctctcactattagcactacttattaatgcaaaatatttgctaatggcgcttgcttttacttcaatcattgttatctcattaacgattttctcgttccaaacaaagtacgactttacatcatatcaagcattcatattttacggaactattgcatttgcagtattctccaccatttatatgttcttcccaactgtcagaattatcgagttaattatatcaccgatcgcaatatttttcttttcattcgcacttgtgcaagcaacacaaagcattattggtaatggaaagcaaatgatttacgaggacgattatgttctggcagccttattgattcactcttatattattgacattttcatatatactttgaggtttattctagcagtcttcgaaagaaactaa

SEQ ID NO: 1289 - DNA, 636 bp, Cryptosporidium hominis
atgctagtttgtattgtaattgcatttctaattatatacttcagagaaagggaaagaactaaaacccgagaaagaattgaaaggcaattcagaatggcagagacgaagaagctgaccaggtatttgcaaactttaagagaaaggatgatgtttaggaaccaaaatgctcaaattaaccgacagccaaattccaatttccagaatggatttccagttaatgttggccccccaaggggacaaatgcagtttaaccatcctccacctgtaggtccacctccgcctattgttccaccgcctgttggaccacctccacctgttgggctacctccacctcaaatgtttaatcaaatgggtcatcctgtaaactatccacctcaaatccaacagccagtttttaccaatgctcctccatttgcccccccagtaatcccaccacaaaacttcgcacctaattgctctgctcagccaattaatataccaccgccaaattgtcctccaaacaactcaaatattacccaaggaacaatttctttaactgttcatgatccatcattaataccagaaggaccgcctccaactcctcctcctggatatgttaccgttccgattgtcttgcaaaacgaaaaccaccaataa

SEQ ID NO: 1290 - DNA, 1008 bp, Cryptosporidium hominis
atggtaaaaaggagtgcaaaagaaatagccagtaattactatgaatcatatgagaatggaatgtattataaacaattaaataaacaagatactagaaattcggatttcgtaaatgaatttgaaataaaaaatgtaactacacttcaagaagaaaagaataattataataaaaagttgattgagaatggactgaacaacatttgcagagtaattgtactggattggcttataggggtacatagaaagtttcaattcaggcctgcaactatccatattgggataactttatttgatagatttatcagactaaacaataaacacggattgataaactgtgacaatcttcaattagttggagcaacctgtcttcacattgcatccaagtacgaagatatgaacccagcagttctattagattactgtataatgagtaattctgaattcaaccctaaagacatgataaacatggaagttgaaatactaaatactttgcagttcaaaatagcagataatactacacttattgactatttggattcattttttgaatatggaattttgaaaggagtaaataaaaaaaagctaccaaaatatttctattcaagtgctttgtatatatcagaattatctttacttcaccaagcaatgatattttatcgtccaaaagtactttcaacatcaattttactacttctatgcctgctatttgaaaaagatgagtcagaaagaaacaatttgtccatattaaaagatttaaagtattcattaaaaagattttcaaaaattaataatatcacaaaggaaattcgaatatgtattaaaagcttattaggtataattaaagaacaattctttctagaggtaaaaattaaagaaggatttgagaattctattattggggttaatccagaagaagaaataccatttatatacttgaaagatttaacaagtaagtggagaaatgcatatacaaacttatataagaaaatttcaagtttaagaacttga

SEQ ID NO: 1291 - DNA, 2667 bp, Cryptosporidium hominis
atgaaagtagaaaaaattaaagaaattgaagcaccaggagatggaatactttcagtatctttccaaccccatccaatcactgaaagatgggataaagaaagagttgctatttgtggagaaaagggtgtttatatttggtcatttgaatataatggaaaccacaaaaaactagcatttattgaaagttcaacatgcgctttaattaagatgtgcagatggagtcaagatggtaagtatcttgcgattgtagatatggaacaaatcgcaatatattataaagaagctggaacctgttcaggaactccaaaaaatttaaattctgttggatttggagttgaggaaaaagatacagattcaaatgaagtatttgagaattggacagtatatacgacattttcaagtagtgatgtgaatgaatgtgcagatatctgttggcttaaagggtcgaaggtattagtaaatggaaccatttctggacatttaattgtttataatatggaagaaagatgtcagtcatgcaatttatttattagagatattgttgccacaagtacgcgtaatcaaaatattccaaattatcatccagacattgggcatgtaagtgggctttcttcagatacccgaggattctttttggcatcccaaatgagtagccgtcgattactcgtttttaatgtaggatataataaagaatatgggaaagatactttatcaaaacgtaattgtatttcgttatcatttttactggaagaagaacgattaataattaattccccttgtatattaacattcattagaagacctgtttttgatccattaacatgtttgcttggttgtccatatggagaagttggaacatcatatttttcctgtctctatccatttagagatatttcagatatcaagccattcggttgggaagagctttgtaaacttgtaaattatcaaggagagaaacaaatggaagatattaaatctgatatttggaatttacataatgaaggaaaaacaagtattaaaggtaagctcgagcttccagatgcatatagattacggggtcaccaaagaagagtaagattatttcaattttcgcaaactgttattaaagaaaaggacgagatattttccttatgtgctcaaagttctcaggatggttctttaagcttttggaaggttatatatgacttaaattccaaatctaagattaagtctattgaatgttttttggttttaactaattttatggatgagcaggccagtgttacagatatttcattcaataatttaaataatacagttttgataggatcagatgacaacaaattaactctagtatcttttgaattggaagaattttcacttgcaaaaaattcttcaaaaaactctcatgagttttactattcaagttggaactattggaactttgaatttacacctgaaaagcctattttacaaaaaatgggcatagaatcatcagcagaagaacccagcttattctcaaaacatgtttctttacctgtaatcacagcaaatgaaataagagagcatcaagaacgaacacaagaagcagttataagtagtaaaggtacaaagattaggagaatacaacctttgaaccttacagaaatatatagtaataaatctgacagtaaaaatgaaactagcatgaatggagtaaactctagcattagttctaatatgcaagaagaaaaaaatctaaataaaacttctaatcaaagtcttgaacatacaactaagaaatctgcaaaaagaagtcaggaaactaaggaaaataattcaaatgaaattaaagaaactttaaaagatcaaaccagaagtgatgaaagtaaatctataaggaaattatctcaaaatgaagaatttgaaaggagttgtgaacaagaaaatgctaataattctatgaaaggaggaaatcaagttcaaattcatcaaaatatttctgattatcaaaataatcaattcattaaagaatggatggacagtattattattccacctagattagcaattgaagcaaatattttaattcatcaaaaaaagtataaaatggtcatttttgctgataacagacaaattattgaaaatattaatagaaataggtcttcttcaactgaaatcatttgtatgagacaggaaactttacaagaaaatcaaatctcaaatatttcaaaggaaatgttatggtataaacctataagtattaatcatatagtaactcacatgattcgtattaaagatgttttattgatcatatattccgatattttagagaagaaaaattctattccaagctctaatttggattttttaaattttaatactggatctattttaattggaggaatctctttgccttttgtattaaaagttgtattgagtgaatcccttgatatgattctactggttacaattaatggtaatatcaaaattttccaaatccatggctcattaaatgattatgaatcttttatacctaaagcatcaactaattatgtatcttctggttttagtattaattgggtcttagatgcagactggtcatttttaaataatcataaacttgttagagttgatttatattcaaaccataagtcttatccatgcaaggataatgctgatttcccccattgtaattctttattttga

SEQ ID NO: 1292 - DNA, 846 bp, Cryptosporidium hominis
atgattattgcagtccgcttctattgtaaagatgaaactccttgtttcttattatcaaagggaagattttcggaggctgaagagcttctttataagatttatcaagatacttcagttgtttcaggtgaaatggaatccttattagcaagtaataggagaagcattgaagaggataagataagtcaaaatgtatcttattcaatgctattcagtagaaagtacattcttccaacatttgtaactcttgttattactgttggagtaagtggaagtggaattggtatttttgctcaaaagatgaattcattaattgaatcggcttctggtcttcctcaagaaaaagttatttatattgtaatatttacttcagcatttgagacagtttcttgtttctttggaggacatttaattgagaaatttggaagaagaaatgttgcaattattggttctgcaactaactcactatctctacttcttcttggattatttacaatttttaagaactacatttccagcgttgttattccagttgtttcaattattgtattttctacattccttgcttcattccagctagctctttcaccagtattatgggcatatgttccagaagcacttccaacagaaatccgatctacaggaatgggtctatcgtcaatcttaaactggttggtcagtttgatttacatacctctatcttatattatttcggatttgagtgtgtatgctttatcatccatttgttgtggtattctttccattatttgcttcttctttatgaaagaaactaaaggatgctcagtatcaccatatgaagaagattcagttaagaatccagatctctga

SEQ ID NO: 1293 - DNA, 990 bp, Cryptosporidium hominis
atggcttcaaacgaagttgaaaattttattaatatttcgggttgcactgaccctcaaattgcaaagatgtatttggaaatgtatccaggagacatgaatagtgcaattaatgagtatttttcgaacttaggtaatgaaaccacaagcaatataaataacagcaatcatggaaacaatttatttcatgatgaagaagatgttagaaccccaataccatcctttaatgaccaacttattcctgacgaccacaatggcttaaattcttctcaattcatgcaaaatggaagagttgttcacactgatgattttcttcctccagttgatgatttctctactcaaatgttttctccacctcaaattattatgttttgtgaaccttttgaaattgccaaagaaaaggccaagtctcagaaaaagttaattttagttaatattcagagcccaaatgagttctcctctatgattttaaacagagatatatggaatgattccttgatcattgaatttattcaagagcatttcattttttggcagagaagttcaaatactcctgaaggaaatgaatggttgaatttatataacatatccaaacttccacatgtttctgttgttgatcctagaacaggcagacagctcaaagtttgggatgttgctaaatctttttcagactctatttcagcttcttcagaaattattgaatttctcgagtctgagaatacacttagagcttttaatagaatgtcaaccaattcaaacagtacaagccatgaagctactaattctattcctccaaatgtttctaaccaaacttccgattcttttattactaataccagtattagcactacacaagccccttatgatactctttcaagtcaagattcacttcaatctcagtcaaatactcaaatacaggttccaacaattaattctgaattagcaatgcttcatatggaaaggatgagaaggaagaattctgagaaaaaatag

SEQ ID NO: 1294 - DNA, 5364 bp, Cryptosporidium hominis
atgtatatacttccagatatattctcaattagattgattttaaatcttcttaagaaagaagaaagcttgttgtttatgatatcttcaatattatcccacttcaacttattaaaagatgaagctaactgtgaaaatagtgataatcattctaaacaaaaagctgatataatggatagcactcaatcaaattcaaatacagaggataaaggtgatttaaaggatatacaagaaactagaaactcttgttttaatgtcattcattcaagaaaatcaatagataagaaagttaattgtgctgtactattaattatggatatatttaccaaagttacatctcttgaccttcctaattctctctcttttaataagtctatatatagatatctacttgttcaatacctaataaggaaaaacaggtctagatcagaaattcaggatgggcttccaatatcatcatcttcgtctttatattatggaaatttcattcaatccataaaatcttcaaatcttaataatataattgatgagatcttggactcattttgcgagaagatcccagcctctgataataagccaattctatataaaattaagcaacccattggttggatgttatatgatcctctattacctattaaattctttggaagcgaagatgaaaccaactatgaatccatttgttcacactttaatggctgggataatagtctaattataggcaatggagtagatggagataagggaagtactgaagacaacactccaaagaagagacgaataggcgagagtaacagtttagagacaaataaagaacaacaaaatggtattttgaatagaaatatatcagaagaaattccagaaaactcagagaaaaagtttataagtgataagtttgttaaatttcctactaagttatgccacataccattaaatgagcatttctcttctatgatacacttcaattcaagccaaaatatgtacataaagtctattcttctctcaaatatactccatttggttctacctcaattatttgaagttactatgggccaaactctaatggatgatgtaagaataatgcaaaattccttcattcttctctttaacttaattaatatagagatcatggaatatgtttataatgcattcaaagccaatatgaaaggtgaaccccagttggagatttcatttaatagagtttctctcagtactgaaacgttggaaaatgatttaaattttgaattcttttctataccttctacagaaattagaaatgtaaattcaaaaacatataatgaatcagattctgatggttcattaaatatttcactttactgtttaaaccatgattgcgagaatgacgattaccagtactttgcagttaagccaagtctatgtaatcaaattaagaaagagttgagaaagaaacaaggagagaaattaattcagaatagatctccaattgagttaaatgatttatatatgactaatgtttgtgatctacttagaagaggcaacgtagaaactgtatttgaactattaatggttccattggttttaagatttgataataacttaacatatgaacagccattttgtctgatggatatattggtagaattaatgtattctttgagaatcaatgataatgatattcatttaggaaaaaattcaagtaagttcaaatttgttagcaaagaagttttaaagataattcccatggaatcttcattatttctggaatggggactatctattgccagccaaacaagtccaaatattgaatcttattttaacaactatttggaagagttatataatgagagaaggctttcattgcaagaaaaagctacaaaattgaatccagtcaatctcaaagataagatacaagagaaacaaaaaaatattctccaggaatatatgaacaggcaaaaaaactttatgaacattcttaaaaagtctatgattttaaatggtgaagaaatcaattctgatgaagacaagattgatattatgccagacaagctttgtgttagtaaccaaattgtaggtggtgatgaacattctgatttttgtgtattttgccatgagccaattcatattgagcaagatcatgaaaaggatggaaattatattgcaacttttggatatttagacttacaaaattctagtttggattcaaaaagaaatattcaaagtgatacaagtttagatggattccaaccaaattttggatatacttcgttctatttaacaatatgtgggcatttaatacattacaaatgtgttggacaatattataaattatttaataatcaaaattcttcaagttcaaattatgctaatttgagatcagaccaggaaaccagacaaatccagacagaagaatgtaattttgagaaaaaatctgaaattcaatacgtagggtttccattaacttaccacaaaaacaaagtaggagttagtgtaagacaaatgaatattagagaaaatggtgagacttttgaagagcttaatttgcctaattctaataactcagttcatatattatcttctatacccgataatactggatcaaaatttactagtagagttagacaatacgatattaataaagaaatttaccatttaactaacttaacatgcccatactgcaatacattctccaacattatatttccattcaagtacttcaagaatgaggaattaattatggatatttgtcacgaagtacaaaataactttgaatcttgtaaagatgatcaattgatggatattttggatttattattggatctccaaacaaaatacgaaataagtgatatgattagtgattattatgaaggaagttgtaatggtaatttagaaattgatgttgaaagtattccaatacttgaacaaattctttcaatattgactttatttgacaatttacttcctttcaacattccaagcgttaatttgtctataaatggaattcctagtattaatccgataggtttcttaactaagattataagtgacaatattataattgatacaatttcaagttgtgaagatgatatgagtgtattaacttcaaccaatttattttcttcttcgagaaatttaatgtatgaaattgttattaaatctttgaaaagtattattaataatttcccctgcatggctacttcaatgatttttaacttaattccgatacttagagatgaaaacaagattgatatttggaactatatttcgcttcaatcgccttcagctagatttcagattcttattagtttaataattctgattgatagtacaaaaacattaaaggagcaaaaagtcaaagaaaatgacactcattttgataatttttatagtaaaacaaacaacaaatataataactcaaataatagtattagagatagttctgaaagagaaattcaaggttatgagactttagaacaaggggatttgagagttatgtatattttattgatgatgtttgttttggaagttttttcaattgtttggacattttggaaccccgaatgggatgaagatgaacaagtatctaaaataagaaatccaataatccaagctatattaaatttgaataaatgcagaaaatcccatgttgatgaggaaaatgataaccagaaagaagaccaatcaaatgaaaatgaggcaatgtcttttttccaggaattgatttatggaaatggatttcacttatataagaaattagatttaagttctgaagagattgagtataaagctcagaagataaataatatatcagattcaagaattaatgttaatatttttggaactttaccaattcaaattaatccagtaaatagcgatatctcgatttctgagaaaaagaataaatgcgagattatatattctttcaaagttaagaattctataaataaattatcaagtgaaagtaagagagaattttacttgagtaaatatccgaactttatattaaatacaaattcaagttatttaaatactaagaacaaatttaaaaagtataaacaaaatcaagaagatgagtgtaatatggatgaatttaaacttggagatattaaaaaacttaaagatattgtaaatcttggaataatagtttggctaaagttgatagttagatttcaaaatatttatatgaaagaaaaaaacaagaaaatagaaaattcagttaataataatacaagaataaatggaaatgaagaggataatagcttaaatgaacaaatctctatactattacaatgtatttctagtagattttgtatgaatacaaatatactggagattgcttggataattttaacagagtttaatattaatactgataatgatactgatattactaaacataaaaactttataaaccaaagtagtggaatgatgaactctttattaactataatgctagaaaagaaccttttcataaagttaatttcaaagaagaaggcaataattcctttaacttgtttggaagtatcagttgttaatgatattatggttaattcgaagagaccactatttaatagtaatattaattcattttataaaagtctgagtattgaagagtttgaaatatttaagagctcatttctaggtttaggaaagaagtttttgaatatcaatgaaagttgccgaaatattattatatataatggttttaatcaatcaacaataataccccctaaaatgtttcacaatctttataacaaacttttatcaaatccaataaagcattggagtagaaaatattctaataatattaataacttactaatttgtatttcgtgtggaagtatattatgtacggaatataattgttgtaatgagacggaaactagtacaaatttgtcatcttcaattttgaattcttatttctactgttattcaagagaaacagaaaaaactgggaataaaaatatattatcatactcaattccatttggttcaggtttaaatatatctttaaggtcaataccaattagagatcatattgcaaaatgtggaaaaggattatcttttttcctacatgtttcttcatcaattatactatcatttagaattgatattacttcaacaaagaatgaaaccaataacaatttgtttaattggattgaattggataaacaatttttgtatggtgcaagggcatgtgaattttctactctttatgtcgacgaatatggagaagaggataagcatttgattagaggaaagcctatgattttgtgtccttatcgttggactaaattgcagaatattattcaaaaaattaatatcagaagaaatacaaatttaaattggcgttcatttcaaccttttgaatttcaatcaataaactaa

SEQ ID NO: 1295 - DNA, 783 bp, Cryptosporidium hominis
atgcctcagaatgaatatattgaattacacagaaaacgccacggatataggtttgatcactttgaaaagaagagaaagtttgaatcacgaaaagtccacaaagattctcaacatgctcaaaaactcagaggtataaaggctaaactttacaataagaagagatatgctgaaaaggccactttgagaaagttagttaaagctaacgaggagaaagatgcagttgaaaaggacccagaaaatgtacagaaaggtgcagttccatcatacttgttggaccgtgagggggttaatcgaacgaagattctaagtaatatgataaagcagaaaagaaaggaaaaatctgcaaagtggcaagtacctattccaaaaattaaggctttgaatgaagatgaaatgttcaaaatcttaagaactggtaagagacagaagaaatcatggaagagagttgtcaataaagtttgttttgttggaaatgactttactagaaaaccaccaaagctcgagagatacattaggccaactgggctaagatttaaaaaggctcatgttacacatccagaacttaagaccactttttaccttgatattgtttccatcaagaaaaatccacaaagccaactatatactacattaggtgtaattactaaaggtactataattgaggtaaatgttagtgaactaggtcttgttacacaaactggtaaagttgtatgggcaaagtatgctcaggtgactaataatccagaaattgatggttgcattaatgctgttttattagtttaa

SEQ ID NO: 1296 - DNA, 624 bp, Cryptosporidium hominis
atgaagacttgctctaactcggatgatagaagttacgttccaaattctctaaatatcaagtgtgatcattattgcaatgataacacaggatcaaatatgataatttggaagttggaactgacaaagcttaacggagttaggaaaatcatctggcagccaggagattctatttgtttagcaattcaattttctgaaaggcttaagaatactaaacttatgtatgatgattactatgaaatgaacagtaaaaatgcgagtttattaactcatatagataaaaataatatttttggaaaaatattctttatagattctagatgctcaaatgatgatatgttactttggtcgaggctgatggaggattttattgcaattcataaaaataaagaatatatagagaaagaggatgaatttgacaaagtggatgagaaacaagacaattcagaacttgatgaaattaaaaagacttttcttgatgagtattataaagtagtttcaaagcaagatacacaccaacaaggttataatgaaatacaaatacaaaaattctcggaagacttacatgagtttaataagaacttagataagaaagtctattggtttgatataaacagaaaggtttaa

SEQ ID NO: 1297 - DNA, 336 bp, Cryptosporidium hominis
atgacattatcaggaaaatctgcaaatacagaatcagacgaggcgaagatagaaagcataatcttcccaaaggagtgtattgagtatattatgaataggcaaggtgcaaagtcatcagaccctaatttgttttcgattgtttcaattttaggacaaaaatttatcgaagaatgtttaaagaaaagtatagagacaacagaagatggtagatttgttattagggatgaaaacttgagaaatatgattaaaatggagaatccaagttgtgcagtcaataatgattttaatttattcttaataccaaatcaaagatataaggagttgttaaaagagtaa

SEQ ID NO: 1298 - DNA, 1536 bp, Cryptosporidium hominis
atgtttcaacctagtaactcttctacagctgaactatctattacaattgatcagctagttatgtttggtcagaatattcatgattctatggtttatattgaaaatactatttcacagactgtggagcctacaatgcaacagatttttattatttggagtattattcaaaaaacagagattattgaagatcaggaaactaacaaagtttcagtgcagattcatcttttgaaagagtttaacaaaaccttaatttacgagactgagcaagttaaaccaattgttcatacttttttgcatctattgagcatagctaagacctataaagatgatgtaaagaaaacttcaactgatcattttttaccaccaaaaattatctcttctgtaaattccaatattatcgcctctactttcaaaattagttcagattcgtactttgtattaaaggattttattaagagaaagcgtcttttcaccgatgaaaatgtgaaggaaatggatgatgaatctcaaataagccactttttgaatgaaatagaattcagaaaaattgataagcttttgaatgaagatgcagaaggttgttctttatcttgtatttttaatttgagctctgccattgaagaactttatagactagctgtcaagaaagtctcaaagaatttcatttgtagcttttcttccttaaaggtgaatttagatccaggatatttttccactcaaaaaatcttcaattgtacaaatgtttcaatggacgatttccaaaatatagtcgttaagttaattcatccaatacaaactgaaaacaataaatatgttatttctaagatttgtattaagaatgatgaattttcaagccctatttctacatttggaaacaatcacacgcttgagtatccaactgatttttcaaacggaaatattcaaattgaatattgttccaaggaattttcaccaagcattaacaaaatatcaattgactatacaattgtgtgccttccaattcatttacagaactttaagatttctagtgtagtatggacccacactaatgagcttttaatgctcgtttatgatggcttaaaatcatctcttctttttggatttaatttagatctgatcaaattacatgctttaactccaagaacaaataatttattggacgattctttgcaaaataataatcttgctcaaaattcactcagactaatgttcagtataattaattccaaagctggacaggacatcaccaagtcttgtactaaatcttgtctgaacctcaccaacttgtcaaatatatttcattactctcaagacatttctcgaattcataggcctcagaagtttagaaacttgtcaatgaacatttctggaaccaatgaaagtaactcctctattgaattcaatgaatctcaaaaggaatcttgtacaagtacaatgattctcgactttcactcaaaatttaaccaagtaagtttaatcatcattaacaaaataactgttcgtttactttttaatttaattaaaatttctttttag

SEQ ID NO: 1299 - DNA, 4293 bp, Cryptosporidium hominis
atggtccataatggaggagttgatgtagtgccttcaggtgaacgcaagggattatttgttagaatttatagagatctttctagattaactcttcactctcctgctaatcctattattagtgctaaattgggatggactgcattcattggccttttggtatcggctgttttagcatactgctggagcttgtacagaaataggaacgcaaaaaagcaagaactacgcgatggccttcaaattgggtataagtattctgttattggctctcttctccgctcaattgctacattatccacaatattaccatttttatttattattattcatacatatgatacagctggttgtaatagaagagagcttgcgccttactggaataatagagctcttgtatttatatcactttggttagagtgcttctttttatgcttcttttatagatcaacaaaatcttcatttgaacaattcttttattatccttgtgatttaaaagatgctgattttgtatcaatatggcaaaagataaatgtagactctgatgtgacatgtaaaaaacagacaaaacttaacaaaattctttccctttttctagatcctttcaataaactttcaagagttctgaatgacgaggtttctggctatatactttccactatatctgttcgaagagaacgtactgatgacaacacttgcaaagcatactttgaacttttctgtgtcagatattggtattcagaaaatttaaaaaggttcacatgtgtagaggatcaaatgggttctaatggtgaacttgttaatcttacagcttatttggaaaatgatatttatagtattccaaacatatcgcagctagaacaattaaaacctaactttgagaatttgaaagctttaaagaaacaagattctgaaggtataaaaaaggaatataaagacggaacagtgattctcagcccaattttaggtttaaatagtgaacttgtacatgaacaataccaatcttatgggaaaaatgaaattaatattgaaatgccttctcttattgagggtctcttaaatgagattcttaatcctctaacagtgttccaacttcttgttgtagcttcatatacattccaaggatacgtactttttgctgtaaaatgggtcccgatgatgattatcagtatcattgcaaatataaggattcactttattaaaattagaaatatcagagaattggcagaaatgactggatgtgataatgttaaggttataagggatgggaagctagttactttgcataactcagaattagtacctggtgatattatacatgtatatgagaactctatagtaccatgtgatcttctactcttatcaggttcagccgttgttaatgagtcaatgttaacaggtgaatctgctgaggttttgaaaatgcccatttctgaatctgaatctgaaaaaatatctccagaagatgggccatattcaggaaagaggtatttcttatatgcaggtacacaagttactgctgtttataataatgttggtagaggaatggctcttagcagtttgactggatctatgaatatcaaaacatcatcaacaaggtccagtgattcaattattaacttgagtacagacctatctgaactacctggaaatcaaaagcttatgtcagatgaaatatcaactactacagcattggttattcgaactggtgtttctactcttagaggaaagatcattagatcaattttatatcccagtaaatatagttttggcctatatgatcaacttcccattgcttggctttttttaagtattatcgtggcattgatcattttcaaacaaggtaattcgttcagctgggggttatttacattcttctttgcattaggatctatgaattccactttccctctttatcttggtgtactgaatactttgtctcagaatatttcgtcaagaagactttttaagaacttcaatgttaaggctctgattccaactagaatcatccttgctgggaaacttaggattatgtgttttgacaaaacaggaacattgaccaatgatcatcttgattttattggtatgtctccaataaataccattggtggtgatgaccaaaactgcttactcaatgccgatgttacaccaacagaaatgagtacggattattctattgttttatctgaacacgacacaaaaagccaaagcattgattatattttgtctgataatgtttacaatatagatgagattcaagataagtttaagctggcattcttatcaataaaaagttgtacatcgttaagccactctccaacaaactttggaatctctcgtgacgtaattactaatccaagaaaatactatgagagtatgaatggaaacgataccgataaagcacttttttcagttacaaacagcttttttgaaaaggatccaacaaatgacaatgtttatattcagtccgttagctcgggatatgacggtttggaaaaagaagatatttcaactagctcattagaggtgctccgaatttttccgtttgattacaatagaagactaatgagtatcattgtacattgtaagcataatgacgaatactatttattcaccaagggagcacctgaatcaatccaaaaaatttataccggatccattggaactgaatttaagcagaaacttgatgagctttcttctaaaggttattatttaattatgtccggttacaaaagaatagaaaagagtttgttaaacttgtatctgtcgttgaatagaaatgaaatagaaactgatttatcgccaattggacttttattgtttgaaaatactgtgaggaaagaggcctctcatgttttaaaacaactagtagattctgatgtactacctattatgattactggggactccgcattaacagggttaaatgctgctttgaaacttggaatagttgacgagacttatggaaaaattgcagtctctgagctttcaacaaatcaaatggggtctgaatatgtgcaatggagatgtagagaatcaagagaattaattgcagatagcgagatatacactaaagatagtaaatttggaaacttaattttgactggtgactgctttaacatattattaaaggagcacaactcctcaatagttttctttgagcctataagaggatccgagaatcttgataaactggatattgaggcctcatgtggcctacttcaaggaaaaaccaagattgatcacatattaaaccgcgttagcgtttatgctagaatgtctccaaataacaagtctgaggtaataagtctttttatgaagagaggtatcataactggaatggtaggggatggtgggaacgactgtggagctctcagaatttcccacgtagggctttcattttcaaggggagacgcatctttggtagctcccttcaattcctctacctcaaatttgaactctgtattagaaatcattcgtgaaggaaggagtagcctggcttcagccatgtcaatcttactgtatctcgttgtttatggtattatgacatctctaagtgaaacattgttaacacactttgcatatgcagcagttccagatatttctagctcatttgttgctttcttcgcacacactcttctcctaattggacttttgttcaactctccatgtagaagattagcagcagccagaccttttggtagtattgcaagcttccgctttgctttagcctttttggctccaatcactacttacattattggttattttacaatgtttaatagacttagctccaagccttggttccagtcctctaaaaacttcaatgttcaattacccgctcaaaattggtttatgcgtatggataatattgagtcaacatgctcttggatctacactgcaatccagattattgccactgcattatgctatactatgggatcccagtttagaaatcctttcttcaagaacccgtttatattagttcctgtaacaatcaacgcattagtttatgggacactaatttttactggacctaatagtttcacatgcatgtttagggccaactgtgactctgaaaatattaaaaattcagtttttaagttatttggggtcactgtgattaacccttcatcaagacctttttcaggacccaacggctcgaatattatgccttttagttggagaatcgagtttgtgatcatttgcctaactaccatgtttttgacggtttcgctcttttctttaatcacaaaacataaggagatgcgaaaaacatccgttgaaagacaattttaa

SEQ ID NO: 1300 - DNA, 699 bp, Cryptosporidium hominis
atggtaaagaaggctgagaagaagctaacaagtattaagaataagagcaacaataataaaaagggttctaagaagtctgaaatgaataatactaagattccagaatcttctactgattcttcttcaggttcttcttcatcttcagaggatgagaaatcaaagaagaataccaaggcagtaattccaactccagcaaagaaagcaatgtctgatagttcttcatcatcagactcctcttcatcttctgaggatgaacaaccaaagaagaattctaaagcaccaacaccaatgaagaagaatatctcaaatagctcctcttcatcttcatcttctgaggatgaacaaccaaagaagaatgctaaagcagcaataccaatgaagaagaatatctcgaatagttcctcttcatcttcatcttctgactcagattcttcttctgaagatgaacaaccaaagaattctaaagcagcagcaccaatgaagaagaatatctcaaatagctcctcttcatcttcgtcttcgtcttctgattcagactcttcttctgaggatgaaaaaccaaagaagaatactaaagcagcaacaccaatgaagaagaacatatcaaatagttcttcagattcttcaagctcttctgattcttcgtcttcagaagacgagaaaccaaagaagaataccaaagcagcaagctccagctaa

SEQ ID NO: 1301 - DNA, 1035 bp, Cryptosporidium hominis
atgagtaaagtaaagacaaatatgaaggagaaatctgaaaaaaagaaggaaaaacgatctaaggaggttgaaaaaaactctaaaaagaaagtatcggaaattttaaatgagccagtaaatattgaaaagacttttgaaaaaaagaaaaaatctaagtcaaaacgattagatgaaaatcatgaagaaaaaagtattaaaaataataatacattagaatgtaatacaaaaaatatttttagtgacaaacaagctaaagaagaggatctgaaggtgaaaaaaaaatctaaaggatcaaaaaaggcgaagaaaattaaaagcggatgttggacaactgatatgataaatgaaagtatccaaaatttggaaagtaagttaaatgatgaatctggaaaattatcaaaatccaaaaagcgaagaataataatgagactctcaaaactaaaaaagggtcttagaggagaagttgaaattggaggacaaatccaaaaaagtattaaaacaatcaagagggaaatgaaacaaaaaagcatgaattcaagtatatcacttaggaaaaattcaaatgtagtttgtttatgttgtagaaagaaaggtcatcagatgtctgattgtaggtattataaacaaacaaatgaagaagctgaaaatggagataatgaaataaatagtattagtgaaagaaatgcatcaggaaaagaagtatttaaatgctttttatgcggagaattagggcatactcttaaagactgtaaaaaaccaagaaacgataactccgtattaccatttgctagctgttttagatgtgggaaatctggacatatagtcgctttttgtccaaataacgaaacgggatctatatatccaagaggaggaagctgtaatatatgtgggtcagttaaacatctagctagaaactgtgatcaacaaatatcaaaaactaacaaaaacaagaaatctattggaggtaaaaataaagaaaagatgaatattggaatggatgatccagatttaatgtggaatgaagcaatgcaatga

SEQ ID NO: 1302 - DNA, 1011 bp, Cryptosporidium hominis
atgtttataagcttgaagtttctatttctttttggtttggtttatttattgccattaaactttaattactataattctgaaaactgtgtgaaaagcttttcattttcaaaccaggctcataattacgattctaagagcccacacattaaatcagtgattgatgacgataaatttataaaatccagagttgataaagcaaaatatcgctatattaaatttaaaaacggtttgaaggcttttttagtaagcaaagaagatgcagaaaagtctgaagttgcaattttagttgatgtcgggtttctttacgaccctccaaaaattattggattatcaaatttagtgcaatatagccttttgttagcttcttatcaatatccaaatataaatgagttccataactttataaagctattgaatggaagaatatatttggaccttcatgaaaaatctacagtatattcatttacaataggcactgaataccttagtgaaagcatattcagatttagtagctatttccatagtcctttgttgaataatgatactattaacaaagcaatgctaacaatatttagccagttaaatagaatgaaaagaagtgaattctgggcaagaagagaaattgaaagagaaataattggcttaaatgctaaatttgacacattctattatggaaataaaaatactctattaaataatccacatttatcagaaggagagatctatgaaaaagttcgtcactatttctcaaaattctattcacctaataacatgaaacttgctatagttggaagagaacctcttgacaaattggaaaaatatgtaattcagaactttgctcatattagaagtaacggttttaatatagtaagaattgatgataactataaatatgttggaaaccctttcattagaatctcaaagaacattgttactatacggagatttaaaaaaactgggattaacacaatcaatctccgatttccaattgaaatacaagttgttaattga

SEQ ID NO: 1303 - DNA, 3381 bp, Cryptosporidium hominis
atggaccctgaggatcttccaggtcttgtaagtttggtacaagaatcactttgtttaggaacctatcggtttgtcgataattccaatttttgtaactttgttatttcaattaatggagaaatagatatgaaagtttatgagagaaattcagtatttactataaaggttggaagccaatatatttcaacagctttggacagattaagcgacatgattaggaatccttcatttcctgagaaattattttttgccaagactaaagaatattctggtacatttgagagcttactgaatgatagtgaatttttgtttcaatgtgttattagagacatatctttggatgacaatatatttaagagattaaatgttcttactgataaatcaattaaagaagctagagagatttcagagattaacttacttgaacaagtaaagaatttctattatcaacagtacagctctagtattatgactctagtcgtagccagtaagcataccatagctaagttgtcaaatgaagtagttttaaacttttctttggttaagaatttgaatatttccaatccacttccatttgacttagcaaaaatagttcgccatcctcaccttggagtagttggaaacgctatttatgttaaggctcattctattaatgagctaattctcgagtttcccatagattatcaggaagttctttgggattcttctccaagttcctatttagaatatttactcaaagataattctgagaagagtttgagcaattttcttacaaaaaaaggatggatcttaaagatggaggcagtaactaattctcacaggtactcattttcaagttttgaaatcaggtttttacttacgtttaaaggaattgataagattaaatcaattattcagacaacttttattgctttagaacatattaaatcttctcctgtaaatcaggagattcttgctgagatcaagcagatactcaagtacaagttcgattactattttgatgtttctccaaggcaaatatctaaacagattattgattcttttgatattaagggatgctctcccgaggaagttcttattgctggaaatcttataaggaattcaagcttggaagagatttctgcatttttgaataaaatttctatcgaaaatttgctcgtttttgtaaagctcacggattttcataaagataattttggtatattaaacaaagaccagggtattattccagaattgaatgtaaatactcctataaataataaccctataattccgaataggaataataatgccttattggcaagcaaaggccaggatagcgatgattctcaaattgagaaaaattcatatttaaaacaagtacctgaacttgattttatgcaggatcaagagcaggaacaggaacagaaacaggaacaggaacagaaacaggaacaggaacaggaacaggaacaggaacaagaacaggaacaggaacaggaacaggaacaggaacaggaacaagaacaggtacaggtacaggtacaggtacaggtacagaaacaagaacaggcacaggaacaagagaagaggattgaggccaatccaagttcaaaaatgatcagttctaaagacaaggatattgaatttagaacttgcccaatgttcaataacaagtacattgtagagaagatctctgccgaatttttcacccaagtaaattctgcagttagtcagattcatgcaaagtctattgagttcaagatcaggaaaagaaacaaacttctgggtaacactcccttactaaacttttcaagcagtgcaagctatcgaatatacacacctacaattctaaaaaatgcagtcttagattacttatcagcagaaagttcatcaaagtttaaaagtcttcataaaaagattaaagacaatattaattatccagtatatagcagctttatttttttcaataacataaatcaccaggctccttctgcaacattcttccttagaatcatgcttccagaaccaaaaaagcttgaaaacaataaaaatgttttaaacaggcctattattgatttggtacatactaagtccatcaaagagctaattttatcacttgaagttttagttgcttgtattaattattcagctagagatataattaagcaaatgcaaagcattgaaggagcttttttgatttcaagtatcctgaaatcagaacttggtggagttccttttggaattgaaatcaaaatcaaaggattcttaggttcaatttttttagctattaaatcattatctaaaaaaattctccgtttgaatagaatcatttctcaggaaaaatttaaagagattaaacaatctattcaaaacaaagtcaaatctgagaatattcatcgaagttcgagcgaagtatctcggttattcttgaaatcaatttttgaagagcagaaaacgtcgattttatctttggaaatcgattacagttcaattacttttgaacaaattttggagctgtcctcactattatgtaataatggatcattggaaggcgcattgcttggaaacgcaaatccagttcaggcttatacaatactgaatcaattcacgtcaggaatacgtaataaaagtgggaagaacaatcaagtttcttcgaaacttagccctattaaaaactccatacaaacttggaaagttcttgatcctctttgttgtcgaattaccacaaactattattatttaaataaaataagcttaaataattctttgaactcaaattcactattatatgttccattttcatactttaattcacaatcagttgcattccaagtcgtatttgaatatatttttaccattttcaatgaaaagctttctttatctggagcagaaattgagtttttcccaaatgttaatgaagctttacatattggactggctattaaattgtcagggctagacaatgtttcagtcctctctgaaaaggttttagatattttttataatcttatcacttttattaaaaatattcaaaaagagatatttgatcaagcaaagaataaaatacttttgaatgaagatttaggttttgagcttgggtcttacgaatcaagactattatttcaaataacttccagaataagcatatttaatgttttacgagaaataaagccatctttgaaaaaattggattttgaaacatttattaatacatttaatttaattctaagttcgcaaaagttcttgattgcaactcaacaagatttagaaagttcgaaatgggaagagctacaaaattatattccctcaggatttgttagtattgaagacttagaccaggtaactagttctggtgtttgcaagtttattaggatccctattaggttgattgatgcataa

SEQ ID NO: 1304 - DNA, 3258 bp, Cryptosporidium hominis
atgtttcgactaattagtttaatttcagtcgcatgcttgtttttattaaatgaaaatttaattagcagttatattggttcaaagagtaagtcacattattcccattctttattagagttagaaaaagttagtggcgagaatggctttgaaacttttaaatacagagatgtttatcttaatgaagatgttttaatctcaagaaagtcattcaataatggctttactttgtttaacattcagcagccatttgaaagttcttattctgattttagaataacttttaatagtggaagttcctccgatccaatacatttacctggtattagatattttgctctatttatattcagcaaacaagtgaatgtttgtatgagcaaggtttttagcgaggaaactcatgctaattttaaaattaagatagatgcaaccagatctactttgatattcacatttttaactgaacaaacaaataagttctttgactgttttctaaatactattaaaaaccaatcgtatttagaaaatagttcttattttgtcgaaattctacaagcttcagaagaatttgaaaaaattcttgatgatccaagttcaattgaggttgacaagcttatgattagaatgatttacggtaatctaccatcatttggctgcgaatctttacaaatttcaagcattttctcggaatcctgtttcaagagttctattaaattgaatgtcgaattaccaaaatactcaagacaaattgttaatagtatcttcaagcctcatgccatgtccgcaatattcattggtaaattaaataattcaagtctcattaaagggctttcttcattgacaaaaggtaagctcagaaagacagatgatttagattgtaataaaatcaataaagccaacatggctatcaaaaacttgacaagtaatattattttaagaaatggcttccatacgaatatattgaggctttatataccatttgaaacttatgatttggaatcacttgcatcaaatggacaagcttttatattaagtatcctcaattccagacatagaagtggtattttaaactttatttttatgaatagatttgctaataatgtaaatagttactactattctgaatataccaccactattttgtatttggaagtgaatctgactgaaaaaggattacaaaatattccaattataattgaatccatagtttcttacctcactttaataaagagaactgtttctagcgacaagcttttctctgaagcacagaatttattcaattatcacctcaccaagtcaacagtaattttatcggaggctatagagaactatttaagttcgcatttcattatgtccaaatcttcatccaacattctcaattcaaatattaacactcagtttacacgcgcaaatgttgagtatttcatttcaaaaatgaacttgaattctattacagttactctttatgttcctgatcaattggatcatttgtcactcttcaaaaaaaatgaaaagtctggaatattcccagttgaaacaattgagcctcacacgaatactagagtttttatatttaaaatggctgatatttttcccaataaactatcttccttaagtacaaaatatgcagttgatacatttggtctacaattaccaaacaatgatttaatcagcaatatttctttaccatttttccactcagcgcctatttttgaaaagttacttcatctacacaagtcgttagatatccactacaaatatcttaaggaattgggcagtgagaccataatatctcgtacaatggcatataaatcgattaccacatctggaatatggttctccagtaatggattatttagcaagagcgttaatcttgagctgaaatttagtttacgtaaatggagtcctttattagaaaagtttaatggtgaagtttcatcttttttaattctggctacaattcacattttgactgcaattctaaacattaagctgagtgaaactttatactatacaaatagattgaaatcaaatatagcctttattccagctcaatcatttagcgatatgatttcagatccatttgaaatatttctagttgtaaatgcaccaatcgactattttactttgatcatgaatgacgttttaaatactattttatcctttgatagctacttaacagaggaaatagttattcgcgcgaagaaagctgctagaaatactttattgagactgtatgaaggttatacacaattcgaaaaggatctaaaaattgttactcaaatagtttcttcccagcattgttcatttttaagacttggtacctctcttaagaatgattttgatattgagcttatccgaatagtatactcttctttattcacatctccatctatttatggccttattcaaggtaacctcactcctttccatgccaatcacattttgaatgtgtttattcaaggtcttggccatgagttcttctcaatggaaattaacgaagaaaacagtttaaatttctttaacaaagaagttcacaataatgataagaatgattccaatgattatgctccaatattagaaatcaatacatctattttggatatttccactattccaaatgaatataaaagtatgtatactcataagctagactttactgctgatgcttcttactcaacagttgtattacttattggtaaattaacggttccgagctttattaaggcaactgctatcaaagaagctttgtccaatgaaatttcatctagaatttcgtcagacaaaaaaattgatttcgcttcttctttatcaattgttgcgaataattttgttgtggtgtcactaagcatcaggagtgttgaatttttggcaggaacattaaatagaattctagacaaggaattaaatcaatccatttccaaggttcttaaaagccataaatccaagagttatgttaataaaatcttagagaatatgaattttgtagataatgtctttgaaacaaagtttcttttatcaaaaattagtattttgaatcttgttggtggtactagagaatacttggataaaatggagttatccgacatctctgatttgttatctgatatagaaactgttccgcgtattatgattgccactcaaaaagtaactaatttgaaggcttccaagacttctctggacttcattccaagtggttataaagatattagaagcgactacaaatgtcttcttgaacatccaaatacagttttcaattga

SEQ ID NO: 1305 - DNA, 447 bp, Cryptosporidium hominis
atgatttcttcaccagaatatagcatcatcaagttaactagtttggcagtacaattctataataagtactttactcttgtcactcctctcatttccagagatgaattcaagaaaggggttaatcgtgctgttgctagtattgaaattcctcatataaatatggttgaacttcttgatcagtattccggttctctacttgatagaaaatcagatccaaactggaaatatattcaagttgcatatttacttaatcttaactataatgaattccttaacaaatggggagtttttgttaaacctgctaaagttcttatttctattgtaaagactcatgtttcagctattgaattggcagaagcaaattcattcaaattagaagggtataacagaatcaactcaacaagtattgtaaaaaagatcgcaattgaaaacaattttattacttaa

SEQ ID NO: 1306 - DNA, 495 bp, Cryptosporidium hominis
atgatgacgccttcaatgttctctcaagctctaaaaagtattaaatttaaagatgttgttgattttgcatcttacataataaaaatgggctcaattgaatcattagttattggaaactgtactccaatgcaggttaactcttacttattaaagattgggagaatacttaatagagactttgtagcagtgagcgatgtaagcaaccttagatttttgaatgtttccactaactttgctgatatagaagataataatataattgaatatactgatttcaatttaacaaataagctaaattcaactaattcaaaccattcattagaatttaacattaatacaattgtgtatgtttcatatcatgatgaagggtactctggaacacactctgcaagaataatctcccctactgcctactcggtagaagcgttcctcaccgcagggacgttttacgcgaaatcgatcttatctgaccccccgtccctccttccctcttga

SEQ ID NO: 1307 - DNA, 3765 bp, Cryptosporidium hominis
atgacctcaaaaatatttttattcggacttttagttcagctttctcttagtttagagagatgtctagcttctaatgttgccttaacggcaaacaattcatcttttagtgatattttggtagaatcaagtaccagaatgataaagaacgactctttagctctggatggccaatattatataggtggaatgaatagaatatcagaatatcgagctaaaaagaatattaatgatgcttatagccgtttctacgatgaagactttatcaaatcagtcaaggattcaaacaaatacagttttattagattaaaaaatgatattcaggtttttcttgtatcacagagatccagtttattttcttcaattactttaggggttagagtgggtagctccttggaacctaagaaattcccaggcttggcaactttattaagtgaattgttgttttacgattggaagaggcctgatgttggcagggagacaccatatgatctttttatttccagtaactctgggattttcaagactaaagttgctccatttttaacggaataccatctatctatcaaacaggagtatttttctgaagcactaataaaattctgttcttatttgaaaagttttagccccaaaagaattcatttagatccagcaatggaagcattgcaatcagactttgaagccttaatgggtatgagttttataaaacttaaacaaattcttaaggaactttctgttgaaggccatgttaaccatggttttcatatgggcaatatgaaaaggttgatggcaaatatagatttcgatacagaagttcttctttttgaactaattaagttttacggctcttactacagttcaaatttgatgactatttcaattgtttcagataaaagcatagatgagcttgaaggtcttgcaagaacatttttcgatgagattccaaaccagagtaaacaactaattactccatttgacctttcaaatgaaatcattcatccttatattgatttaaataataaagtaatacaggtaaaatctgcggaagaaaacacttattttacggtgatattccctattccacaccagagcccactttggaagtacaaacctgctgagtatatttcattcttctttacagattactcaaataaaagtctttacagttatttaaggggaattggaataatattaggcttgaagactatgattgaagtaaatgacaatggtttttcaaactttattattagatttaagttaaactctaaaggtgaaaaagctattgtaaagatcttagagatcactttatctttcctaaaactgattaaagaggtttccatttcagaaacaataattaatcagatcagaaagaaaagacaatcaatcttagaggtttctattgatgctctttactcagatctatccagaaaaattgttaacacatttttgagaacgaactgctcacctccagaagttttacatgcaggagtatcaatgaataagatagaatttaatcatgtaaaggagataatagaccatatgaagtatgataatttaatattgattcttgaaaagaaagaattcaaaaaaagcgcttccaatatcctcctttctagtcaatttttcttggatagtaagtggaagagtgcaagaaagtcaatatcttccttctttagaagtgtaaacacagcttttcataggacgaaagtaggcacatttccgaagtttttgaaagaggaatacctaggtggagaatatttattagaagacatcccaagtaaagttattgaggtactacagtctgttaattccacgttggctaatgatattttaaagttacaaatgcctgaaatagatcccaaattcccgagaaatttcgttatttatacggaagatgttcccaagaaagagtttcctgtttctctctactatgcagttaaagagtttaaacaggctaaaaatcttactgaaataagcttatcagaagcttccaataattctacagacttttcttatttaaatttatcagctccaataaatccaagagatttggtagttgctttaagtacacagaaaatggattcaatttcgagaagtttttgttaccttccgacatcattcaatcctgatgtaatgatttctgtaagacttcagatcccgaacaatcctccaaaagaattcagctgcccagaaaagttagcaatactaatgttcttattccaaaataccctttacgatgttttacctagccacctaaatgagaacttttcttttgaaagaagttatcaccattgggagctacaagagttcttctatggcatagaatttagttggagaggttattcctctatttttcccgatagcttgaatgagattgaaaatattctatccatattccaaacttctattaagcagtccagctttcagaatgccaaacaacgtttccaagatatcattaattcgttcaagtcagaaaatgataacctcagacttctttcgctttcctaccagttgcttgacccaggatttatgaaaattagcaggctagaagatgaaatgtccaaaataaccattcaaagcctcattgattttgctaacttttttattaaaaacttttcaatttcaggatcagtacttggaaatgcaactccgatacaaataaaatattacctatccagttttgtaaatactgttcgaggaatggacagttcatctttagagctttctttggacacaacggaaaatatgttcaattcaacaaaacaagtcaattcagacataaatgaagactttaatactcttggatttgaagaatttagctttgaagagaaaggaagaatgcttagatctggaagcaaaaaatcaacatctaaagatcttaaaaatgacaataataatcaaattggaaagccaaatgaagttactcatacaaacacatacaatgctatgaatattgagaatcttggatacacaaggaactcattcagtgatatgagtagattgccatacaattacagcaattcttacttcttttacattaattcaagcaaaaatagcaaggataatatggttctcctccaaattcattatgggttttatagcgagcagaacttggcattccttcaaatagtttcagagctcaattcatataagtattttatagagttctcagataaagtttgtccagattgttctttaaaagtgctccctagaataatacttggtaaatatttagttcttgagttcaagctacagtccccaactaaaaacattagagaacttggcgagctccttaacaatttcttcctaacatattattccaggccttcaaagattatttctaaatcagagtttaataaagccaaagaatttttattattgctttccagaaacgcaagattaatagaaaacaaccttggaggccaaatcacatcaaaaaccaataaaatatactacgaagggtcagagtcagaagatttattcacactagcatctttacatatgggagcttccaaacatacccacttttcttgttcatggaaaaaagattatttagaatttattgacgctttgacatttgaccagttttataaatattggcagtatttcggtagctcatcaaaactatttatttcatatcaatcacaaaacacaaactatgaactttttgagtcccttgagtcatatttacctcaagggtttaccaaacttttatttgcagaaagtctttatgacattaacgagcagcaagatatatttaacacataa

SEQ ID NO: 1308 - DNA, 3828 bp, Cryptosporidium hominis
atgttaattaattgcaaacattttaagcttttgaaaatggatggccttttatgcttattatttgtcatatttatatttgctcagtacttaaattttgcgagttgttttttagatgagcaaagtttagactcaaatgatacatatgttggcatttcagaatttgtttcaaatgatacattcagttatatagcttcatatagcccatttatattggacggattcagcgacatgaattccttttcaaagatgcgatcaatttactataatgtcaatgatttcgaagaagttgataataaagactttgttagaatggcaaatgaaaatggtgagtacaaatttattaccttggaaaataagataaaagtatttctagtttcaaaaaatatactttataagtcttcaattgcaatttcaataggatatggtgattttaatgagccgtcccatatgaaaggactatctgttttactgaagaatatagttgtttctaaaataaaattcaagaccaacaaaagaactaatcctctatattttaaaaacttggaaaatacagtagaaggtagagtacatggtcatggcacagaaattaatattgaagtttttaatgaggattttgtggatgttttacacactcttagtgaagttttagccagccctttagagttagatttccatacgttatcatcctcaagaaagattacaagagaggagattagggctagatgtatttcaatggaaaatttaagaggtgcttttgtggaaaatgatttctgcaaaaaatcgggatataagtatttatacgcatttactgattctaatgtaaattcaaaagatcagtttaaaaggggatatagaattggagcaaattctaaaaaagttgatgaattttctgatgagtatagtagtttggatagtatattgaatgaacattttaacaaatattattgtagtaacttaatgactttggccattgtatcaaatgaaagtatgcattatctattgactttagtcaaaacattttttgggaaaattaggagctctaattttaatacaaatgatcttgaaaaaatatataattttaatgaaaatccgtatttaaaacatgtgggaaatgtagttgcagtaaaacaaagttcagtcaaccttgagctaaagctgatatttcctataccatatcagaaaaatttgtggaggtataaacttaccgagtatatctcattctttttagatgatgaatccgaggaaggattaactggggtcctaagatcaagagggtggattacttcattatcatctggttgtgaaactaatgagagcggctactcaaattttgttgttcttattactttacagaaagaaggtgtccgacatatcatgcagattcttgaggcattgctttcaactattaaactaatttcaaagcaagatttttctgaggaaacactttttcatattagggaggaatcttctattgaattaaagaatttgtacttggatcttgataccgatcaagcaagtttcatcttgagatcttacttagggactgggtgtttcccaaaagatgtgctggttgctccttttaaaatggaccaggttgaagggaggcatataaagaaactattgaattttatcagagcggataatatggttatatcacaccctgtaaaatcattgaataatggtgcttcttattacttaaggtcaagcgagtcgtttaataactcgtttttattcaattttgagaaaatggtttttaaatcgttttacaatttatcattattctttttaaaatggtttaagactggtccagaacaaggtgattgcagattttataagaaacttcattattctgaagagaagttgcctcaatatttacaaaggagactttccagtattgatgaaagagttgctttagaggaattaaaaattcaactttttgatccttcacttgaaagtaatagccaaatttatatcaatgatcaattgaaaacaattaattatcctatcactctaaggaaaggaatagaggacaaactgcttaatgataacttttttcgcaattctaaaactgaagcgaattctaaaacttctcagcatattgatgacaaggaattatatagaaatgattttaaattaaatgttgatcacaatctaattgaccttaaggaaggaaactctagccatgaatcatataacaataaactttctattgattatgcagatgaatatgaaggatttatggaagaaaataagataggcgaattagattatgagacaggcaaaaaaattgacagtttgtatcctgaatttgatatggattcgatattctacatgcccttacataacaagttaccaacattatctgttactttcgatataactattccttttgatgtaaataactctacagacttattactgcttaatatgaacaggcagaagctactgttgctttcgttcctttttaaatattcaatgaatttatcattggctgattcgaattctgatggagtaattaaagtcgagaattatacagattttatgaatattgatgttttgcctggaattcaattgagctgggatggtattaccaaatattttgatgacttctttatggtttttgcgcataatttagtcaattacagaacgataataactaattgttattttcaaaaatcgattactgcacttaagaaattgctagaaagactgagctatgctagtaacgaggattattctctaatgctattaatgcaaataacgcatctagaaagtgttaaatcgtggtcattagaaaatgatgccaaacatttaactcttgaagatgttaaactttttggcaaaattcttctcaagtatggcgaagttcatggcgttgccattggaaacgctaccccatcccaaatttatgctcgaattaataaattcataaagatgattagaccatcagctagtttgttaaattcatttaaacagatacattctggacaatttagtatgacttttgatactaaaagttatggttggatatctgataaagatttaacagatgaaatgattaagcgaagctatatgggtcctatgctgatgaatgctgaaaacaaaggaaatttatttaatagcaaatttattaatatggaattacttccttctatgtatcataaaaactatttttttaagcaaagagcttcaagctctgatccattcaatacagttctactatacatttaccttggaaatacggagagaaatatggtccttttggatcttttagagctggtggattttcacaaagtcttgaactccttcattgcaaacaaaaaatctcttcgttactcttcgattcaaattggatctttatttattactcgcgatgtcgcaagcttccaaattaaggtaacattcctttctaataagatcatttccatggtaaatgttattctcgagtttttcgatatttatttcctaaatccagaaaaagttttttctaaaagagatttcttatctttgaaaagtatgttgcttagtaattttcagaaagtctcactaaaacctagtaaactcgttcaaatgcattacgaaaggatcattcgaggaaatttaggtaacgattggcagataaaagagacagttttacttcgaaatttctgctacttaggttttcttgaactttggagctcattcagaaccgcacccacaattttagtcataattcaatcgaacaggaaccaagatgatcagtctaatcagctatcagaatttgttcctgagggatataccagactcaagtctatttatcaattcaaagattctttcaatgtacattga

SEQ ID NO: 1309 - DNA, 1569 bp, Cryptosporidium hominis
atgaaatcactagatagactaaaaacaaggtttcaagtattaagcataatacttttattgattcatggattctgcaacaaaagtttagtgaagaaacaacaaaaatatgctaccgaactaaacttaatggagtttggtcagcaagaaagaatggagggagaaaaagaggaatttatttcagaggaaagattaagtaacttattcagtatgttaaaaagaaagagacataaccccaatttaaatgagctcatagttggagatattaaggtcaggattgtttcaaaaaaaaatattaattttcctagaatagttttggatgtagaatttggtaatcaattgaaccctttatattataattcaatttcaagttcggatcgttgtttgctaatgcttggttggcattttcggagccatcttagacaagtttttcaaagttacatttccagagcaagctttataatgcaagagaaacatatttattttggaggaacaaaatactttttcaagtctaaaaagtccagcttagaggaaattgaattgattcttaattatattacagcattcttcagtaaaaatatcataaactcaagcaatattgttgggaactatcttttagatcttcaagaaaatggaaacagatattttatgcctgataactatatgaggaatctttttttgactgtattaaatgacaaatttaagaggaactatttccaacctgaaggttttagggatatttatggggacttgaaaatgtgttctaatattaaaaatgtgaaaagctttgcttataaatatgggcactactttaaaagaagaattaaaaaaattgagatattcttaaataaagaaagaattaacatgcacaaattagagcgtctaatccgaaattcatttagaaaaatacacaattcaatgataaatttcgaccatttaaaatttttaacaaagataaaccctttttcagaattgtcaggaggaattcttcaaataaacagcaatagagtgaataacaaagttactcttatgtttccaatgctagatcaattaagaaaaaggacttctgaagttgctaaatttttggataaagtcttgactaaaaatacactgattgatagcttatttacgaatcaaaagtggattttagagtatagttacgagtttgaaagtaataatgagaatttgtacacaaatctattactgaactttatctccaataggcctttaaattcaagagaagaattacttaaatttaaccttactaatgtgattgagatctggcttcaaatattaaatgtttcaaattcaaacgcaggaggcttaagaaacaataacatattgagctcagaagaatttgactcacaatttgaaagcattttgatcaaatgtttaggtattgacaatatggttataataatttacagtaatgagcctatatctattaaaggcgtagacatattgaatttaaatgctaagataaatgaggatagatactggcattttattcgaaaattatactcgaattcatatctaatacgtagagacttgctgcctaagctcggaaattaa

SEQ ID NO: 1310 - DNA, 2076 bp, Cryptosporidium hominis
atggaaattaatccacaaaatatgatcatcatcttcaacctgaagggtgacaaagaaacgatcgaagatactggtgaattaaccttgtttgaccagagtattttaaataaagattgcgccaagtatgaagaatttctaagtcaaaataaaaaatttagatttgttattttaacaaacgttttatctaaagaatttaaaggagttataaaaacaaagaataaatttagattcattttggaagaacaaaacttttgtctgaaaaaatacatttcacatttcccagaatctttaactcaagaattaaagatatacaataaagataaagatccaaaaacaaaatacaatcttgagaaatacaatattgttgagaggcttgttgttccaaagaaacttcgtgatcttctatcttcagactcttcacaaagagcaacaaattttccgcaatttcaagatttttattatttcattccgcacaaagtaccaacccacaaaatttatttagcaatgaacttcttttttccctttgaaaacaagaaaatggcctctattcgatcaacccgtattgctaccatattactatttattaaagagatcttgctttctttttccgaaagtgtttcttcacatcttgcaaattatagcgttgattttattccaaaaatctatttaccatacgattcaatagttaatgcatttggattatcattatcacttggaagcgcgccaaacgcattttctcaatttttatcaaatctttcaattaatttgaattcctatattgatttggatgaaaaaacatttcatgaatttgtttcttatttaaggaaagtccaggtagaaaagtccaagagtcctaattttattgagaaggtaaatcaaatcaatcttaatcatttaatttcaactgaaacaattttgaatgagttacaaactctaaaagttgaggaggttagagaagttttccaaacaatgattagacagagccaaatttctggagttatttatggaaacctaactccattagacgcagagaagtatctaagtcgattattttcaaatttaattggtgaaaccccaaagaaaaaaactttaatttttaaatctagaagaaagtcgggagtatcaatgagattaagatactcacgtatgataactaaaattgggtcaaaacgaactagaaccagaaagattgtgttgagtaaaaggaagaaaagtttgataaaaaataatggtcaaagaaccaaaatttccaataaaacaaaaactattaaaagtgaaatgctttctaaatcaaaactttataagctttactcttcagctttttctaaatcaaattcagaggaatgtaagaatttgcaaattttagatatgtcatcaattagacctatttcgaagtttttcttatatgaagaaacaaatgataaagtaaacgtttcaattttatggatatatattgataaagcctctccagaatcatttatatttgctcaataccttaaacttattatagaaaatagactgaattacctacaaaaaaataataataataataataatataaatacttatataaaaaattatcatatatcttcgagctcatatttaatctcaatagagggttcatcaagcaaagaagattcaaatgcaataaacaacctattattaagttacctagatacattcctttttccaggctcttcaatttttaatctagacctgttcaattcaataaaagaatttcttgtgaaaaagtacaagaaggaagggcattatttagattcctcagtcgcaaatatatttgaagaaatcattaacaaaagattcgacttcactaggttcagatcagttttgaatctcctagatcgactaactttcgagaattttacttcaaaccttgaaaaagtacgcaagtcagcattttatatattatattcaatgtcttataaatcgcagccaatagttccaaatggttttatgcacttacgtgatccaaccgatattttcaaacttcatggaattaaaacattcaaaccggcatattccagagttgacaaacaacttaacaatctcccttaa

SEQ ID NO: 1311 - DNA, 1611 bp, Cryptosporidium hominis
atgggaaaatataataattttttttattatcctaataagaatattccttcaccaaaatcaataattcaatttagattcattttccctttggataaaataactgataatttttcagaattttcaacagattcagttacatttaatttactatttttaatattcacagatatatttggacttgttttaacaagaaatttctttgaaattttatctgcaaaatattcaattgatacggatgatgtaaggtttataagtgattctaataaaacaaaccaattaacattagtaatttctggtttttctgatcatattgaagaaattacttctgaattaaaatcttttattcaaaatttttctacatatattacaaataatgactttgaattggaaaaagagaaacttgcgatcggttttaaaagctatattttaaatccaacaattagttctgatatagttgaaatgaagaataaactattttttaatcaagattattcttttgaaacacaattatcacgacttgaaagtataaattttgaagaatttattaagttttcagaattttatttaaataattacaaattggagggatttatagtagggaatttaaatccattgcaatctattaacataattaatacaatttcgactatatcttcattagaaaatggaaattcaagtacaaattcaattcataatttactttcaattttatctatgggggtaaatcaatctgtaaaacttcttagattactttattcttctatcactggtctttttgtaagtatggatctcaaagatgaagattatctaaatgttcaagaacatttgagaccttcaccacctttaccaatgtctaattcaattaaggatttccaaaaatttgatccactatctttaaaaaaaggttccaaaatttactcttattatctttcaaaatcaaaaatctcagtcaacagtgcaatttctttgaaagttgcaatagggtacgattatatgaagaattatattctcacaaatattttgattttaattatttcggaagaattctttacggaaattcgtacggaaaagcaactcggatatgtagtaggagcaagctatgaagatattgttgatcatgtctctggaattaattttaatgttgtttcttccaataaaaatatagaaacattagctaacaatgtgcttgaattttggaacgattggttttctccagattctaacaaaattactgaaacactatttaatgaagctaaagaatcatttattcaaactatgaaggaaaaaattgtaaatattaaagacctattttcacatttttcagatgaaatatcaactaagacttatgattttgactggaagaaaaattacattgattatgcagaaaagcttacatatcaaaatttccttgattggtttaaacagatttacaacaattctaatttattcatgcttgcaattcaatctcctaattctgaagaaaaaaacgttttagatactctatctaacttcgttcctcaaaactttacaaagttcactccatctgattctttgttcagtattgaaaatattagaacttataaccagtggaatgtttgtaatgcaatataa

SEQ ID NO: 1312 - DNA, 555 bp, Cryptosporidium hominis
atgcaaatagaaaggcagctcggatatgtagtagaagcaaactatgaagatattgttgatcatgtctctggaattaattttaatattgcttcctatagccacaatgtagaaacattaaccgaaggtgtacttgaattttggaacgattggttttctccagattctaacaaaattactgaaacactatttaatgaagctagagaatcatttattcaaactatgaaggaaaaaactataaatattaaagacctattttcacatttttcaggtaaaatatcaactaagacttatgattttgactggaagaaaaattacattgattatgcagaaaagcttacatatcaaaatttccttgattggtttaaacagatttacaacaattctaatttattcatgcttgcaattcaatctcctaattctgaagaaagtgatattgtaaatagcttatctaactacgttccccaagactttacaaaaatatctccaccctgctggctttttagtcatgaaaacattagaacttataaccaatggaatgtttttaatgcgatctaa

SEQ ID NO: 1313 - DNA, 918 bp, Cryptosporidium hominis
atgagtcttccaccaaatttatttcctgaagatctatcttttccatactctccaaaaaaacttgaagtaattttttcaataatatcatttttgtttctaaggtcttttgaagatattaaatattattacaataagttgtcaaccagcttaagtttctcaattaatacaccaaccattttttccttctatacatatggaataattctagaaatttcaggaattacagataatcttcctcatgcaatatcaactattgcatctcgcattaaagaatttccaaatactgtgaaagcttctgatttaactgttgcaaaggattattatttaaggtacataagaaataataactttgagcatttacctgcaattcaatttcaatctatattaaagattttattgtttaatcaaaatttgacaacttgttcagtcaataatgaaattaaagagattaaattaaatgaaattactaacgctattgatttccttgtaaaaaatgggacatttgaaggtataatctatggaaatattaatccaattaaagcaagagaactcctattattatttttcataaatcttggtagaacttcagctgaagaaaaaaatataaacaaaagatcaaatattttcttaaaaatacttatctcggttaaaaagattttctttggttgttttaatcacattaaatattttatttataaatttactggaaattttaccttacaaagtgaacctcccgtacatttaaagtcaattcctacacaaaatataacgcaaaattctctgaaagatcttcaagtcattgatttgctttcatttaaagaaggaactaatttcgtttattttgaaaagtctaaatttgattctttccaatttcatacattaattctgaaaatatgctttgggatatttcacagttga

SEQ ID NO: 1314 - DNA, 786 bp, Cryptosporidium hominis
  misc_feature (743)..(743): n is a, c, g, or t
atgattaaaaggtattggtatctaacatcatgctttttaatttttaccattatcctttaccgtaatatttctttcacgtttaaaaagcaagagtatgcttttattcaaaataaagctaaaaaaaatcaaagaaacaaaaaaaattcttttgttagaaacgatagaaggaaacatagaattaatgataaaagaaacatttataaaaataattcaaaatatttcaatgattcaaacgatgatttaattaaaataatgtattcagaaaaaaagttcaaacaggtggaagaaatgattgatgataaatcatttgaaaaaccaattggatgtactagggaatatagatatttaaggctatctaattctttgaaagtatttatggtttatgataagacaacagaaatatcatttggtagcatgaacttagattttggatttgcttctgatccagaaaatattcctggcctatctagataccttctttatacattattatttggatcattaaagaaaaaatttacgaagcaatttgctatgttaatcaagaaacataaatgcagttataaagcaagtattagtagagacaattcaagatttgattttaatatcctctcaaatgaatttgaaattgcactgaaaatttttgcaaatatgtttataaacctgaatacaaatgataacgtacatgaagaaatttttgctaaacttgtaaataacttagctaataatataaattttgatagttntagactttcagatatattacaagagatttcctcaccaacttaa

SEQ ID NO: 1315 - DNA, 1671 bp, Cryptosporidium hominis
atgtcatctggtacaagaaagagccaacttgagatacgacagcttgcgttaaagctcactgcaaactctctttatggctgtttaggatacaaaaactctagattttatgcaaaggaccttgcatcaatcattacattctatggacgccaaatcctacagaaaactaagttgaaagttgaggaagaaaccaagcttcaggtaatttacggagacactgatagcattatggttaatacaaatatattcgatgatggcaatggcgaaggatattctcatgttctaaaattagcttctcaaatcaaacagattgtgaacaaagactatactaaattagagctggatctagatggggttttacagagacttttgttacttaagaaaaagaaatacgcttgcattcaaatagttgattttcatcgtaaacaactcaagctggaatgcaaggggttggatttggtcagacgtgactggtcaattttaactagaaatgtctcaacacaattactaaattcgctgttttctaacgaaccaattgacacggtaataacaaatatattgaataccctagaatctttaaatgaagccttaaattcgaattctattccgctagaaagtttcataataacaaaaacgctaacaaagcttcctcaattctattctgacccataccttctccctcatgtaattgttgcaaaaagaatgatttcctccggtttacctgtttcttcaggtacagaaatcccatatattatttgcaaggaagttaactcacagtcatcagaagaagttgcccccaaaagttcaatactttctaaaagagcatattctcctgaagaagtaaaatcaaatgggctaaatattgacattgaatggtataagacccaacaattactaccaccgctttcaagactatgcgctccaataccaggtttagaaattagcagaattggccaatgcctaggtcttgaatataagcaatatagcgaaataattcataaagaagactctgagcaccatggagatttattttcaacattcgagtggaagaaaagtccagaaacttatactagtgttccaattacagctaatattgattgtatccaatgtataaaggcaggaaattctgaatcaagctccgtttttgatcttcttaaagaaaatagatgggaatgccaagtatgtaatagtcaatttccgccagaattcctatctaactggcttcaaaaccaccttagaacgctaaccctcggattttactcggcctttcatggtgtctgtagagaatgtaatattcaaactagaagagtgtcattaaaaaatgggttcaactgcccacaatctcattgcaaaagtaaaaaatcgctaataaatgatctttctccacataaaatttggctatatcttgatcactggttattttggctctctttaacgaatgaaaataacaattcttccaatcaaaagtatcagtctgagaaagatattattatacagactctattaaaagatataattctcaatttcatgaacataaacaagtacaatcatatccaaatgaatgatttattcgttcttctgaagggaaaggataagagaatcgcatctacatgctcaaatgattatttattgtccagtttatggaacaaaaatataacttctttaggttcttaa

SEQ ID NO: 1316 - DNA, 669 bp, Cryptosporidium hominis
atgcttttgcaagagattcagtttaaattttcaaaactggactcactgatttcaagatatgaatatctttcgaaaaccaaaaaatttggggactctactgtttcgttttgttcccagaatattaacaatgcattagagtctattcaaattgaactcaaatcattaaaggaaccaagcgagaaaaaaaaatttgaggaatttcttaattctcgaaatgaccgtattagaaatattaatgaatcttggacaaaaaatgcactaattcctacagaacaagttacatataatatgaaacgaaattttaacgaagatattcaatctttgaatgatagcgacttaacagactataaaaaaggcgatgctttaataaagctagcggatgagtcaatcataagaatgaaaaaatctctaacgtatactgagaaactaggagatgactctcttaacaaaatgaatactcaaaaagaacaattagacaggatccggaatgaattggataatgtaaaagataatatttataaagctaacatatctttgaaggctattgccagaaacactgcaaccgacttttgcgtacagatgttgtgcggaatattatctatttgtttgctgataattatcgtactcttagtcgtactcagcattaggaaaaataaacaatctgaataa

SEQ ID NO: 1317 - DNA, 2283 bp, Cryptosporidium hominis
atgcaattaaacaaaaaaatgcacaaggagtcttttaatatatactcaaagacggaatatttggagataagaagcttagtagtatttaatagcgggggaataggattatacgacaaagaagcaaagaatactactattgagaaattaaggaatgatagaataacacacaaaaaaaataaagttcagaaagaaaatataataatttctatcgaaaatttgtatttattgctcgatattgatgatgatgaaatatttttttattatggcgaaaccttggaaagccagaggcatggatggggttttttagctgataaaagcaaaattatttatgagggaatgtggtataaagaccaagcaatagggttatatatattacaagctaattttatgattgaatttggttataaagattacttttatagagattcaaattcatatcaatcacaaattatttggggaaaagaaacagaaattattttggataaaaaaacacagaaaaataacacattttctgaaaacttaaaagttgatgaatttagtaaaactaacaattctagacaagtattagaggcttgcttaatttctaattcaaagcaaactaaactctcgggaaattcaaatacttcgttattgtataacatagaagaatttaaattcactgaaaaaaatgtattcacgagaggctttgaaaacttgtataagataaataatcaagctatttatcaacctatagttctatataattcaaaagatatttataataattaccaacaaaaaaaaattgatattttgactgaaaatgaaaattttaaaatcgctgaaaattatactaatgaaaaaaaatcaataaaattgaatggggctaatacacatgacagcacatgtaataatttcaaaaccttaatatttaaacaacttatttcaacttctatttatgcttgcgattgttataaatggagtagtgaaactatttcccttattctactttcaaatggattactagaagaagcgatgatatttcaaaattataaattatctgggagtgacattcctattcttaacgatcagttgattgaaaagctcggaatttcggataattattcaagaagatttatattgagattgtttcggcagttttgggggtttcttgattacatggatttatctctgattgaaaatcttaatattaaaaactcaagtatcctgccttacattaaccggtcagaaataaaattaggaagctatatttcaagtaattataattgcgttatattaagtgggatgtataaatctcaagaagttatctgtaaagttctcatgtttgatactgaaaattatgaggagttgggctctaaagagagaattaaatatagaaatagtaataatgatattttagagtattatttggacaattacaataacaaaagcaaagatttaaaaagcgtagataatttaccgatttgctatatttataagtataggcgagagagtatattaaaagaaaatttatttaagtatattcccacttcagttaaaatgaggaattgggaagcaaggattttaagttatctttcgccacatccaaatattgtgcaatgcctgggcgttactcagctatatatgggttgtgaagctctattgttggaaaattgcgaaggcggaagtatggatcaatatttaattaacaacaataatggtgaattccaaaaactcagatctaaatattcagcaagtagattggaaatgctctcttggctgagagatattgcaataggcatggaacatgcacacaaactaggtattttgcacagggatttaaaattaagtaattttttcgtatctaaagttggaaaaaatggtattggaaaggttggagattttggaattgcaatatctatagattcaaaactcggttattcaccttttactgactatgggaatacatattacgccgcacctgaagtactaagaaaagagggattttttaaggaaagcgatgtgtggtcatttggaatgagtatgctagaggtgttaacgaagtcttttgtttttgatggtttttgccctggccttgttatggtagtaaatgctgcaaatatagatactattcaaaaaaaacttgatgtaccatttgagcttaataagcttataaaatcaattcttaatccagatagaaaaatgagaccatcttttgagcttatttcttgtgagctatcaaaaattattgaaaaatcacaaaaattggctttccaaaaactattcgaatttcatgcatttaattag

SEQ ID NO: 1318 - DNA, 1065 bp, Cryptosporidium hominis
atggaagtggagaaatatgaaaatgaaaaaaatgaaaaagttgatttaatactatgctgtggtgatatgcaaacaataagagacgaaagtgacttacaagatatggcagttaaatctcatagatcgaaaaaaggagatttttgggaatattatgaaggattaaaaaaagcttctaaattgactattttcattggtgggaatcatgagactccaaatgttttaattccactttattatggaggatgggtggctccaaacattttttatctgggtagttctggagttattcgagttggagatgttagggttgtaggtatttcaggtatttataaaaattatgaccattttagaggttattatgaatcaaaaccattcactgaagaaagcaaaaggagttggtatcacattagatggtttgaaattcagaaattgttactaattgagaatataaaatccaactttttaggttctagtgagttgagaaaagtagatgtgatgatttctcatgattggccaaatgggatagaaagatttggaaacctaaattatcttataagaagaaagccgtatcttaaagaagatattgaattaggcaggcttggaattcctggatgtatcgaactcattgaacatttaaggccaacattctggttttcaggccatcaccactgtttctttgacgcttcaatagaatttgagaatcaactatattcatctgaatttagagcaattgacaagtttaaaaattcaaattcgccagtaagatattttgatataaacagtaataaaaacgatgttcgtatttatctagattttgagtggctaacgatacttagatctgttaaagcaaatattccaaaaggaaattatacagtagacaaaaattcagttccaaaattaagtaggccaaccaaatctgatattaatgctatatataaaaatcttaaagaagtaattggagactttgatgaaaatcactacgaatggcctctatgggaccaagcaaatggaaattttaaaaatttacaagatcaatataattttattaacagaattattgaataa

SEQ ID NO: 1319 - DNA, 612 bp, Cryptosporidium hominis
atgtcctcaaaaacaattgacaatttcgataatacctgtttatcaacgcctaggcgttccaaaaatattgaagatgaaacaatagcattggctcctgatgctcgaagagcagtacgtaaacaacttaatattgagtttattaatgctggggagtggtgtgacgaactagacaacttaaaaaatgaaaattttttcgagaatatgtatgagaaaaatgtatcaaccccgctaccgaaggtatttagcatatcttctttaaatactaagcatttaattaccccaaaacggggacttaaccgtgatagtattttaagcacgggaactcccagaggaaaaacttcccaatattatcttgacctaacgtatgaatgcgtaagtatatgtgggaatgacagcgatcctgaaagttcttatgaaaaggatcattctccaatcaaaaatattgatataaatgaaaacataaaaaatgcttcaatggaaaaatcagaatattataatagccgtatactttcattatgcaagagaagccgtgattcattggagtttgatgctggaagtgatagcccaactgaactagttcaaattatgagcaaatcactaagactaagctag

SEQ ID NO: 1320 - DNA, 1620 bp, Cryptosporidium hominis
atgagtgacacttcctcaaaacaggtcacgcttaatgatataaatcaagtagtggaaataagtataggtaaaaataagcaaaaaaatgagaaaatactgggtaacttctcaaaaaatgaattaacacacatgggaatagggttcattactgtatttaaagcagcaataggaaccggaattttgttttcaccaaaaggagtagttaatacgggatatcttttgagcgcgctaatcatgttttactattgggttttgaatgtattatctacatttcttttaatgcaatgtgcagatagagtgaatgggaattactcttccattgcaatgcatgcaatgggcaaatttggaaagtttttattggaattttcattgatttcaactgcaatttcgttcggttcaatatatgtaacatttatcacaaacaatatacaagatattattgcaggaatccacaattgctcaccagaatatttgaactatggatcagctcttattacttttttgcaattgattatatacattccattggtatcagccagaaaaatacaatcccttgctcctgtaatactattttcgaaccttgctttaataacagcaattactttagttcttgtacaatcatttcacacattaatcagaagccactctaaaagctccttttataatattcctgcaatttcggatgtatcaaatattccaggatttgttggaactgcggcatatttatgggtttgcgctccagtcacgctttcatactattcttctataaataatcaaagagaaaagagattttttacatggatatatttactggccatttttgtagttttcatatttgctctcacattcacatatctttgtgcgtttgcctatggtgaaagcactctttctgcaatcaccttaaacctaccgtttactccagttgcgatgggtggtaaaattctctattcagcaagtgtgttactatcattgccactaatggtttatccgatgaaagaaattttttcaaaatattcatttggtttatctcaaaaaattcttccaaaatccgaaattgaatttaaggaagaaaatccaactaaacaagagtctctaaataagagcaactctaccatttcaatggaaaatgctagtttaaatgaacacataattgtatcttgcgaaaaaccagggacagatttcttagaagaggatcgtccattcccaccaaattttgattgcactaataattgtaacttaaaagaaaccaagcacattaaactgaaaaaactcaaaaccgaaatatttgaggttcaaaaagaaaatatactgccatctttttggatgatgatatcttgcatatttattacttttttgggttatattttgcatgattcgcttagcaatctaattaatttaattggaggactattttgtgttccattaaacattttacttcctgcattatttcatttcattatttttagaaaggaaattggaattaaattaatcataatcgattttctacttattatttctggcatatttacttcaattctagtaatttggtactctatactaaattggagtactgaaaatccaaccatttgtacaatgaagaattccgaatggtttaaatag

SEQ ID NO: 1321 - DNA, 736 bp, Cryptosporidium hominis
atgacaagcaaaatattatttttatcggcattaatactaatatatttaagtattttagtagactctgcatctaacgattcccctaggaaagctagcgaagtcctggaaagtagtactggcttaagcacacaaaacgaaaataaagatgcgcatttgcaagaaacaacttcattagacacagaactatctaatacagctgctagctttcaaagtgaaactattcaattgatagttagcaaaaagcctgtagacatttctgaatctttagcaaattttatagccaaatttttggttgaaaatgcggaaatgttagttattttagaatttgagacaagatcgttatgttttaatagtatatatttatctaaattttggtcaagcctgaacaaaattacttcaactgaacatacacttattaaagggctagtaaatttttgggacgaagaagatgatactgtaccaaataaaattgtcgaatatatggttagaagacataaagattataaaagagttatattgaaggattataggaggctcaaagtttcaagacataaattaatgctaaataatttaaataatttcaaatgttcaaatttgaaaaacgcatttgtattattaatattaatttttgaagggaatgatgaagatactttttctgttttattactatttttattgatttgctcagtacgtattgttgaaggtaataattttaaagaaaaattcgaatttgata

SEQ ID NO: 1322 - DNA, 14178 bp, Cryptosporidium hominis
atgcttaaaaaagaggagtacgggccatgcattaatagtacatttagtgagtcacatagtaagatgaatccaaaaaataatgagccaaattttcaagatcaagtcagcttaaaggatttattttccctatatggaaaaaacccatttttttatactctcaaagaaaatgctagaataaatggatttagggaatgttattcttggatagggtcaaatggggacataaagaagaagtttacttatagagaattatttgaaaaagtagtcgaattaagttggtatttgagcaaaaaactaggaatcaaggcaggggacaaagttattttgtgttatacaccaggctatgattttgtaattgcatttactacatgtttagttagtgggattgttgccgtccctgtatatcctcctgatccaatgagaggacaaagcgaaatacagaggttttgtgatataaagcaagcttcagaaactaatatttccctcacttgtacatcttatatgagaagtattgagatagctaaaacaatgtctaccgacaaaagatttaaatcaataaggtttgaggcaacagataatttgaaaatacggaaggaagaatatattaacgaagtacaaaaggcgattaatgatattattcttaatgattctaattattgtgattttttgggttttgattttaatattaatacggtagcatttctgcaatttacatcaggatcaacttcccaaccaaaaggggtgatggttactcatggaaatctactttataatattcacatttgtattagtagctactcgtttccttcagttttagaagaacattataaaaacgagcttgacagcattcctgcaggaattacagttttgaaaaaaaacgagcttacagaagatgaattatctttcattaataacgaatttggagaagaaaaaaatattatgtcattaaatgatattaagtatgataaatcgtatttatatatgagtattattaataaagtcttatataagaatacaatgagttcagcttctgtttttagctggcttcctgtttatcatgatatgggtttaattggttttttttgtactcctttgttttttgggtgtaatattttccaaatgtccccaattgacttcataaaaaaaccctacctttggatgcaatgcatggataaatacaattgttctgtaagcggtgctccaaactttgcttttgaagtcgtggtaaaaaaaactccaaaggaaatcttaaatcaacttaatttaaaacatgtttttgcaattttatctggagccgaaccaattagaaaaacaacaattgatagatttactgaggcctttaagtcagtgggaataaaacataatgttatcaagccggcatatggtcttgcagagcataccttgattgtagcagggaacaatagttttcagcaagaggtaaaccatatcactgttaacaccaagaaattaagagagaagaatattgttgaaataaaggaagctacagagaaaagttctacagaaacaacatcatttgtttctagtggtattgtttacaagggaattgatttgagaattgttaatccggagagtttaaaagaagtaactcccggaaatgttggcgaaatttggatttcaagtgagtctgtaacgcttggttattataataacaaggaagaaacagaaaaaacgttcaatgcaaatttcactatgctagatggaaaaacatcgaaaagtacttacatgagaactggggatagtggttttataataaatgatatgctttatatttcagggagaatcaaggatatgataatcattagaggtagaaacttttatccacaagatattgaggaagttattgatggggtcagtggagttagacaggggtcagttgctgtattttctgtaacccaggcagatggtgaagaagctattggtgttgctgttgaaatcagaatggaaacgagtatacttggaagggtaagaaggttttttgaaaaacctgcttatgataacattgttagagcgatatcgaaggcagtatttattgggcacgggctaccagtacattatatttggcttctctcccctagaacaatattaaaaacaagcagcggaaaaatcagaagatctcaaacaagagatgcaattttttccaaaaaacttgttccattattcgagtgggtttgtgaacagtctccaatgtctgatattttggttgaacgatcatcacagttcattagtccaacatccatgattatttcaaagtctggagttcaaaataaatcaaaattttatgagaaaacacagtcaggtcaacaaaaaatatctgagcaagctaatgatgaaaaaaatgagtttgatatcgatcaagtcaagataaagatcattgaatttgctgcccaagtattgggaataacacagaaggacctggatcttaatgcgcctctacatgaatatggaatagatagtttaggatcaattcgtctatctgaaatgatgaatgaagaatttggtgtagagctagactctacacttttattcaactatccaactgtaatagagattgtggactttgttgcagcacagatctctggaaaagaacttcataaaaagaacttgcttaatcgctcaggtattgacagctactcagatattgtagttgttggaatgtcttgttcatttcccggtgggtcttcaactccaggagaattttggagtttgttacagtcaggagttgatgcaatcggagaaattccaaaaagtagatggaacattgatgagtattattcaactgatttagatttagagaacaaaatgtatactaaagaaggtggttttatagaaaacattgatcattttggagcatcattctttaaaatatctcatgtagaagcaagatctatggacccacaacaaagaatatttctcgaaaaatcttttgaagcgttaaaggacgtaggatataccattgatactttaaaaaaacgaaatatttctgtgtttgcaggttgttgcagcaatgattggacccatgtttgtaaatcagaagcaaattcaaatattggtacatatgctgcaacaagtcatgctgcatcaataatagcgaatagggtctcatacactctaggcctgacagggtcttctgtaacagttgactctgcatgcagtgcatcaatagttgctcttcatgtttctttacaagaaatctccactggacaatgtgaagcagctgttgttggtggtattaatttaatgctttctccgcagatcactgttgctctttgcaaagctaggatgctttctatggattgtcgatgtaaatcttttgatgcagcagcaaatggatatgtaagaggagaaggtgttggagtccttgttttaaaaacaatgaagaacgcaaataatggtgaaaaaatctattcagttattaaaggatcatcggtaaaccacaatggaaggtctgcaagcttaacagccccaaatggaatctctcagcaaaatgtaataaattcagctctggaatatgcaggaataagaccaaatgatattagttatattgaagcacatggcacaggtacatctcttggagacccaatagaagtatccgcattaaaaagcatattttcgagaacaagagattcaggaaaacctctaattattggtgctgttaaaacgaatattggccacctagaaggagctgcaggtatggctggtattttcaaagtaattctttctttaataaatgatactgttcctccaaatctgcactttaaaaacattaaccctcacatcaacctaaaaggttttcccgtaatcattccaacatctaacattgcactgcaaacatatgacggttcaaaaacttgtgcaggagtttctgcatttggatttggtggcacaaatgcacatgcaatttttgaaaaaccgagtctaagtatcgatttgccgattaaaacaggaaaaatagagacgaataaggcaagaaataaccctgttctatttgtatttggttttcaaggattccagcatgtaaacatgggtaagtattactttgagagagaaatagtctacagagaatggttcttgaagtgttgtaaaataattgatccattcttaaaaatatcactaaaatcattagtttatcctgaaaccaagaatatagaaaaattaagagagctaaataagatccttgagcaggaagaatatgctcaatgtgcgctttttgcagttcaatattctcttgcaaagctcttagagtctaaaggaatatatccaggagcagtaattggtctttcagatggagagttagttgcatctgtttactgtggttctatcaacctagaggatgggctaaaattgtgtatgctaagggcatctttattgagtgagttttcagctggtgaggggaaaatggcactgttcaatgtgtcaaaggaggatgccgaaatggctttagcagatgttggaccacaatataataatagggtttcaatttttgcatctattagttcaaatcaagttttgctttcaggcgatgaagaaaagcttgaaaccgtagtttttatattgaaagaatactaccctagggccaacgcacattctatagatgcaaagttcttaagaacaaaatattcatttggtaccaacggaatgaatggcctaatagagccaatttctaacttgatggaaaatattgcattggaaactccgatgattccaatgattagtggaacttctggttattttgtttatgaagaattaacaagtccaaagtattggggatggcagttaaacaataaattatctatctcaaaggcactaaatactgccattttaaagggagcatctaccatattagacttaatgcccatttccagatcagaatttggaatttcagaaatttttaattttgaaaatattgataaagacactatttactattcactttttgaagatacaaacttggaaagttatgaaccgaataaattcaataaaatgatcgagatgctatctgaaattttgcttaaaaattcatataataatgttgaagatggatgtgtccaaataatggatagcaatggatcaacatatagccgtgagtcattcccttggaactcgtttaaacattcaatacttggtgagcagaaatcaattgacaggtcagtaaaaattgtctctaccctcaataataagtcaatcaaactattctctgatcataaagtttatgaaacaattgtgattccgggagccggactcattgatttggcagcagcatccattataactgtttcaatggatgatgaaagtattttgcaaggttctaatgcattatttggagaaagtatagctgtgaagctaaacaatgtactttttgaaaaaccagtggtggtgaatagaactagtttattttcttctgaatgtacagaagtaattaatcaactgaaatcatacaacaatctcgctaacgatcaaaaaacaaatttaatttgtaatattgagtctgacggaaatatttccatacagtattgtaacattaacaatcaagaagattttgattatgagactgataattcaatgattgattgcttttcttgtaaggcaaaaatttccgagggggaatttgttctaagtgaagatcttgcccaattaaagaacactacaaatataaaggaagatccgaaaattatgtatgaagaatatgaagaaattggtttgaaatatggaaaaaaattcagagttgtaaaagaaatttatagaaatgaaacatgttcgattgctttgggaaaaatctatttacctgaaacatgtaaatttggaacatttgaatccggattttatttccatcctgcgattttggatggtgcactccatgttgcaggctcactattaaaatataaagattgttttaagagtaagcaggcaatggtaccagttagtattgaagaaattgaaattaaatatgtcaacgcaaatcaaatgatttgggcagctgcatatcttagtgaagcgacacagaattattccattttcaatttagttttgttcgattcagaaggaagttgtattggaaaattagaaaaagtttctctgcgtcaatttaacagcaaaaatatttcgaaacctacagtttcgcacaatgaaatactttggataacagaatgggagaaatccgatgttttaaaattttcaaaaaatatttcaaaagagagtgattttgatttaaaaatagccttaatacattcaggaatctgtaatattagtgaaaaagacgacatacaattgcccaaagctaatataagcttcgtaaatttagatacaataaaagaaagtaatattgaagagctagaaagactcatagatataacatcactcgattcattagttttcctctcaccagttgaactggctttgtctactaagatagattgtgagaagatttcaattgatattttggagtatgtaatgaagatttgcaaattatacttaaaaatactaaagcaagccaaaccagctaaacaagaacaaaaaagaaatattccaaatttctggatcgtcacaacaaattctcaaaatttaatcaactatgatgttaatgaaaatatttacattccaaataactctggattatggggattagctaaatcagcaaatcttgaaattagttctttattgacaaactttagccaaccaatcaagagtgtggatctagaaattacacattttagtgataatcaatatttgagaaaaaccataggaagcttagttcgatggataggaaactttgaatattcatcactaaaagaaaaagaaaatcttattttcaaatttgaaagagaatttagtattacctccaaaaatatatatgtaaacagaataaataaattccataagcaaattgttgggccagttgaattattcatgcaaaatagaggttcaatttctaacttatcgttaatagaatcagagcctatacagcttgaaaaattaaatgactatgaagtagttatgagagtgaaatctattggattgaattttagagatgtattaaatgttatgggattgtatcccggtgaccctggacctcctggcggtgattgttctggtactgttgtcgctgtttgtgaaggtgttaagcatattaaagttggtgacaatgtatttggaattgctcctggatgcttaaaaacttatgttaccactgattcaaatttgttgtgcaaaattccaaaaggatttaccttcgaacaagctgctgcgttaccggttgttgcaactacagttgaatattctcttagagatattgcgaatatcaaaaaaggagatattgttctagttcatgcagttactggtggtgtaggattaatggttgttcaatattgtaaagcaattggtgctaaagtatatggcacagctggaagcgaatctaaagttgaatatgcactttctaatggtgttgagagggtaagtagctcaagaaatgctgataaatttaaggaagacatgaaagatttagagggagaagttgatattgtaattaattcattgatcgaagactttattccaaattccttgaatttattgaaaaagggtggttgttttgtcgaactaggaaaaagaggaatatggacagaagaagagatgaaagaaaagaggcctgatattaagtataaatgcgttgctgttgatgtaatgatggaggaagatcctgcttggtttgggggaatgctaaaaagaataaaaaatttggtagaagaaggaataatcgaatcattaccactgaaagtgtttgatatgagaggttcagatgagaatggaatagatgcattcagatatatgcaaagagcgcaacatataggaaaggttattattaaaattccatatttagccggtattggagataattcaattccagaagaatgcttgattacaggtggaagtggttctttaggtctagttcttacagagatcctgcttaatgagggtattacaaatatttcgataatttctagatcaggaattgaatcacaatcagatagtataaaagccaaatgggagaaactacttaagagaactctgaataataaaaatggtaatagtggtattagattctttaatattgatattagcaacaaaaattcagtatataaattaattaatacagaatttaaaaacctaaagcatatattccatttggcaggagtactttcagactcaaacatcgaaactcaaactcgtgaaagtattgaggaggtatttaaaccaaaagcaatcggtgcatggaacttacacaatatctgtgaagaattagggttaaacaaagaattaaagacatttgttatgtattcttctattgcatcaggtttaggtaactttggacaaacaaactactctgcagcaaattcttgtttagattcattatcacaatatagagtaagcaaaggacttagcagcagaagtattcaatggggggcttgggatgaggatggaatggctatgaatataaaacagcatttgggattggtgggaatgagccctatctccaaaactactggacagcaggtaatatttgatttaattacaacacaaatttacgaggaaaatagaaagtctgcgacaataatgtgtcttccaattaaatggaagacttatattaatacgatatattctggagaaaatataccccagttctcactggtaaatacgaatttaagaactaaaaggcagcaaaatacaatattattgaaaatgagtaaagaagaacgtgaagaatatatcgagaaacagattatttctctttcaaaatctattcttggcattgaaattaaatcactggaccaaccattacaagacattggaatcgattcgcttgcagcactcgaattcagaaacgcattatcaaagaaatttaacattaaactgtcagcaacaacattattcgattatcctacaattagaggaattaaggatcatatatccgagaagctttctgtcaaagagagcatatatgaaactaacaagactcaactctcgaacttgattctttcccaagacaatttatcagatgacaatgttggagttattgcgggattagcctgcagattccctggcggatgcaatactccagatacgctctggaaatctcttattagaggttattcgataaatccattgtctggcaaaatgtttaactcagtaggcggtgccttttgtgcatctagagaaattccaattcagaggtggaatcataatttagtttataatgcagatccagataaaacaggtaaatgctactcttacaaagcatgctttattgattcaatagacatgtttgataattccaagtttggaattacgaatattgaggcaaagcatatggatcctcagcaaagaattgtgctagaaacatgctatgaggctctagtatccgcaaaaattaaagaagaaactctaattggatttcaaatgggtgtatttattggttgttgttcaaatgattggtcatttttacaaagtagaaaggggatggcaccttttacagggactggggctgcaaacactacaatttcaaacagagtttcatacgtttttggtatgaggggtccaagcatgacagtagatacggcatgtgcatcatctctcactgccgcatgcattgcaatggacagctttagaaacaaagagtgtaatggagctatagttggcggagtaaatgctttattatccccaaacctcttcattgcattctgcaaggctagaatgctttcagtagatggtaaatgcaaaacatttgacgtttcagctgatggttatgttagaggagaaggatgtggcgcaattgtaattttaaagcaaagtgaacaaaagaagcaaaatactcctatattaggaagaataaaaggttggggatgcaatcatgtagggagaagcgcaagcttaactgctccaaatggtcctgcacaaacatccgtcattaaaatggcacttagtcaatcaaaattaaacagttcagatattgattacattgaaacccatggaacaggaacagcattaggagatccaattgagctaggtgcattaaaaagtgtttttggaagaaatggagattataaaagatcaattcctttagtattaggagcattaaaaagtaacattggccacttggagggcgcagcaggtattgcaggattaattaagctggtcttagttttaaaacatgagactgcaattagaattgcccatttgaccaaaattaatcctcatttagatttagaagattttaatgtcattataccacaaaaaaccgtttcattaaagtgtaataaaaacaaacttattggtggggtcagcggatttggatttggaggatgtaatactcacgtaatagttgaatcaacagaaaaaaacaaatctgaaaatatagaggcagctgattgctcgaaaaatcatattttgttcgtatttacagggcaaggctcacagtatatcaatatgtgtaagggtatttatgaaactgaacctatatttagaaaaaatatgaatttatgtaatgaaatcgtttctaaaattctaaatatatctcttcttgatataatctatccaattgatggtaataaagacgctgaatttaaagctatgaacatgctaaatgatactcgttatgctcaaccagcaatctttgccgttgaatattccctagcacaattatggatttctaaaggtataaaaccagattcagtactaggacatagccttggagagtttattgctgcgactattagtcaagtaatgacaattgaagacgcattaactctggtcacacacagagcaaccatcatggcatctacacctgctctagatggaatcatggtagcctgtagactcactgaatctcaagttgttgatacaattaaaagatttggcctcgaagaatctgcctctttggcagctgttaatggacagaaaagcgtcactatatctgggaaaaaagagtcggtatataagattttagagtataataatgttggtagtagattcagacggctagatgtttctcatgcattccactccccattggtcagtgaagcatctgacaaatttagcaaattattggaaaatatcgaactaaaaaaaccaactgttgaatttatttcaaccgttactggaaaaaaagaaattgaatcaatatcaactcctaaatattggtcaaaacatatattgaacactgttcgactttcggatgcagtttatcacgcaattgaatctgtaaactcaagaatgacatttattgagattacatcaaagcctattctttcacaattattaaaagccctaattcctgtaaacagtagccacatttcggttaaatgcacatgcaagctgataaactctgaaattgactttattcaacctttagaggaaatgcaagaactaggttcagaaaattcaagtttcacaagtcatgctaataacttagatgatgattcttggaggttcaagctcctgaaacgaaggcaaatttcatggagcgacattagccatccaataattgctcctctacatgactttaatgatatcgaatgggtcaaggaaaatatatctataaacaagtcaaatgcaagagaacttgtcgaaaaattagaatttacctgtatgatttcaccagaattacttgatttgtttgacaaccacaaagtattgggacagtcaatcctcccaggagctgcctttgtcgattttatggcaacagtagcattgaattatacaaagtcgcaatttactttaggagtaattggaggaatgccagactggattcaattaaagggaattttctttagaaacccatttatactgtcttctgcaaaacaatacaaatatttaaatagacaatttgatagtcaagactgttctgatgaagataattcaagccgtagttcagactttaatattattatgtcaaaaggtaacaattgccaaataagcattgaatcttcattgaaaatggacgaagaaaccgttgtatatgcaacatgtgatgaagtagaatacttgtcaaatattgaggcacaaacaaaaagtttgtgtataatttctgaatggccaagcagcgaacttatttcaaactcaaaaaaagtttcccaggaagatatctatgaaaaaatgtcaattgcaggccttcaatatggtagcaggttcaaaactctgaaagaaatgtggaaagttacttcaaactccgcagtagggataattcaaagcgagctatttactacaaattgtgcagagtcactagataatcttgcagtttatgaatcaataatgaatgaaagaggctttactatacatccgactcttttggatggcgtattgcatatgtgcgcatctatacttggcgatcaatcagataaggaaacatttaatgaattacacaagcgagctacaatggtaccaataagtataaataaatgccttatcacttctaaaattgacacttcaaagtatatcaagggagaaaaatattgggcttttgttcagctcaaaagttctgataaggacagcgcaatagtaaatgttgcactaaagagtatgagcggagttccaatagcagtgcttctcggagtttcactccgctctgttaaaaacggagtgatttctactcatactattaaacatgtaattccaaatgagctgttatggagaattgactgggatgaagttattgaaagcattactaattctgaaatagtgtcgcttccaacgaaaatcaattgcgataacacagaaaatgagtcctatcaagggataaacgcaaatctggttgaaaaaagaaaagttttattacttaccaactcttgcaatattagtaaagaagacttgtattccgaatattttactgctgatattgtatgtgaagcttcaaaactatctttagctgaaatagaggcaacaatatatgggagagatgatcaagaattgccaccttctccatcaaatgaagcaaagtatgacttaatttgtctccatattcccaattcagataagaataaggctattgtttcattattgccagtattatatctttgcaagattctaagatcaatgttcgaaaataaggaaagattaattccacgtgttagaataattactgaaaacatattcaatgtagatggaatgaatcttgaatttagaacaaattcaggtgttgctcctttcattaagagcgctagacaagaactcgagttattctctgatcaatctgtttcactgggattaattgatatagagactgcagaagacttaaataaagctataattctttcatttgtgaaagatctactttgtttcaaaaaaagagaagatattacttctaacgggactcttacagaatcgcaacttttatttttaaataccgaatatgagccagagcttgtgctaaaaaagaaaattaagggtaaagaagacagctgtgaagctcattacagaataattactccaaaactagtcagcttaagaggcgaagcagcaattattggttcttgtaagttaaatttgagttctcgtggagcgataaataatttagagttgctacctttatctaatgaagaaagaaaatgtccatctgcaaacactgttgaaattagagtaaggtcaattggacttaactttagagacgtattaaatgttatgggtttgtatcccggtgaccctggacctcccggcggtgattgttctggtactgttgtcgctgttggtgaaggtgttaagcatattaaagttggtgacaatgtatttggaattgctcctggatgcttaaaaacttatgttaccactgattcaaatttattatgcaaaattccaaatggatttaccttcgaacaagctgctgcgttaccagttgttgcaactacagttgaatattctcttagagatattgcgaacatcaaaaaaggagatattgttctagttcatgcagttactggtggtgtaggattaatggttgttcaatattgtaaagcaattggtgctaaagtatatggcacagctggaagcgaatctaaagttgaatatgcactttctaatggtgttgagagggtaagtagctcaagaaatgctgataaatttaaggaagacatgaaagatttagagggaaaagttgatattgtaatcaattcattgatc

SEQ ID NO: 1323 - DNA, 288 bp, Cryptosporidium hominis
atgaaaagagaaagaaattatgattatgaaaatgaagcaaactttaatacaattaaaaaatcagagagagttattgataaagataataaacaaaagcatacagtatggtgtttaactcaaagccaaaagaatttgaaccaaattatcaaagaatattgttctctatgtaatagaagatctctgaataagagtaatttgaatatcgaaaaaataaaatgtgggtattgcgatagaagtacttgcgataacgttaattgcaaattatcagaatgcagtaattgtgaactc

SEQ ID NO: 1324 - DNA, 705 bp, Cryptosporidium hominis
atggtaaatacaatgaaccagattttgcttaagcatatatcagtatttcttttattgattgctttttttgatcaattagttgaattcaatgatttaacagctactttcaaagatattagctttgtaaggcttagtgcagtatataatggtaattttcatgaacaaatagaagttctggagattggtatagaaaatcctccacaattagatttatcagaaatggtatatactgaagaagtcgatattatctcacatagtatggctgaatcacttatagatcgatttaaaataccagactgtaagcttaatatcttatataaagctgtaaatactcttttacatagcatgtttttatttgaaagacaaaagtgtatacttcaattgcttaaaacaaaatatgaaaaaagaaaatgtgatttattgcctagaataatttctatttcgttaagttgtcgtagaattaagaaacaaattaaaaagttggaaagatcattggaaaaattaactgaacaaattgaacaacttgaaagatatattttgaattgtttcttatctgctataaaaatgttatggaaggaagggcgagaacaatccttcgaaatagatgaagaagctgcaaaagaatgtgattataaagagctgtactcaatttggcaggaaaaccaacttttaaagaaatctaaaacattattaaagtcatttact

SEQ ID NO: 1325 - DNA, 414 bp, Cryptosporidium hominis
atggttgttcatactgaaataattcaaacaagcaatctagagttagcaaagcggattttatcagaagaacacgagatttcgggtgaaattttttggtctttgctgttttggaaaatgccagagttattttttttatcagtttcaaaatcaacgcaaatttcaaaggaacagctttctaattcattgaacaaaattatattaaatgatttcagagatgcatttaactcaattataataattttggcaaaacttactgatttaatagagatacaaactatcttgcctaacgagtctaattcattaaataatacttctattccaaatctaacagaagtcatatttctatacactactattatctacaccatattcccatactttaatgaagagatatctctgacagaatctcaggga

SEQ ID NO: 1326 - DNA, 186 bp, Cryptosporidium hominis
atgccaaataaaataaacgagctgaatgggattaaaaactttaaagaagatattaaaagtcttgtttcacaatatgatgactttgagaactttgacaagattgttcagttagaagattcagcaaaagaaattgcgggtacaatacaaaataacatccaaattctgttaaacaacagagtaagttaa

SEQ ID NO: 1327 - DNA, 255 bp, Cryptosporidium hominis
atgattcctactactttattaccactacttttactacaactaatattactgttactactactactactaatactaatactaatattattattattattggtaatactactttcaatactattaccaatgataattcaacaaatagcatcagctgtttatagtattaatattatttcaaagcttttaattccattcccacccatttttatccatttcattctctctattcccctctcaataagtggatttatgtaa

SEQ ID NO: 1328 - DNA, 90 bp, Cryptosporidium hominis
atgaaagtgcatataattaagtttggaagattatttcttcctattcttattttagtaatatttagctttgtttggttatcagaaagcgtt

SEQ ID NO: 1329 - DNA, 205 bp, Cryptosporidium hominis
aattacaaaaagttctacaatgtaagagtggatatgaattacctgaggtgttaatagagaatccctagtaaaaaacttggatatggtgaatctgaaattagaccgagaactaatagagagaagaaatatgcaataaaaagtgataaaatttgtattaaaactgtaaaagttcctgttgaaattatatgcaaagtaagttttcttt

SEQ ID NO: 1330 - DNA, 480 bp, Cryptosporidium hominis
atgaaaatatttaaactttacttatttgtttcattcttgtttttcatatttcagtatccaagtagtatttcttttcattcaaacttattaagtttttcttttattaaggtaaagagcccatgttgtaaagctatgaaacgtattggacgtagaatatgttgttgctgctgctcaacaagttgcgattctgattctgaggatgaacttaattcttcaaccaatacctctcaagaacaaggccactcaaactgtcaatttaatcctgaatcatttgatttagaagaaatccccccaccacctcctttcccggccccgcaagctccagtagaatcactttctttcccgccaccaccttcaccagaagaaatgggttcatcttcttttacagatccagactcacttccatcacttccgccaccccctccaccagttccaccaaagcccagaaaatcaatgttaaggaaagtttttaacatatga

SEQ ID NO: 1331 - DNA, 822 bp, Cryptosporidium hominis
aaagtggattgtcttggcccaccaatatatttttttgatgttgctaatagaaaaattgtgagcttggaggttgcctgtaaagatacatttttacttattaacaataatggtgaactaactgtaagattaacagatgaagtctattatgttaatgatcgcaaagctaaaaagcatttcttttttgattacaattttgatccaacaacttttgttcaaaaagaatataatgatttgactgaagttgaacataaaactaattatttgtcggaaaataactttaatgaaattccaatagattatgatacatctaatgatggtaaatatttagactggatagtgaagacagagtttttaggagttattacaatttcagatactactgttaaattaccaaattataattttggtcaaccagaaagtgaattcgaaattaaaatacctgttgaaacaaaattatttttaatttttataattaaaacgaatcttcttggaattcaaaatactttttttgcagctttccctattttctttctttctaagattatatatgatgttaggaagccactactaaaattccaattcgatcagattggttcaaacagttcagaaatatatgatattaaaaagggtattcattactataaaggattaaaattaaaaatcaacaagattcatggtgaaaaaattttatttagtgaatctctatttgaattagagaagctaattaaggatagatttgataaattgaaagttgagctagattcaaaacacaaccttggcattatcaatttcttaaatttagttaataataatgaaggaatt

SEQ ID NO: 1332 - DNA, 225 bp, Cryptosporidium hominis
atgaagactttcaacttcgccaagcttgtttttatctttgcaattgttgctttatttggaaactttagaaacaccgaacacgaggtttcaacagtttctttcgagcagtcctttgtacgtcttaaactaagaaaacctctctctaagtctgaaaagaaggaactacagaaacaaatcaaaattttagaagaaaaaatgagtcaagctgaaagtgagtggaaatag

SEQ ID NO: 1333 - DNA, 1005 bp, Cryptosporidium hominis
atgctgtgccaaaataccgaactcagtaaacagcatattccgaatacttttgaatatccttcaaattgggaatctattacctcaatgaatctgacaatcgcatggacaacagcaatgatttatttaattatatcgtcaacactggttcctcttgctggaatagttagttatgaaaacccttctccaaattcaatattgttcaaagataagaataaaaatgaaatttccaccgcttggtactttaatccagattttgaaaatattctatccaattcatgtgttatcacctctcctggaaataaatgcaagagcggttcagttaaattaactatggatgaaccatttactccagaaaaacaatacttaagatatgcatttgctgctcctccagaatatttatatcctgtaactattacaatttattcatctgcatcattcctggcatcaataaaattttccaaggctatggttgaaataagttcagaaaaaaaatcaaatacgattactattccttctccaatagaaacaggacaatggattgcaggtgatatctttctattgactagctctggatatgattttctaaaaaataattcaaataactttcaatgtttatttatcactaccgcttcttgttttgctactcaatcaagtcagaaatggagaaattacgacaaaaatttagatctattacgttatgcatatattaaaggtaccgaatacagaacaaaaagcagcgaatatataatgaattcatcttcagatgataattattcggaagatacttcagaaagtgaaattgtatacctttacgtttcgtacaataatgttatcattggaggtgttcctattccttattcttcggaaattactgagttaagaattacaggcactaaaaatcttgttccaattgcatattggaggctatctcaaggaatgactccctcaattactgtatctgccgacatactaaaaggtttaataccgcaaatcaagtcagtatga

SEQ ID NO: 1334 - DNA, 267 bp, Cryptosporidium hominis
atgggtgctgaaataagtaattgtcaattcacaaaattaggtgatgcatgctattcaccattttcaatgataaataacacattaagtgaagctgctgcaaataattatgtcttaaatcttgaaaggtctaaattcaaatcagaagacaatcaatattggttttcatgtatggatggttcagtgccatataatggaactataaattgtgagattaatgatcatgcaacaatcatctgtggaagtagtaagttatacaattcatcttaa

SEQ ID NO: 1335 - DNA, 975 bp, Cryptosporidium hominis
atgaacgaaaattatgatagattttcatatccagaggaattaatgacaagtagtacgatagatttaaacttgatgtggcaatcatcaatatactcattgaaaacaaaatcttccgatacacctttagcaataattccaatagaaaataaaaacattccctatcaagctgttttgttgaactcttcaacaagagaagaattaaaatcaaactggagctacactacaggagtcaaaaatctaagttctgtttcgtgcacaatcaatgcattagaaggtagatgcaaaagttcaagtgttacagtcacaaaaatggttaatccaaacatagaatttttgagatttggcttcctgttttctaaagatattttggctcctttcgaaatggccatttctcaaaactctaataatttagcaactgttcaaatatcatcaaatgtcatcaaagttcaatctagtaattcagaggaaataactctcaaaaaagaatttactactggagaatgggtttctggggatatttttattatttcagatgatattcataatttaattgaagaagatagcagtatttcatgtaaaaactataacgattcatgttatagtacacaaaatagtcaggactggatgagtatagtcagtgaaaaatctattctcagatatgcatacttgaagaagcaggctgtggaaaataaagttaaaacagatacaaacactgaaactgattcatcatcctctagctcaaaaactcagtattacctttatatctcatttaaaaattgtattgttgctaaacttaaaataaactctaattcttttaacaaagtttcagtttcaaacagacaaggctcaagcaatttagtctattggagattgaaaggtggtgtctccacctctattaatattcccaatagctatctggataatctcaaaacagatattccaaaagaaattgaggcaaacacaaataaaaactag

SEQ ID NO: 1336 - DNA, 243 bp, Cryptosporidium hominis
atggctaaaaattcacaaggttccttgaattttgaattgccaaaatttcaaatagaagttgggttttggaaggccgctagtactcttaaatacgatgttattaaatccagtgaggattcgtttgatgtacttggtttttacaatcaagaaacaaacattattcgaattagacaagagtctttgaattcaaaaaataaagaatatttaggtaaagtttcaaattacttaatatttctaacttaa

SEQ ID NO: 1337 - DNA, 1710 bp, Cryptosporidium hominis
atgtcagctatcattaattttggtaatattgatcatgactgtgactcctacctggaatctgcagttgataatgcaaagatgtggattaataatagttctaatcatgaaaaatatccatttactttcaaattgtgcatttattttgattttaaaacccaaatagcttactatagtgctttttttcctaatataaacactaatttcaacattaagactgacaaacaatctgagctcggaattgaaattaaatcaaatttacccgaatattctggttcgtatatagatttaagcagtattaataaaaacgcaaattcattggcagttcttaaaacattaaaagatagagtggagggaaaaatcggcaattttaatgatgaaacaagcattgaaaaaaaagaaagatttgactgcccatggtttttttcaacattactcaccattatactttttaaagacaaatataagaattcactcgaaaccaatgaaattataaaacttttgaaagaatcaggttcaaatgagaattttaaatttgattcgagaagttgttttatttcaaataagcatgttaaaaatgtgcttactattagcgataaagaaatgaaagaattacaatctgaacacattttaccatttgatttgaaaaattacttaagtccgcatgaactccaacagagattgagtacaatgaatattgacttaattaagtggaggctaatacccaatttcgaacagattcactttaagaatttgaaattcttgatagtaggtagtggtacattaggttgtagtgttgctagaaatcttattggatggggcatacgaaattttaaattcattgatcactctaaagtcagcttaaacaatccaatgaggcagtgcttatttacattggaagatgtcaaaaacaagaaaaataaggctctggctgcagttgagagactgcgatatatttgcccagatattcatgcagaaggaatcgactttgaaattccaatactcggtgattcaacattaagtcctgaacagtttttgaagtcagttaatgaaacaaaagataatataattgattctgacgtggtaatgttacttacagataacaaagaatcaagatggctacctacagttcttattgggctaatcaaccgctattatagtagaaagaggccaatattatgtatcacagttggattaggatttgattcatttattgtagtcagaaatacattcacagaaacggattattctagttctgggtgctacttttgtggagatttttcaatcaattcaaaaaataacacattagatattccagttgatcaacaatgctctgttgttagaatgggggcaagctactttgcatcttcaattgcagttgaattaattatgaatctgtctcagcatccattaacatggaatgctcctcatttaagtaatgaatctaataaatctgatgaaaataaaagccttctaggtacaactccacaatgtattagagggtttttagctgatttttcattctgtactgatcctattcagagaaataaatgttgtattgcttgctcagacaaactaattgatcaaattcataaagatgaagttaatacattaagcgaaatttttatcaaccctcgaaaggttgaatcaatttctggattaaccaattttaaatctgaaatggaaaaatcaataatagaaagttatatctaa

SEQ ID NO: 1338 - DNA, 549 bp, Cryptosporidium hominis
atggtatatccagatgatgaagaatttagattaagaataatagatgcaagaatggtagctaaagaaattagaaaagaaagaaataagaaacttaaagaatttaataatgatggaatctatgataaagtattcgggtttaatatccctgtaaggcctgatgttaaagagttacttgagatgaagagattaaatgagttaattcttccaccgagatgggatcctttggatggaagacttgatcacgaatttgatcatgcaagatatattaagattcgaaagcagtttgaagatattcttccgattgcaggaacttcaatcatttcatctgaagaagttgaaaggaatttcatgaaatggtataacgagggactttccatagaatcatcaaaaagatataatcatactagtatggtaggatccaagtatataattgatggcgaatccgaagtgaaagactttacatttcaatctagaaatggcaaaaatatgagtgtacaaaataataggcaagaaaaatcaaaatctttatcacaaaaaaagaataaatag

SEQ ID NO: 1339 - DNA, 1134 bp, Cryptosporidium hominis
atgacatgtacaaatattccaggttttggtacagtccaatcacaatgctacttgttaccttgtaaaacacttaataacgatgcacttattggatatatttattattgtacaatgtttccactcataaacataatttctggtattgtaattcgtaaaaaaattatcagacaaaatcaattgtatacaatcagtagcagttttcttttttctggttataaaatttcagttttatattgggaatcagttcgattttacattatctctggaataattaatgttctaaatcttaattatgtgtttgccagatatttaatactctttgtactttcaatttactccatactagtattctttgaaagtattatttctccagttgatgacagtgatagtagtaaaaagaatggaatggataagccctggtggatattttctacaagtttaaatattaatacaatagtttccggattcacattaatatttattccttgtttactttgtctttatagctattatccaaaatttgaatttactattgagattacaattatgacatttcatattggaacagctttttttatgattcaacaagtatttgttgatacattttttttaattcatcaatataacaagcataaacaattatatggcgataaagaacagattttggatgcaaaagaatctaatgatggattgtctctttattacaaacacaaacttggtgataatgaacaaacaaatttcatgctaggacttcttaaatcaccttttcctgaagaagctgctgcacagatgctttatttaatcgaacaaggaaacatcttcgattgtgaggcaaaggatatcggtaaaaccctttattcagctggtttttatgaaccacaagggcaaaccttgaggtacttaattccaaagattaaaggttatagatcaagttctgatattcctgttgaaaatgaaactgagctactgggagaagtaagaaaatgtgttatgaatacaataagaattcttggaattgaatcagccgtaaagaattcccaatttagagctaaaggagctagggtaatattttcttctcaacaatttggagaatcaactcgtaagtttgacttaaaaatacatttaaataactaa

SEQ ID NO: 1340 - DNA, 1425 bp, Cryptosporidium hominis
atgttcaagaaaagagttatccaaacaagtggggaaaccctgattggtcgccgtgcagtcctacagctgagagatcgtttaataaagcaatttactctggaatctcaaattggcgatttaattttgggtaaaagaaaaaaaaatgatttgaaggttactgctacgaaatttgagggaaataaaacggaaagaggcgttatttacaggctagagtttgaaaatgaatctaattttttgtttagtagctcaaacatatcaaacttggagaagattgaaagtaaatctttagaaaataaattcgaaataaaaacaattaactcagaaatgcaagaatatgtcgagtcaaattcagaaaataaatctgaaaatgaaataactaatatttcagagtttaactactgtccaaatctatcaaatctgaaaagtctcccagccactttgccatggctatttgagttaaatatggacagattattccctacaatgcatcttctatggattcatagttctttattctctatcccgagcataataattttaagaaatgcaaaacagttcatatttaatggagctgatctaatggcaggtggaataatttttgaactgactagcgatttaaaaaatataagaaaggatcagatttggacaattaaatgtgttggtgataatcttccaattgcaattgggacttctttggttgattgggatgatatttcagatccaagcgctcgtaaaggtaaggtgctgaaggttattcaccattgtaatgacactctttcattagaaggaagcatggatttcaacgaaagaaattacttaaattctgacaaagaaaccaattttaacaataatgaaaatgaaacaacttcagaagtcattgaagagtttcaaaatattactttagagaaaaaagaagatgtaatttttaatgaaaatcgaaatttattgataaaacgcactaatgagcctcaagtttctgaaaatgaaatatcaccagaaattcaatctgtgcattctcttgatgaaaactactgcgaaaaacagcatgaagatctttctcaaaaagcatatgattttttattagagacattattattaaaagtaatttctgaatattcttctaataaagctttactgcctacagattcatcagctatttggaacaagatttcaaagctctgtttacaaaattacggaattcaaattgacataaaaaaatcatcatttgtaaaagttcagaagtttttccaatattattctaagaagaacattctcttaattaagcaaggaagaggaggagtgctgaatattgtagatattaacgatgaagaggctattaaaatggataaaaataattttaacagtgaaatctcatcaaaactacctccaattaaaaaaaaacctaaaaagctttcagaaagttga

SEQ ID NO: 1341 - DNA, 2514 bp, Cryptosporidium hominis
atgattggcatatttgaacctgagttaaaagttgtagagctaatttccccagtgggaaaatggctaaaagttactaaaacagtgagtaaacttaatgaaatgaatccaataaaacagagaagcacctctttgttgcgttcttactctaacaggagtactgaaacagaaaattatgcagtaagcaatgtaaataatattgggaatatctttcaaacaacggaagaggatctctatataggatatttaggatctgtaagtactaaagaaccagctaacattcaaggaattattgaaggaagttttttcaatgcctatgcattattaggagtatggcgatatgataaaggaattactaaatgtctatttgttacagaagcggaatttatcacagaaattggccaaaatgagagaatatacaaggttaatgatgttttatttgtatcattgatagccagtgaacacgaattttcatgccaaaatattgggaaagaaaatgacgaagctaattctgaagaacagttcgagtatgaatttgagaaaaagattgaatctgtaagaattgctgaaaatatgattctttcgatttttagaagaggaggattttatttttcaacaaatcctaacgttgatattacaagaaatatcagacaatcaataaaatacgcaagtaaatccggagatcttcctgaagacagattttgctggaattataactttcttatgcctttgtatgaaggagggtcgagcacttcaaagtgggcaactcctttattatcagggtatgttggcttcactaggttgaattttgaacatacaaataataaagaagtgcaagaaaacaacactaaagttgatttcttattaatttcgagaagagattgtagacggcaaggcgttaggtatttatgcagaggcgcaaattcagatggtaatgtttctaactctgtagaaacagagcagattattttagttaggaggcctgaatctatttacatttacagttatttgcaatatagaggctcaataccaatagtttggaggcaacccccaaacttgaaaaaaactcctcccgttgaaatttacagaggagaaagatgccaacaagttgtgttgaatcgtcactttaatgaactttcaaggaaatattgtaatcaatctggagatggagattccaacattgaatccgaaattagagaaaatagtaatggaaagatacttgtagttaatttgattgattaccgacaacatgaattaaaattgggtttggaatttgaaaaataccttgaaaaagtcgatattaatgacatttactgtgattctgattcgctattgaaaaaagataacagttctggaagaccaatatttagagatgaagattgtaataaaaactcaaatattaaattttgttggttcgatttccatagtgaatgctctaaaatgaggtggtcaaatttaaagttcttaattaagagacttgttgatattggaatggacgacttaggtattacatctttagaaattcaattaagagataaagttggagatttatctccaataattggtattgtccaaggacattattctagttcagacaatgagtttaaagttataataagtagtattcaagatgggatttgcagaacaaattgtattgattgtctagatagaacaaatgtcgtacagtcagtaattggaagaagggttatccacaatatttttaaacaacttcaagaattgaagttaattacctttagcaatactagtcagtctgagcacgggcctgcattcgaacctttacctggaaaaaactcttcaaatgagaaaatattcagacaaatatggagtaataatgcagatgctcttagcaagctatatagtggcactccagcacaaaaaacagattttacaagatatggaaagcgaacaaaaaaaggtgtgatacaagattcaatttattcaattattcgattccttttaaatagtctaatagatggttatacccaagatgcgtactacgtttttactaatcaatgcagttcgccaaatagtgacttaggaattaagaagaatattcacaaccgacttctaaataataagaacaagtatttaagtcctcctgtagtaacagcaattgggcaatatttgataattattacatttctactgctcttgccaatagttcagcttttattcacatattctcaaacattgactggtaatttggcatgcatgcttttggacattatttatattccttcaaaattgttcttccattattatgatactgcaaacacccaatattcgtatttaaatatcatccctacttttgcagattatctttcgaatcaaaatcaatgttcaatttataacatttctggtagaatgatttcaatttttctagttattttcggatttatccagttccttaagtttaaaggtccgaaagcagcaactaaacccctcttagatgaaacaaattctcaaatttggaaaaagcaagaaagcaaaaagtaa

SEQ ID NO: 1342 - DNA, 246 bp, Cryptosporidium hominis
gaagagaacttaaagttagaatcgactatcccagacgaagatgggtttattaaagttgttaacaaaaaacaaaaggcaccagatggcacagttattcacagttttgaatccaacaaaaccacgcaaggatttaatacaaagaaacaaatcaacaaaaaggaaaagaagaaaacatataatgacttctatagattccaaataagggaaaataaaaaaaaggaaatacaaaaactcaattattcttaa

SEQ ID NO: 1343 - DNA, 219 bp, Cryptosporidium hominis
cacttttatagaggatatatacccactgttgtatcttttggtctattttcttctatttattttgtgatacttgaaagactcaaaactagacagtttaaacaggatctgagtgaaaataaacaactacttctaagttcaatagttgcaggtacgcttagtaatagcagatatcacaaatttaagcacttaatcacaataataataatattttgcttgttt

SEQ ID NO: 1344 - DNA, 1857 bp, Cryptosporidium hominis
atgagggaagatattgaattattatgtgaaataattagtactcatttcggaggcttgcctgcaatgattattaagaaattgttggtaaatgggccactgccaatggacaggttataccatttagttattaaggacaaagaatcatctaagtatctatcctcaaatagtaaagataattttctaagttttagaaattccatgatgtatttagttcatcactattgcataatttattacgaaatatcagatccaaatatagagttagataactcaaaagaaggaaaaaatgttgtttttgaggttaatattgatcatgtaatttcaaggctgagatttccgctttatatggcccatattgagaaattattgggagagacatgtaaatatatttttatggaagtaattaagcatggacgaatatctactaaaattctaatttcagaactttctgaaacagttgagaatatagaagaaaatattaatttacttattctatatgattttttacttatactaaatgataaaaacgaaacaatgaatgtagcagaatccgataaaaataatggtaagaaagctttaagcagtgcatttacagatttattatttgattacaatgaagattcttttactaattcagaatcaattaactctaattttcaaggatcaacatttagtaattttcaaggtgaatttccaaatattgaatctaaaaaaaacacttcaaaatctaatagtggttatttaattaattctattaaaaataaaatattgtcaataaatattcttggtctaaataattctatctatagccaatttattgaggaaatggtgagaagtagatataataatttactttcatctataatagtacgtgttatgtctgatagtaagggtttaaagagaaaaccaatggatgaaggttggactattgaggaaatatctaatgaaatatccgaatttttggagcttaaccaggctttaaaaactgatcttgatatttctgatgattctaagctaaaatcctctgtattgagggtaattgatgttttaactaagcattctgacgaattcatatcttataatctaacttcaatgggcactatatataaactcaatattccaaaaattaagtcattgattaagtacaaagttctatacgagtatattgggcatagagttggacaacttggttcaagagtttggagtatgatgtgcaatccgcatttgatttctagatgtgataatattcaagtattagattctgaaaaaactaaatctttttctgaatctgggccgtctagatcttccaaagtatttgctccatttccaaaatatgatattaaaaaaagagtttattgggacgacgttactttagccgaaaaatgtcttttacctaacaatattgcaagaagcttgctctattctcttggaagtgaaaaatttgttagagttcacaactcggatacagtaaccattgaccattctattaactcaactcaagacttagttaattcatccaaactttctatggctgattcagtaaatacgaattcttcgcaagctaacaaagtatcttataacactatttcacattcctcacttagtaaacatgggatattttatagtacttgtattgaaagcactgtcaaagaagtgcaactcaaattttataggatactactaaatatattaacaagatgcaaaattcaaaataatcaaattctaaattttgaaataagatctaaacatctaactcaaattgagatggagtatctcgagaaactatcttatggactaaactatttattcaataatattacacagattgacagattcttactcattttaactgtttaa

SEQ ID NO: 1345 - DNA, 1725 bp, Cryptosporidium hominis
atggacaagttgaataataatccaaaaatacaagagcattggctttggaagaaaaatgtaccttttatttatgactacctttttattacgcccctcaggtggccaacattgacatttagcatacctccaataagatttaatagcgaagacatgaaagctgaggaggcgaattctgatattggcaatgactctgaaataagcttacatggtcaactattgatctacggagcgtattcatcttcagttccatctaatattgaaggaagagctattgattcgaattcacatgaaaagtatatagcaatctctatgttagatactccgaattttgatgttgatcttctaatgtgcgatgatttaccagatggtaattccaacaagaaattagaaaaacctaattatttatcccctgatataaattctatatttaaaataatagtaaatgatgatcctgtaaaaatttgctcacgattagatgaatcaaaaaatagaattttaattgcttcaaaaatgctaagaggtgaaatatggtttcataatattggaattgaagaaatttgtgatgagacgtttaaagttagagcaagagcaattaattctaaagaagaaactgaaattgttactttatatagctcagattatggaaacgaaacaatattaaatcataaatataactcaggcaagtcaggatatggaatggaatgggggacaacaaattccaattggttattaacaggaaatgaggattcttcactctatattttcgatgtaaatatatgcgaagcagtatttaaggatcagtcatataatattagttgcggaattaatgatctatgttggattaatccaactttaactccgaatatattttcaacagtaaatcatcagggctgtttatcaatatatgattatagatgtagcttgatgaactcaaaatcaaatgtaaatagtcctataaacaaatggagtatttcagattctccttgtgtttcgatttcggctcatccaacagtgtcaaacctaataagtataggggggtacgatggaaccatatatatagttgacttgagatatttttcaaataataaacaaattaatgggtttcattctcataacaaaggcatagttaacaagtttaaatataatactgaacctgtacacagactcgaatggcattcagggggtaacggtcttttgctttcctcgagtttggacggaaaagcttgtatttgggacattactagatgcaataatttacctatttgggatcaaatggatccaaatatcactaataattcctcgagcatctcaaactcatctccaaatagttttagaaaaaatttagagagcactaataaatctcttgataatccagtagatcaagagattgatataaaacgatcactaaagctattgataaataacaattcttcaagctggacaaaaaatgaaaaatcagatggccctaatgagctaataggggtacattctggacatactggacaaattactgattctcattggatgttcagtcctaataatgactcttggactgtagttagtaccgacactttaaatggacttcatgtttggtcctttaacgaagctatatttacttcagaaaatgatttagtggaactatcttacgcaaaacagacgaaatttgatcaatccataatatatagtacaaaagattctatacaaaatttagtcaacagcctataa

SEQ ID NO: 1346 - DNA, 324 bp, Cryptosporidium hominis
atgataaagaaacaacaaagcatgagttttagctcattgcaagaagcattcaaaccattagaatatgattcattcaaacagaatgaaatttttgagcaaagctggcaaaacaaaggcgaaaataaaataaattcgggcgaatacattaatattgataattcgaggctctattcttcgcaattaattggaggagacttagaaaacattaatttaaatggattggaaatgaaattcgaaagggaaatgacaactttgaaagaatctttcataccaaatgaacgaggataccacgaaattcccaaagtttttaatgtcttactttga

SEQ ID NO: 1347 - DNA, 1596 bp, Cryptosporidium hominis
atgaatttatgctcgcaatttggtaatatagttgatataagtattaataatgagagtcattgcgttacctatgagaatagggagtctttagaaagagctttaaattcgcttcagaatcttcagatatcatcagaaggggattttattcatgcatatatacatcaaacttcaaatacaatgattggtggactagagagatcaatgaaccttgtacaaaataaatggagccacgactttaaccaattaaattttccgaatattaaggaaatgtgtggttcaataaattttgttgataatattggcatttttggtaatacaactacgagtgcttctacatcttgtcgttcaaatacagaaatcagtgcatcaggagcttcaacaactacgaacacttcaacaaattcaccatggaatagttttgatagcacaataacgacttatgagagaaatctttggacagcttggttacaagacaacaaaagtaatcagaataactcaatttctaagagtattctaaatgagaaatgcgaaaactctaatattatacaagataagattgaagaaaatgatgaactgattaaccaagaaaagagtaaaattaaacaaaatgcgaatggggaattccaaaatactaatactaatactactaataacaatagtaataataataattgcaatattaacaaaggacaattaagtaacccaataagtaatgctagttcattaaataacaatagaacaaatactattacttattcttcgatagttggatccaatttaaacaaaaataatttagtgaaagggattagccaaaattctaatgcccaaaataatgaaaattcagtaatttgtacaaataattcagttgggaataaacctaatattcaagatattaatgcttttaagttaacaaaaattattggtaaattagatgaactaaattcagatacagtcgaaatgaaaaactctggaaacttaccaccaattattacatcaaatcaatctccaacttctacttcatcatcttcatcttcagtctcatctccttcagcaatatcaacatcttgtcaaaattcttcaagcatgttaaagaaatacacagcaagatatgagatccaaatacctccagataaccaatttcaaattgcaagaagaattattggaacaagaggaattaatatgaaaagaattttcaagttaactcaatcaaaacttagattaagaggtaaaggttctggctatttagaaggttataacaaacaagaggcagatgaaccattgcatttgtgtatttcctctacaaattctgaacaatacattaatgcaagaaagctagtagagcgattattattgaagatttaccaggaatatgatgacttcttattatcaaataatgatgatcataaaactcttaatttacaattaaaattcaaagaaacaatgagaactaagcaattgccaacaaatcaacccaatggaaataacagtaataataatcataataataataataatattaataacaataatgcgattttatctggagtcgagtctaatacaaacgacgatgatttgttgaatgaatttaatttttga

SEQ ID NO: 1348 - DNA, 3711 bp, Cryptosporidium hominis
atggcagatcctgacttgggagaaatgcttactagcagaaaacctattgtacttttaaataatgcatactgggagccaaaagttaaagaatgggtaccaaatttaaaaatagatgagttggatgaagatcagaagagtattatagaacaaaaattatttgttgctgttttgaccccgagtaatatatctagatgtgcagtatgtggaaaaacaataacaaaaggtacttataggctaggtgtacctgagtatgatagaagaggaatgtatgggataataaatagatggaaccacattaatccttgttcgcaaaagtatcttaaaaaagcaattcaaggctatgaatttaacctagatgaaattgagaagagaatttcagaagttacctatggttggacttgtttacctattggaataagggacgaatttcttgacttgtgcacaaaagaaatcataacaaatcctaatgaattcaccattgaaaactcagatgacctaattagccgttcaattgtagaagtaaagcctacccccataaaacttacatatgaattattacaatttcaaaaagaaggtttagcatggctatgtaatcaggaaaaatcaactgcaagaggaggtattttagctgatgaaatgggtatgggaaagactattcagacaatatcattaattctagaacatgatattccacctgttacaaataaagcagaaaaaggagaagttattggaaaaaatttggtaattgctcctgttgcagcagtgctacaatggaaacaggaaattgaaagatttacaaaacctggttcattaaaagtacacatttaccatggttcaaaaagaaataagaaccaaggaaataaaggcactaaacaagattatggtggagttgacattgttgatgctgacgtagtaattaccacctaccctacattggaagctgaatatagaaagattgcatcagcattcaaatctaaatgcccttactgtgatagatcattcttaaaaaggaatttgaagattcaccttagatacttttgtggtccaaactccatgagaacggctaaacaagcacttactgaaagaaaaaacgaaggtttaaaaaaagctatgagaactttaaagattggattagaggaaggtgttgataaggcaaaacagctggaagatattgctcgtagtttaccaacaattagcaatgtttatagagaaatacttgctaaagcggacttacttgacgatgaatcattgtcttcagccttgccttggtttacttccagaagaaaaagtcaaaaattagttaaaaaggaagactctagtaattctttaaaggaaaacgatactgaagaaaaaattcaaaagactgaaattgtaaaggatgaacctgaagaaaatttgctttctttattggaatggggaggaattaaactgcctttaaaatcagagacagtaaaatctataaaagagttcctttcaagtattgaaaatagcaaggagtatttatctactagattcaatattgatggacaaatattggatgctttggttgaattatatgatagctgtaaatctcttcgaaaggctgaactcgtggataaattatcaaatatattgggacttgataaccctgacaacaattctaatgaagggaatcatttaaatcaaaatactaaaaaaacttcaaagtctactcataataccaataaaaaagcaaatacgaagagtactaattctaagaatagtagaaaaaagaagaagtacgaagatgaattcgaggacgattataatgccgaagaagaatcaattgatgaatattctgaatatgatgaatctgatgactcccgagacttgaatacaaaacgtaggaaaaatgctaagaaccaaaaaaaaaagcagaatgatgatgatgatgatgatgatgatgatgaatataaagtagtagaaattgatgaaattgatgatgaagaagatgataatgaagaggatgaaattatccaaaagttaagagaatattcagcaatttttggaagaagctggaatcgtattattttggatgaagcacacagaatcaaggcaagaacaacttctactgcaaaggcaatttttgctttaaagtctagaggaacaaaatggtgtcttacaggtacccctcttcaaaatagggttggcgaactctactctcttgttagatttattggatttcatccctatgcttataacttttgcaataagggagattgcgactgtaggcaattaaactatgttacacatttaaaatattgttcgttttgtggtcatgcaagatcatgtcattattcatatttcaacaaattaattattaatccaatcaaaagatatggtttctctggagaaggctctgaagctttaagaaggcttaaagaggaggtattagataaagttttactaagaagaacaaaagttcaacgacaagaagacgttagacttccaccattagaaattaaagttataaataatgaactttctgccccagaaaaagatttctatacttctttatatcaaagatctaaagttcagtttgatacttatgttaatcaaggaacagttttgcacaattatgctcatgtctttgatttgattagtcgtcttagacaagctgtagatcatccatatctaattgtttatggaaaattcaaccacaaaaaagatctagaatataaaaaagaatacaaagaagaagataatgatgaagaaaaggatgttgaatgtttaaacgatgcaaaagaagaaaaaacaaattttgactcaaaaagagttataccgtcaaaaagcagagctgacagtaatgaagacttatgttatatttgcatggataatgttacaattgatcaaagagttacaagtaaatgcaaacatggattccatattaaatgtatcaaagaatacattgaacaagctccccaggaagacgaaataattactgattttgatacagaagatgaacaaacaatgagaggagttattggatgcccagtttgctatgtacctcttacaattgaccttaataaaatttcaaatttaaataagaaaaataaaaagattaaatccggatatgatgaaatgaatgacgaagaaaatgatacaaatgataatatggaatctgaacatatgcaagagcaaattgaaagagagcttgaaagaatggaaatggctaaacaattaggtatagatgttagcaaagaaaatcttaaacaagaaccaaagcaagaaaatgaagacattctttcttgtgttagaaataaatttattactcgacaaattaaaactcaagggttcgaaagctctacaaaaattgatacactattagaagaagttaataaaatgatgcaagaagatcctgaatcaaagggaatcgtattttctcaattcacaaatatgcttgacttggtttcctatcgcttaaaaaaggcaaatattggatgcgtaatgcttgctggctcaatgtcaattcttcaaagaaatagcatattgtattcatttaataaattcccggaccttaaaataatcttaatcagcctcaaagctggcggtgaaggtcttaacttacaggttgctaattacgtttttctacttgatccttggtggaatcctgcagctgaattacaagcattccaaagagctcatcgaattggtcaaaagaaaaaagttactgcattaaggtttattacatag

SEQ ID NO: 1349 - DNA, 639 bp, Cryptosporidium hominis
atgccatcacaaaacatcatggtacttggaagcttaaaaaacaataaaaaaaatggtcacttttctactggtccagtaaggttagaattacttcaaagtattatttctcaaagcgatattgtaagaaacattcaagataaatataagaagaaggcaatcagacttgtatctttaaaatgtggattatgtgcaagaattgatttctctagtacagataaaactccagatcatggagttaactatcgaaactatatacttaatattttagaaaaagctcaggaacctcctcaaaaacctatgaaaaagccacttcctattccaaaagattttccaaaatctaggagaggtggaaaaagaattcgaaaaattaaagaaaaattcaaacaaactaaaattaaaaaagagatgaatagaatgaaattcggagaggaagaggaagaatacactgttgatgggaaaaccattggtttaggactattgagcgccggtgaaggtggcagaagaattagaggtcttcaagttggaagcctaaaaagttctagttctagcagtaagattgaaacactatctggaagcgattctaaattgggaagcagcacttctatctcatttactccataccaaggaatgatattttaa

SEQ ID NO: 1350 - DNA, 882 bp, Cryptosporidium hominis
atggaaaaaattaactactactgtaaagccttatctcaagagctaaagttacttgaaagagttatatataaatttaagaatcaacatggtaggctaggatattttaagagtatctttaggattacaaaagaactcaaacttttttatattgctttgcaagaaacattttataataataaatccacagaaaatgctgaaaattactataaaaatctcaaagacctcagtaaaatagttcgtagaattaaatgggatcttaaggatgctggaacatctatttctagattattatcacatggctttttcttgcctttggttttccttttattttccattttgagtagaatattttcagtaataattaatattaaggttaccatcgatcacattattcctactataccatttaagtcaagtcactctaatcaaagcagctccatttctataaatagtcataaaaataataaaataagttcgaacttcataaataaaacttcagaatcgctacagatgcgatactttgatgaagaagtcgaggatctgggagaggttgtatcctggagttcaattgttgagaaaagtgatatcccacttaaatcgaaaaatacaacttccttgataatcagcaatgataacaatagcttagaaccagagatggatgtaaaaaactcattcattgatttaatttcagagcaggtagctgagaaagaaatttgtagttctaatggtcttcaaaacgatgcaacaattcataacgaaaatgtagatcaagatttagctattcagtcaacagctacgaatacaaatgcatctataaagctaattagagcatggaattcccatatgattctccgctccaaaaggcgaaagcttactaattaa

SEQ ID NO: 1351 - DNA, 324 bp, Cryptosporidium hominis
atgagcacaaatcaaaatattgatattaaaaagtggcaaaaagagtttttttcagctgaaaagtcttcacttcctcaagaagacactagaataaattcttctatacaggatgaaagaagtttaatagaacaaaaaatatctgaagagatacaaactttagagcttatgaatcctgatgcatttaatagaattcctatgatatatgaaaagaaggatccaagttatattgaagaaaattggagagaatatagagggcatcttacacaagactatttaaaaaagtcaaaacaagcaaatagaaagttaaaaaaacaaaatttgtaa

SEQ ID NO: 1352 - DNA, 1017 bp, Cryptosporidium hominis
atgacaatctgtaataataacattggaaaatacctatttgaattgactgaacttaaaacatccaattccatcaattttgaaaatgttaaaaactccactttaaaagcagataataaacaagagacaaaacccatatatttaagtcaaaacaattcatctgatccaatagaggagctgtggcctgaagttatacccttatctgataattgttataataaaattgatctgaatcatccagatattcaagaaaaggtattaaaagttcataatattttattggaatcattttctggaatttatcctttaagcccatatgttgaaagagaattatatcattatcctctattgctagctccaattatttctagtatgagcaatttgaacattaaaaatattgttgatagtttatcttcaagttcaattaatcttatattaatgttaagtctgattgaatgtacaaactttgaaaagtatcaacttgtaaagttggaaaatcctattttagttaaatatttgacagaaaaaactagtaaggatgaatctactttagatttatcagaacatattaaagaaattaaaaaacttttaatttgtaaacagccttcaaaagaaagtgaaaaatggaataagtcaatgcatgaattacaaattcacaatttgcaattattatcagtattaatgagaatattacattatacaagagagaacaagttaataatttatgaaaagagaaatcaaaataaacactcactagattttgtattggaaaaccttcgtgtatattctattttggtttcaaatatattggaaaatcatccaaacgctctagttaggtttttatgtaatttaataatttctcaaatattcaagtttccaacagttttcagaacaaatatcaaagatgacattgtaaaatcactaacaaactcatcaaataatgacaacaataaaggtttgagaaaaatgtcatgtattttaaaattaaaaattctgactttaaatgatcatatttactag

SEQ ID NO: 1353 - DNA, 561 bp, Cryptosporidium hominis
atggttcaaatgtacgattatttcattcaagtacatacattaaaccaacaaaatgaggcttttaatatggaaaataatttattacaagtaatagatattgttgaattgcaaaaaaaacttgaagaaaacaaaacaatacaaagctattactactttatttattctttaatttttagagaaagctacccttttaatgagaatgaaattaaagattttgataatttacaaataactaatattccattaattttagatactgatgtatttatcaaagcacttcttgaggaaattaatgttgaaaaactcaaaataattaaaaataattgtgaattactgattttcacttcattcaggttctatgtatatatattaattgaactaaaaaagattaaaaactctctaatacatttttcagaagaaactgttaatgaagataatgaggaggagaaagagagaaaaatggtgagatttgaaaagatttatttaataatggaagatcaattggagttgtttgtttacaaagtattgaaaattgatgaggctgatgattctaaaaactga

SEQ ID NO: 1354 - DNA, 4815 bp, Cryptosporidium hominis
atgacaatttctagaagcagttcatcattaaatgaagatggaaaaatcaatcgaagtaagattgttccatatattacaagagagatgagtattgctcagcttcaagataagaaataccatagttttgtgcaaaatacattggcagattatcaagcaagtgcatttgatgctcagaaaattgcattggaaaaagataaagagcttaaagagttgagagatacacaaaattcagttaaggtttcattaaagtattatcaagagaaatgccagcaattagaaaatgagcttaaagtaacttcaatggggctattatatggaaggaaggaaaaagaacaagagagagaaattgcaagattgagtactgaaataacaagtttcgagaaaaaaaaagaggagttagaaacaaacttgagatattatcaagatagagaaatgtatttacagcacgagttggaacttaaagaaaatgaattaaataagctatctcaagaatttgctactttgacagagacatataatagtacatattcggaattagagaaatgtaaatttgacttaagtaccgaacagaataataataaaacattagaaaatcaattaaaagtaaagaatgacgagattacaaaatataaaggaagtttaacaactaaagaggcggaaataaataatttgaagaatgaaatacaaaaattgaactcaatggttgaaatcaataaatctgaaataaatactattagtgaacagcttaaattaaagcagaaagagtgcttagattatagtagtaagattcaacaaatagaattggagatgagaaaaaacttggatgaaaacgaagtattaattaaggatttaaattcacagataactttgactagaaatgacttgactcaaaaagttgaattaattaatgagttaaactctcgaatttctacactagatttaaagctacaagaatcatcaagagatatattggaaaaagaaaaaactataggaaagcttaaagctgagcaacagattactagcctagaggctgatggtcttaaaacaaagattcagattattgaacaagagaaaaccaatattgaacaagaaattgaaacgatattggtagaaaagaaaaaaatagatgaagaacttaaagatacaattaataagaagaattccaagctagatgaagctttaacttacagaattgaatcagctataactgctgagagagaaattaatcaacttaaagaaaagaaccaaataattgaatttgagaaaaaaatgatggaggaaaaattggaaatttctaataataatataaaaataaaagatgatgaaattcaacaacttaaaactacaatccaagatcttaatcgacaaaatattaaacttgagaatgagcttcattcattacaagaaagtagcagaagagagagtgtggagaatacatttagaagtagtagaattggctcaaatattgtaagtagtaaaatcaatgcatcatctgggtctatagttaactccagtgaaaatacaatttctagtaatatagcaactagtaatgctgaaactgttgaaaaagtagttaatgctgatgctatagctgacacatctattcaagattcacctataaatgctgcttctacaacagttaaaatgttatcatccaaatcaatttcaagtaaaagtgcaatttcttcattaccaaagtcaaaagctaaaagtgcagttaaatcagctcctgctactgaagagaataacggcgatcaaacaatatctgaacctgcatctatatccgaagttaagtctaaagctggaagtaaatcaatgccagtttcaaaatccaaatctggaattaaagctaaatctcaggttgttgctaaatctgatatggattctggaaaaattgtaaaggaagacaatgagaccaaagacaatgaagatgaagcggccaaggttagagctcagaaagaaaaggaggaagccgaagcaaaagctttaaaggagaaggaagaagccgaggccaaagccaataaagaaaaagaagaggctgaggctaaagctttaaaggagaaagaggaagctgaggccaaagctaagaaagaaaaagaggaagctgaggccaaggcaaagaaagaaaaagaggaggctgaggcaaaggccaagaaggagaaggaggaagctgaggctaaagctttaaaggagaaagaggaagctgaggccaaagctaagaaagaaaaggaggaggctgaggcaaaggcaaagaaagagaaagaggaggctgaggctaaagctttaaaggagaaagaagaggctgaggccaaagccaagaaagaaaaggaggagactgaggcaaaggcaaagaaagaaaaggaagaagctgaggcaaaggctaagaaggaaaaggaggaggctgaggcaaaggcaaagaaagagaaagaggaggctgaggctaaagctttaaaggaaaaagaagaagctgaggccaaagctaagaaagaaaaggaggaggctgaggcaaaggcaaagaaagaaaaagaggaggctgaggcaaaggctaagaaagaaaaagaggaagctgaggccaaggctctgaaggagaaggaagaggctgaggctaaaggcaagaaggaaaaggaagaagctgaagccaaagccaagaaagaaaaggaagaaaccgatgcaaaagagaaagagaagacaaaaatcaaagaagattcaaaaatagattcagatagtgaggaaaactctgaatctaaagaaaagaagtcaactggactacttgctaagacaatagcaaaagctaaagcaaaatcaaagtccaattctgtcttatcaaagcttccttctaaagttaataaagaaacaagcaaagctgaaaacgatttagaaaataagatagaaaaagatgatgaatcaaataaaaaagagattaaaaaggaggaagattcaatagcaaagcttaaagcaaaagtacctgtaaagccaagcccattattgaaatcaaagagtgaaaaagaaaaggagaaagaagaagataaagatgaggagaagaaagaaaaggaggacaaagagaaaaaggaaaagttaaaagaaaaagaagaggaaggtaaggaaaaagaggaaggtaaagaaaaagagaaagagaaagataaggatgaaaaggacaaatcaaaaagcaaaataaaagagtcccagaaagaggaaaaattagaagaaacggagaaagattcatcgaagaaagagtccaaagatgaggagaagaaagaaaaggaggatccaatagcgaaacttaaggcaaaagtacctgtaaagccaagtcctttattgaaatcaaagagtgaaaaagaaaaggagaaagaagaagataaagatgagaagaaagaaaaggaggacaaagagaaaaaagaaaagttaaaagaaaaagaagaggaaggtaaggaaaaggaagaaggtaaagaaaaggagaaagataaggataaggatgaaaaggataaatcaaaaagtaaaacaaaagattttgagaaagaaaaattaaaggaaactgaaaagggcgaaaaagaagccgaaaaagatacatcaaagaaagagtccaaagatgaggagaagaaagaaaaggaggatccaatagcgaaacttaaggcgaaggtgcctgttaagccaagtcctttattgaaatcaaagagtgaaaaagaaaaggagaaagaagaagataaagatgagaagaaagaaaaggaggataaagagaaaaaagaaaagttaaaagaaaaagaagaggaaggtaaggaaaaagaggaaggtaaagaaaaagagaaagaaaaggtcaaagctcaaaagaaaaaagatgaaaaagaagaaaaagataatgatgaaaaagaagatgataaagaaaagagtaaagaaagtgaaaatcttgaaaaaaaaccaactatttcagaaaaagttataaatcccgaaagtaaaattgatgagaaggactcagaaaaagaaactttaaatcatagtaaaactaaggaaattgctaaatcaaaggctgcagctcaacttaaggcagctatattagcaagggcatcatctaaaaagaatatatcagctgataatagtgaagattcaaagttaaaaaaatctgaatctaagaaagatattatcaaagacgaagccaaagatgaaagtaagacaaataaagatggaaaggatcttaaaaaaactttgaaagaaggtgagggttcgatttcaaaggttaaaggaaaaggtaaggtaaagactaaggctaaggcaaaagaaaccccacctccagctgaagaatcaagttggttcagtggttggtttggaacttcagcaccggaagaacctcctaaagaagaggagaaaaaagaagagaaaaaagaggatgaagcaccaccagcaccaccagctgaagagtcaagctggttcagtggttggtttggaacctcagcacctgaagaaccacctaaggaagatccagcgaaaaaacctcctaaaaagcatttagttaagaaatcatcttctgtgaagaaagatgatggcgaaaagaaagaagaaaaggaggaaaaggaggagaagaaagacgaaaaagaggataagaaagacaaaaagaaggaagaaatagaggaggcaaaagagaagaaagaggagaagaaggaaagtgacgaaaagaaggatgaaacagataataaggaggtaaaggaaattgttgaaaaggaaaaaacaggggcagatccagagaaaaaagttgtcaaagcaaagacaaaatctaaagcaaaggctaaagctagggaagagcccacctcctgcaccaccagctga

SEQ ID NO: 1355 - DNA, 456 bp, Cryptosporidium hominis
atgggaacaccatatgaaggaggtatatttcaacttgatattattgtaccaaaagaatatccatacgagcctccaaaagttaaattcatcacaagaatttggcatccgaatatttctagtcaaacaggagctatttgcttggatattttaaaagatgcctggagtcctgctttaactcttagaacagtaatgctttctatacaagcattactctcctctcctgaaccaaatgatccccaagatgcattggtcgcatctctatacaaaagtgattaccaagaatatattgaaacggccaaaagttggacacaaatgtatgcaaagccaacatcaaaggaagaaaggattaagagatttcttgatatgggattcaaccgtgaatctataataacagcactagaaagaaataattgggatgaaaatctcgctctaaatgagctattatttgaaaactaa

SEQ ID NO: 1356 - DNA, 348 bp, Cryptosporidium hominis
atgcttagttcctttatggcaatcaaaaaaatattacaaattcaatcaaaatactcggcaaataatgattatttcgatactgttgtgcttttgagagtcaatatagcactaatggaaatcactcttgaatctaagctgaatgaaatacctgaagatgctagaaataaagtatttgaactgaaaaagagaattataacaaataattatttattgaataagtattatcaaaatcagttcaatattctaaactttgaaagaaaaaatttattcaagatttttttacgctactttatttaccctgcatatttagatctttacagttatggtaatattatattatcgaggtaa

SEQ ID NO: 1357 - DNA, 1152 bp, Cryptosporidium hominis
atggaagaggttgaaaacatgattaaaagattacaggtagatacaaatttgacttttgattctgaaaagctcgacaataaaactgaaataactcgtgaaatcacagaagaagacattaagaaggttgtcgagaaggaaaagatggagaagaataaaatcttaacagaaatgtttgaaactcttctagatcatgaatttgattctaatttaactcgaaataacaaatttgaaagtttgactccattaaagaaaggtgaggaaatttcaaacgtaattatagacgaaaatttcttatcaaagttaaacgaccttgattggcaaattacaatggaaaagatgcacaatacaatttggtactactgggataatgaaatacataaagagtatgttcaaaggattccttcagctctacgtcagttacgacaaatttcacaaaagatgggggtttcatcattgtttgatgaaggagaattgggagatacaattaataagctgaataataaatctaaaactgcagatagaaaatataaaaagttatttaaaaaattatttgttaatgatttcaatcaaaatattccagaaattaaatataaaagatctgaggaagcaatgattaatatggttattgaactaaagggatatattagaatattactaaagcttattgatattaaggcatctcaggttggattattattattaaataaagtccaacgtaaaagcttcaaaaaattatccaccaatttaaacttatttagaagtaatattaagagttgtccggtacatactgcctttagctacagatatcaagatgagaactttgatattttaatgcatcatgaaaaagggtttggtatatggaatactagagatctatcaaatattgatagaaaaaagagtattgaaatttccagagaaatcgatgaaatgatcaactttgttcacaatgaatttatagctcccattgcattgcttggttcaagtattgaagatactgctctaattcactcttctcttgtccgaaatctttggaagaatattacggtacaaaacaagatacctctttatgttatttttgaatccatttctaaagcaacgttcttctttattaaacaaattaacaataaaatatatatggtaaataatagttaa

SEQ ID NO: 1358 - DNA, 1029 bp, Cryptosporidium hominis
atgagcaatgttaatgtacaattatcaagaaagcaacaactattagagagaggatgcaacgaaatgatagaagaaaaaactaatttgactaatttaaatcacaatgttactttgagttctggattatcaacaactgcaacatcttcaacaaatttggaaacctcatcaaaaaaatattcactaggaaaaaccttgggaactggatcatttggaattgtttgtgaggtattcgatatagaatcaggaaaaagatttgctttgaaaaaagttttacaagatccaagatataaaaatagagaattagatataatgaaggttttggatcatgtaaatattattaaattagtggattatttttatacaacaggagatgaagagccaaaacctcctcaacctcctgatgatcataataaattaggaggaaaaaataatggagtaaataatcatcacaaaagtgtaattgtaaatccatctcaaaataagtatttaaatgtcattatggagtatgttccagatacattgcacaaagtattaaagtcattcatacgttctggaagatctataccaatgaatttgattagcatttatatctatcaactatttagagcagttggatttattcattcattagggatatgccatagagatatcaaacctcagaatttattagttaattctaaagataacacattaaaattatgtgactttggatcagctaaaaaattgattccaagtgaaccaagcgttgcatatatatgtagccgcttttatagggctcctgaattaatgttaggagcaactgagtatactccaagtattgatttatggagtattggatgtgtttttggtgaactaattctgggaaaaccattattttctggtgaaacatctattgatcagctagtgagaattattcagattatgggaactccaacaaaggaacaaatgattaggatgaacccgcattatacagaagttagatttccaaccttgaaagcaaaggactggagaaagatgcttcctgaagga

SEQ ID NO: 1359 - DNA, 786 bp, Cryptosporidium hominis
atgtcacgaagatacgattctagaacaacaacattttctcctgaaggtcgattatatcaagtagaatatgcattggaagcaattaataatgcagctccaacagttgggatactttgtaaagaaggagtaattctgggagcagataaggcaatagtatcaaaattacttgatcaaggaaagtcactggagaaaatttatacaatagatcgtcatattatagctgctgtagctggtttgacagctgatgcaaatattttgattgcccaagcacgtatagactctcaaagatatcaatatacatatggcgaagaacagccagtagaacaattagttactcaaatatgcgatagaaaacaaagttatacacaatttggtggattgagaccatttggtgtatcatttttatttgctggatatgataagaattatggataccaattatatcagtctgatccatctggtaacttctcgggatggaaggctactgcgattggtcaaaataaccaaaccgctacatctttattgaaacaagaatggaacgaggacttaacattagaacaaggtcttcacttagttgcaaaagttttaaccaagactatggatacaacttctcctacagcagataaatttgagttttctattttgactcacaataatgaatctaataagtgcagccagaaaattttgtctgaaaaagaaattggagaattgttggaaaaagtccaaaaagaaattgcttctgaaaatagtgctaagaataactctgaaactgataaccagagttaa

SEQ ID NO: 1360 - DNA, 4074 bp, Cryptosporidium hominis
atgttacttaaagaaatagcgtcatcggcaaaaattagttggtgtccaatatcaactaagaataagctgagtttgttagctttaggaggatgtgggctaaatccctgtttaagtgtgggattaattgatattaccaataatggtaaagatattcaaaatataggaacatcttctttgaactcaaggtgcacatcaatagcttggggaagttttaatttagaagagaatgctttgggtcttatttgtactggaatggaagatggtaacatgagtttatttaagccaatattatcgacttatgattcaaatagaaaagatgaagaaattatgcttgaaagaatatgtgaaacaaacatttatccttctgcagtaagttgtttggaattcaataaaactgaccatcagttacttgcatctggaggaaatgatggaaaagtttatgttttagatttgagtgatggtataactggaaatttgaactattatgagccaggaaaggaaaataagcatggagattctgatgtgactgctttgaaatggaatccaaaagtccctcatattatgtcatcttcttcaagcaatggtactacagcaatctgggatttaaagatgaaaaaaagtgctatttcatttagagatcctgctcaaagatctagaccttcgactttagcatgggttccaaaccaaccaacacaaatagttgtgggatatgatgatgatagaaatccctcgctccagttatgggatttaagaaatgtttcatatccatttaaagaagctgtttctgctcatcaaaaaggagtaatgtctatagagttttctccaattgatcctaatttattgctttcttctggaaaggatggaaaaacaatttgttggacattattaaataaccagcagccagaaatatttacagaaattcactctcagcaatggagtgttcaaaaccaatggtctccaaatattcctggaatattcgctacagcatctcataatgacaaggttagtatctattctttatcatcacattccagtacaacaacttatattccatcttggtatcataagccatgcggagtaaatttcacattttctggtaaattagtttcattttcaagtaaatctactggtggagtaccccaatttaacttatatagagtacctacaaatcctgaaataactgctcatgctgatatgtttgatcagttactcaatcaaggagactttattggctattgtcagaaaaaatgtcaggaatcagaaagctccaatgaaaagcttgcttggagtctagttgaaaatatgttttctgaagattccgttgaaagacgtctatatattgcttcacttttgggattcgatttcaataatgcaagtacaacagcaaaccagtttttagggaggaagtgtggagtaatatcacagcaagaagaacttcaaaaagaactttctgctattaatcaacaaaacaatatcagcttaatccaagatcctgcctctacttcatttactggaatgagctatcaaaatagtccaactaatatgaatggtaataatatttctggttttcaaactttatcaggacagatagtatccaatcaatctttggatccagaaaaattcttccaacaattaggagagagtgaatctcccaataataatagagataaagaaaccgaatttaatcaaaaagatgacgagccttatacatctggacaagattactctagtggagcaagattttgctgcgaaggcgctgacaatgaaatgattgaaaatccattcgctggtattcctcagggtcaagaaaaccaaacgagccatgatttatttaattcaagtggcttccctggaagtagtatgaagtgtaatcacggagtttatatacaacaaggtactgagctttctcattctaatctaagtgttggtaagttgcacaacttaagacaaaaggaatggacaaagcaagaggaggatgttattaatgaactacttgtaacgggaaatattgattctgcaattgatgtttgtgtgcaaagaggatttttcgctgaagctttacttttggcggtaaaattcggaggtatttaccttgactatgtacaaaaacaatatttgaaaaagcacgaatatcaatatacccaaaaggttttaggtcatgtaattatggatgatcttgaagattttgttaaaagcagtaacttggaccgttggaatgaaactttagcaattatttcaatctatacccagcctaatggaataagacttggagattattcttaccagtcaaagtatacaatggagaacctctctgaattgttagctaagcgattgcaggaagaaaagtttgatgttcgatctgcactaatttgctatctgtgtgctcgaaactttagaaattctattgaaatttggggtaacatggcatcttgccaaagctcacaaatcattggacttcaggactttgtcgaaaaagtagcaatccttcaggcagcaacaagatttaatggtaacgacgagaatattacaaaacaggttgtccaatatgctgaaatccttgctaattctggaaggattgtagcagcaatgaaattcctttcctccttagcttctaatgactactccattaactcatcaactttaagagataggatatacaatgcagctccagagctgatgagttctttgggatttaacaaaccaaatttccctttcaccattatcgatgttgctccatttgtgaatgctaatgcaaatatttaccagcatcaacaacatccaaaccaacagcaacatagtatgtttggagttaataattcgttccaatcaaatttgaatattggcatgaattcctatccaatgatgaataatggtaacaatgccggtatgggtatggtaggacaaatgatgcaacctcctctttcatctcacggggtgccaccctcaggaccttcttcaatccactcgaaccagatgcatccttctcctccccctcctcctccctcatccatccattctacaatgaataatggaatgccaggtggtattcaaactcaatgtcaggcatttaggccaggaatcccatctagctcgggactccctcctcctcctcctccaccctctactacttcctctattcctcaaatgatgaggccatcttcatccttgccatcaactagtaatgggatgatgtcaaatcagctacctccgcctccttcacaaaatatggctgctctaactcgtccaagttctccaaatgtagtatattctcagaacaatgtcgcacttggagttggatcaggattatcttccacaaaccaaggtgtaaaacaattcttacctcagtcagctcagcctccatcagtaaatcctactaattcttttatgaacagcttaaacaagaacaattttggtactaacaatgtccctcctgctcctatacctacatctattccaacaccttctcaaatcccatcttcagttcctcctgtggctcctcctccaatgccaaattcaaataatagcagtattattggaggaggaatgcaaggagtcttgaatcaaggaattagtcaagtcgctcctccatcaaacagatcatcaattactactgcccctcatagtggagctacaccaccaataccaggaatgccagtaccatggccactaccaacagcaacacaacaattgaattcaacaacatcaacaacagcaaacgcaaataaacagattcaggaagcatctaagaagaacaattcccagatagtgggtaaacctttatctggtcaactattggatatggtaacaaatgtggtgaattctaatttgaatagcatttttgcaaatgacccaagaaagaagatggatgctcagaaaagatttgatgagctttttgaaaatctaagagttggaaatatttcagaaactgtttcatccaaagttgttaatctttgccaagccttgcaaacgggggattacttgactgcaaataaaatccatattgatttgagttcaacagagtgggagaataataaaaactggctgatggcttttaagagaattattcccaaataa

SEQ ID NO: 1361 - DNA, 858 bp, Cryptosporidium hominis
atgacacgtgtcaatagtaaattaatggagatttttcaagaaacatatgaggaattgttaaaaatatttgaaaataatcgggagcaactaagaaagatagatgaacaacttctaaaactaacgaccgatgacccaaattatgatattcttaaagaagttagagatgatttaatacaagttatacaactagtggaggaacttattgataataaaaggaaaaacagtgatgaaaatcctgaagatgtaaatattggaaaaattgttgaagttttttataaaggaaacaaaagatttggaagaattaaatcaaaagacttaaaattagcttctaacactattaatgattattatttaatttcgatatttggccaaattccagaaacaattagtttgcaatttcaggacttaaagcttttaccacaatttaagggattatctgtaggagaaaaggttcaagttttatttgaagaagatggtaattggtacaattctgtaattgttggtttaactaaaaatggatataatattaaatacttggattataatcaagaagagaatgttacttatgatagggtcagaatgattagtaaaagttctagaagcaatttaaatcacgataaaaccatcgattcgttagattctacatcaattattaccactcctgctggatataaaatacctgaaaatcttttaattaagtcttacgatacagaaaagactaaacttgaaaagaagaaaaaaatttcggttattaaaaaacaacaaaaaaatgaaatatttgaaactcaagcaaaacagaaacaacaatcttggaagaatcatatcagtaaattccaaaaaaatagtaaaataatttaa

SEQ ID NO: 1362 - DNA, 1788 bp, Cryptosporidium hominis
atggatgaagagctcaatgacttatttaaagaactagaaagagtacaaaaacatgagataaataagaacaaaataaatgagagaacatgtattgaaattttatataagctaataaagaagaaaggtttaaatttaattactagcttagatggggaaaccttttacacacataaatatttgctcaataatatccaaaatttattggagtctaagggaagaatttcaatacatgatatttcaaaaacaatgaaaatttcaatagaagtaatattaaagctagtaaaagatatggaaaaagataataattatattttttacaagagtgatataatgacaagaaaatatgttgatgatattttttatgacttaaatcaagagttacaagatttgcatatagtgggtttaatgaaaatttcagaaaaaacggatctttctattgaatttattaaagaagagattaagaaaagagtgaataatggagagtctgagattaaaggtaatatagtttttgaaactaataataatccattgataatttctaatacatattataaaattattgaatatgtgattaaaggtgcattattagtagctaaaaaaccactatattttgatgaaattatagatataaaaattcaagatatctcaataataatacaatcaacaaaaaatcttatagaaaagaactggattaaaggttttatttacgaaaataaaatgtatattcctgatatttttattaaagaggaaatattatttttaataaattactttaaaaataatggtttcttagaaattgaaaaaattaaaggtattttgagatattctaattcaaatttggaaattaaaaatcaaagaattattgaatggtcaaaattacatttaagtgataatattataataattgatgatttatttattattaatactaataaggtagaaatcataagggataatattttacactcgtgttttgagctaaatcctggatacatttacattaatcaccttcttccatacattttaacgagtgaaatcaacaaaaattaccatttcgatataataaaactaatttacaaactaaataatcacccagttgaaatacaaagcaatgattggcttttcgtaacttttgatggacctgagtcattatatataacaaaccttgaccgttcttactttaaaattcaatttgaattcgaaagtaatgatattaaaaatggctttgaagaattacaagatatttcaattaaaaaatttcaattcaattcaagaaaacacatttttaataataattttaacgcaattttatttatcacaaactttaacttggttattaattcaagaataatttgtaaattccaagattttgtttttagtaaactagaaaatattataaacagtatggttctcccttattttcaacttcttccaatcccaagttctgagtttaagcctattaagtcaaatgaaaaacaaaaaaacaaacaaattaataatttcattaatgaattagtttccaaaaataatataaaggaacttttcctttctgagttcaagcaagattggaatgaaattattaatgataacccaaataatatagaaattttctcatcaataagttcttcaaacaatgttcaacctaatgaagatgattttcaagatttattatggcatctaattatttactcaatcgcaccatttattgtatatatctataatagacgaatgaaatttgtttatgatccctccaatgtttcaagaaccttccatattgaaaaagattaa

SEQ ID NO: 1363 - DNA, 615 bp, Cryptosporidium hominis
cttaaagaagaacataaaatatttcttgaaactgcactaatacccttacataaagcaaaatatatttcttctttccaccaacaattgatatattgcttaatacaatacattgaaaaagatacaaaattatctgtaccaattattgaaggtgttctaaagtattggccaattactaactcatccaaacaaattttatttttaaatgaacttgaagaactttttgaaatcactcctacaaattacattgaaccaattctaattccaatttttgaaagacttgcaagttgtattcaaagcccacattttcatgttgctgaaagagttttatatctttggaacaatgatataattgttaatcttattaatgaatataaatatgaaatatatcctgtattgatcaaggcactatcatgcaatggaaaaaaactacattggaatcccactgtacatgggttgtcttttgttgttaataaagttttatcagatactgatcctgaattattttcacaaattattgagcaatataacgacgatagtgctaatattgaaattcaaaaaaaagaaagagaagaatactggaagtatattattgagcttgcagaaagtatggattaa

SEQ ID NO: 1364 - DNA, 291 bp, Cryptosporidium hominis
atgggaaataggcactggattgaatttgatgaatttggcgaattaactgatggtatttcaatggatatggatagacaaataaataaggatgatcttgttgtcaactttatagttagcaaagaattattagagaggaattataaattaaaacaaaatcttactagaccaataaaatgctctacaaaaaagttctgttcagacttatattttaatgagtcgaaagtcaagattatttatgaaaatgataatatttctactcacaatatagatagcaaaacagaatctccagga

SEQ ID NO: 1365 - DNA, 756 bp, Cryptosporidium hominis
atgagctttccaaataatcaaggaataatggactacttaatacaaaataataaggaaatagttgactataatgttgatagcatgctaactactcaaggtgaacctcagtataatggaatggaaacaataagccaggtagatttgagtgataattatataaacaattcatataaatccgctagtgatactgcaatttcagaatttgttggctcacatcaacttaatcaaacatcactttcttcatttaccttaaattctgcgtcatatacggctccatcatctagatctacatcgtcaagttctaattccgttatttcatcatcctctttagtgagtaactcaagtatatattcaagagaagacattaatattatttcaaaagattatatttcacataaaaatcaatcaaatatacccgtttttagtaaagatgaattgaaaactttaagccgatgtcttcctcatacaaaaatcaagaaaataatcaagtgctctggagccgtaaatcatatgattggaagtgaagttcctgcactattggcaattgcttgcgaactttttgttagagatttgacaagcttttcttggaattttactagaagagctaagagaagaacagttcaagttcaggatattaaatctgtttccagcaaggattttagactaaaaagattattttatgctagcaagagccaattaaaaaatatatcatatgaaaatgaatcattggggcaacataaaaaaccaatattaaat

SEQ ID NO: 1366 - DNA, 222 bp, Cryptosporidium hominis
atggcatgcatggaggcttccgccctaaattcgtcaaatgttgacgaagcatttcaccgtattctatctgaaatttatacgttaagaagtgaaagacaactcacagcaaatcaacatgatttaaacaaagcaacccttcctttaggtactcaaggagtacgtgttgacccaatcaggattgatcttaactctaaaggaagtaaaaaaaggtcctgctgctag

SEQ ID NO: 1367 - DNA, 459 bp, Cryptosporidium hominis
atgcaggaacaccaggaaaaggagatacaatttccaacccatttagttgagcttgcattgcaagaacaagaagtaaaggatcaaatttgggtattaatttcagggggtgataagaataagactatttcctttagtgaattggagaaacttagtgaggctttaggactcaatttgtgtgaagaagaaataaattcgatgttgttttggggaaaatacggtaataacaaggattttaaaaaaattcaaaactcttggcttgaaatccaaacgggctcttctaatttacaaggcagtgaacatgactccaaagtagagtcagattcagaggcttcaaatgatttagaatctctcagaaatattgagataaattacacagaattttgtgaaatatttgcaaggaatgaaagaagttgcaaacgtagaatagcaaagaaaattgatttgaggaatgtgaagtag

SEQ ID NO: 1368 - DNA, 1824 bp, Cryptosporidium hominis
atgaactttatattactcccgaatttcgaaatagtgtctcaattatatgtggggttggagtttactgaagcaaaaatttgggatgaagaaatattatttctttatatatctttactgagggagtttattggattgtcaaagtttctaagttactttcaatggagagacttcatttttggccaagaacatatacttggcaataagtgcctttttagattggatagttcaaatgcactaataaaaaaagcaagtaatttaagtattgctttttggacattgaaaaaaaaattattgggacaatctgaaatagaaaaattatatctttttatttcggataatctgaatttttactggatgaatctatcaagcacagtacttttgagaggatttgagcattctatgagagtaattaataaaataaatagagaaaaaagagatccaatttataagtggattgatggggaaagctgccctgagatttacgaaaaacatcaaggaggaaaatttaaagaatacagaatggctgtatacttaagtatatgctttgaaatggtatctctgttcattttaactcaatttatttttcaaaatcaatctacgaataacactgaactgtcttcaagcctatattccagggagagctatataacaattgcaaagtttttccagaggaactcagccacattgataaggattctatcattattggcaaacgaaaaaagcaactctgattataactcaatgaatgtaccagttccatttgagatgttttttgagaaagtatttatttatagcaatgatatggaacaagatgaagatgaaaataagaattttgacttaaatacaaaaaaattggagaaatattttagttccaaaaatgaaaatggccaggatgaaaagaaaatgagaggaaatagcataacactttcagagttcacaataaatgcattcaattaccatgttgttacagataattcaggagaaatccaattatgtattttacttaattcttgttcaacaataatcaatcacaatgttttagatgattactatttggtgaacaatactcatggaaatggtgcttctgaaagaatttcatactatctctcaaacaaaataatccattcaattaattttgaccagagtgagttagcgaattccataaacgatgtaaaaggcgatatttttgaaattatttcagagagagaggagatagtaaattctgaagaagcacgaaatataataatttcaaactcaagtaatctaaacttatattttacaaggccagttgaatacttattcatccgagactgtaatcaatgtaatatttactgcttagatttaatttcaaacatccacatcgaaaattgccaggaattatttatacatgttgattgtatgtttgcaaccttggttaattgtgaaaaagtgagtatttttcttcactctcagttttcgcctctacttaggaactcaaatgatatttcaattggaccatacaacgtacactgtataaatagaaagacatcctatatattatcttacgaaaataatttgttaacacaaagctggagattcccaatgagtttttcgtccagctttaatatggttaaaccagaaaagctttatatggtagaattatttgatacgaaacatgaaattattacaatgaatagtggtgaactaccaaaattcccacttccttccgattattatgagaatttcactaacagactacagttcctagaacttgttcgaaatctcgagccctcatctcaagaagaaatcgttaaacaatttgtttcttggatatgcaataattaa

SEQ ID NO: 1369 - DNA, 846 bp, Cryptosporidium hominis
atggagtcttcactaactagaattctaatagctttggcattcccatttacacaggaattctggaaagttcatggggttagtttcgccttatcaagcatcttcattgtactactctggtactatttagtaaacaaacataatacagatcaaaataaaatgagatgtgttttccagtatatatcatctgccattatatccttcatatgttggcctgttgtaattgatctctggtttaaatatttccaatttgaaatggatatgttaaaatggcttcaatatgattcctatggatattataaattcatgttaaatttatttttatcttcacttttatttgaccttatttttggagtcttgtatttcagaaagcaaatgtttattttaaatggttggattcaccatactgcttatatcatcttaaccttatatattatgcgttggaagtcttataatatattgcttgttgctctacctgaggaaattccaacttattttatatctatttacgtaatttttccacataacaacaggaagttctcccaaaagatgttctctataacgttctttattttcagaatttcgtatcatataataggctattcattgttattccttcgtgctagtaatagagaagctacccaactttggatacctacatcacttactatttttgcacattgttattggtatcttctctggcttagaaagcattggagatctctatttcattctgaagaaattccatattctaaagaaaatataagcactgctaagagcaaccccgataaagaatacaattgtattgactactttgatcactacagcaatattgaacgagaaatttga

SEQ ID NO: 1370 - DNA, 1662 bp, Cryptosporidium hominis
atgattcaagatgacttgatgattctagataatattgcaagaggagcaaaaggtgaagttggacttagattagctgctatttatatgtatagatttatttgccaaagtaatttggtttgtgggtatattcttggctgtaatatctgggtacagcttttcagaaaggaagaagaaagcaatgagaaatactattataattttggagatccactcccagcagtttttaatgatagctataaatctttcaaatattcaacagcagcattttgtgaatttattaatatgtttagtttatgtattgtttgtaaattatacacagagattagtatttgtcaggcatcaactcctaatgatttaaatgactatattactttactggaatgctttattgtaatattggaccattatggaggaaatttggaaactattaaaaaaacttcaaaagatgggagtttaacattctctactaaacttttcaattcaaaactttttggaaagaactcggatgacatttgttgtgggataaactttaacggcaataatcttggaaatgacttgaactatggaaatgataataatgcaacaacatctgcaaactcttggtataagaaacttttccctaataatgtcttagttagtagcttcttctttgtaaaagcttgttttttgtttgtatctgcaattggtagagttcactcccgttcagaaaactcaatacaaacagttagaagcttattaagaacgtcaatgtattttctaaagagaagtataaatttcaattacattatgttaccttcctactacttatgggggaatatttactctattctcggacaatgggatgatgctgtagtaattttcagaagaattatcagactatttccatcaaccaatttatcaataacatcagctacttctctattgcttcaaagagttcagattgagaaagatctccgaatcacagatttgctaaatcaatgtattggatgggcgtctaaagggcttcaaattaataaagacactccttctattcacaattctttgggaatttgtgcctattatgaaaagaagtatgacattgctattggttacttccagaaggcattcaattgtttgtcaagccaaaatcaagatgggatagaaaatattcccataaataattcattttccacatccatatttaataaaactttatttaaaaacccgggaaatccaaacttcaactcatctctcttttcatttaatcctctaccatttattatttccgttaatctcgctctttcatatttaatgggaggtcattatcagaatgcaatcgatagcttatctgtattatttacctcaaagaagtattttcaccatgctctctttgaccctacattccttcaatacatttatatgatccttggaatttcctatcatttgctcgataatactaaggaagcatgtaactactacgagcttttcctttctcttccaactgacgatgaaatacttgatgaactagaagaatatccaaacacagaaactatgaattctattaaaattccgggaaatgacgcaattcaaatgatcatttctggggaccagaacaagtatctttcaaaagtgttcattaagagcatttctgagctttacaactccctgatgcaaaatatctaa

SEQ ID NO: 1371 - DNA, 258 bp, Cryptosporidium hominis
atgtattacttcaaagctaacgataagaattattgtattgatgctaccgaagaatgtttagaatttgggccagggagactaattaatcattctagaaaaaatcctaatattatcacaaaagtactaatgatagaaaatactccaagattattcttcgtctcaaaaagggatattatgtgtggcgaagagctgctttttgattatggcgataacaaccccatttctactctacacaatccctggcttgtaaattcataa

SEQ ID NO: 1372 - DNA, 560 bp, Cryptosporidium hominis
atggtcaattcaattatcaaaatagcatcccttttgggtggcttatctttaaatattgcacttggaatggtatactctatgagtaattcatccatttatgttgcatcttatatgagatgggtagcaaaacaagaattaaagccagtaactttagcagatgtttcttgggtatatactttaaatgttttttttctcggcttgattctccccattggtggttatattaataaaaggattggtgtacgaaagtctttatacttggcatctgccttattttcagcctcaacatttgtatcttattggtttgtttcatcatattattggtttcttataatttttggttgtatacttggaattgccgatggtattgcctttaatattccccaatattgcgcctataaacattttccaaataatattggacttgcttcaagtgtagtaatttctggattggctttgagcccaatactattttcaccattacaaacatggattgtgaatcctaataacaaaatgccagaattaaaagtaggaaatgaattatatttctctgatgaaga

SEQ ID NO: 1373 - DNA, 1074 bp, Cryptosporidium hominis
atgaaggaaacaggggtagagtcaaaaaatgtttctggaaaacatgaagagtataaatatgttcaaccaatgacatcacctttatacaatcatgtgatctctcctgtatgcgataaaattgtgggatttcttccaaaatatctttcaccaaacttactgacaattattggattaatttctatttcaacttcgtttattatgttaatttctataggagagaattcaaaaaagctatattttgtttctgcagcattatggtttttatatggcattattgataatttagatggaaaacaagcaagaagattaggagtttcatccaatagtggggagttcattgatcatgcaatagactcagtagttacttcatttgtaggccttgcatttcaatatatgcataacagatatcttgaattggatttacttgtagtattgtcatatcagttacctttttattttgcatgttggtttcactttcaatatggaaaattaataattggcaattccatttcaaaaactccatatttcacagtggatgagcttaatctagtttttgtaccactttttatcttattcgaatattttttccctgggctttggaatttagatatacctctttttggtggttatataataaagaattgggggatcccttttaattattgttgttttatttattcaatatccacacttttaagctgcttacattactgcttatcaaagtccttaacaaatgctcatttattattcattcctctaactttacatgtaacttccaaggaattgacaaaattaagcatgtataatacgattctcccattttcaattctttgtattacttttattttccttaagatttcaaaattactcattaagaagccaactcgctctttcatcacgcttattggtgcttccttaattccaaatataacaactaaacttttagtttctgaacttgaaattaaccaaaattcgattatttttattcaattcttaatatgggctttacttgtctatgaatttgccaattatcttgatagcccatgcgaagatgccgaggacaagaaaaaataa

SEQ ID NO: 1374 - DNA, 1500 bp, Cryptosporidium hominis
atgattgaaagtacagaattttacactgaagttattcaaggaattgatactaaacttgctgtaatagcagaaaatgaaactatattaaccgagcaagctatactactaagaaaagagtatgaagctaggaagaaagaaattgaccgaataatatctgagatttgcgatgatcgagtgaagaaaatatatgaaaaggttggctcaatgattacaactcaaagaaagttatggagtattttgatcaacacaaagatttctgctcaagaacaagaagaaaatatattaacagaaaaaaaacaaattaatgaattaatcctaaaggagcttaacaatattgaaaaaatgtattgcgagaattctgaatatattaacaaaatagaagaagattggaaagatgtaaaaaaagcatctattgatggagttaaattatcaagagaaattgactgggatagtattcctgaagaagaattaggaaaaagattaagaggaggtgaagtattacatagggatgaatggatacctactcaagataataatactggccgtaaattatctcctgctgaatttaaatctcacttagaatttggagaaatgattcttaaagaaggtaaagatcaatttgaaaaacaagattttgaattatcttatactagatatactcaaggagtagaattattatgttgggttagaggatctgatcaagagtctgaatcacttagaattgaaatgtataagaaatttctaaagaatcaggcattattagcacttaaacttgggaaatataatgattctatacaatcatgtaataaagtcttaaaaattgatgaatgtgatgaaaaatctatctttagaagaggagaatgttacatgatgttgggacgatttgaggaagcaaaaaaagactttagatatatttgtgaatttgattacttttctagagatgccaaattacaatctagaaagaagcttgtagaaatgatgaaaaaatccaaatctaacaattatgttaataaaaccattattaataatttggatggcttaatgcaaaataatagacaagaagaagataaaaaaaaggttcaaattcaagatcattattctcctgctattcatcattttagctctaattatcaagaaaatcaaactcattctactagaaatgaaattcaaccctattttgatttggaaactacaaaagacattcttgatgagatgctttttaaatactcatctgaagagttcgaaaaacaactatttgaacttagaaaactttcagattacgatgaaaagagattcttaagaagaattagaaatgttctcccaggaatcaatactccaatctacgaaaaatacggtctagatctacaatctatgagttatgacaaagcaaaacgtattatagaggaaagtgtatcgtattggagaactaaagatgatcaagtaaagacattatctaaagagatatataaatatatcatgggagataccattgctgagtaa

SEQ ID NO: 1375 - DNA, 1158 bp, Cryptosporidium hominis
atggtagttataaatgaaatcactcctaaggcaatgctaccagggtgccctgtaaagcctttaggcggaggagaattttcatcctttaatatatactcaaaggaaaaaataagggaattattattaagtcatgatactgatatttcaagtaaaattagatgcttattttttggaaggtttcatggagacgaggaatcggcagagatgttatcaaagtcattggattattcggaaagcgtattattccgtcatgaagtcctttatgttcttggacaaatgggtttgaaaagcccattaacccgtctttatgaaattttggctgatgagaccgagcatcctatggttagacacgaagctggagaggctattgcagctattggagacgatgaaagtttggagattgtagaaaagtacttaaacgataattctccaactgtgagagagacatgttatttagctgctcactctcttagacttaaaagagaaaagagattgaaggaaagtaataagcaagacatagatacaaatatatcaaatattaatgcttttaatacaagagatccaactccaccaaaatcttcatgtgaagtttctcatatagaatcattagcttccgatcttttaaatgaagatcttcaattggaaaagagatatgctgctttatttgctttaagaaacattttaacaggtatcattgattcaaatcaaagaaaaagccttagtgatcagtatgaccagcaaattgacaatgataaggttcattttatcgcaggagaaattgctaaagctatggaaattgataaatcttcggcagtatttaggcatgaatgtgcatttgttttgggccaaatccaagtagtttcaactgctgatacactttctagagttttatccaatcaatcagaggaatcaatggttagacatgaagcagcttttgcacttggatctgttggttctaatgatcctagatgtagtgagaatttggagaaaatggataaattatgtacaaagaaagaattagatagagttagaaaattatccattgaaacacttttaaggtactccaatgatttcgatattattgtagcagaatcttgtattgttggattacaaactattatggatgagacaggatctttggatattttattggaataa

SEQ ID NO: 1376 - DNA, 786 bp, Cryptosporidium hominis
atggcaaatataattaaatcattttggatgtcactaagttcgatattcctatcggaactaggggacaaaactttctttatatcagcaatcttatcaatgaataattctgcatggataatctttgctgggagcatgtttgcattagctggaatgaccttatttgcatgcttgataggatttattttaccaaatctattcactccaaaatatactcattatgcatcttgtgcactgtttttcatatttggattaaagagtctttatgaaggattgtttttaattgagagtggaaatgcaaacaatgaatttttggaggtaaaagctgagttagataaatccagaaaaaaaatgagttcaataaccatagataataaattagaagctcttgatactggaaatatgttatttaaagacgttgaactttgtaataccagaaacaatgaagaagatttaaatgtatcaagtagtaagatctgtatagatgaatgtatcaagcataaaggactcttccgtataataaaaaacaaatcctttattcaagcatttactcttactgctttagccgaatggggagacagatctcaaattgctacaatacttttatcagcttacaatgatccattttcagtattttttggatcaattattggacactcaatttgtacaggcttggcttgttatggtggtaaatatctaagtaaatttatttcccctaggatggttacaatttctggaggaatcttattttttgcatttgctattgggggaattgtaatggggccataa

SEQ ID NO: 1377 - DNA, 2223 bp, Cryptosporidium hominis
atgggtggtgaaaaaaggaagcgaacaagccaagttgaagctgatttttatgaaaacaatgaaaatgaatttacgggaaatattcgtagaatacatagtatagagtcaagtaaagaagatttaggaaatattgatgcaagtgaacaattgattcaagatttactcaaatattatccagattttttttatcccacaatacattcattatgtagaaaatatggaagtccaagatttcaagaaattttccaactggcaaatacaataggaagtaatactaattcaattccatatttacaagttataggaatgccaggaacaggaaaatattcacttgtaaaggatatgcttaaaaaaaatgactctatttttgggtttatgaatggagcttacacaaagtggttatgtaattcaaaaggaggatgtattaataaaatttctatcgaaaacttatttgtaaagccagtcgaacaaattagaaagaaattaattaataaagggatttttaatagtaaaaaaagaagatccagaattggtttgtttgagagcgaattagagagctcttcatcagcgaacaatattattgaatttatagacgaattaagattaattaaaaaggaatatacagagtatttacaaaagcataacagtaagggggatagtgaactagatgatgatttaaatagtggaggaagtacatatgatggagagattgaagaagttgataaggtgaaatcaagaagtatttttttgattgtaaaagatgtaacaactatttcaaaaaataggccagacttactattaacactaataaaattacatgaacatttgagagatgtattaatacttccagctaaaaaagaaaaatttataataaatataaatttttgtttgatatttatagataattatggaattccagaagattttttctgttctcactctccttttccagtaatatggttttcaaattataatgatatacaaagttttgacattatggcaaatttaagattaaatactgatatcaaagatatagatctaaattatgaaatattaaaagtttatgacagaaaaagttcgcaatcatttttagtaaatacactactgaattcatatattaagggctcagtggatttcattcccaaaactgatacaaattcaaatgggataaagctaaatttattaaaagatgatacaaataaacaaagctttatcccaattgatatactttactcaatatggacagaatttatcgcagaaattatcaccattttacatccatatttaagatcagattttagagaaattatctttaaagttcaatgtttatggccagtattcttacttccacttgtttctggtgaattatttttcacaatcaatgaaaactatgaagatgaagtatattctattgtacaaacattattaaataggtttaaaaggcattatggtactttaacaaagaatatatattctcactttttaccagagttatttcaaggagatttaatctcaagtaatattaatactaatgggatattaaactatgaattcttgaaaaatgtttctcaaatcaatatgccttatttcactaaattactacttgtttctgcatatgttgcttcaaaggtttcaaagaaggatgacaaaacactttttcataatttggtatcttcaaaactcaaatcaaaaagaggtagaaaaaaaattaataaacaaagttcggaaaaagttaaatctaaaaacaaggaagcattttcattaattcgttggattgcaatagctgattgtattgctttgcacattactggcaaacaagggatagaattatcagtacctatacttgagcagataaatgatattgttaggcttgggctagtaattcctgtttcaggaaagtggagccagttagtattagcaaaaagagatgttggtggaccattattcaacatttcacctcttcaagatttaactcttggccaaaatattgggcttgaagttgcaatgtataaacaggggaatgctggatttaattattgttctggactcaacggctcgtctaacccagcttctacaaacaatttaaagttaacatatttggaatcccccataaatatggaagatccacgagcattatatataatgcaagctccgagcgagatgattgaaacattttcaatagaaattggtgtagttctcaaggaaattattccagaaaattga

SEQ ID NO: 1378 - DNA, 3477 bp, Cryptosporidium hominis
atgggggttaaaggtttgtgggatattgttgctccatctggaataagagttaggccagaaactttagagggacaaatattggctatagatgcaagtatttggctaaagcaatttttaatgggattaaaggataaagaaggaaaaatacctcaaggtgcgcatttattgggtttttttaagagattatgtaaactattatactatggtatattaccagtaatagtttttgatggaactcctccagatattaagaagagaactttggagttaagaagaatgcaacgagaaatgtcagaaattaatatgagaagagtagcaaataaattattattaaatacaataagactaagagttgctaaaaaggttaaagataaggtaagaaagaggaaggataaaaagctctcagatgaagaatataaaaatcaaattgataatggtgagagcgaggaagaaaaagaagaagaacaagtacaagaacaagacgaaagtgagagtgagaaaattaatcaattagctacaataaatgataaaaataaagttgaatacaagaataaaagaaaagctcatcattcaatggaagaaaaaattagtttaactcccaaattattttcttcagaagatgagaataatattactgatgatgatgaaggtgtatataatcgaccaaatcgtaaatttaagaaatatggaagataccaacaagttcatcatttaatcaatgaaacagaagaaaattcagaagtaccaacaagttattttccagtaatgggatttttgagtgagagaagaagattagatgaaatgcctgaaatagatacaaatttattttcaatgccaattcaaattagctcaagtcaaaaaatagcttcaaaaaaaatgaccaaaattgaagatttaaatgcatttcttagagtaactgaatcaagcagtgatgaaagaagattaatggatctaccattagatacagaaatagatccacaagtatttgagcaattaaactcaaaacttcaatatgaaattttgattcaacttagagatgcttggattaatgcattaagaagtaatgctgttgatactaaagataatatgagtcagtttagtaattctcagattgagtgttatttgagatatttgagaattaatcaagaaatagagagattaaaggtaagaatggctaaagaatgtgaagaagagcagatggaatcagttaatgaagaaattaaagttgttgaatatggtcaaatttatgatcctgacaataatgattttaataataatattcaagattgttcatcttctagtatatttgaagatcaaagtaaggaaactatcaatgaagaacttaatattgatcctaacatagatgattctacatttactggtaaaattattaatttttcaaagaaaattggtatagataataaagatattgatacatttaatcgtaatgatacattattaagtagtgatatattatcaatgaaaggatatcataatttatctaaaattacaaaaaaagagagaattaaatttcttcaaagtactgattacacaaaaaatgataatattgtatccaatccactaaatactccattatttgagcttgagaaacttttgaataacgaaaatatacaagaaagccaaattcaaaataaagtaaacaatacttttaatgatattaatgatattgaaagacttgaattattaaaagaaaatgtggatgaattatttaaaattaataatgaaccaattcaaaaatttgaagaaaaagatgatggatttattgtggatattgagaatcgagtttatcaagatgaagattataaaaaagtaaataggaaagatgactttggtaatgaaggtcttgatgatagttatgatgatgatgatgattggcaatacattgaatgggaaagtgctaacacaattcatcctaaaccacaagaaaataatcttgattccttacaagttattaaaagtattattctttctaatgatttagtttccaatattgagccaaaacttgatagtattttgggattagaaaagattgaagaaaatgatgaatcaaaacaagttattttaatcgactctgaggaaattaaagaacagaaaaatgatatatatttgattaaagattcaggcaaatatgaagatggctttaaaaaaacggaaattggtcaattagaaggtcaaatacaagatttggaaccagaaaaagaacaggaacaagagcaccaatcagaacaggaaccagaacaggaactagaacatgaaccagaacaggaaccagaacaggaactagaacatgaacctgaccaatatcaagatcaagaacagaaaccagaacaagaacccgagcaccaaccagaacctaatcaagatcaagagcgtcaaccagaactcgaacaccaaccagaacttgagcaagaaccagaacctgatctagaaccagaactattagactattcctatttggaagatattaaagaaatcatccaaaaggaagatgaacaaatcatggacatgagcctttttagtgaccattatgcaatatatgacaaaaacttggatgaaattctttttgaattggaaaaagaacaagaagaattaagcttagaatttactaagcatgatatcattttgaattctgaaataacaaaagaaatgcaatatcaaatatgtctgcttttaaaagctcttggaattccttggattgattcaccaggtgaagcagaagctcaagcttctattctaactcaattaaatatttgtcatggtgtattatctgatgattctgattgcttaatttttggagcaaaaaaaatttttcgtaatttcttttctggaaatagtgttgaaatgtatgatctaaatcaagttaaaaagtatcttggaattgaaaaacaagaacaattctatattcttgcaatcttacttggttgtgattatactgttggagttaatggaattggaccagttaatgctgttgaagtacttaaagcatatcctgaacttgaagatatgattttatttcaaaattggtcaatgaataagtttcaagataaaagtaatgatctaattaatgatacttttgaaagagctgaatttaaaagaaatcactccaattatagacattcttgggtatttcctccagatttcccatgctttgatgcaattcatgcaatgaaaaatccaaatattatttcaaattttaaaccaacctttggtaaaattgataaaaattcgactattgaattaattacaaataatacaaatctaactcatgaaaaagtatctctaattattgatccaatcattaaaaatcaaaataataaatacaaacaaacaaaaattgatgaattcttaattcaaaatcaatctattaaatttaataatcatcatattcaaaaagaagaaaaagttgcatccattatttctaaaagaatgaaaaaggctctaaatcatctcaagtaa

SEQ ID NO: 1379 - DNA, 426 bp, Cryptosporidium hominis
atggagaagttgaataataataataataatcttgaagaaatgaagattttgaaattaataaatttcaataatttggaagatatattttctttaataaaagataaaactcagtctcaatcaagtgggaataatattagtaaaaataatgaaagatataatagagctggagtacttggacttatttcaataatattaagtcatccatatgatattccattttggcttccagagacaataactttcttagcaaattatagtggtagtagggatatttctcaaatattaaaaaaacaaattcaggaatgtattcaagaattctttaaaactcatcaagatgggtggaactttattcataaacataaatttaatcagtatcaattggagattttagatacttataaaggaagaccaacttactttacttga

SEQ ID NO: 1380 - DNA, 1113 bp, Cryptosporidium hominis
  misc_feature (1008)..(1008): n is a, c, g, or t
atggaaggagattataattttcttcttgatgaggatattaagaaaaacttttactttatttttaatggtaaatttgatagagaaactttgatggaaaaatttgaacaaagaaaacttttgattgattcattttttggatattgtatttttgaatttttagaacgtgttttaaaccttttggaaaatgttgttaagccttcagaaactgcaagttattcatcctctgttgatcttggaatttcttatgctttaagagctttaattattagtattttcactaaatgtaaacaactgggatataatcaacttttaagagattgttatgaaatgattggtaattggatttctaataactatattcctgacaactacaaacatctttctaagatactttctgcaatgggatcatgtgatccaagtctttcttttgagtttattctttcaaaattattattaaaggttaaagctggctcagaatatactcaaaacatcaatcatgatatttctttcatacaagaagaatttaatgggataaaattcattaacgataaaaatagtttggaatctgaggatgaatcctttatattgtattatattaacttggtttcaagtttaatcagatacactcaaaattatctattaaggaacgaaaatagagtctactatttcggaatctattcattaattattgaacttctttctgattctagaagaaaaattaagagagctggacttaaattagaacaaagatttattgaatctttaatacatatacaaattgttgattataaagattcatgtttagttccagttttaaagagttctgattctattgtaaaaggaataattctttggggacttccattttatgtacaagaaaaatctattcttaatcatgttcaaaaacctatttggtttatacctcagagaaaatgtttacttgaagttaagtctttaatcattttcaattatttgtttattatcaagcttttgaaaaagattattcanatagaatctactagctctgggatttctaatttattggataacttatatcaagaatatttgcaaatttttaaagattctattgataattttggtttctcaagatga

SEQ ID NO: 1381 - DNA, 1305 bp, Cryptosporidium hominis
atgtcgtttttcaataacctttctactactggagggcaaggactcgggtttggtggaggatctacaagtaacttcagttttggaaatccctcatctacaagtactaatttatttgataacaagtcctccttatttccaacacaatcaacacttaatagctcaaataatgctttatctactagctttctaaattctaattcaactagtaccaatttatttggtacgtcaaattcaaatcaaagtcaaggaactggattaaatttgggaacaaattcgttttcaatgaataacacacagttcagtagccaaactcaatcagctactttaaatatgatgaatttgccactccaacaaagacaagaacttgagagaatagagaaacgaaaagtgtctttacaaaaaggactctctttacaaatgaatcctactatgacagcattgacataccaattagatgaaaaggctccagaaaaacagcaagaagtggataattacatatattataatttaaatgacgaaggaattattaagaacttaaatgatgcaaaaaaactcaacccaaatccaagtaagtgttatactctcccaattaagggatttggagaattagtgcaaagagaacaacaacaaagaaaagagctagaaaacttattatgtgagatgaaatctgttaaggatgaaaatgttaaaattcttcagacattgaataccagtacaattaaaagagtcgaagaatgtaaaaaacgtcatcaaagtataattcaccaacttgttcatatttcatgtatgattgaagaatatggtgagaaaaaccattttgcccaagttaactaccaacttgacaatcaattgaaccaggttttacatcaaattcaagaaaaccatatgaggcttggagcttggcaatcttcaattaaccaaattgaaactaatatcaagtatattgatgagcaattgaatgataatgattcaaaaaattgcaacgatcttaagaatcttcttgagagttctcctaataagtcgggtaataattctttttctgatcatcttaattcttctgatcaaaaaggatctgaaaataatcattcaatttctgacttaaacagattacaacaaaatcagcaattatcttccacaaatggaatatattctgatatctcaaagaactctagggaagcctcaactaactctccaagtaatgtagaagccatttttgaaactctcgatagtcagcaacaactattagagtccttaagtgatactgtcagaaacgactctctattaattcaacaattcatttcttag

SEQ ID NO: 1382 - DNA, 564 bp, Cryptosporidium hominis
atgggtattgatttaaaggcaggtggtcgtgtcaagaagactcagtctaagagaactcgttcgacaaacccatatcgtatattgttgtcaaaactctatacattcttgggtcgtagaacaaactcatccttcaatgaaactgttctccatcgtttgaagatggctagaagattccaagcaccaatctctgtatctcgtcttgttcaattcatgaacggaaaagaaggcaagatcgcagcagttgttggtactgttactgatgatactagagtcttaaagatcccaaagttgacagtatgcgctttgagatttactgagacagctagaaaacatattgagaagtacggtggcgaatgcttgactttcgatcagctcgccttaagagctccaaagggttcaaatgttgtcttactcagaggaaagacaaaggctagaattcaggagaaatacttcggtagagctccaggtttgccaaagagcacatcaagacctcgcgtacaatcaaagggacgcaagttcgagaaggcaagaggtagaagagcctccagagcatacaaggcataa

SEQ ID NO: 1383 - DNA, 4032 bp, Cryptosporidium hominis
atgcctattaatcaggatataaaggagatggaatatgacagtctgaagactggcactaatgggtcggatataaaactttcacagggggtactggatgagaatgaccctgatagcgctaggtttatgatattgattagaaatgctatggaagatttacaacaccaagtagaaactgagcgctcattgtatcacaaaagcagggatgaattatcagtggcagaatctcaaagtagaaggtttgagactgaactaaatttagagaaagaaagaaattcccagcttattcaggaattggataggctagaaaaattgctttctgagcagactgatgtcaataatacagttaattctgaagaagctgataattactggaatttatataaggaagcactgaatagaatagatgaactagaaagctcaatacaaaataataaacgtgctgaagaacttgagttagaaaaaacacaactagaaaacgagctggatagttacaaggatgtgatttcagaatacaaatctgataaacaaaaattaatcaatgaaattaattctctaaaggaagctagagatctgggtgtcagcgatttacaaaatgttaagaaagaatatgatgagatgattcaggatttgaatgaaaagctggcgattgaaaagattgaacatgaatcacttttagagcagtatactaatgtaaatacgagtttggctgagatgaacaaaactttgcaatcaaatgagtactcttccttggaagagctaatcgatactgttcaaattaagtgtaaagaaattgaatcatggaagaataggtttcatgatttagagtctacagcaggagttaccagtgaaaaagaaatagagctacacgagagagaaatctcaattgtatctaaagaaggatacttagatggaaaagaagcatctctatctaatttggaagaaaaactgaagctccaggagcagaatctgaatgacaaagctaaagagctcgagcaaagatccttaacggtctccaacctagagaaagaaattatggaaaagcagaaggaatttgagtcatatgttgatgatctaaatttaagagaacaaagtttcaacaggatggttgaagattattcaatgaatatggaaaaggttcagttagaacaggattcagactataaaaagaggctagctgaaatcgaaaatgcaaaattagagctggagaatggtaaggttgaatatgatcgattgaagaaggaggtaaagaaaaatcgtggcgaaatagaggctgaaagaagaaacttggagcaaattaagagtgaattggaacacaaaatgaaagaggttgatgctggaaaagctgaaacggagaaactcagagcagaacttaactctcaaaaagacgaactagataaacaaggtattgaacttaggtctcagaaacttgaacttaacgaaaaaaagaaatccctagatacactcaaggacgagcttgtaagcctggagaaggttttggcggcaaagtcaaaacagattgaagaggatgagcgccaaatatatataaagttggagcatgcaaataatgatagtttacagaagatgagcctgcaatatgaatcacaacttagaagtttggaaatagagttgagagacatcagaaaggagttggatgaaagcaggaaagcattaaaggaggagcgagaaagccaagaggcaaggaggtctcaagtggctcatcaagagtctcgtctaagagagcttgaggagagagaaaagtcagtaaaagatttggagagtttgctaagctcacagaaggtggacttagagaataaacaaaaggagtttgatgtttatattaatgagcttgagagtcgccaaaaggagtttgaagagttttggtttgagttggataagcgtcagaagaatatttcaacaagagaaaaagagctggatggcagagaggctctattgaataatcagagagctgctctgagcgagtctgagagaagatctcttgaggagagagaaggacagttgtatgaaaaggaaagcagacttaaagataaggaggggaagttcatagagcgtgagagtaagttggttgaaaaagaaaataagttaattgaccgtgagaataagttaatggagaaggagaagggcttactagagagagagatgggtttgaatgatttggagagagaaatgagcagtttagggcagagaaccaagcttgttgaagaaagtctccttgcaagggaggtaaaaatagaggagaaagagaacacacatagaactagggagtcaaatttaggtagaagagaggctatattgattgagagagaacgttccatggatcgtagagaggcagatttgaaggagagggatttggagctaaaagatcgcgagagagagttggatgagaaagagagacaactccagttggagagaaagcctctccttgatgagttgattagaattgaagaaagagataaacaactttttgagcgagagctggctattcaaagaagtgaggaccttttacaagagatggagggggtgataaagagtcgtgaaaaagagttatatgaagaaaggagcttttccaataaggataaggaaatttatgagctacgtagaatgattgaagacttagaattgaggaaccgggatattgaaagagaaactcagaagacttgccaagttctccaacagcaaattcaagaagagatgaaacaaaaagaagaactcctttatacaatcttgcatctccataagcaaattaatagtattggaagctctcttggatgtggctcatccgatggagctgggccgcatgataatagggatataagacagaatactgccagcgttcagacaccctgcgtgaatgggggagagtcaaataagggttcaaccacaaacgaaaatacaaacgaggcaaaaatttcagaagtatataaaaagaacagtgatgtaattaattctttggaaaaaacaatgaaaaagctatatgagaagctccaggccacagaaagccgagagaagaatcttttaaaggagctgagacaattcacagaaaagagtaagagctctaggataagagcaagttctacttctcctgcaattaaaaatatgggagggtctgatgtaggagagcatacctgcgactcttcagctctgccaggttatccaaatgaagttcaagtagttcctgaaatatcaaaaccacaggatgcaagagtaccaacactcttaaagtctacctacatatcaacaagtgactcctcttcaaatcagcaaatccttccaacattaacaaacaactcccctataatgtatccagagtcacctatggtcttaatgccactacttacggacattaaaaacgaattgaatgaattaaagaggagtaatgaatcaaatataaacagaaacattcagactgatgaaaagtttactggaaacatctcaagaccaggagagaaaagtaatggcgtaactgggattagcttcatccaaccaactcataacaatacagtaacaaatacgaattcttctcaaatatatgacaataacttaaatatggattattgtatatcaaatggttatgggcccaatatgaacaccaacaatcttccagcctcttccagtattaatcctccaccaccaggctcactcatgaacaatacaaacctacattacccgtccatttcatcatcagttatgggaggtagcgttcatgagcaaaaccaacttaacgctcaagcttccaagattgcatcaattctccagagtttgcgtccaaatagtgggtcggccacaagcaattctgttgtgccaaacaaggatattgccagaaagttactggaacacgagctccatagtttaaggcaatggaagaaaggaatgaagcaatgggactcagaattctcagcatcttcccacaataaacaggaagaggcaatcgcttggaaacaatttctagatcagcagatgcaagttattgctagaaaattagagaggagaatatctgctgctttacaaaagtaa

SEQ ID NO: 1384 - DNA, 3561 bp, Cryptosporidium hominis
atgaatggtggtaataacatcctaccaacaatgtcaacttatggaagggaaatggaccaccaccactacaatggagttccttcatcagggaattctaatatgttaacaggctatcctattttataccaaaacaaccaccacaatcacccagcaggagacttgcttacattgcaaatgcagcttcagggaaatccatcaaataacgaaaatgaaaacactttagcagccttacagagaaactggattgctttgcagcagaataatggtaatgttggtggaacaggaactgggaccaataatggtatgttgcattcgtcaattcatcacccatctgctatgacattacaaaatgacgatatgggatatatgaggaatttgattccaattggtggaagtaactcatccccgctccattctaaccaatctactcttttggattcattaaagtttggaggtggtttggagcccccacaagtttctcaatatggccatcatcatcatttggcaaacgggaacttgcagccaagtattttggacaatggaatattagggaacaacgtgggaattccaggtatgtgtcgtaataatccaatgaatgttggaacatctcctaatggtagattacagatgcaaatgaaccctaataatggtctgggtgtgaatgtagatatggttccaaacaatggaatgctcccaatgaattgtaataattctattggtggaaatgtaattgtaaatacaaatccaaacaataatattgaatggcaaggaggaataccaattcgtaacattcctgatctaatgacaatgttagatctttctgatataccacctcatgtacaaattccgaaatactacgagggcattaaaatatctctaggagaggcagggcgtgaaattttaagatgttatattaatcaaaggggtattaggggaaagtttatgagttctagtaatcttcagcaattattgagagttgcacatcaatgtggactatggaatgcagcagtaaggctgcatttggagtttattggagagattcctatgacagctagtcatgctgaaatgaggaagtataagagccttcagacaaagcgtaggttatcaaaaagaatctcagttttgtctaagtttggtgctcctgttgttcgtagagctgatggagaagaaactattgaatatagagatggtatgaagctttctcttggggttgatgggagaaaattactattaaaacgaattagagaaaccagaagttcaagagaaaatgagataaataatctgttttccaaatatggattaaaatatagtcaacttagaaatgctactatccacgagttgtgtagaatggcttatgtttgtggtctttgggaagaggctgttaagctccattttcaacatattaggaagaaagcccatgaaaatacttcaaatcagcaggaatctggaagtgatcttgatagtgaaatggacttgaataaggatagaggagacgacgaaatgatatctaacaactttttgcagcagcttcatactcctggcattgatatattaaatgtaaatggtgcaagtaaccctggaggtatggcaggaggtaatgcaggagggatttctcaaaatcctgtcatgggagctatgggtgctgatcctgttcatgttggaaattctgctccacaaaatgcagctcatcatgtgcatcagcatccctcaatacatccagtttcacatattcaatctggattgggtcgttttggtatgtcatctgttggaggatctgttccaaatggtcctggaaataagtctggtagtgagggtggaaatgcaaattcgaatgtgaatactaatagaggcatatctggtgcgaattcaatgattggaattgtagataataatggtggtattcatccatcaattgtactatctaataatggaggatcaactggtaataatgctgatgctcatgcattaacaggagaccatttgaattatgatgattataggaattatattctagatggaggaaataatgctggaaatattgataatactggtttgtcatctatgagaagtggagcaatgacaaatataagtagtcgtattattaggcatgatgcaagaggaggtaatatgggtgcctcttcaaatggtatggataaggtattgggtagtaaccctaatgctgtgaatgggacaggaggtaatagcgctggaaatggagttaagagtgttggcggaaacaatccagatgtggataatttgaatagaaacaatatcttaaccggtattgaaaatgatggtctaatcggtatgtcgtcaacaggtgctttaggggcttttgttggttcgagttccacaggaacaagaagtggtctttcaaattatgatagtattggtgttccaacaacatcaagtacaggatatgatgattattcattattatctgcgtcattaagaaagagaggaaaggttaataatatggtttcaggtcttggaggagtagatgactctaattctagtgacttgacagctcataatattgtctcacaccctaatacatcttcatttgttatggagacaatatcaggtattctaggagatgaacctttaggtaacaataatattggcgataaagtgaataattataaaggtaacaatttgtcctcagtcctgggaaatgatattgggatttctcaaaacaatgaagttcctcaattatcagcggtagttgtgttagcagcagcaaaggcagcagaagcagcacaaggttatgataacaataacaatgataatgttaaagaactttatgaagagagtgaaaatacgtcaaatcaaagattagaagctgttgattcaatgttaaaaagtcaccactcagcgtctaattctccagttttatcacgggatggagaaaagaatgaattatcatctgttactgtctcaaagccgttagaaaataatgagggacttaacaaagatttatcagtggctgctgaatgtgaagaaatgacaagttatcagaaagattactcaaataacaataatagtaatggtaatggtaatgttaatggaatagaaatccctttagagtcaaatatgttattgaataatcatcacaataaccatttattaatggatacagttcattccaagatggtatcatcaggaatttgtataaatgccaagtatgaattaataggaaatgaaataaatattggtcatacaaacaatagtaatgatgatggtattatttcaactgaaggtgtaggaggtggtgttgtttctacttcctctgccacagtaacatcttctacgtctttggaagtatctgatccattttgttatcctactccaatagctttatcttcagcatcaaaccatatagaaaagaatgaaattaacgatggccgtagtaatggtgatcccattattaataatagtattgataacagtactagtaatactggaaatactagcaatacagaaggtggtgtttcattggtttcaagaggtttaacaactcaatcaacaactgatacaagtatagaaacaccagggaattga

SEQ ID NO: 1385 - DNA, 876 bp, Cryptosporidium hominis
atggatggacaaattccattgtgtataggaagagaaacagtaccaaaacaagaaacttgtccttcaaattatgaacttgtgacagcctctgatactgggttaagaagatgcagaacatatacaaaaagtgaaccaataatagcttgtgcgaatggatttgtagaggatactcaaggttgtgtacaaactattacatcttctccaagactactatgcccagaagactatatacttcaatattctagatgtattaagcaaattgaggatatgccaaataaaatgtgtccagcaggatttgaattgattgacgatgaccaatgcagtcaaacagtttactcgaagccaattccaaattgtcctgacgattatatgtttgacaatatcgttaaaagatgttataaagtagatgtccaatatgattttgcatctgtagatacaggtatttacaaacaaaattttacaagcattgtacagacaggagaaaagaatgatgataaagaagaaaaaacaagtgaaaatgagacaattaaagaaacttttcaaacgaataatcctcctttccagaatcaaattccaaattatcctggcggaaggtatcctccatatcagagaatgctccctcctcaaactcaatctcaatccataaggccccctccagttcagacaatgtatccaccacaagcatatttacaaaatggagtttattcgagctacggaggaatgatgcctcaacctacacaacttaatactggtgctgcagggtatggctacccctttcctggcttccaacaatatgcgcctgctccaaggtttacaaatagtccatcttacccagtttatatgagaagtctttcggaagaaaaaaatgagttataa

SEQ ID NO: 1386 - DNA, 5433 bp, Cryptosporidium hominis
atgctgaatcgactgtatatggccgagaaggccttatctatacttcgcagtggcaatgctataccttatcctgaaccacaaggtagtgtaagaagtcagtgggattttttactacaggagatgacatggatgtcaaaagattattatgaagagcgaagatggaaaatttatgcagccagacgtttatcacaaatggttcagaattattggaggaaaaagatgctcaatttggaacgccatatttcatctaaatgtagcgcattaattcagtcattttggcttgggattgctgataatgtagatcctgaattaataccaaatgatttgaagccatatacaatggttgttcagcctgcacccgttggtgaggatggtcagggtaacgcttctaaaaggcgtttatataattattgcataagacaatttgaaaggagtttatatgagtgtggaaagcttaatgagttgaataagactgctaacgacaataataaggagaagaaagttgagaatgtttcagaaaatgagattccagcctctccaatgagcattgacatcgaccatgacaacgaaagttgtcagtgggtagtagatgaggatttattgctacagttggatccactagtctttgtaaaaactgcaattccaccaactgcatcatccacagatataattgatctagaaaacattccaaataaggcttcaacaaccaatcaaaatataggatcttcggcattaggtgggacaaatgcaaatacaaacacaagtaatacgggaaatactgttgggaattcttccaaatcttcatcaaacaattcagccataaccaaatattcagaaatatccgatttatttaacgaattttcaaagaagcaggaaactgtagtggatttgaatgattatcgtaaatatctcgagaattgggcagatactgttcaagtactacttcaaggacctggaataattaatacaagagcagagtatcgcccacctaattttcatttggattcaaagaattatttggtcgctcccaggtctaactttctggagatggaagatatatctctcattctttctctgtttgtacttgcagtggatcacttaccagcattcttaaatcgttatatggcatcatctccttctaatgttgtatatagatcttcaggaggaatgatatcaggttcttcgtctcatgaatctatggtaaacgactttaatgtagaaagtaaaagaaagagtaggagaagagcagcttcaaacacaaagaagatatctggtgtaatggctccacacattcaatcctcagtttcaatgccacatggagtttctggtggtattggtcttccacaatcttctgcggtgtcttcagttggaggtgctatgggtggaggagttgcaggaggagcagtctctgcttctggagggatttcaggtcctagcactgttccaatggtgggagaccaatctacgagctttgatattcttgcatatgctgatacttgggatacttctgaagacattatattagtttatttcgtttctcaatactcttcaacacctagttgtggggttttgagcaaaaagttggtttccacaacaaattggaacctgattgcattatctcataattacttttttggtgctttatatgggaggatgaaaacagcaaagcaatgtcaagaaaggtggaactttttgaatagggatgaaattgatggatcatctattgagcgtgttgaaaagaatgttaaaaaggataaagctgctgaggatgaagctgttagtaacaatggagaattatccgggaatgcaagtaacaaagaagcagctagtgctatagttatgactgaaggcaacgatacaggtaatgttaccaagagcgatatagatcggttgatgaggagggagaagcaaatccggataatgcccaattttaacaagcgatatattataagcagtactcttttgaaacatttaaaggagtttagtaaatctttggaagattccgagggatctgaaaacaaagcggagaatggatgccctaaagttgcttcagaagaagttggaggtgaattggctggaacaatagattcatcttcaataaaagattcaaaggaattagagaaaatggaaagtaatgttactgatggtaaagctatttatggagacaacttgctatatttcaagaaaaagataattcctaagatgaccatattgaatttaatcgaaaagagcaggaatgtgagaagtaagaccgagaatcatttggagaataattcgggttctaataatgataatagtgccggctctagtatattagcttctcagaataatcagggttctgaaagtacccatagcgaagttaaaagccagaatattgtttccaataatggtgaagatggtgaatgcactaataggaggaataacaaggggtcaaataatattaagacggtaagctcttatcagagagagcaattggagcttttatcttcaatagtgagcaaatttggtgcaaatatgagaaagaggtcattacagaatcagcagtttcaagactctttccagattacttcttatctacagacaattcaacaaaattatgggtcaaacatccttcaggacggggtattaccacctcaccagagccatgcaaatctagtagcacatgttaatcagatgctaaatcaacatatagagtctacaatggccaattataataatactggaggtagtaatgttggcaacaatactgccacaagtactaatactggtggcgtaaatactaatcccaataatgctgggacttctaatactaatgctggtgggaataatatcaacggaaatgttaacaacaatattggcggtggaggtagcattgttggaaataattctaatggagtaattaactcaggctcaggtggtcctagtaccagtagtaacatgccgaatcatactcaaggtaattccggtactcaaatgggaggtggagctcaattaggatcttccaattttactcctcttccaagcggaatacctccccatttattagctccagggaatcttccttctgcaactagtgttgaggagtatctatctcgtttacctgggattgatatacagctaaagctgatcgattattccctggataggtatcgccagagcacaatgggaggaagatacggaggcactgggattttgatgtcgacttcttcaacatgtagaaagcctcaattacccgagtttttgctacagcgctcggtaattaatagcggagctaattcaggtatggctggtgggcagcaggggaccaatattcatggagttggccaacatgttggaatggtgccccctcaacaggggatgattcatcagggaggaggtgtcagcggtggtgtgggaggcgatcagcaggttcctttgcagcagtcatcttacacccctccagtaatctctggacaacctggtcagatgattcttccaaataaccagatgattaagatgaagaagagggagattaaccagaaacaggtggttgctcaggccagcaatataaagaggaggaaaaccaatatgattcctcccaactctcaaccaaatagcatgatggggccaaatggagttcaaggggaaatgattcagtctcatggaaggattgggatgatgcagggaatacctcaacatatgggaggagcaggccagggaattccacaaccacattcccatcctcactcccatcaccttcaacagcaacaacctggttcctcttctcagttacagcctcagcaataccaggctcagcagtaccatccacaacaacatccgcaacaacatccacaacaacatccacaacaacatccacaacaacagcaacacccacaacaacaacagcaacacccacaacaacaacagcaacatcatcaacagcaaatacaacagaaccagcattcgattccccaagttcaacatcatcaccagcagtaccagcaacaacagcaacaacagcaacaacagcaacagcagcagcaacaacaacagcaccctcactctcatccccatgttcagcaacaaccaatccagggacaagcacacactcaacatacatctcacccttcattaggtaattcccaaatacacctttctatgcaacaaatgcaacaacaaaaatacaaccagtatcactcacaacaggtaactccccaagcccagtcttcccaccaacaacatcatataggtaatccatatcaacaaacccaaaatcagggccaatatcattctcagcaaatgggaatgatgcagggtccaatggttggacctgatgtacatggaggaaattctactgcaggagcttatggccagaatatgggcactaagagaggagttcagcctggaggaatgaaccacccatctgcacagatgatgaatactcagggttcccatggagctgtaggcggtatcgggagtgtctcatcttcatctatagtcggaagtaatggtaatagcggtaatagtgttggtattggaaacaatgggaacggaggaaatatgtctaggcaagtgaatacttatataggatactctggtatgcaaagcagaggagggaacgggcccggggatatgaactccgggatgggagaaggcgtaatgggagttgggatgaacgtgaatgggcctggacaagctccaggggtagcttcacaccaagtttctacaagcggccgacttattcctccatcttcgtcaatggatggccagaggtacagtaatgcaagctcaaatgcaagtagcatgaatggggttggaatgggaggaggtggagtctctggaacaagttcgggattaccatcaaatgagaatagcatttcaggaactcacaagatggtggcgggaggtatccctcaacatcaacaacagccgcagtcaatgcagaaactaggagtatccaatcctggatatattggaggtggaaatactggcacaatgggaggaaataactccgaaatgtgggttggcggcggaaacgtagatttggtaacaggaggaggccctacttcatcacagtctcttccggtagttcaccatcaatctcactcaaatattggaagcggaattcctcatggcacgggcatgatcagtggaggaggtggaggaatgcattctgatacacacttaggaccttctattaagcaaaactcaatgaatcagcattacagcaatttgactggagatttaaattctaatattggagcagcagcaactgcagtaggaggagctttgaatggagtccaggtcactggtggtatggatgagggggtaagtattactggagctggccataatactaccaattctactaatacaggagtaatttcgacttctaatttaaacattaatattgctgataaaactaataacaacatcaatagtaattcccaatga

SEQ ID NO: 1387 - DNA, 1155 bp, Cryptosporidium hominis
atgatgagaagcaaaagattgagttatatcccaacttttgaggatgaaaatgattttaaaagcaatgatttgaaaaaggaaatgaatgatcaagctatggaaattgatgactgtggttgtgattatgaagacttgtttactcgcgataatactgagaatgaaagagaagatggagaaattgagatgattgatgaaaatgacgaaaatgagcaagaggaaggtttatacaaggatattgatggtgacgatgaaaatgattatgaagaaagtgaagagggaagcgatactatttttccattaatttctgaacctttgaaaacttttgttacagtaaatccagcaacacttgaagacgaagaactttggccattatctagtttgaaaagcttatgcgaatatgtgggaatttcagtcaagggaaataggaggtgcatattaaatagattacaagcttggaatggagctccattatctggagctgggcatccagactcatatgatacgcgttcagcaagatttcatactgttccaatggtgtttttagaaaaaaataaggtagatcagagaagcaaaacaagaagttgtttagaaaacaagatggagaagaacagaagctctctaggaatgaaagattctttaaatgaaaatgggaatatagttggtgaaaatcgagaatttgatgagattgaaggcaaaagtaataatcttaaaagctttcattctccttgtattattaaaagaatggaatcattaacttcaacccccgtaacatcttctaaaagagaaataaagtcgtgtttgaataccacaagtactcctagaaagaaattaacacaaacctcaaagtcagctgggagaatttgtttttcaccttacaaccatgtaagagtttttgtatcaaacccaggggagagagaactcaatatggatcctgaatcaattttaaggctgattgacgattatgattatgagtttgaagaagatgataatcggttattaggagaatcttgcaatacaaatacaaacaatttagtgaacgaatttcaaaataaggagacttttttgataactaataagaattatattgatgaagagaatagtaacaagagcaacttctggagtaattctgcaagtgtttttgcatcaaatgaataa

SEQ ID NO: 1388 - DNA, 1152 bp, Cryptosporidium hominis
atgactttggaagcaacagtaatttgtttggataattcaaactattcaagaaatggtgactacggaacatcaagaatgctccaacagcaagatgcaactaactttatctctggaatcaaaactcagcagaatccagaaaatcttgttggaatactatcaatggcaggcgaaagaattgaattgagggtaacaccaacatcagatttaagtaagaccatgcatgcaatggatgggattcggcttaatgggaagattgatcttctcagaggaatacaaatcgcacaattggctcttaagcatagacttaataaaaatctaaggcaaagaattgtctgttttgttggtagtcctctagaagacgacttaactgagaaacagctagagaagcttggaaaagttttgaaaaaaaacaatgtttctattgatattattagttttggagagattctcgtgaatagagaaagactccaagcattggtaaatgctgcaaataatgataataccagtaacttcgtagaggttgctgctcctacaaacttaactgatgcactcatggcatctcccattgttcttggagaaggaacttcctctggagtttatgcagatgggcttgctggagctgctggagaaacttctggatttgagtttggaattgatcctaacgctgatcctgagctttatatggcactcaggatgtcaatggaggaggaaagaaaccgtcagatgaggcttgaaggcaatactggaggaaatccctcatctacagagcctgttaactctgcacaaggtcaatcaacaaccaataactttgactctatcccaactatcaatgagattaatgctatggaagttgatgacgagcttaggcaagctcttttgctctctattcaagacttttctggcaatgattccaccaataacactaatactagtaatcagcaacaaggtacatccacttctgaaaatacatctaatacttctacaaatcctaaccaagggaataatgctcaagctggaaatccaagtgatccaaactctattgaagggcttattcaaggaatcccaggagttgatattaatgatccaagaatccaggatgctttaagacagcttaataagagtgattcagaagataaaaaggataaacaatag

SEQ ID NO: 1389 - DNA, 1272 bp, Cryptosporidium hominis
atgggatcatctgatagcaataaggaatctcaaactcaacaatatttgatagtggcatgtgccttaactgaaaatagtaaggattcgattaaagatgaactgataaagagttcaaagaatatcagctcaaatgtgaatgtattggattttgatgttccattttcactaaagtttggagcatttgacgatttagtcaagttagtggacgatttagccaaacatgataccggtgtagaagttgttttgaggagagtagaaagattgggtctagaactagaccctggaatggaattgagaatcatttggcaaagaagttcatatacaatacaacaatatttgagaagtttctcctgggatcacgctaaatttcctaaagaaagatcaatgaaagagaatttggcagcattgttacaatcagtctctaaattggatacagatttaagagcaaaatctgctcaatttaacgaggtaaaggcttcagttcaaaatagttttgggaaatcagcaactcaaggttcttcaaattcaggtaatggtgcagaaagtggaacttctaatactagtggcaacaatttaatggtagtatctggaactttgaatacaaaagacttaactgatgtaattacaccagaatgtattgaaagtggcgacattgtagatactgagcatattattactgtttttgttattgttccaaaaggaaacaaggaaaacttcttgagtagttatgaaagctttgacaaatatgttgttccaaagtctgccaaattcattaaagggattactgacaaggatggaaatgaaataactcgggttttaatattcaagtcttctgttgagaattttaagacaaactgtaaaaatcataaatttattgtaagagatgactttaaatactcacaagagaagtataaccatttaatgagtactcgtcaaaagcttttacaagagaaggataagcaggaaaagtaccttaagagaatgtgttttgctggattctctgaaattttcatttcttggatacatgttaaggctatgagatgctttgttgaggctgtattacgctatggagtcccaccacaatttgcctcattcatgattagtatggattcaaatcagtcaaaattgaagaaggtccagaattctgtagagaaggtattcactgaaatgggtagaattggcgctacattcaagtccaatgaaaaggacgttgatgacgaatacactccatatgtatttttgcaattctctccatatcagcaatctctttga

SEQ ID NO: 1390 - DNA, 1092 bp, Cryptosporidium hominis
atgcaaagtcagaggaactatgcaaaacaagagctaatttatgatttattatttgggaataatcaaagaaagctcccaaaaggaggaattgggaattttgaagactctaatgagtgtgtgatttgtaaaagagataagtttggtgttgctacgggtctaggaactgaattgcctaatgttattcctgagttattatgcatagaatgtaaagaggaattgttttcatttgaagggtttagataccaatgtaaacaagtaaagaattcagtttcaaatctagagagtattagtgttgttcttaatgagcaaatgagaaagctttacaacctaattggcaaagaaaggactttttcggggagctcaaagaaaattgaacagaataaggttccagattggtgcaatcgggacattccctccaaatttgggaaaggaaactttaaatttgaaaagggaattgaaaaaattaaaaaggatattactcatgatgaagagtccagactttctgaccaattagaactttttcatggagacttaataaacttacaagagactatctttacgtttattaacgtattggaagcttatatagacacaccttggacctcagtattaaaagaagccaaatataagcaggaaactcaaccttgtgttacaagctttaatgaggataacattattactccagttgagtcagtaaaaactcaagttattactaaccagaatcaggaaagtaatacaacagcccagagaattgaacgaattagaagacagcaagaaaaggtccgtcaacaaattaaagctctctatgataataacactactgacttaccagagaataatggaagtcactacttcagttctgttgatacagaaactaataatttaaacaaggacagtattggaaattactttttgtttagtaaagatattttgcaatctgataaggacgatgatgaagatagagcaaatgaagatcgaaagaatatgaatagtaaagaaattggtgagcaaagccaacatgtactgagaaactatgatatactttggtctccatcttcagcttcagtatcttcaaacatcgactcaaactaa

SEQ ID NO: 1391 - DNA, 921 bp, Cryptosporidium hominis
atgaatactccaactaaaaagaatactcaagataaggttaacgatgaatctttattaggttcatactacagactaaagtcttataaaaagcttacaagtaataagaaaaagtctacgataaatggagaagtttccaaccaaaatatagacgaaaacgcaatttatacaactccaataagaagctctcgaagaataagttcacgcacgaattatgcaaaaaaagagcctaatcttttggattattcaccagattccaagaatgggaaaattttagtcactccgaatccatatatcagagatgatattgttgaggaattactaaatgatatgcttttgaagtataaagacaaaattcaaataatcagttttaataaacaacctcaaatacttgatgagagcaataaagatgaaattgaggatttatatacgaagtttaattcaaaactacaaattaatgattctgatacaagaacaatccattctattgaaaaagagacctttgaaattcaggaagaaattaattgtgaagacaaaaatgaagaaaaaaatcaagagatagaagatgaaaaacttaagcctatcttaccaaaactaacagggaaaaaagaatactttgtttgcagaaataaaccaagaaaattcattgggggtggcacagtaactaacccaatattggtaaataatacatgcaaatacgaaattattgcagaaaacgaatattggatggttgttgagttcccaaagaacagcagtctatataggaaacataactgtccacgtgtactcactcaaaagagaatatttgggagtccagttaattgcccagcagtacagtctattgacgagtacaaaaccttacattcagaactgaaacaattgctagaacttagtaattactgttattccccagatttgttttaa

SEQ ID NO: 1392 - DNA, 357 bp, Cryptosporidium hominis
atgtttcactggcaagcaactattatgggtccagatgacagttcatatgctggtggagtattctttttaaatattcaattccccagcgactatccattcaaaccaccaaaagttaactttactacaaaaatctatcactgcaatataaattcaaatggggccatttgtttggatattttaaaggaacaatggagtcctgcactaactatatcaaaagtccttctttctatatcatcacttttaacagatgctaatccagatgatcctctagtacctgagatcgctcacttgtataagactgacaggtcgaagtatgagcaaaccgctagagaatggactcagaagtatgctcaataa

SEQ ID NO: 1393 - DNA, 2244 bp, Cryptosporidium hominis
atgtcacagacttcaacacgtaatgcgaggccaaagacactggacccacagaaaaagctccaagtagttttttccattagccaattagaaaaggctctggaagaaggtaatgacaaacttgagcctgatgaagttcgcaacataatcgatgaagagaagcagaggatccaagaggtgatcaatcaaatgagagcgaaggaaaaagaaaaatcttcacagaaacagtctactggaaatgattcctcggtatcttcatcaacttctaaggacaaagataactctaatacaaactcgcatgcaggttctgccacgtcatctggcgggagctcgtgtgcaggtgggctgggaggatcgtcaggttctttatcgggagctgcagcttcatcgattttggttcctccagtagagatttgcccacttaatgttccaaagctgatagcatttcaaaggcctgaacactatataagatttccagttcataaggagtttgtttctgggattcgcttggaggatgggactgtggtacattataatatggtcaagatagatgaggagttcttacagagtttgtctgaacacatgaaggttggagtttctgagtcagattttattaagatgatcgattttatggagaagagtactggtagagggagtgagataagcttcgatgaagctttgcaaatatgcagggagaggggcttgtcatccataaaaaatcaacaggccttgttaatttataagtattggaggatgcgtcgtcataagttgggaaagccactattacgtcatttttggccaattacttcacctcatgattcatctccatatgcatgctttaggcctcgagtgagagaaaaaatgactttgagacggccaaggaggaataacaaggagactttggaaaagttggagaagcttttggacgacttccgtaaagttgagaaaagctttaggaagcttagacagagggatgaaaagaagcttctactggcggagctggacacttgcattttcgatcagaggcgacacgagatcaccgatccgttctatagatgcccaatctgggataggctaaagaactacaagcaacagaagagacaacataagaaagaaatgagaggagtttcccagctttctattggaacaggagcagggggttctattgctcagctttttactggcggtggagttatgggtttaacagcaggctccccgttattaatccaaggcggagatttttcttctagttttaattttggagatttgagtatgttcattaaaaagctatcttcagagattggcaacctagatatgcttcttaagtattcttgggaaaatgaaacgtcacttctttcttactattactatggctctttacaacttacctcttctatttttaatgtttttaggacttatgctggtaaacaagatcatacagaagccattaagaatggagaaaacacggatcaatctttttcggtgatgagtgatgggaataaaggagaggtcataatggctcaaacccctggccgttcttctaatatagagtctgcaaagttaaatgaagattgccaacggagccaggaaaaccaagcacaacctgggccttcacccgccttctgtaggattgctattccgaattatattcagtctatatataaaaatggggttgaccttgccagattggagcctctacaaagtctgagaactccatgcagacctcataggcttgttcgtagacgagggagaggaggaagaatatggtttgatcgccatttactatttcaagacaatttcgaaccacatttcactgatccggataaactcgatctcgctagtaactgtggggggagtaaccaatttatcataagttcatattttaggaaaaccgcctccatgtgcgaccttattgatgagctttgcactgaaggtaactttgatccttttggtaatagtagcaatggaaacaacacacaaggaatctcagtcagtatttcctcaagctctaacaatactggtatccatcacagttcaatgaatgatcttcctaaatcgaccattcgactttccggcacaatgaataatcctaattctaacctcggagctgctagtatgcctataaatcctgtcattggggtgaataataccaattcagcagctggattttctactggaaaccaaaatccaaccaacagatccattccaagaaatgcttcatatcttgatgctgagatgacgtgctag

SEQ ID NO: 1394 - DNA, 390 bp, Cryptosporidium hominis
atggatcaaagcattaatttaaaccctcaattcgaccaaattggtaaacaatttgtacaacattattaccaaacatttcaaacaaatagacctgctcttggaggattatatggtccccaatcaatgttaacatgggaagatactcaattccaaggtcaagccaatattgttaacaagtttaattctcttaatttccaaagagtccaatttgaaatcactcgtgtagactgccaaccttctccaaacaatggttcaatagtttttgttactggagatgttagaattgatgatggccaacctttgaaattttcacaagttttcaatctgatgccttctgggaacggtggattcatgatttttaacgatctatttagactaaatcttggttaa

SEQ ID NO: 1395 - DNA, 1959 bp, Cryptosporidium hominis
atgccaagcgctgcaggaacaaactttcatcctcagtcaggccatcctggagttacttggtgtagtgaaagaagaacctggagaatatgttatgcaccagagcctggcaaacgtgtgacaaaaagttttaatccacgtcactatggtggtttagaacaagcattacaagctgctattgaatatttaagagaacaaaaagcaaagttaagtttatacagacccaatggaaactcaaataaaggagagaactcgtctagtatgaatatcaagaaaatgaatgataagctgaatgacatgcataattcatcaactaacgttttagaaatggatataaataataaatgtggagttaaacataatggaccaaactggaataataatattccatataatggatttgagtatgggtctggcttgggtaattctgagcttaataatatcaatggtgaattattacctggttttgatggtggaaaaactggtaatataaatcaaaatctatttggcttagaaaattcaagtgaacaatggaatgcagcagcagcagcagttattgctcatgcaataaatacttcaaaatcaaatggagtcaaccaaaagagaaaagctaattgcgaatactcagcttcaatgagagcaccatctacaaaagctagtaaatcttcaaatttgtatggcgaacacacatactttaattctcaatcgtcacaaactaacattgaaattggtggatactgctgcgaatgttattataacaataataataataataataataataataataataataataataataatattaataataataataataataataataataataatagtaataataataatttaggaagtaattctactaatggaagtggtagctcaaaaacgaatgatgaacaaaattctacaatatctaatcaaatagataatataaatagtattcattgtaataatggacaaaaccatatgattggacataattccttccatccatattcatgttctcagtcaagcaaatcaactgtttcaactaataatgttagtaattcaaataataatctcggaaatggaaataatagtattcatccattcatttatgattacaatgatcaaagtaatgttaatgatttgatgaatattagaactccaaaatatgttaattatcaacgtcattcaggtaatcaaaatttagatgatgacttgttacatccatcaattgcatcttcttctccattaggtaaagtctttcaatctactccttattctaatattgacaattatgacacaatcttaactccaaatatgagatctggaaattctcagaatcattcatccggcttaaatattaatagtggaaggtattgtggtggcaatagtaatatgtttgaaagtgatggagttgttactaattccaataaatcatctaataacagtataaataaggctggctacaataacaataatagtagtattaatggaaataataatataaataataatacaaatgtaggctgtaatcatcaaaatcaaattaattcaagttattcatcttgtaataattgtatttcaaatgccacacaaaatgaatttggcgattttagcacaccatattcctcatggtttgagggattggggtcatgttattccgaaatagaggatactttcttaaataaaagcagccatctattacctgttggttctcttgggccatactcttttcaaccatacaaagagcaaccacatggtgatgcttctggaaaatctattgttgaaagtatattattaccattatcgacaacaagttgtggtacatcagctgaaccacaattatcaaatgatttaattttggattcgtgccagagtattaatttatatcaaaataatgctaatgcagttacaagtaatagtagcagtaaaaacgtttgtttaaatgatgcaggctcaatttaa

SEQ ID NO: 1396 - DNA, 1983 bp, Cryptosporidium hominis
atgtcaaattaccaaaggaatagacttgaagaagtatgccaccgattaaaactacaaagcttttgttttatgtggatgttaccagagcatgcattattaaattctattatagaaagtggattaagaagtatgatagtaaaagttgcatcatttggattaaatgggagctttcttgttttgatgatttctgactgtgtagatgactttgaaaatattcaaaataaaatatgcagagattttcattgttgtggagaaggaggtgaatatgagtcattgacagttgatggaccaaaccacttatttaggaataattatatttctattgaaagttttcaaagtatttgcttagactcaaatccttatgctcctgtttatgctttaagaccaatagaatatcagttgaggaggaaagaaaaaagtaatgatgaagaaatcaaaacagttttgccatttttggaccctaattacagcttattttactacatttgtgatacaggtagatataagttagctagttttgaacctgagaaaggaattgagtcggaaacaaaaattaatacaattgatataagtattgaaaatccgagtgattcaaatgatttatttgaaatacactcttttgaaacagatacaacttttttgattactattgacttaaattttaattctttaaatactaattcttattcagaaaaaatttcaaaatttattttagaacatttaagtaataaagattggtttatttcaagcaaagtcatatacttagatgtactaattccattattcgaaactgaaaatacatttttcaggctttttgaattatctgaactttgggatatgattaatttggaaagttttggggtaaaatggaatcctgtaataaatatcaactattccactaataaacgagtaattaattcaaagttccacatagttattgttaaaaacagtataaatgctggggaaatattgattaaagaatcatgttcatcgtctatctcatcttatggaacttcaatcccaaggtctttttcaaattgcataattgtttcaagtggaaaatcttttaatttattaagtaacttccaatataaatcaggggcaattgaggatacttgcattttactgagttcaagtatttatggactaattcctcactctggagtagttccaaactgtaaagaaattaagaatttcttagagatggtagattcaaaaggctttaagaatttggatatccaattatctattgaactctcactttcattaagatctttcagatgcgatttgaattcatcaatttataattcccatatattaggctttaaaaatgatgtggaatacagatttgatgtatttaatattacacacgtatggataattgagatatttaagaatgaaggaatttcattatctaaagttgctgattactttaaatctctaataaatgagtataattataataaaagttacaattctaacaaatggtcggaaattcaaaaatttattgaaacctcgaaatatccctcgatagatccaatagtcattccaatgcatgttgattatttaccttcaaatacaatgtgcaagttaattccagtttcaataattatgaacgattacaaagattattgtgtagagttatcaaattctgaatttaatttttggagctttgaatcaaggtctttttcaaatcataaagcaataataatattatttgagttgaaagaaaccaaaatagtttcagcagaaaaatgggaaaaaataattaatgacctcagaatgtctgttcaaaatactctgggcaaacacggtttctctttggatgataaggtaatttgttccaagttctttgttattaatgaatattataatttgattaatcaatatcaagatcaattaatccgtgcttcttttatttcccctgtgagaatgctaccaaattcttcagttataaaatatctaattgttgttggaaattaa

SEQ ID NO: 1397 - DNA, 300 bp, Cryptosporidium hominis
  misc_feature (291)..(291): n is a, c, g, or t
atgccaaacaaattcatttttagaaagagcttaaaatatgccaaaatattgttggggatacacttaattcaaaaatatgggtttagtatatgtattacggatggaccttcaatgattccaacaatcggaccgaagagagaacttttgctctatgaaaaactttctatttctttatccagaatatttaaactgaatggaaattttccagtcaacagaaatgatataataattgcaaattcagtggaaaatccagaaatattagtttgcaagagaagtattgctaaagtaagntatgattaa

SEQ ID NO: 1398 - DNA, 459 bp, Cryptosporidium hominis
atgactcagtcaaatgcaatgaaggattatgcattaagtgctcaagatttaagtggagaagggtttgcaattgtcaagaaaccaacttcttatgggaagaacagatttatgaagttgtactacaagtttcaggttgaagaagctgcaataaaaaaatacggaagcgtagaacaagcattggctgagtcaacaaatgctgaagataggaaaatacagaagaagataaataaaagactcgggataacaagtgaactaagcgaaaaggagcagaagaaaatggaacaaaaaaggttaaggattgaaaaaagacttgaaaatgaaaacaagaaaaggatgttgaaacaagaaagttaccatgaacatgatttcgatccccctgtcaaaattaatacagaaagtggtctttataagaaaaaatgtaaaatctgtggattcgagctgacttgggaggaaatttag

SEQ ID NO: 1399 - DNA, 2208 bp, Cryptosporidium hominis
atggtctttaagattataaaatatatttctacaatactaatatttattattttcgaagcagaatctaacattcaaaattatgttgaaaataatgatttaattactattaacacacatttgcgtaatgaaatttcagtttttgaacttataaaatttgagaatcaaaaattcataccaaaaaatgtgaatgtcgaattttactgggacaaattccaagtcaatgatatatataaacgagtatgttacttttatagtcctaaaaataccccaaaaattccaaaaaaccaacatgaaaacaattactcatattcaattggaggatttagtctgttccaagcagcattttcaagagaacctaatagttcaaaagaggtagatattagaatgttggaaataagtaaaacattacttcgattctttgattatgagtatgatctatctcgtccaacaaatgattcaagtgctgatataaatatttggagacatattcactataataagatgaaattgagtaatttaataataccaggaagaggttctagtaggctttatattaagaccgaaactaacttagcatatataggtaactattttggatatttaaaagttaaatatgaagacgaagttgaattaaaagctgtaaaattatcaattagtccatctcctttaaatctgtttattttaaaagaaaaccaagtatttgaagaatccaataataaagtaatagttatcgactttgtattaagaaattatctagttttcagaaatttgaatactttttttcaacctaaacttgaaggctttaatgaaaatttatgtcaaataaaaaatatacttcaaaaagaatctcaaataatagaaattagaccagggggacttgagaagattcagataatttgctctattggaagattgaaaccagaatttattaaagaccttttactaattcaaattaatagtttttggagcagttccagtagatataaaacaacttataaatatagtgaaatgatgagacatgaaagaaaatttaatagaggattatttttatctgaatttataatggactatccaatttctccagaattttttaactttaagattgttggacaacgaggatattcaataaattatttaaaagaaaatgagacaggaataattaacttttataatccatttaaaacagattttctttcttcacaatattggataactttggatttgcttcaaatatctgaaaaggtactaaacttaagatataataaaataataattgaagttgatagtaaattatcagatttcctacatgttacttttgatgataatattagagaaaaatcttatgaactagattcaattactgaaatgaattcccttttattcttaaaaattaatttgggttttaacccacagactttaattgatcaagtatttgttacaaatgatagggaaagtatgaaattaaaaattcctataaaagtaaagttatttgagaatcataaagatatttctaatgacacaaatatctttgaaaggatctggatctttaattttgatttagagagtgaagctgatgaatatattattagaaataatttattagaaaacaagattagacaacccagattaattgtgagagatttggatgaaaatataaatttgaacattttaaaaatcaaaaactcaaaggcaaaagattctaaaaaagtagaaataaactttttagagaataaagaaaataattttgttctaatttcaaaagtttcagctcttacaatgaaaaattatgatatcggtcaattaacattaaattttaaagaactaataaatagaaaaatattcaaactaaagcaaaatgactcggctatcaataattcaatagaagatttgccatattttatagaaataggaaaaaataaaaggctacaattagctacaatggctagttgtggtatagttgaattaaacaaaaatgaaatagattttggaatagtaccagtaagtttatttgggaatccaaaattaactcagaaaatagaaatgaaattaagaagatttgaaacaggaagaaaatgtggtaacaaattttcagttgggtttagcgtttcaattaatttcaacttaagagtaacgtggaaaaaaaatctttatccttcaagtagcactagaatcataaaaattaacaaaacaagatataaaattagttaa

SEQ ID NO: 1400 - DNA, 2019 bp, Cryptosporidium hominis
atgattaacaagacagataaatttttgaatggagatttttcttgtattggtgaatttggtatacaaaaacttcgaaaactaaaaggagaatctaataatattttttttttggatcataagattaaagtatatcatataaattcaatggatgagcttaatgatattaaacagaaaagggagaaattatattacccaagaggatataatccagaatgggataacgggttaactaaaacaattttgaagatggatattatgggtcaaaataccagtttaattgaaattgaagtcaattatcttcatgagacagaaaacatgaatgaaattatattaaatgggacagtaggaaatgttttctacaataaataccattatgatttaaaacaagtaacgagaatgaaaagttcaacaagtatgaagaattggagtatatttgaagaaaggaatcacttagtgatcaataaccataaattaggggaagaagaagaaattgaattggtgatattaaatttgattccagaaatgacaatattgatttcaattagggaattaaatggagataataaagaggtttctatttcaagacatgttttgagaattccaaataaaacgaagaaaattgaattattaaatagaaaattattaagcttgggaatactcaaggttcaattagatgaccattttattactcaaggggaattttctggtaaaaggagtggaaatggaaataacttaagaaatttgaatgaggaggaacatgttgatgaaaaccaattaatattgaaaatggaaactgatatggactctattggtagtaacttatcaaactcattgttcatttcaagtaaaatgttgattgatggttggcctgaagactttgagagaagactatttggagaaatggggataaatattaactcgggacatttaagatttaagaatgataccaaggaaattagtgggaatgttgagaattacaaaccaatttctgagttagggaatgataaaaaaggaaaatctgatgaaggaattcagaatctatttgatgcggatttggaaacaggagtagacttttataataagaattatactagtaaagaaactttggggattgagaatgggatttatgaagaacatttcccacacattaccttaagctttaatcctccaatttgtattttatatgcaaaattatattggaaagaaaataaatctccagtatctacaatagtatctgttggattaagatctagaaatgtctcaaaacccagaataagaaatttcaacccaattgttcatgaatgttttgaaaatcaaaaatctgtaaatgaaagttatactcaggatagaattgacacaattcaaattatccctcctgaggagatggtaaacacataccttggaaatccatcgaacaggtacccttatatttacaattttaccttatcttttgcaggttcctgtggtgattcaagatttatagaaagaaaagaggaagctgcgctatcattaaaggaaattgaactaattccatgcatttctaacgatttagtactttcttactcagatcctctatcagaaaccaatatatctcttgttaatacagaacatcttctaaaacaatctcggttaagagaaaaatacttggaaatacaaaagattattctagataatctcagaaaagatatagaaaagaatactaccaacttaaacttaagtgatatttctgtcaaatataagaagccattaaacgaaactaatgtatacttggatattaatacagtcttatcagaagaatcaaagctaagatcgtcgcatattccaagcgtaaggttgctaattcaggaaaatagaaaagaaataaaatattcaaggaactctggaaattacagaagattattagaggatgatgcagggaaaaatcggagtcttctttttgcctatgttttgcatttatggcttaatctaacaataatatgggtttggaacttagtatatttctttaaaaagttcaattaa

SEQ ID NO: 1401 - DNA, 5901 bp, Cryptosporidium hominis
atgaaaacgaatagttttcatagtgaggagggattttttggatttttgggacaaatgaataagagttttgtaggagagttatgcttggaagaattaacagaatctgaagaatcagaaattggagacactgaagtaattaaaaatgaggatgtattggaattaagagaattagagacattaagaagcattcctgtttcaattaagcttccaagtgatattaataatgatggctcggaggatgaattggtctgtaagaaagagaataaagcaagaacagaagtagctccaggttctaatattaaggtaaatagaggtagaggaggaagctcaaatttgaatggaattagtttagaaacaattgacactgatgtggaaaatgactcaattaaagtagaaatttctgaaaagttgttagagccaatgagtaggattagatctgataatactcaagaaggaggtatattttggggggaaaaagatgaaaaggatgaaaattatgaagctatgggttcaattgattctggatattcgattttcgggatttctaggccctttactagcaatcttttaaaggtaactatggaggatggagatagcgacaacgactctgaggacgaattggaatactttcaaatgtcagacagtgagaagtcaatgtttaaggttagatctaaaattaagggggattattttttggatgagatatccaacaagatttcaatattttcttcggatgaaaatagtgctcaagacaaatctactgaattctttatacacattgatacaaaggatcctggtttttcaaaaaatttaggaggaatatctaaggagcttaaggaaaagctgggattagataattcatcaaagcataatcttggagtggatttgttaggaattacgggctcaatcacaagaaatcaagaagttaacactattggattaggcggaaaggaacaagatcatagtaggggagaagctcagcagtcctcctcagggggaggtagtggcaataattgtaatactggtggtagcagtagcagcaaacctttgagcaaggcacaacaagaacgtcaaagacgacaaaaaatgaagaaaatagacaaacaaaagcgtttagagcttgcaattttgggaatgaatcctttagattacgaaggtggtattagaaatcccgacaaagtacttgatgaaaatcaggatttggttgatatgaaggatggagaggatggaaaagtaggagaaagctcgggtggaggttccttatcttacaatagtggaatagctgccttggcttcgtccatattaatgtccaatatgcctcagaaggatcgtatttttggtttaaagcttcgggaaatgtctttggatgattcatgtcttttttccattcgtcagtttcttcacttggttccgaggctgtttgatggaaaatcatatgatgagattgatgatctttttgaggagatacgaacttctgtcgcttcttctggatcaaaaaatgagaaacaaagatcaaaacaaacattaaaaagtaggaatgaatggcaaaatctattgataaagtggcttacttatgtttttaagttctcagaaagaaacgggatttcaatgtatgaatcctgggcagagagtaatcgtcaatatcatgaaagcagagtcttactaaatagtttgggaagtggttatggtgaaggcgggggagctaatggaggagatcaaattggaggtgggaattctttacctccaatatcctctctccacactcccttggcgtggtctttttatttggttagtggaaatatgcttccaatcgatggagttagattccacaaatcagatttcagaatgggtatttttgaatcattttcatcaagaaccaacctaatttatacatattcgtccaattggttcgcctctctagtgaattctaagagtgcgaaatctgagtcagggtttgaacctttcggtccttggttggttacccctttatttcttggagctaaagggggaggaggatcacaaggacattcttcgactcctcagcttcttcacagatatttccaaagacaaagagagttcaaggatattccttctagcatcaattcatctatttgttttgtttctccagatgatttatctttaattcaccagactcctgttgcactttttgaatatttggagcagtatccacttttgctaaataatttaggaatggctgctagaattcatagatatgtaagatgtgaggatgattccaatcgaaaacagattgaagatttactttcagagtgtggtcctttgggatttgttcaaaaggttcaggaagatactaaaactggcggatcctcaacttcatctcaatctgggactttcccgaagttctttggagtgaactatccacttgaggaaaatgagtcaatggcagttttagaaactggtctatttaaagctccaatataccatcatcccagaaggcaaagaaatctccaggctggagaaaatactaatatggaggatggaggagaggcttcctttatcaaagatgatgaggatgaggaggagcgagacagaagtgggaaagggaagttttctgcatactttttgttgataagaaagcagattcaacaaggatcttcaaaatgtgggctttatttaaggcctttgtctggagattgtttaacttgtttatattctgttggacaggaagaacctctggttgaagtaccttgtgtggatagtaaaagcttttcaaatctaagaagggatcatttgaaagctctggtgttaaggtatgcaaaggaaaatgggaaagatacattcagtgaggtgagaaaactgagtcaaaaaatgtttagaaatacttttgaccaaaatactctacagaagattttaatgtcttgcaaggaaaccaaggaaagtagtggaagtgattccatttctggaataggagttggaggatcctctgtagcaggagggccttctttgagctccaacggcagccattcgagtttgcttggaggaattgggggaggagttgtagtaggaactgggattggaggcagtagcagccaatcaagcattcaggtaggagttggaggaggatcaggaggtggaggagttctgatcaaacaacttaatgaatcggagctgagacaaataattaatccagaatctctctgtgccttagatagctctgtttcaggggatatgagacttaaacaaatcggagtgaggtctttgagacacttctcgaagattcctatagtagtaagcgagctggatcagatggaggagattgcaaaacagtatgcagaacaagctagaaagaggactaacagtttgatagagaaagctaaagaggcggaaacctggagtaaagactcttctatgggtaaatcttgtaagtactcatccctactgagcttaatcaatgaggtaagtactggattaataaattcaaacggaagaaggcttactcctgttgctcggtatattgaagagtcacttttactttctccttggaacattacacaagaatatggacaagtaatgagacatcagaatggccaatttagtattgcaggtatcggagatccaagtggaggaagaggagaaggtgtaaactttataaggagaggactcatagattctgcaatagagtctagaagtcagaaagccttggcggggaagagtgaggaccttagaaagctttcaatggatcaacttagacaaaggcttcttcaatgtggacttgatgatgtggcaattattcctctccctagatgggatagagtagcattggttagacattttgataccagtggaggaaattccaatgggaaatctggaagtgggtcatcctcaaacagtatgcttcaaaacaaagctttatcttctgaggagtatcaaagagctatagtcaatgtattagttaatcaaaagaatgctttaagtccagatgatccaataatgactgatgatgaggaggaagaagaggagagaagaggagatggcagagacgacgaattaagagtagaggatgaaggagaagttgaaatggaactggatattttatctgaaaacacaccaaataagagcgagactgaaggttctagaggagagttaaaaccttcacaggatgttgatatgcttgaatcaatgttgattgacagctacaattcaagatcggatctagtagtttcacaagaagactcaagtccgaaccgagattcagatgagtcaggatctgatctggatgaagatcttgatcttgaagaatcctttatttcctcattagttaagtctaatgacaataacaacgaaagtaacgaaagaatttctgggaaatatgaaggagacaatggtaactatgataatagtaatttaacaagtggagattattctaatagtaaagttaaacatatgaaacaaagcaaactttatgatcagttatacgggaattcaaatgatgatactggtagagatgaagaggatgaaaaagacttggaagagtttagaagaatgatttctaagagtactcctcaggatggtatagatcaagaacttgatggaaatggaatggattggaggaatcaaaactcacaagaggattcttcctcttcaggtcaggaatatgttcctagaatagcttggatacgtgttagacgtaatatgaatacttggcaatatgaagatgaaaaagttgtttatatatatggggaagagaatattagatacttcctttactggagaaggatgagaatgcagcttaaaagagaggaaagacgtcaactaaatcccacaggagttccaggagttttgggaagagctagcagaacttgtagaagatgtggacaagttggacacattgcttcaaatccaatgtgtccttattatgagggtaacaagagtagttcaggaacaagtaggtaccaaaatgcaatttctcagtctagaaagaagaacatgttattgccaaaaggctttgagattggaggaggtatagcttcatgtaaattgtcagcttctgaagaagaaagcacaattgcaaatcttttggggatggggtactctcaaacaaataattgtgatattaaacagttagtaactttggacaacgtagttcactctgtaagagttggaaaacgaggaaggccaccttcaaatcctacatctaactcaaggggagatacgggactgagtagttcatcaattaggaatacccaactaagttcatcaagtttaggaaactttgaagattctactgagactcaaacaaatacacaagctaatgtaggaacaggatcttcagttcaattctcaaggctttctgcaagacaaagaagaaagatgatggataatgatgataagagctcagttgtaagctttactagtactgctttaaatggtggttcccagacatgtaactttaataatgctctaaatccttcaagcggaggagctggcttacatatttcaaataacttggatggatcccacaacgtaattaatgcaggacctaatattacctcctatactgaagctttagatgaattttgtattgaacttcaaagaattattaatagtacaaaaactcttcatcattattcacatgtattttggaatagggttagtgagagaattgcaccaaattattataatttggttaaaaggccaatgtggcttcaattaatgataaataaatgcaaaaaaagggaatacaaatctagaaaagatttccaagatgacttggacttaatagttgagaactgcaagatttataatgggataaatcatcctcttgtatctgttgcaactttaatacattcaaatgttgtaaaaaagattgatgagattcaaggaattgagaagattgaggcttatttatcactaaaaccctag

SEQ ID NO: 1402 - DNA, 306 bp, Cryptosporidium hominis
atgatacatttgttaaaaataaatcaatctctttatgatttttcgtattatcaatggcttctaattcagtattggaattactcaataaatcgagttttagatctgtatacaactcctcccccaattcctccaagcaaactcgaatggctgccgttggagctcaaagaaggccctcctgctacagaggatcctccaactcctattccagaaatggaatcacttccactactttccttggtttccttgcaagacattaaaatattctgtagagtattttggtcaaaagtatttctaaacattttttga

SEQ ID NO: 1403 - DNA, 543 bp, Cryptosporidium hominis
atgagaccattaacagaagaagaaacaaagatattatttgaaaagctaagtaattatttgggaaataacttgttgtcattattagagagagaagatgaaagttatgttttcagattacataaggggaatgtattctatatgagtgaaactttagcaaaagcagcaagtattgttccaaaaaaaagtttattaagtatgggaacatgcttaggcaaattttctaagaataataaattcagattaggaataacttctttacagtacatagcaagactgactccaaataaggtgtgggtaaaaccaggaggtgaacagagctatatttatggaaatcatgtaatcaaaagacatattagtagaatgactgatggtctaagtaataacgtcggagttgtagtatattcaatggatgagctaccattgggatttggtgtcttagcaaagagttctgctgacatgaagaatgctgatccagaaactattgcggtttatcatcaaactgatgtgggtgaatacttgagagaagaagctgatttgttgtaa

SEQ ID NO: 1404 - DNA, 522 bp, Cryptosporidium hominis
atgcttccttttaatttgattttatatatattgctactagggatttggatcaaaacaaatacccttgtcggtgcaaatggtgcgctatgtaatggaattgattgtttagttagccctgttccaaactgtccacataacggaatattttcagagcaagaaaatggttgtattgtgactgagcaattgttgaaatcttgtcctgagggatttaaatcttcaccaggagcaactcaatgcagtaaaaatgtgcatacagataaggttttgacgtgcccagaaaacactagatatgacaagcgcactcaggcatgttatatagaaaatagagaaattccaaagtgcgaagcaggatatattgaagatggaaatggtgattgttataaattaaaggaagcagaaatgaattgtggggtaaatgaggaagaaagagaggatggatgctatattaaaaaattggttaagaaagaatatagttgtcgtgagatacctttatctattcgagcaattcatgaacaaggatga

SEQ ID NO: 1405 - DNA, 2043 bp, Cryptosporidium hominis
atggaaaacgaagcagaagaaaacttctcaaaaatgattaaagctgtgaatccactttctagtgatcaaaaggtatttttggacttgggacaagaaggtaataccattccaattgatgctacaaatgcaggtatatatgagtataatattacaaagccaattacaattagcaaaagtggttcttacgttgaagatgacgattcatgtctgacaactactataactactaatgaactttgtgattcaaatagtgttctttctgttgctggagtaaataactcagaagatatacaaactgaagattcaaaaacggaggatgttcttccaaataaagattctaaagaaaagccagaagagcaatctgcttttgatattcatcctattagtattgatacgggggctgaagagttagtgcattcaacacaaagcacttctaaatcaggtcgtcgtttggcaacaaatcacgaggctggttcaagacagttaaaatataatcaaattggagtatattggaaagataaagaaagcagggtttatgctaggtttacatgggctaccagaaagtattccaagagtttttatgtagggccgaacaagccatacgccactgttagggatgcagaaaaggctgccattagatttttgttgattaatagtccattgcatagaagaagtcatctaaaacattttagattttctgagagtgatgaagaaggggaggagccttatgttgggtctcaagcgctcaaggaagcaagaagaactaaaggaattatgcttcattttcctgctcctgaaagtgatgatgaggtttggtctcattataatacttctaatattaatcctgcgacattatatggcgagattattaagaaaatggatagcagcgaagggaatgctgctgggcttaccagccctatcacatctgcaagagaatatgtgacagctaagcataagcagagctctaatgcaaaccaaaatgaatccaaattttccgccacgattcccgcagcttctacaattggagaaaacgtttcttctgatgatttatttttggcacttatggcaaaccaaattgattccgatcgtcttgtagagaggcagactacaggagcatatatgaacccatcaaccagcacaaccacagtatcatctaaaagatttaaacctaacgctaagacagaaactcttgattcttctgacttgagtttctttcctacaaatcaaagtcagctcggctcgacttttatggatcaaagctcttctactgcctccacaaatccttttgttggtatggattataatactctggttgctttacagcatgctcaaatggcaaattactatttgcaacaacaggttgcctatgcaactgctgccaatcttgcaatatcgtcaaattcaggtggtaattatgctaatgctgcaatccgtgcaaacccatttttgttttcacaatacggattagccccttttactggattagagtcaaataaatcagaagaatcggatgctgaaaaattgcaatgtggtgctttgaatgttggaagttttaaaagttctgttcaaactgttccttccaacactgtaaagaatattgctgaatctacattagatcaatatggtgcaattatgccaggacaagaaactaaagcaatgccttcttctagcattactatttgtggcacaaatatcccaagtaattaccatgcagactatatggctgccatggctgctgtttattcaggttggtactcaccttatggatacactatgccttttatgggttcgtataccccaattatgccttcaattattccgaatcctaatgtattgggaaatcaatttcaaaataatataagtctatctaccactacaactaatacaggtcaaatgcagtccaacagcattaataatacaagtgttagattgcaaaagcaggtaaatcatgtcaattccaatgaatctctggtgaacactcgggtagaaaaggaattacaactacaaggtacttcagaacaggaaaataaacaagtaacttaa

SEQ ID NO: 1406 - DNA, 807 bp, Cryptosporidium hominis
atgttcgaatcagcaagaccaactcttgctcagcttttagatatcgtacctttcataaagtcgagatcatattcaatagcttcttgtaataaatttgtgaatggagaaaaaattgaactttgtgtaggaatagtggactggaagcttgaatccggtgagattaggtatggccaatgcacaggtttcttaaatagattaccgatgttggattcggaatcaaaaatagacagtattcctagactcccttcaaatattaaagcaagcgctttcaacttaccttttgattatagatcgccggttattatggcttgtatgggcactggaattgcaccttttagagcctttgttcagaataagaagtacattagagatgtattaaaagaagaaattggaccagtaatattatattttggttgtagatattatgataatgactatttataccgtgaagagcttgagaattatgtaaaggaaggggttattacttctttgaatattgcattttctagagatccaaaggggtataagacgtcaaattgcgagaatattagatacgcacaaaagatgtatgtacaacatctgatgcttgagaatagtcaagaaatttacgagaatatgatagaaaaatgtggttacttttacctttgcggtactaaacaggttcctattgatattaggaaggcaataatccagataattattaaacacagctctacaacagagcaggtaacctctgaagaagatgctaacagtattttgaatagtattcagataatgggtagatataatgtcgaagcctggtcatag

SEQ ID NO: 1407 - DNA, 1284 bp, Cryptosporidium hominis
atgtccggaccacaaaaacaatatgatttatttatttggggatccactggcttcacagggaatttaatatgtgatttacttgtaagaacatataaaccaggaacaacaaacttaaattactgctttggaggaagaagtgtagataaaatggaagcacttagaaagtgccttattgatactttagacaaagaaacaggtacttctaaaggtgaagaaatgatttcctctgtcccaatgtttgtatgtaataataatgaggaaatcggaaaatgcattgcaaattcaaaagtttgtatcaatatttctggaccatatactgaatgtggtgagattattgtgagcctatgctgtgaacattacactcattatatagatttgtccggtgagtatgcatgggcaaaaaaaatgcaaagattatatggagcttcaattgcatccaagggtttgaagtttgccacaagttgtggattagtctcaactattgttgatttaggattattgcatcttcaaaactttgcagcacaaacaagtggtctcccatgtcaagaagtcatacactattctcagcatgatggatataaccaatcagcaagttatggaacagtgaagagtgttttattgacaataaatggcccaatgaggaatgaaataaaacaaaatgatccttatggaatgtgtaatggaactttatgtcttagtaacattgcagaagttactgaaaaaaatagagttgcctgtaagccaatttacaactctagtcttcaatcatggacttcaccaaatatgctttccggtccttattcaatgtttgtacattttgcaaatgaagaaatgggttatccatatggtatggattttgttttttcctcaagatctatcaataattcttatttatctgctcttactggttgctttaaggataagattggaagattcttatctgaaagatatatcatctcaaagatggttcattgtggagcaccatatttgattggaacaggaccagatgtttcaaaggctaaggatactgttattaaatcaacctttgttggaactacaatgcaaggaaagaactacaaatgtgttgttcaggcacgagatcttgagacttatagtatttctgcaattactgcacttgcttgttctttctcgatcatttttgattatgataatctcccacaaactgctggattttcaacaccctctgctctttttggagtctcagctatcaaacaatgccaagatttaggaattcaatttgaagtcgaacatttggaaaaataa

SEQ ID NO: 1408 - DNA, 144 bp, Cryptosporidium hominis
atgaagaaatctgagaaatcagatgctaataatccaacccaacaaggaaatgtcaaccctaataaatcaaaaacctatgaaaaaccgctcattgaaagtaatgagagtaaaatcagccaaaaatcgctcattagcttgctttga

SEQ ID NO: 1409 - DNA, 1002 bp, Cryptosporidium hominis
atgaatattaacacttctggagacaagatagaagaaatcgatgagttcgaacaacatttatctgatgagagtaggcaatctctcaaaaaacttaaagatttgcagattgaatttaacttgatagaaaaggaatacttagcagaaatgcgaaagctccgttcaaaatatgaagctcagtataacgaaatttatagtagaagagatcaaattttggaatcaggtactgttgaagaatctggaactcctggactacctcaattttggattactgcaatgaggaacagcagaatgttagggtcagccattgaagagtatgacattcctattctttcatatcttaagaatattacctcggaatggacttcagagcaacaatctggttttattcttaatttcaactttgctccaaatcccttctttgaaggcacaaatattaaaaaagaatatgttatggtttttctagaagacgatgagccattattaagcaatactgttgtaagcaaaattgaatggaagcaaggaaaagaccctactcaagaggttgttgtaagaaggcaaagacataaacaatccaaagaagttcgtattgtgacagaaactgtccatagagaaagcttctttaatttctttaaatctttaaatgttccttctgacgaagaacttgcaaaaatggatcgcttcgatatcatggaacttgaatccaccgtagaaactgattatgaaatgggaatctttattagggataaattgattccatattctctatattggtttactggtgaagctgttgatgaagatgacgaacttgaagaagatgacgaaggtgatatccttaatgtagatgaagacgactctgatagtgaatcagaaagcagtagtgacagtaatagcgatactgattcagatagtgaagatgacagatctaataaaattagtaatcgtagcaataaaaagaacttatttggaaacatgggtaatgcaaaatcttttaaaagaaattaa

SEQ ID NO: 1410 - DNA, 183 bp, Cryptosporidium hominis
atggaggaccaaatcatggaatatttgaaatcccaaaaagttgttaaagaaagggcaagagttgaaatggacaataaatataaagaatcactcgaggaaaagaatatagagaggaagaaagcagaggaagaattgggtaggataatagatcaaattaaagagaagaatggagaattaagtaag

SEQ ID NO: 1411 - DNA, 1026 bp, Cryptosporidium hominis
atgagagaattatataaagtggataaggaaataaaagatgaattagaggaaaaggtgaatgaaaataataatatttcagcagagatatcaaaattgaaagagaataatgaaacaaatgagaaaaaaaaagtttctattaaggaagaagttgttaaattagaaaatgatttaattttaaaagcagatgaaattaagttaagtaaggaggatttatcgagaattagtgatgagttggagaaaaaaaagctagaaacatccaaatttatacaggagttggttgaaaataaaagatgtttggatgaaattaatgaattaaatatactcttagaaagcaaaagagagaaattgagacaaatggatgcaaagagtgaatccagtaataattattacaatataatagagttggagcatataaatcaagctaataacttacttgagcaagagattttgtcattgaattcaaaaataaaacaagatgagaaggttttaattgatgaaatttctaaattaaaagaatcgaaagtagttgtttcagctgaaaatattgaaaaatcattaacggaattggagaaggaattagctgaagacaaattgggtaagatttcattaattgagaattttgatcaagatgaaacaaaaattgatgatatattaaaccaaatttctaaaatacgtcaattattgaatgaacaagaaaatgataacaataataatgaagaagaaatttcgattaagaaaagaaagggaaaatcaaaaaggtgtaaagcaaagaatactcaatctatggaacatgttttaatacagtcattaagaatgatacaaaaaatagatcaatttagagtaggatcaattgatcaaagttcagatatcaaagagactcagaagacaaataacattattacaactgaaaatgataataatcgaatagtgaagcctcttgaaagtccaaagagtggggtatccggctttggaagaagagtaatgatttctaatagaagactgctaacaccaagaaaggtaagttaa

SEQ ID NO: 1412 - DNA, 591 bp, Cryptosporidium hominis
atgagtacattagttagaaagttagcaccaaactttactgctgaagctgttatggcagatggttcattcaagaaggtctccttgagcgactacagaggaaaatacgttgtattgttcttctatccattaaacttcacatttgtatgtccatctgaaatcttagcattcaatcaagcacaaaaagactttgagaaattgggagtacagctcctcgctgtctcagttgattctcaatattcccatgctgcatggagacgtactcctcttgaacaaggtggaattggaccagtcaatttcccacttatctctgattcatctcattcaattagcaagaactatggtgtacttctcgaggaagaaggtattgctctcagaggtttattcatcattgacaaagagggtgttgttcgttctgaagtaatctatgacttaccattaggaagatcagttgaagaaactctacgtgttattgatgcactccaattcactgaaacctatggtgaagtttgcccagcaaactggaagaagggccaaaaaggaatgtcagctactcatgaaggtgtttccagttatcttaaggactcattttag

SEQ ID NO: 1413 - DNA, 1836 bp, Cryptosporidium hominis
atgttatttcacctaggagcgttaacatggttgagtttatttgctcattatgcaaagcttcaaatggattctattgatttttcaggaacctcagaccaagatgagtgcagtatccaatgtaatttaaattttttcccatattgtgcaacaaatggggtaacttatataaatgaatgtttttatatgagagcaagatgtttagatccaaaaattcaattacaaaagatgccaggaataccatgtggattacttggatcaatggatgcaactaaatatactggatgtgagaaagggtgtgctccagtagagtttccatattgtggtacaaatggtgtaacttatataaataactgtgcattggatatagctatgtgcgaagatgcaaacgttcaattggcaagattaccaggtttagcgtgtggaagtgagactaaattttctgtttcaacttcagaatgcgaaggattatgttcagagcattatattccttattgtggttctgatggaaaaacatatattaattattgtgaatttagaaagtctagatgcaaaaatccaactctatcaattgttggttttccaggattaccttgtgagagtcagatttacgatgaaaaagttattattcaacagacaagaaagattgaatgtttaagaaaaaataaatgttcatctatattaataccaatatgtggatcagatggtgtaacttataggaacccatgtgaatttaagagagcaagatgtagagatcctagtttaagaagagcaaatatacttttaccttgtgggagtaaaatatctgatggtgttgaaaatattattgataaaatgccaaatactacatcaactggtatttataaatcatgttggtttaaatgtactaaagtatgggaatatccattatgtggttcagatggtataacttatagtagttattgtgaaatgagaaatgctttatgtttggatccagatttaagacttgtcaaaattcctggagtgaaatgttcaggtgattttcaatttactaatccaatagaaattgataaatgcagggatgattgtccatttggtaagacattatcatatatatgtggaagtgataataagacatattttagttactgtgaatttagtaatgaaatgtgtagaaatcctgaattatatttagcaaagcctatgggatttccatgtagagaggaagatagaaataaaaatctggaatctgtagctaaagagtatcagactatggatgaggtatattttggcattacaaatttcaaatctaatgcttttgaagaaaagattgaagaatcgagaatgacagaaaattctgttattgtaataaataatgcaaatttacaagaaaatatcagaaatgaaatagaaaagaattctggtttattatttgataacaaaatttacaatagtaataattataaccatattgagactaataacacattacataagaatattactaatatgcttggctatgaggttcatatgttaaatcatggattagagacaactaattgtgaatttgattgtagtaattcacctagaatggctcattgtggcagtaatatgttaacatatccttcaggatgtgcatttcatagagatcaatgtagaaatccaaaattacagcttgttgcagagccaggaataccatgctcagaattgggaaattttaggattactcaagaaaagatgcaggaatgtttgagggattgtactcattctcaaaaagtttatcattgtttgaatactggagaaactatatatagttattgtgaatttctttatttacaatgtttaatttctggatataga

SEQ ID NO: 1414 - DNA, 558 bp, Cryptosporidium hominis
atggaccaagaacttgattgtattgctttaggacctataacaagaggagcattaaaatttatttttaaagctccttctccagattttacaaaaatccctcctgaagatatacatggaatggcagtagttttaattcttggatcctatagaaatgaagaatttatcagaataggatattatgtacataatgtttacactgatcccttacttgaagataatccacctgatattccaattcttgataaacttcaaagaatcattcttagtgaatctccgagacttactagatttaatattggttgggatactaaacaagaagatcaaaatctttcatcctgttgtgatgaagatcaagtaaactcacaaaagagttcaaataatgactctcaagactctattaattctcaaatatcctcaaactcttctcctaaaccttctcaaatttcaaatttaaatagccaaaaactttcttcttcccaaggtcccacatctcaatcctccaatcccaataataatgagaatttggatgcaaatatgtccactataagctccaattaa

SEQ ID NO: 1415 - DNA, 3210 bp, Cryptosporidium hominis
atgttttttttattcaagtattataaaggtttaggtacatctacagatcttgaatttaaagaatattttacaaagattgaaaatcatagtattgaatttgattggatggatgatcaagatgatgaagccattgatatggcattcagtaaaaaaagaactgaagatagaaagaactggattgaatcttataaagaaggaacttatgttgattattctattaataatcaatgcagaaatttaagatattttgattttattcataaagaacttgtattatttagtagatatgatactactagatctattccaaatttattagatggtttaaaacctggacaaagaaaagtactttttgcaacatttaaaaaaaagcttaataatgaacttaaagttgcacaattagctggttatgttgctgaacatagtgcttatcatcatggagaatcatcattacaaagtactattgttaatatggctcaaaattttgttggaagtaataatctaaatctgttagaaccatgtggtcaatttggtagtagaaaagaaggtggaaaagatgcaagtgctgctcgttatatatttactaagctatctaaatggactagatatattttcccagaggctgatgatcctttattaacttatttatatgatgatggacaacaaattgaacctttatattatgttccaataattccaatgattttggtaaatggtactgatggaattggtacaggttggagtagttcagttcctaactataatccaaaagatataattatgaatctaaaaagaatgttaaaaggtgagatgatgattccaatgactccttggtataaatctttcaaaggaaaaattttccctattaaacaaaaatctaaaaagaattcaacaaataatgggggtggaaataataatagaaaaaagacagcaattaatagttttaataatggaagcaatagtagtattttgattggatcacaagttgatgctgaagatgatgatcttcaacaaattcaaagaacaaataatatgggaaatggtataattgaagaaacattagagcttggagcaaattatgaaacttttgggaattggtacaaaaagaatgaagagaccctagtaattactgaactcccagttaggagatggacacaagattataaagaatggttagaatcaacattattacctgctcctaatgcagataatgataatattgagaattcatggataattgattatagggataattcatctcacgaaagtgttcatattactgttagaatgagaccagaaaaattacaacaagcagaaatggaaggtatagagaagatttttagattaaaatcaactttatcaacaagtaatatgacattatttgatcataatagtagaattgtaagatatgaaactgagttagatattttaaaagaatttattcctataagattggaaatgtacgagaaaagaaagaattacttactttcaaagttgaattatgagaaatgtttactagaacaaaagatcttatttttgaaattagtcattcaaggagttattggattaagtaataaaagcaaggaaaccttggtttctgatctaaagaagaataatattaaatccattaaacaagtacaagaattaactcaatgggtaggagtaggaggaagtaatttagcacaaaatagtatttctggaagtggaattggagaacatccaagctttgttgattctggtgataattctatggattatatcaactttgaaatgaattcatttgactatttagaatcatctcaaaaagatggaatattagaaagtactagttattcacgagaaactaacaaaggaaatgagctaaaactctttgattacttactttctatgccactttggagcttgacaaaagaaaagatggaacttttggaggctgatttaattaagaagactgaagaatacgaaaaattattaaaaacaagtattgaagagatttggaatactgagttagatgagcttcttaaggttattgaagaggaagagacacaagatgagttgattgaggcagaacataatagcttgatacaaaaacgaagactttctgtagattggaatgattcaaagaaaaaaaagacaggtaattctagaaaaagaaaaaatgaaacaacaaagaaacaagaaagtttgaaagtaaagaatccacaaaaatcaaatttaaagaagactagtgcaaaacctacaaaaaaaagcagaattgatgattctgatgaagaagatgattatattgatggagataattacagtgatgaagatgattattatgatgacattggcgatgatttctatggttctgataactctaatgattctaatgatcgaattatactaaataatgaagagtcagaaaatgaagaattggaaaatctcacaagtgatttagatgatttcagtgatgatgatggaggaggaaataaaggaaagcgtactcaaaagactttagctaataaatctaaaacagataatcaaggaaagacaaaattgaataatcttaaaaaagcaaagaatacttctttagttaaaagttcttcaaaagataagaagcggggattattaaaggtttcaaagagtactggaggtagctcatttggtggaataggtgatggtgttgctggtactggtactggtactggtattggtactggtattggcaatacaaatagttctagtactagtaataatacttccaccaaaaaagagaatattgaaagttcttcttcaaaacctttagaatccgtatctttgttgcaaagattgcaacaaaggactaatctagtaaatagcttaaatcaaagtttgaattccttatcttcaagtctgacaaaagttgcttctacaactagttcttcttcaggaggggttcctgcaactaagcagactaagattacagatctattcaaaagtaaagatagtgaagatgttgaaattagaacagcaaaatctggaagacagaagaaacagaacagccaaaatagtgaaaatgaaatagtttccagaccaaaaagaggtaagagaaaaaccatcatagaaagtgaggaagaagaggaagatagggaagaagaagatgatgaaattgaggatcaagaatctgtgagtaatatttctagtgattctttaaaagaaagtgactttagtgaatattctgacttttaa

SEQ ID NO: 1416 - DNA, 234 bp, Cryptosporidium hominis
atgtcaagaggaaatcaaagagatattgatagacaaagagcacaaaagagacaagatagaacagctccaaagactggaaaatcaataatagaacaaaaggagaagattttgagtatagtttgtaatatttgtaaacaaacatttatgtgtactgcaaatagacaaaccctggaggtgcatgttgatacaaaacatccaaagttggaattttctcaatgttttccaaataattaa

SEQ ID NO: 1417 - DNA, 564 bp, Cryptosporidium hominis
atgaatgaacctccccttttagaagaacttggaattgaccctgaaaatattgcaagatacttaaaatgtgtaattatgttcaaaagcatcaaagaatactctggaaataataatatatgtacgaaaagtgatggatcacctaataatcatgaaattgaatgggatatggctggacccatattattaattgcatgtcttggattcttccttctattagcagggaagatacattttggatatatttatggtataggaattcttagttgtattggaacttatattttactcaatataatgagcagcagccaaagtattgatttatatactacaatgtctattcttggatattcactcctcccaattgtaattctcgctggtatttctgttgtattttcacttagatctaaagttggaattattatggccatattctttaatatgtggagtactattactgcttcaagattctttgaatatactgtatctctcaaacaccaaagatatcttattgcttatcctattgctctattatatgctagttttacaatcgttaccatattttaa

SEQ ID NO: 1418 - DNA, 1785 bp, Cryptosporidium hominis
atgaattctatggagttattcgtaagagaacatttagcaaagtatggtatgcatgagatagaagctttaattgaggatttaagtaaagaagaaaagtatgaaattaatggatataatcgagaaaagttaagaaatttgtattctgatttagagagtatttttagagatgagagatttatgaaagaatatgaaaatattatagaaagaaaaaaaatgataaaagataatatggattttgaagaatttgacagttgtttaaatatgaaatattttcctcctaagaaaattgactggaatggattattgggaaataataaagataaagatgaatcaaagatcaaaaaagttattgaacaagtaaaaaaaggagagattggaattgatttgataagtataaataaaaaaaatgacaaaattgataataataataataataatagtaatacttgttttgtaactgaattagaagatattcctaatagtattagagattatatatataaacatggaattatgaaattaaaacaaggaaaagtaggaatgataataatgtcaggaggagatggatctagacttggttataatggtccgaaaggaatgtatccaataggaaaaataagtaaagatagtttctttaagattttttgtcaaaaaatacagagtttgattagattagtctcaaaagaaaattatgatcatgatactgatgatttgaaatctaagaaaactaagtatttaaaagaaatgaaagaaattcctttgtatattatgacttcagaaaacaatgattctactattaagaagtattttaaagaaaatgagaattttggtttaaaaaatgttactttctttaaacaagattcggtacctagtttaaatataaataataactattcattctttttaagtaaagatttaagaataataaaatctccaaatggaaatggaggaatatttaattgtatgaaaaaacaaggtataattaatgatatgaataataaaggtattgaatatgtatttatacattgtattgataatccattatgtaaaatatgtgatcctttttttataggttattctgatttattaaatttacaggtatctacaaaaactattcataagaaggatattaatgaaaatattggtagtattgcacagaaatgtgttcaaggttcgaacaaatcaaataatatattaccttgtattattgaatatacagaacttaataaattaggggataaaaaagaaaattttacatttggcagtattggaatacatttattcaaacttcaattcatacaagagatttctaataaaatatttgaatttccatatcatattgcaaaaaaaaaaataccttatttaaaatacttgaatgatcatgataattcacgtttgaaattctatattgatcaaccttcagaagttaatggaataaaattggaaacattcatttttgattcttttgcatttactaatattccagttcattgtattaatgtatctagagatgaattttctcctgttaagtctatttctggacaagatacaccagaaacttgtcaaaaagctatttcaaacctaaataaaaaactaataaatcgtgctttaaatatctctgaagagctctcactttctttatttaattatattgaaatttctcctttggtttcctattatggagaaaatttggaccattttactcaacttaaaactcatagtgatcataaatttatttatattaatgattatgaacaaatcattcttctagatgaattgcagtag

SEQ ID NO: 1419 - DNA, 627 bp, Cryptosporidium hominis
atggatgaaattacaccaaatattactaatattaataataacaatcaatctagaatttcaaaaaaaccaatacaaaatattcgtgaaagttctccaattaattgtatacaaatgcatcctttagatgatcacttttttgttggtactcaagatccaatcttaagattatacgatattcatacaaatgactcatttacatcatcacatcctattcatcaacattgttctgctattaatgatattaaaatttctcaagatggatcaattgtatgtacctgtagtgaagatggtactatcaaattctgggattctgttaatttatcttgtattaatactatttatggatctcatagtggatttccagtacattctttatcattttctttatctcaaagatatttaatatcttcaggaggagatggtattgctagattgtgggatcttagaatgggaagagaattagtcaagtattcatcaggattaagaagttcttgtcattcaaaagtatcgtttttgattgatgaaagatatactattctttctgcaattgatgatactggttcatcttatagtaatataatgaaatatatttcaattttatggatgatcataactcaggatagataa

SEQ ID NO: 1420 - DNA, 978 bp, Cryptosporidium hominis
atgagtaaagatgaagaactggcgttaagaaagtctattcgaaaatataatactaatgaaagagcgcttcagaaaatacaaggtgatgttttagaaagattaagaagagcaactgaattagagaatccttatcagataaaaacgaatagaaaaaaacagcttgatcaaaccaagtatgaaaataaccttagtcgaataatttgccgagattattatccagatctagattatatgaataaaaataaagatgatcatgaaagtattaagtcaactattaataatcctccaggtaccttaaatatgaatgattttcctcatattggagattatgaaagtaataaagatttattagtctgtaaaaagttaccaaatatcactcaatttcaatccaaatatactcataaaggccatttagatcttttagctttgactaatcaagatttaattcaaagaagagaaaaggaaagttggatagaacaccaaagcttcaatcataatcttaaaagagaaatgaacatcattcaaatgaatcagaagaattctaatcaaattaatgattttgatgaaaaatcacttatattcaataaaagtcaatctagaagtagctttatgtttccaaatcataatcatcataatcaaccaaaaaaagaagttaatactcctcaagatagagaaaagcttattaatcctagtaatacaagatataattacatggatgattttgaaaaagatgaaagaatgcttcttcttaaagaaatacaaaccaaaagaaaacaaattcatctcgataaagctccaaatttaaatcctatacttctagataacaaaaagacttccaaaaatctacttatgaagtccccccttgttaaaaatgctctaagaagattaaataaaagtgatatactttttgataatcagttaagagattcttattcttacaaaggtaatagtaaacaaagtctttcaagaataacctag

SEQ ID NO: 1421 - DNA, 402 bp, Cryptosporidium hominis
atgtctaccgtcaaaaccacaatcaagacggatctctgttcttacagtgaataccgtatatacccaggaagaggaagaaagtttgttgctagagatggaagagtctccacatttttaaaccaaaaatgtgcatctttgttccaccaaaaaattagaccagttaaacttaaatggtcagttggatggagaagaatgaacaagaagttgaccaatcaaggagcaacttcaaagagaagaaacaaaaagactgttagacttcataaagcaattgaaggattgtctttggatgatattaaacaaaagagagctcaaaaccaaagcaattctggtgctgctcaaaaggctgctttgtctgaagctaaggctagacaacaaaaaaagaaacaatcaaacaggaagtaa

SEQ ID NO: 1422 - DNA, 2463 bp, Cryptosporidium hominis
atgagtatacaaagacatttacaagggatttctccgcaaggatttttaatgacttcaggactttttgataaagatacaacagtaagtatagaagcaacctggggagctatttatttacaatctattaaagatattaaatcaggaaatccaagaataattggtttgataggaagtccacctcctagagaaatttggtcaggagcaaataatgaacaggagtttgttttattatgtactgaaactttaaagaagttaaagactaatcctccttttatatcttttaatactcaaggacaaggtgagagaggatatatacagaatttttgtgaagatgctttagatactttgatttcattacaaagagagcctgataaagtattgtctttggatttttcatattcaggatgtgtaaatgaatcaatgagaaaatggcaatggaatcagatatatacacagatggatattgatctgaaagagttaggaagttacagaattacaggtattcctccaacagttagtcataaaatttacaaaggaggtaagaccgttgatgaagttgaagatcagtgcggtgatgctttagaagaattggataagagaaataaaattaagatacttaataagaatgcttcacaattttgtaaagatgctgcagagaatatatgtaaggaagatgaaacaggcaagtttaattgtaatattgaaagagcaagattagaggaaatgatatctgagtactatatggagactccaataggaaatccattaaaattggattcaagaacaagatgtatgagaatttggactttacttagaaattcggtacctaatgcattaaaaaataaaatattatcaacgtattcaacattaggaagtgaaaagtttgatattacaaatggatcaaataaattaatggatatgggtttagatttaggttttgaaggtgaaatgggtttacctggtatgaatagtttaatgggagatagtaataatattatcagatcaggaggtattatgagcacagtattagatagtaatattcaatttattgctcttaaagagattatggatgtatgcagtccaatagacactccaagtcatataataggggtttttattaaagcgatgagaaagattcaaaagattaattcattgagatcatctgaagaaggtttgtataattggattagagagttagtaataagatatttagcagatgagagaactgataatgaatactttgatttaacaggagtgaatgtatttggagatccatattcaaaggatgacaatgcattagatatgttgaataaaggattacattcaaggggtataccaaaaagagttagagagctaacagataatgaaaagttggttatgagagaaaaggataatatgaggattagttcaatagtagatggaatagtaaatcaggtacttccttcaattgctcatttaacaacaaaagaaaaaaagagagaaatcacagatcaagcattattaaagttacaaaaagaaacagaggagagagatttgctattaaataatcaaataggtaataatgaaatattggaaaagattagaattagaaaagaactaccagctgaagagaggaatactatagcattggggaaagtttcaataccaatgttatctggaagagttggtaggaacgaagacaatataattcatggtagtaaaggctcaggaaagattttggcgagattagatacaaggtgggataaagtaggtaataatgaaatattaaggtttaagaaaataaatgatcaaaataaagcttcaaaagtattaggcaaaaatatggaaagaaattacggaaaattagactctgaatggttgaatattcgaacttttaagagctatgtattgttaaatctcccaaaagataggccgtctgagtatggagataaaggatttaaggatatatttaataaagaaacaatgataagaagatgcgtaaactttttctcaaatgaaaaaaatgtagaaaattacaatatttcaattaaaggtaactatattgaaagattatctcatattagaacacattgtacaagatcagcatctagaacatacgaattaacaagtagatcatcttcaagtggaaatagagcaggaattggaagtaaaggtaataagggaaaagcagtacatagagcaggaaggttaattcatgtagagggtgaaaagaaacctcttcatcaaattatttcaaaacaaagaattatttctggtaacataattgaaaattctgaaatatcacctgaagaactggaaaatagtgagccgcttactacaaattctcaagacaatcactttaataatatagaagtacatcatgtaggctcaaatgatggttataaagcacttttacctgaatatgtatcaagaagaggttatattaaagataagaatagtaataaaaagaatagacaaaattag

SEQ ID NO: 1423 - DNA, 3744 bp, Cryptosporidium hominis
atgaaaatcgatgaacatgtatttgataattatagagaacttagcaagaaagatgatagttatatacagtacaaaatgcatgatatgcccataaattattgtaaagatcctaaagttgattcaactaacaatgactcatgcactaatgtgagtccagtatttgattcgagtatatctaataaactaacaaactttattgatgaaagctttataaactctaataagaaattaaccccaggaacagttcttgtaggaaaatcagagttttgtgatagaaactatgatggggaacttaatagtcctaaaaaaaagctcgattgttctgtacactggatgtataaaagtgaaagaggttggatgcccttttcagaaagaaataatgtctacatagaatccaaatataggagtaaaatagaaacaattgttatctacccctatcaaatcgattttataagctttattcaaacgaaccttttaacaggcactgaaagacgtatcctgagatgcgacaaaaacaacttgtcgataaatagcaataaagtaaacaaggacttagtagtgattgaccctctacttaatttgctatccttcaatacatctggagtcattcgaaatatattcaatttccttagctctgataatgattattatcatagatgcaacaccactttacaaatcaatcgcacctttgccgccaaacccccaaatggcggtaatcttgatagaaaacaattaattgtaccaagattacaaattgagaactgtaaagggaatttattgtcagattcaacaattaatacagattctcatatagaaacaacattatctccaactggaggatatatgattaaatctccgacaaaatctgggcttaatgtaacaaataagtgtagggttaatgcttgcaacagagtagtgcaaagtgacgttgcaagtacaacaaatgttgttatcaatgatagtgaaataagagatagtagaagaaatcgttctgacatgtctgtatgctttgaagattgcactaaagaagaaaaaaaagatggtcaactttcatctttttccccagatactggtttggatgatgaggtcaagattcctagaatatactttcatagtgttcttggaagcaatatcccaacaaaaaatgttaaactaaatactgatgtatcgtcatcatcatcatctaatactatttctaatagttctatgagtaaatttggcgagacaaataaagaagagggtgaaaagtctggttcaaaatctcagtctggatctaaaagtttattcttctttactcctcataaatataggaagagcgtcggtatcatcgttcccaggattttgtcatccaagtttagcaataagaaaactacaaagaattcagagaaggaagcaaaaaacaaatatgtacggttcaattgtggattaatgtctccagatcaatccaaacacactttgggaggttatataggtactcctaggagagtgaattctaactcttcaaaagaaggtcaatcaaaaaagaagcgcgatttagaagtatcaaaggaagttgcaggaaacaaatcctatagtagcagccctttactggacaattctagtcaaaatttatctgaaagttcgaatttcaattcttccgaaactgacaatcttaaagcattttctgtcaaatctgcctttattattttgaatgaagatgcaattccttttgatatttctgaaaacaagccagtttcaatatttgatgggggtaggggaatcgaaaaagtaaaagtaacaggatctgggattggagctggaactggaggaattggatctaataatgagggagccgggggctacctccgtgttttgaatagctggaataaaattgggagaatgcaaaatgaattttttgaaacaatgtcagaaagagaatttagtagtcaaagaatatctatggatctcaatgattttgaagatgatgaaactgcttcagatactgatgctagatttctagttgatgaagactcaagaaagttaattagcttgggaaactttgataataacacaggaaaacctcgaccaattaattggtggtttaaccatagcgtccgacacattaccgttaagtttaattgtgaaaacaactttaataataaatctacttcacttgaaattattcctcttctaaaaccacttcttactgggtatatggatgaccaaattccaatcgctagaaaactacttccaaataaccaagtttctggaatttctactcatgttttgttaggactaaaaagcctagaaattattggcttaaagccaaacaagtcagaattcccaaaaatctccgaattttgctttactgaactcaataatatcattccaatttctcttgaagagctttatattattcaatcaattattccaatttcaatattttctttattattgacacgtttcccagtaccggctgcttcaacattttcattttcactaatttgtaatgatgatgaactcccaaatacaggtcttcaaacaattcaagttataaatttacacttatctcagaatccatgtagtcatattaaaagacgtaatagatatggaataactagaggaagaaaacatttagcatattctggagactattctacttgtagtcatgtccatttggatatatttagaaagtacaaccacgtgaaaatttgtccatggcttgctatttcaaattttgtggatgaatttgtattaagaactcctatacttgtcaaatgtattatagatccacataatataatggtagttccatcatttaattccaggaatctccgagataattctcgttttttatatgaccataaagattcacaaggcaactatggcattagcaacattggagaactttcaagaggagcagagtttgtgataatgacagctaatttaattttgccattgttaattattcagtcgcattcaattcaaaatattattattggaggagaaattgataatcaatctgaatcatcgtcatataagaatgttaaaaagcttagagtggattcaatagtattttcttgtaagtatcttccttttaagttttttaaagtccgaaacttggacttgtttctagatttaaatatagacaagaccgaattgggacttttcataagaaataataactccaaagatgggatcgaatctatctcttttacaaaagtatcagaagaaaagagtcaggatattatacaagattctgatagctactgttttcagcaactttacaactcaattgattcttggattgatgaattctctacttggctagataaatatgtatgttgtgattcaatagaaattctccatgttaatttatatgttacgtctagataccttgaattaaaagttaataataaccataatagcaataattctacttatagagataatagtaatatttattatggtattggagataaattaaatagtcaaaaatctaaacatttttataatgatcaagtgattactgaaactgaatgcttaaataatggtaatgcaatcagttttggatccgaaggaagtgttaatgcagttgattgtgatattgcaatatcaaagaatatctttaattttgaccctctctaccagaagttttcagcaaagtccaaggctaatcataattcgctgaatgatgttaagataaaggtttgtatttctagtcatctacaaaactttatctttgatactataaatctcagctaa

SEQ ID NO: 1424 - DNA, 3075 bp, Cryptosporidium hominis
atggcattaactatgacaaaagtatttataatttcgatcttacaatggtatttcttttttttactagtaatacttatggcgggtagaatatatggtgaaagttcacgagaatcatcagagtcttcaaattttttccttgaaggaggctcaagaacagaatttactaatgaaattacattcgatgatgaacatgtattgagcttggattttagtcaaacaggaggaagttatgaagaaaactactcaattgaatcgccattgaaaggggatgaatctactttaagttctttatattataatccttttctttatgagtttgaattgaacacaaaaattgtatgtcatgaacaattttgtaaaaaaggattacatagtaaaagatcatccaaattatttaaatcctataccaaatcagttttaaagcattatattcttgaatctaaagttagatcatggttctttagattatggagtgaatctactgtattaacttctcctgtattatatattgaaaaaaaacaggaatttaaagatatatacaaaattgctagaaactattaccataagcttaaagattctgctgttataattatactcaaagtattaacaaaaaaggtttccaaagaacttgccttagaggaaatggaagaagaggaagtatctaaatcaatctctaatacatcagaaaatgaagaacattcttattcttctgaaaatggagaagaaactagagcttatggtaaaaatagctctgcaggagtttcgtattccattagtcaggctgtgaagaatctttgtgttaaacttagaggcttaagtaaacatagaacaagtgataatggtcaatcatacttgtttgttattgaagctcatgaaattactgatcgaatcatcttttcaaagttaatgactagcttgatacagacttcatgttggaatagagcaaatgtgaataagtctagagttattattccaatcattgttggtaattttaagtataatcctgaaaaccaaagtattcttagtgatgtttattatacagaaatgggatctggaaatagaaaatctaagtcaaatattaaacaaacttcaaaatcaaaatctagatctgtatcttcggtaaatctagaagatgatgatttaattgagaattttgaccagtcaaacttgaatttatctgttgatttgaaaccagaatataatgaactatttattaaatggcttaaaagatgtaatgaatccaaagttatccatcaaaagtaccaacttactagtcctggtctctttgagaaacttctaaatcagtatcttgtatatgcaattaataataactctataacacgtgagctttctaagcataatcaaggatctcgtcattttatgagtcaatatccaaaaaattgtcatcattcttggaatgatttgttaaagtttattgaaactgaatataattctactgatgtcaaattcaaaattattcttattagtacaatacttgaatctctacatgttgcaaactttaccctatttaaagaagctgatattcaatcaagtgctgaatctgatcaaaaagaagaggaaattccatcaaaggaacaaaaaggtaaagaaaatgatatagaaaaagaaactgaaggaattaattctactggaaatgattccaatcatttaaaccaaggtcagattaagtccaaaattgaaaatcatccagaagttagtgatctatatagtattctctcttcaaaagaacaaaaacctattacattattacaagcaagaataatggatgatttaatcaataggcttcaagaacttcctgatcaaagaaaatcaaggcttgagttcaaaaactatatttcaagcttaaaacttgacaatcaatctcttaaccaagtacttgagctttttgaagctattgatcatgtacaaaattcttttcatttacttagagttatgttcattactaatattgatttgggtcttacattaaatcctttagaaattattatttctgtatgtagaaatgctaaaatggttccagtcgattctcaaagtattggagaaaggtcaaatcaaagcttaagaaggaaaaagagtaaaaaaggaagaaaagatcaaaaaaacaataatattgaagatagtcctatagaacaaagtattcatgaagtagaagaagaatattctgaggaagaaaagagtcaaagtactgaagatgaattacaatctgatcataatagtgaaaataaccaagatatattggaagaatgtgatcctttcaaatatttaagtaaagatttattatctgaagattatgatggtgatgttatggaatctattcaaaagtcatccataaaatttgcttcattaatacttggattatcacaatacgatacaaagatcttgaatatacatatatctaatttggtcattaagactgagagacttatgttaagtaatatactagaaaaccaaaagatctctacaatggttttaatcttgagtgaaaagattcgaacttttccatttaatacattatcatctttttcatatttgaaagaaatttctgagacaagaactatagctttattaaaaccatttgttcctctatttccttcatatactttaattggcctattcggtgattctatagaatttaaaaatccaaagcaatttggtaaaatattaatcatggaaatatgtattctttattatgatccaaaatcatttttggaccaagagtttgttgatttatgtattagtacttgggagtctaatagtaaagatgaagaatataataaaagtatttctaaagctaattcaaaatgtaagaaactttctaaagaagtaaaaggtttagaaattggtaataaagtgggaaatagttcacctacagtatttctattctgtgatctccttgataaacttgtaaatggtccaagttcaagaaacgagcaaagctttaatgagattaaggaattgtatgtttcaaaagagtttaacaataaatgtgagaatattaaatcatatagtattcaacaatcagggaatttatataatatgttagttaagctataa

SEQ ID NO: 1425 - DNA, 1476 bp, Cryptosporidium hominis
atgtaccaaaagactcaaaaaccaggatttggaagtcatacagctgacgaatgtgaaaaacattataataatttctatttgaatagtaaaactaaacctttaccagatactagaaattatcttaatcttatacaaaaaacccaagatattgctaattctccagaattagaagctattaaacaagatctcaatcttttaaacaaatctggacaagaaaaagatgactccgaatcgaaaattactgatcaatcatctcataaagattcatcatctaactctattaatacagaaaatgattctaaactcaaacaagaattagaaaatcctcaagtcaaaaaacaaccttatggaagagcttctggcggtaatactggtaataaaactactagtacaagtaatggaaatcaatccaaacctagtactagtgttattggatatatgcctttaagaggagatttcgatgttgaatatgataatgatgctgaacttttattagctgatatggagtttagagattctgatactcctcaagaaaaagaacttaaacttcaaatacttgagatctataattccaagcttgacgaaagaacatatagaaaaaggtttgttattgaacgtaatcttttagatattaaattacaacaacaaaaggagaaaaagagaaccaaggatgaaagagatttgcactcattcttaaaacctatttctagattccaaactgaagaagaacaagaaaagcttgtttctttacttattgaagaaaaaagaatcagaaatcatctccaaaaagtacaagaatggtgcagtttaggaattcgaactttggaagaagttaaaaggtatgaagaagaaaagaagagacgcgaagatattaaatgtaaaatcattaaccaaactcaatcaggaaatcttattgctcctgctggacttggacttggaaatattaaaactgttcctaaatcaggaatttccactccttttgtatatgaaggccaagctagagctattaagaaacaacaaaaaagccaaatctctatttccaatcctaatcttcctcttaatactaactcttctaattcatcttctcttccacttcctaatcaacaatccacgaataatatctctactacatccaattctaattcttcatctgctgtacctattgaaagttatcctggtgcttccttacttactgatcaggaaaaactcttttgtgatcaaatacaactcccgccaattttctatatactctctaagagaattcttattcaagaagccaaataccatttaagccttaatagtaaaactagaaaaggatcaactaatcattcaagcaataacctttctggcatacaagatatctcaacaaagggaatacctcatctttctaaggatgaattctctagagttattagattagatgcacaaagagctggacaactttacgatttttgtctatcttttgttgacaaataa

SEQ ID NO: 1426 - DNA, 648 bp, Cryptosporidium hominis
atgaatacaggtcttgtaacaagtagtgatccaatactttcatcctcttggacaaaatacaaagtttttaaaaaactatattctggtggaaaagtggaatatgataattattcaaaaatactttttatgctttgtgatggttgtattttagcagtttcaatagaaaaaggtccattcgttatttcaacaattgggccttataacgaagatgaaagtttgggaactgaacattctgaagaaattgtcacttttggatattttaataaaaacattaataatagattaatacttacaattggatcaaagggaatctttcgactttggaaagttattattaaacatgatgaattaggagttgttaattctgtccaatttgagtatttgagatcttggaaatctggtcaagctagcatagcagaaatagaatttgactctactggacaatacgtttcaactggaggtactgatggtacaattcaaatatatgatgcaattggaggattcacaacacataattttaaggctcataaatctctgattaccaaattaaagtttcataataaaaggtggcttttattttcaacttgtgttgaaggatttattatcatttatgatttaacaacaaataaaattattgtagaaacttaa

SEQ ID NO: 1427 - DNA, 696 bp, Cryptosporidium hominis
atggtaactggtggatctgattctcaacttattctttggatggataatactaaacaagttgaagatgaaaaaaatcttcaaaatcttaaaagaattgaagatcttaatgaaattgatatgctttttaatagaaaagagtatatgaatgctttaaatctttctcttggacaaaaattacaatataaaacttatttgattcttgaaaatctcttaaagccttgttttaatcatgaagaattatttaaaacactcaattctgaggaaaattccaatgatactactcaaaatgaaattaattgtattaaaagtgttgttgaatggattaagagcttacaaactcaagaattatcaactttattcacttttatgcttgaatggattacgatttcaaagactgtatggatctctaattcactcatgtatattattttatcaaagattgaagccaataaactttatcaaattgaaggttttgtacagattgtacaagcatttagatcttataatactaagatccaggttcatttgtcttcaatttatcagaaatcttacattttagattatttatttctttcaaaccaaatttcccagactaatgatcccaataactttaataaaaaaggaattaataatcaaaataatctaaaagatcaagctcttggactgactttagatactttatttaaaaaccaataa

SEQ ID NO: 1428 - DNA, 1011 bp, Cryptosporidium hominis
atgcaaagaactacagtttctgctgctgcattattaaccagcttattggaagaatttgttggtaaagaggaaacttttaaagtatttcaaaaatttccactacatacaatggatattcagtctgattatttgtttgcaaattccaatgtagaaaatattacgaatcatcttcaagctgcactcagttctaagtcttattttgatattgtagacaaacatcaaagtttatatcaagaattagaagaaaagattagaactccattattaaaagatttatggcctggtgatattatggattgtattatgacaactatttgtacaagaaatcataataagcttccaaaagcttttatagaaaataatctattaaatagaactatttccgcaatagaaaaagaattatctgtaatatatacttggaatgattcaattttatctaaatctgaaatgagcagattattatttgatgtcagagattatataacggatgtaatattgtttaatgaaaacaaaagtgatgaattttctaatattaagagattatgttctattattaatcaacgtacaaatttcaagggtaaagattctttgaccaatattgaatatttacttaatccattatgtaataaatatgaacattattattcttcaaatgatggagttcatattaaagtacctaaatttatcttattttctggacatgatacaactgttattccaactttagcttctttagagatttgggatgaacattggccaccatatgcttcaacatttatcattgagatatataataatccaataccaagtatagaaaaaagacaaaattatgactattttgatgacaatgagacagaattagttcaagagtctctaccttattttattagattgctttataatggacaagttataactaatagattaaaagagtgttatggagaagaaatttgtcatgtaagtttacttgatatatttattagagaaaacaaaatttcatacaaaaattaa

SEQ ID NO: 1429 - DNA, 1303 bp, Cryptosporidium hominis
atgggtagtgatattattctggatggaagtgtacattctggacaagtcgtgagtcctgccgaatttagcctctgtgcagatactagtaaccttgaagaaataaggaaaatcccaagattaagagatgaaaagttgttcgatacattaaaattagttcaattacaaatggttgctagacatggagcaagaactccaataaaatcatttaaatgttgggaagggtatgaacagaactgggactgtagtgatttgaaatctttaatttttgcttcagctgttgaaaagcaaagtaaaactcgaacattaaaatttttaaagcattatgaaacaaagcaatggcaaaatcatttaacggaaacctgtgacatgggccaactaatttcacaaggatatgaacaacatagaattaatggaaaacttcttgctgaagcttattttaaacatggtgaaaatcttgtaacaagaaatggattgaaaattgatgattttatgaatgaaatgtacattagatcatctgatacacaaagaactatagtttctgctacttcattcattacaagcttattagaagagattttcggtaaggaagaaacttttaaaaactttaaaaatttacctatctatacgatggatttacattctgaatatttgtttgcaaataagaaacttgtggacaattctcaagtactaaaacgcgtctttagctccaaagagtttcgtgaattaatacaagttcgtgaaaagttacatgctgaattggtagaagatacaaaattgattaatattaatggttcttggccatttgaattacttgattgtatatctatggcaatatgttctgatgataataataaacttccagatgctttcttaaaaaataacttacttgaaagaaccatgacagcaatagaaaaagaagtatcttctgtttttacgtgggatgattcaattatagctaaaggtgatattagtagatttatgtatgaaattagggattttattgttgatgctatatcatcctctcgcccctcccccctggctctccctccctccccttccccccttctccttcctctcccctctccctctcctcttcccttcccctccctccccccttccctcctttccttcccctcccctccccccccccccttctccccctcctcttccccccttccttccctctttccctctccctccttccccctccctctctctcctctcccctcccctcctcctctctctccccctcttctctctcccctctcctccttccccctcctccccctctctaccttctcct

SEQ ID NO: 1430 - DNA, 948 bp, Cryptosporidium hominis
  misc_feature (18)..(18): n is a, c, g, or t
atgttatcaaataatgancaagctttccataaatggattggatggattgaaagtaaattaagatttttggtcagaaaacttgaaacatttaagggtcttcaagttaggccttggccaaaagctattcaagaacaggatgaagctaaagatggatttatttttgctcaaagtatgtatattggtttagttttaaataatagcaatagcaataatggttcaagttcaacaggagttacaggcgtttcaaattcttcagggactgctccagttgtagatttaagaggagcaatattagattttgttggttttattatgaattggagtgaagtcgagaattataaagattcgatcgatttaaaagttagacatttgagagccaaagatcttcctaaacatcttagagaacagtctagaattaatgctaaagctattaaagcttcaataaataataatgtgcataattcagttaaggaagccacttcaagctttatttcttcgcaacagtcaacaagttcttctaacaaaagagctagaaatgaggatgaactaactaatactattacaagagatttgagtttaaataataataataataaaagtcaattaaataatgttggaaatgatttaaaaaatgatgttaataatagtatccagacagattctcattgtgataatgaactcaataatattagcaaaaagcttaaagttctacctttaaagaccccaaatattatttcaaatgattccgaaacatcatgcattgaaaataattgtgataaattaaaagaatttggtgatattagtaataattattctgaaattacagattctaataataataataataataatggaaataacattaacaatgttccaaatattattaaaaatatcaataatagacaaccatttacattaagaataaatatgtcaaaaaaaagtagttaa

SEQ ID NO: 1431 - DNA, 882 bp, Cryptosporidium hominis
atgagtaagttaaatgagttctttgaaaagaagaaacaaaagtcgaaaggtttgggtgacttgagtagtacaaagaaaccaataataggaggattaaaaggtgcaacaggtgatccaaatatatcatcagtaatatcagaaggaaatatagacgattggtcaattaatactgatgtaaaagatacttcagactttttaatttctagtaagaatttatcggtagatggtttgagaaaaccatcaaattctcatatggttgttgcagtaaagacatcaaaacctgattttgattctaatatatggaaatcaaagacaggtgattcttcgggaatgaatggattatccttatcaaaaaagaatgccggagaagatgaggatgggaagaatatgaatgatgaggagaaggaaaaacctaaagaaactttaaagtataatgtaagagcaaggttagcagcaagaggacaaaaagttgattttttgaatgcaaaggatgcaattagttcaatgcctacgttagcagcagcagtggccactacaaacaagccaagaggttcaaatttggctccattaaatcctgttggtacatcaggaaatgattcagatgcattaggtgctgcaacttctactaatacatttacagagaaacaagctactagcacagcttcagcaacaatagttgaacaaaaagataattcatatgaaaatactgatatgaaaaatgaaggaaagcattcagaaaatgatgagaagagcgatttggaagttattaagcagttgagaaactgtaatttattatattttaataaggaggttgtatttaattgtattgtagatattgaacaaagcaaattaaagtattcaaatattgttaaagatttttaa

SEQ ID NO: 1432 - DNA, 1656 bp, Cryptosporidium hominis
atgaatctcggatctaagtacgagaatttggagatcccagaaaatatatattctctttttggaaggaataagttgaagactaataaaaataggcaagtggggacctttgatatagcaatttttaagagtaaaagaatacaccctgttttgcagaaagataattttaaagcaggcttacttttttataagaaaaaatatcatgaagtggtaactccaagtctacttaagaatgtatcctttaataataaaaaaaattcttcaatgataacttcaatctcaagtcacaaaggtttgttagcaataagtaacacaaaaggttctattgggatttataacatcagtgaagttctgaaatacagagacttgaacaatggtaaaggcccagaattaaaattcccattaggatatgtattaacagaaaaagaacaaaacagggtaaaaaaaggtcggagttttaagctggaaccagtcaattacttaaatcctggagaaaatgaaaatcatagaggagtgatttctactattcatttaagtccttttgatggacaattatttataacaagtggttgggatggaaatattaaaatatgggatacttttgatggaacctgtgtatttactttaaactctcgtagtaaaattaactattcggtcatcaatcaaacaaatccaaatattgtaggctcagctctacagaatggaaatgtggggattctagacttgagaattggaggagaattctctcagacattatttttggacaaaaaaactacaaatctcaatttagacagaccagattctcctgttctaagcatagcttggagaacagattctgaacacattttagccagtacatcccagaatggttttattcgactttgggatctcagatttgcacaacaaccttttctatatatgaatagtaatctaacagattgggaattcgtacaagaaactaatagtataacccctttattgattagacagcaaatgatcttggaagaaaggaaagatatccataccaaacaaattaatcaagaaagagaacaaaaacaaatttggaaacatcaaaacatgaaaatagagctaaatgatgatgaaaagaaatttctcaaaattggtaaagaaagcaatggtgaggaaaaaggtatccctaaagaaagttctaatgacttttttaattcttatcaaagccattttggaattagtgcacccaaaactattggttatgctcatgaaagtggagtagggttttgtcagttccttaagaatggtagatacctaatctcctcagctcatgatggaaccatcaaactttggaattctttaaatggaaagaattgttatattaattatgataattttgaatctcaaactttctgggagggagacggactagttgaaccaggaattgatgaccaaatccaaaaatactttaaaaggttttcaatagattctggagatcaagataccttatttcatccaaatggaaatgatataggtatttggaatattagaacaggtaaatgcttaaaaagactttctgcacatattaatgctaaatctgtatctgtaattcacttaagtcactactctaatttgatgttttcgggagaccaaagtggatttgtacatatatggaataccagctattag

SEQ ID NO: 1433 - DNA, 213 bp, Cryptosporidium hominis
atgttgaatatttccccaattggaagaaattgttcttatgatgagagattagaattctttgagcttgacaaaaagaatggaatcagagaaaagtttattcaggatttatcaaaagaattttcagatcttgatcttcaatattctattggagggcagatatcaatagatgtattcccacaggtaagtcaagaaatttctagaattcaaatttag

SEQ ID NO: 1434 - DNA, 237 bp, Cryptosporidium hominis
atggattcaaaaaagctatttttgtttgatttagatgggaccctcactttaccaagaaaaccaataatggaggacatggtaatgactcttaaaaatgcaaagagcaaagttaagataggagtagttagtgggtcagattatagcaaaatatgtgagcaattacagaacaatggtaagtttgttgtatatttatttccttttttttctttttttaattctataatggaatatatttaa

SEQ ID NO: 1435 - DNA, 2574 bp, Cryptosporidium hominis
atggcaataggagtggataatgctcacgaaaaagtgagagcatacaatgatcacattaaagatattcagaattttttggagaattttgaagaatataatgagaatgaaaattcaggagaagatgtggtaatgtcaaatgctagggaagaaacagaaaaggaaggatctatttggaaacataaaaagtatatgaaatccttacagagtatatctaatagggaaaaaaatgttttatatattgaagttgacgatatattgagttttggaaaatacgaaaataaagtaacagagtacaataatttggttcattcaattttatcaaatactaagagatatgtacaattgatttatatagcagcagataattgtttaccggtacctactcgtacaaatattattgattttaaattagaagagatgaataatactaaaagatctgaatcaatgaagacatgtaacgttccagcttatttaagatccaattttgaagtttacattaaagcaagtaagagaatgcctattacgcctttaagagaagttagagcagaatatgttgggggttatgtacaggtaaattgtatagttacccgtgtttctaatgtgaagccaagaatgcaagtagttaattatacatgtgaagtttgtggttcttcaatttggcaatctgtagaaggtactaattatatgcctttatctgattgtgaatcaagccaatgcaagaataacaaaagaactggaaatttgaagtgtaatattaaagaaagtaaatttaccaagttccaggagattcgaatccaggagcctgctgatcaagtaccgacaggtaatgtacctagaacaatgaaagttatagcaatgggagagaatacaagaaaattactgcctggtatgtatgttactatttcaggagtatttcttccagtagtaaaggaaggattccaagcattcagatcaggtttaacagcagaaacgtattttgaagttcataatgttcatagttatatttctaacaaagaggtttccttgacagagtatgagaagaagctggtaaagcagatggaggctgatgaggaaaagaagaatagagaggaaggtcttaacagttcaggaagtggagcctatgaggttcttcattcacaattttatgataagctagcaaatagtattgctcctgaaattttcggaatgctggatgtaaagaaaggtctccttttacagttaattggaggggttacaaatcaagtgaatgatgggatgaaaattagaggaaatatccacatactactaatgggagatcctggagttgcaaagagccagctcttgaatcaaatcacaaaaattgctccaagatcaatttatgctacaggaaaaggtagtagtggagtaggtttaacagcttccgtggttagagatcagaacacctcagaagtaactttggagggaggagccttagttctagcagataacgggatctgttgtattgatgagtttgataagatggatgaatccgatagaacagcaattcatgaagttatggagcagcaaacagtttctattgcaaaagctggaattaccacaactttgaatgcaagatcatcagtcttggcagcagcaaaccctgtttcaggaagatacgatcccaggaaatcccccgtggccaatatgaatctcccagattctcttctttctcgttttgatcttcaattcttacttttagatattcctgataaggagaaggatcttaaacttgctcgtcatgtactttacgtacataagaatgaaaaggctccaagtgatgattttgagcttgatagatccttatcttctattcagagacctggaatgggagtaaatcaaacaaggagctcagcaaaaaaagtaagaagacgaagaaacaatgatgatagacaagaagatgctgagagtgagaatcaagatagatccaaatctgatcaagaacagagggttttttccacagtatttatgagatactttattgaaaaggctcaaacttatactccattggttccaaaagaactagtttctgagattgttgaacattatgttgagctcagaagaagggaaaagattgaacaaactagggaagattggagaaagacttatacaactccaagaaccttgttaggtattttgagactctctcaggccctagctaggctcagattcagtaatatagtagaaagagctgattttgaggaggcaaccagattaatgattgaaagcaagaagagtgttacaaagccaggaaatacgagtggattttcaaatcctggagcaaagaataagaagcacgactttagagaccaaattattgagattattaaggatttacataatagacaagttgagagaattacaagaggaggtgaagatgacgaatcaatgactgatggaatgattgagatttcaatttctgagattgaaacaagaattgctcatagagggctgcttaagcagcaacttgagttagttattgatgaatacatagaattgggagtgttgtccaagagtaaagatggacaatttatttcatttatcacagatttttcgtag

SEQ ID NO: 1436 - DNA, 1200 bp, Cryptosporidium hominis
atggacttctctcctatcaaatcacaactcgatgattcattaattgggcactcatctttttttggactacttttaaatactttgttggttttaatctactttgtgcttggtgcactttctgtatttcaatctttatcagcattagagtcaaatacaacagaaaatgtatttgaaaccaatggaataaaaattaggccttactttctaagtacattctctattggaattattttcagattactttatattattgtttatttggcaataaatcttttacccaaatttattgaaaatggactgattaataaacttaatatattaagaatgtttgattatttaatcaatattgtatttcttgcatcctactctatagtaatagcattatggagctcaattttcacacattccagaagctttgaatttacaatcatcacattactaaattttgcattatacttaactggtggaggaataataatcattactcttttaattactcaaaagttccccgtactttttaatgttctatatattctaatgggtcttttacatttattattttcctatttttgggtacattatggttcatctttatttacacaaatcaataggcgccaagccatgcataaggacttgcaaaaagatttaatttcgaaaaatgccaattttacatggaatacaaactctaatgttattaattctggttttaaccaagttagaggtacaaattggcttcaatatggaatgttgaacagtggtcaggtatctattattcaatttaatcaggattcatctgcaaatacagcaaatactgttaatactgcttcatcgtcaaataattctaatagttcaacactctcaggattatttatttataataaagcctatagttcctctattaataaactcaggttcaagattcaagttcttactctagtatgcccaatttcattactaatctctagtctatactacctacttagaggatttggtattgttaattctaacccagaaattcttttaaatactgtatggactgcattatatacgttctttgctgagacaattccgtccatagctttaatatacggattttggagtagtaagaactcattcttaggtgatacaattgataaaagttataaccgatataataataatgtacaagataattttagatgttatacacgaatctactaa

SEQ ID NO: 1437 - DNA, 1014 bp, Cryptosporidium hominis
atgagaacatctttggtagatgaccttcatcaattaatgccaagagtagtaacattagaaagaaatgatcaaggtcaaattaaatataatttaaaagtacctgctggagaattaataaattcaagtcaatttgaatttgttaatttaattagttcaggaggatttggtgttgttaatctttgtaaaagtaataatctaggaaatttaccaaatggaagagaaattgcagtaaaattatttacaagaggaggtaaagaaggtgggagtaatcaactttcagatgaaaggctaaaatcaatagaatctgagttaaattatgttcgcatgttcaagcatccaaatattgtagaatattatggtattttaaatccatcaactggtcaaataggatttgcaatggaatatttggatggtggaacagtttttgaagtcttatattctaaaattaatattattcctttagaaattaggaagatgtggtgtgtacaattagttaaagctgtggcttatttacatgaaggatgcgctccttatagatttatacatagagatattaaaacaattaatatgttaatcaatagaaaggatcttagcattcgattatgcgactttggtaatgttagagagagaactttttcgtattacagactagatgataatgggggatcagtaagatatatctccccagaatcagtcagagttggatcatttattaatgataaaacagatgtatggtcaattggttgttgcatgattgagatttttggaggtggaataccttattcaaaatttaatgatgataatgctttaattagtatgattagagaaggggttcctccagaaataccctcattttttccaccatgtttaaagaagttgtgttcaaaatgtctacaaactgaccctaatttgagaccaaatagtcagcatttactaagagatgttattacacttgacattgaagtattaagaaaatctaagcttggtaggcttgacaagtacccaaaagtctga

SEQ ID NO: 1438 - DNA, 234 bp, Cryptosporidium hominis
atggaatcttctattattgatcataaattattagaaaaagaaaatatgaattctaatatgatcatttttcattatattaaagttcaaattaataataatcatattattatggaaaataatcttgaaaataatcttgttatatgtaaatttgagattcttgaaataattctacaagctcttaaatctcttttaaaagcatttggaaatgaattcttattaagtatggggatataa

SEQ ID NO: 1439 - DNA, 1812 bp, Cryptosporidium hominis
atggtatttttgaacaagattcatgatattttgtttgattatttgaaagttgttaatatatcaaatcttaataataataataataataataatgagagatacattattatggtattatttatttttatagaatatttgataatattaaaagaggatgaaaagttgaaagatttagaatataatcaaagaatggatttaatactttcaaaagaatatataatagattatttaaaaataacgaaaataggtgaatttcaatatgatagtttatattataagattttaaatgaatcaagaagttgtaattttaaatataaagattataatataaatgaaaaagaattgaaaaatttaatattaataaatcacaatatgtttttagtgaataataaattaaaagaaacattaaatattgaagaagagaaagaagaagaaagaaataataatttaatgaagatgaatgaaaataatgatgatgataataatattgatgaaattagaaatatgagaaaaagggaaagaattagattaataaaatattggtatcattattattcaatttatttaaataattattatttagattttgaaaatgaagagattttagaatttaattggttaaatccaaatttgaagaaattaagatatactttgaataattttccatataatacaaaattggtgaaaaatatggatttaaaatttgatttgaatataagaaattgtaatagcaatagtaataataaagataatgattgtatttatgatttgggatttgtaattccaataattaattcaagatttaaattagcttattctgtattaagagagagaggtttccagaattcaaagaataagaatagaaatttgatgaatgatggtattaaagaatttgatgatacaatggaagaggaaagaagagaaggagtggaaggagtggaaggaggggaaggagaaggagaagaaagaggagctgatgctcgaacttgctcaggttttgtggagaattatagtcaattaagtgaatcaagattctttaataaggtgattgataataactttatttggttgagaaatttctgtaaaaatggttctcttcaattacttgtcaattctttatcttgtcctgatatttctataaggtattattcttatcagcctctgagtatactttacgaaattattagttttcactataacaaatatcttcagaaggtgagagaccaggaaaaagaacaggaaaatgagcaggaacagggtcaagaccaagaacaagaacaagaacaagatgaagacgatgaagatcaggagcagttagatgataaggatcaagaacaagaagatcaggaacagatagaaaaagaaagtcatataaaagagatggaaactatgaataagaaaaaaagaaataaaaaacagaaaaaaaaacatataagatatatatttaaagaacttcctcaagtatttatgattttgaatactttaaagaatactgtatcaggaacattagtaactgagcatagagaatcaaattctgataaaaatgatcatgaaaaagtaatcgaaagtaagcatgaggattgtattagattatcatcttttttaacaagatttatctcagattctattgaaataatatttgaacctgaaaataagttatttaaacaagttaattattttatgttatcaagatcattcttagatagatatgatattcctttattatttaatttattatattcagaagatgcaaatgatcataatatatataaatcttttatatttaatgaattagaaacaagtattcaagta

SEQ ID NO: 1440 - DNA, 1059 bp, Cryptosporidium hominis
atgagtaccgactttatgaatgtaagaagaagtgcttgggctgatgaagatattgatgactttgaaccatcatttgatgaaccattaaaaggttttgaatcaaaacctgataaagatggtattaaacatgtaattagttatattaaagatagtaaaggctctactattaaaatcacaaaaaaaattaaagaagttagaaatattataaaaattaacaagaatattgtgaatagaagattaactatggaaagaaatcttgcagatagattcaattctgatacagatgttccaaaacttggagatgaaatatctatagatattccaaagaatacagattcaatgaactttcaagataaagataatgatgatgattattatttcatggatttacctacatctaataacaataaactatcaatgtttaaaaaatctggaaataattatccattcattcttggtgatgaacaaattgaaaaaattacttatggacaacaaaataactctatgaatgatatgaattcatcttttactggtggatttggatcgaatgcttcctcttctaatggactaaatcttggatttggtacatcacttacaaacaaaggtggaatcagtgatgttaaaacaacagttggaggtggtataatcacttcaaatattaactccagtaacaatactggaattaatactattggtacaagcattgcaagtaataatgctaatagatatcaacctccattccttagaaccacttccagtagtgcatttgaaagaggatcaaatttacaatcatcacatagagatgattgtacagtcagagttgcaaatctttctgaagatgcaactgaagaagatctacaagaactctttaaaactgctgggagagttgtaaaagtctttcttgctaagaataaaaataattccaagaatactaaaggttttgcatttattacttattctaagagagaagaggcccaaaatgctattagaaaacttaatcgtcatggatatgataacttgctacttaatgtagaatgggcaaaaactaaagaaaagtga

SEQ ID NO: 1441 - DNA, 471 bp, Cryptosporidium hominis
atgacttactgcaatggattaatattaaatgaatacgaacaagaaaatgaagatacaaataatatacaacattcgaatgaaaattataataatcatgaaaatagtagctatatgagtatgagtggttttataccccaatttattcaagcatcaaaatatttcacgtgtttctatggatcaaataatattgaaaattcttctttagttaataggtctaatcataatatgtcattgactacaactattactggtgaaacaatatctgaaaatgaacaagaaattataactattactaataataatccaataaataatacgaattattcttgccaaaatcaaagtcaaaatcagattattgattttgaattagatacaagttgttatttaaatcaacatgatggacaattggcgccattctgtcctataattgacgatgaaaatgcttttttttccaaaaataaaattctttaa

SEQ ID NO: 1442 - DNA, 291 bp, Cryptosporidium hominis
atggattctttagatgaagtgattcacgagaaatttacatatgtttttattccataccatgactctgacaaaatagaagttagagaattttctggtaaggaagtcaacttcaagaatttaatgcgctcacatttttccagtaaattaagaagtagtgaagtttctaaacttcaagaaacatttaataaggaatcaaaagcttcagaccaacttgttgaacaagcaattttaaatagtcaaaatatgaaattattagtcttgtattaccaaacaaaagtaataattttatag

SEQ ID NO: 1443 - DNA, 402 bp, Cryptosporidium hominis
atggtgaatattacttatcattcccaagtaactccttcaaaacaaaatggaccagtttttattctggttggtaacacattcaaagaaatagtttatgattctactagagatgtattagtgttattttatactccgtggtgcgggcattgtaagacttttgacccaatatataatgaagttgctaacattgtaacatcaaagactaatgttcttgttgcaaagattgacatgtcagcaaattttattccagacgatcaaattggtcgaaaaatctttagatttccaacaataaaattgtacaagaagagagaaaaggctaatccaatagattttgatggagaaagagaagttaattctattttagactttatttggatacatactgctcgtgatgagctttag

SEQ ID NO: 1444 - DNA, 534 bp, Cryptosporidium hominis
atgaaaggaagtgtagtatatagagatgaagaaggaagaattattgataaggagttatggtacgagaagaaaataaatgaaaaaaggaaatcgaagaaaagaagtattaaaaacgaaaataagttcacaaaagatcccgaattcgttaaatatagtggtggtattgttcaatatgaggaagctaagaaaaaatatgcgggtgagaacaatctgataattcaggatgaaataatagatggagggcgttattatttgagtaaaagttatgatgatgaattaaagaaaaaagatatttgggatgacccgattaaactaataaatgcacaggataacaatataagtaattctggtttgaggagtgattttgttgatttggaagctaaaaggcttaagtgcaaatttattactcctcaaaatagattttccattgagagcggttatcgttgggatggagtgattagaggtaatggttttgaagaaaattatcttattaaaaaaaatgaaaaaaataatactatttataatattgattga

SEQ ID NO: 1445 - DNA, 579 bp, Cryptosporidium hominis
atgggaaaagttgataatggtgatttttttccactagaaaataattttttatgtttaaaagaatacatggtgaatttgaataatgaaaaaaatcataatgaatatatgaatttattgccaaatgattcaggcaggcataattatttaagttcaaataattcagaagattacaaattttattcacttgattataatatagaggaaaataaagatttttcaaatatggaatcagaatatgcaagtagccacgaattttctaaattaatgatgaaaaattccaaatttaaaaatattattgttgattttccatcaaaatttaaatctgttggtgaaaataattcaaaatcaactttatcaaaaagatctgaaaaattatcgaaatcgtcttcattgaataatattgacatacctaaaataaataatgaaagaaatgataaagaattggaattattatttcaaaagataaaaaaattcatgagagaaaaatatggtgaatataaaagattattagaagaagttagtttatgggaagaaaatgggtataaaaatggaatcaaatttttaaaaagaaagaaataa

SEQ ID NO: 1446 - DNA, 2184 bp, Cryptosporidium hominis
atggaggaaaaactagaaactggaaaggtttttatagataaagaagttgtagactggagtcagtatactactatggactctacacaagaagatacaccaacatgtggaattggtgaaaattttgataaatctaacgaagttgaagttggtaatagtaaaatttcacaagtccaatctcaaattgaaaatcatgttgaaataccagacgaaaattctaatgaaaaatttgaaaattctaaaaatatcattgatgatgttactatggagcagaatcatatagaagttcagaaccaagagggtagttttattaataaagacgaagctattaatgatgaagattctaaatcagatgaggaaaagaacagcgatgagggtgttacaaccgtggaagttggcagaaaagattttaatagttctatagtgtctactagaaaaggaactgggactagattaagaagagcagaacatcaaagtggggttcctggagtttattggcaagaaagtagtcaaagatggattgctcagtggagtgattctatttcaggaagaagaattactcacggtttttcagcaagagtatatggttttgaagatgcaaagcaaatggcaataaaatcaagggttgatgcaattgaaaatggaaaagcaacagcaagaaagttacatgaaactagtcttacagggaagatgtatttaaatatgaataaaagttgctatataggcagtggccatcagggtgagactggagtaggtgcatcaataaactctcataattatattggaggtataaaaggaatgagaattgcaaagtatggaacagcagaatatgaaaagcctgaatacttattaaaggatgatagatcaattgttatgaatttgatggagaaaaagaatatacaaaaaattatgaataatatgagtgatgaaggtattggattacttatggaagaaatgaaacatttaaaagaagatgtcgaatatgagggaatattttggcatccaataaacaaagtctggataggagtttggctagattcaataacacatgaaacatgtactcagtcttttgcttatgagattggcgaggatggaattgatatttcaagattaaaggcaatagaatggagggtaaagttaatcaatgaaaaaaaattgagagataatgtagtagagtatgttaataataaagaatttaaatatcataataattactctggctcttcaggaattacaaattcttgttttaatatttttaacaattatggtaattctggaattataaatcccttgaataccgatggtaatagtaataataacagtaatggcaatagtagttcttcattaattaattttactggttctagcttctctgctttaaatggcttaagtaataataataataattctactgaggggagccaaccaatacttgttcaaaataataattatcagctattattaagtcaattaatgcaatatttatatggtggcaacaataataatagcaataataataatactaataataatactggcactaataacagcagttataatggacttataagtacaaataacagtaattttggagctaatactggaaatgttggtaccaataatatggtaaccgattacaataatatgattctatcaaatatgttactgttgaatggagcattaagtggctcaagcccaagtaatataaataacgctaataacatgaatactaatctaaattctatggtttccaattatttgaatatttattatggtaatatgttaaaacatcaattttttggtgataattctgaagggtttactactaagagcaacaacaccaataatatcaatggaaattgtaataattcaccatctttaaacatgttgaattctattgattttaattatctatctcctttgcaagtgttaaatgattctactcttgaaggaatgacaaaaagtaaaatgatgaatagtttattactgggtaatggagttaataatggagttggagggtattttagtaactattcaagtttgaatacgaatttggcaaatatgtttggaataaatcaagcaagtggagctaatggaacgattaataatacattcagttctggaaataatcatattaatcatctaagtaatcaccagaaccaatatatgtataacatattacagaat

SEQ ID NO: 1447 - DNA, 681 bp, Cryptosporidium hominis
atgaagaatggaaatcatttagtgaggcaatgtcgttttattgagaatggaaggttaaatagccctagaagacagaaaaataacgatagacaacagtatattgtttcaatgttattacatgaaatcagaggctcatcctttataacagtttggaatatgaagatatctaaagaaaatgcaaatgaaaatccaaataatcgcatattatttgcccaaattgcctctaatttgatttgtgataaaccatcttctgtgctagttgtttctgacgattataaacttttggctgttggtactaacacaggcttaattaaaatattcaaaaataatctgactgagctaactttacttaaagaagggatttttcatgagctcccagttactggtctacaattttttaattctaatgaatatattatttcagctggagctgactattccatttctgtattagaaattaaatctagaaaaaattctgcgaagtctaataataaacaaatgaatatggctaagagcaatcaaaatggtggaatgtttggcgttggcctaaatattattaaatatactttactaactatatttattatcatgtttatcactacttttattaactattcgattgatattggagttaatatacaatcatccattagagacgggagtcaatccacagagctttaa

SEQ ID NO: 1448 - DNA, 117 bp, Cryptosporidium hominis
catgatgagacaaataaaattttaaataatgaattaatcaatctaaagaatgatgggaaatgtatcaacacaatttctattgaattggcatatgatggtttattcttacctatataa

SEQ ID NO: 1449 - DNA, 1104 bp, Cryptosporidium hominis
atgagtagttttattctttttttaggttctggtaccgaacaaggtacgccaaatcttgagcatgtatttaaaaatatagataatgttaataaaggaaacgacccattttgtgatatatgtcaagattcaattaagataaagaataaaaacgtacgtaatccattttctattttaattaagaatccagttaataatttaaatagttctgaaagtgaacgccatgatacatttctctttgaaattggctcaacatttagaatatcaatgctagaatatgcaatacctgcaaatattaatagagtggatgccattttttgtatgggttcggatgaatcatcttttaatggaatagatgaaacaagagaagttcaaaaatatgaaagaccggtgggaaacgatggaatagtattttatgaaccaaaaattagagtaccaatatatttgacatcttctgcaataaacaaatttaatgactggtatagttacataattaattattctttaaaagatgatttaaaatcaaaaacaaaagttggttgtgttcaacttaacatacttgatccaagaaattctccagatgttactacaattgattcaatatccaaatttaatgattatattagctcgaataatgatattgagataagtgatgatattgataaaaacttaactttgaatccagtgattattcaatattccaatgaaataaaaattacatcattattttttattgattcagataataaactttcttctggatattgtattgaatatgcaagtgataaaaaattgatttgcgttattccaagatattctattattccaaaagaaactttagcatttttaaaaactattcaacttattaatatactcatctttccaattgtcccaaatgaatcaatttcgattaattcaaaatcaatcaaagattcaataaatttttgcgcaaatatgataaatactgagaatatattcttttatagtattgattgtaaatattcacatgattttgttcaagaaatcgttgataaaaatagtattgaatttcccaacttaaaatttacggtatctttcgactctcaaataattccaattattacctaa

SEQ ID NO: 1450 - DNA, 246 bp, Cryptosporidium hominis
atgcaggaatttggaatatttgaagctggattaaagaaacatagacttgttttttgtgaaaaacctgaatctattccaaatatggcaagacaactacaagctaatatgcatattgatacaaatcaagataatgcacagaaacttttaaataaggttccaaatatttctattctaactttcgacgatgacggaggttcattatatgaattggttgaaacaattgaaaatgttgtaaactcaaaataa

SEQ ID NO: 1451 - DNA, 1803 bp, Cryptosporidium hominis
atggagaacaagagaagaacagatataaaaaaacattcaatttttgattataagtctcttacaaaagcattagacgatgcaggtgtcaaaagaattcatgcatatacaatttggaggaatattgtacaaaaaggcattaaggatatgtcagaaattaaggatataccaaaagctgcctataaaattataaatgaacaattttctatcttaaatatacaattaattaattcacaaacatccaaagatggtaatacaaccaaaattatcttcagattacaagattctcatgaaattgaggctgtaattatgagatacggtgatgatcaggttaatgaaaatacaaacatttgtaacagtaatagtaataataataacaatgatagtaatcaacaagaaataagcacttcatccaagtataagagaatctcaatatgtgtatcatcgcaaattggatgtagaatgggttgtatgttttgtgcaacaggatctatgggtcttagaggttcacttttatcaggagaaattttacaacaattatattatataaaaaatatactcaaagaacctgtgagaaatgttgtttttatgggaatgggagaaccgttggaaaattatgatgaagttattgattcaattagattaatggttgatcctagaatattctcgttatcttctggacacattctggttagtactgttggtataccttccaatattgttaatcttgcagatgatttacctggagttggactttgtttaagcttacatgcaccaaatcaatcacttagagagagaattgttccaattgcaagattatataaaatttctgatttaatgagatctttggatatttttattttcaagacgataattaataaatgttataaaaatttattagatgatagaaataaagatcacattaaagacaatatgaattatgatgatattttaatctcgaataaattattatatggacataaaatgataattattgaatacacaatgcttaaggatgtgaatgactctgaagatcatgcagttgaacttgcaaatttgctgaaaaatactccaatttcaaaaaatattattgaggaaataatagataatagagatgatagtgttaaaatgaatattaataattatatgtctgataacaaaataattaataaaaaccttaaaagtcatattgcaagtaccatctttaaagaattatctaaagactttaatagaaccaattttgctatagttaatctcattccatacaataaaaccaatacgagtactcgtttttccactccatctaaagaaattattaccaaatttgccaaggtacttattgatttgaatatatttgtaactgttagaagaaaaatgggggatggaatttttggtgcgtgtggtcagcttgcattatttcaagcaaaaaattataatattgaagatgtaaatcaacaattaggagtttctgatgatgaggataattctgatgaagattttattgatgatgagttatttatgaattcatctgaaattgaagattctgagcttgaagcaatgacaaagcctgttaataatagtaataattcaacaaaagcagcaaatttaagtgccaattcattatttaccattcaaaacaagtttaatgatgacttcaaaatctcaaatgtattttcaagaatcttcttatcatattataatttatgtaaaagctttatattaaataataaaacgtcaatttttctattggttgggtcgggtctttatattcattacttttttagaagaaataaaagattgctttaa

SEQ ID NO: 1452 - DNA, 1338 bp, Cryptosporidium hominis
atgggaaattcacatggtgtacttggggagggggggatgaaaaataataggaagtcaaagaacaatggtaaagatgagaaaaagaaattagaatccgccccacctccaatggaaatgaaaaggaagagaaagcaaaaaggcccaccacaatatgctagattgccggcagtagttccaaatgccaaatgtagactaagattattaaagtatgagagaattaaggactatttaatgatggagcaagaatttattacaagtatggaaagtgtaaaaccatcagcagagacagcagaagaagaacacaataaagtcgatgatttaagagggtcaccaatgaatattggaactttagaagagatcatagatgagaatcatgcaatagtttcatcatcagtagggtctgagtattatgtaaatattttgtcgtttgtagacaagaaccaactggaacctggaagttcagtattattacataataaagtatattctgttgttggaataatgaatgatgaggtggatcctttggtttctgtaatgaaagttgataaggctcctttggaaagctatgcagatattggtggtttagagcagcagatccaagaaataaaggaggctgtagaaattcctttaacacatcctgaattatatgatgacattggtattaaacctccaaaaggagtaattttgtatggtcctccaggaactggtaaaactcttttagctaaagctgttgcaaatgaaacttcagcaacctttttaagggtagttggaagtgaactaattcaaaaatatttaggagatggaccaaaacttgtacgtgagttattcagagttgctgaggaaaatgctccaagtattgtttttattgatgaaattgatgctgttggtactaagagacatgactctcaaagtggaggtgagagagatattcaaagaactatgcttgaattacttaatcaattggatggatttgaggcaagaggggatgttaaagttattatggcaactaataaaatagaaagtctagatccagctcttattagaccgggaagaattgatagaaagattgaacttcccaatccagactgtaaaactaaaagaagaatcttccaaattcatacaagcaaaatgactctatctgatgatgttgacttggaggaatttatcatggcaaaagatgatattagcggggcagatattaaggcaatttgtaccgaagctggtcttctggctcttagagaaagaaggatgagagttacacaagaagatctcaggaaagctaaagaaaaggctttatatagaaagaagggtggaatacctgaaggcttatatctctag

SEQ ID NO: 1453 - DNA, 333 bp, Cryptosporidium hominis
atgagcgcttttataagtacaagcttttctcttcttttaaaagagctattctccaataaatcaattgatacacttaaagataagatacttgaaaatattgatataaaatcagcacaaatattaagtaaaaatattaaaaaaaagcatgtttctaaattatttaacagatttctcttattttcttttttattcttctctactggattaggttactactattatacaaagatttataaaaaacgaacaagcaaagatcctaactacaaagcttataatttatttggtgatatttttagtaaattttccagaaaaaaatttaccaagctgacttaa

SEQ ID NO: 1454 - DNA, 216 bp, Cryptosporidium hominis
atggcaaaatgccgtgggtttaagccaggaggagttgacaacccatattattataataagagaaagattgtcaaacaagaaggatctacaatcaaggaaagacttcaaagatcaacaaggccaacatgggaggaattaagaaagatggcaaataaaacatcagagggattctgtaatattgacgataatactataagaaatgatgaatataaaaga

SEQ ID NO: 1455 - DNA, 411 bp, Cryptosporidium hominis
atgtttggttttagtagatttacatctggtaattttttctcaggaggatttgaaaatgacaatatacatgatgattttgaacaaattaacagggggggatctaactttagaagctcaagttctaatctatttatcaatgaatattcttgttatccagtaagttttgcaggaagagatgagcttgaaggtggaaacaaaatactactacctccatcagctttaaatcaattggctagaagaaacattacttggccaatgttgttccaaattagcaaccctacaaagaataaattcacgcattctggtgttttggaatttgttgctgaagaaggcacatgttatatgccttattggatgatgcagaatcttgaattacaagaaggagatattacttcaattatgaatacatca

SEQ ID NO: 1456 - DNA, 1419 bp, Cryptosporidium hominis
atggaagcggatattacgcccattgggaatagtactggtggtaataatatctacttcaaaggtaataacccagaccagatatcaattactgagattagtaatgataatttatctaaaagagaaagtagatggtcaaaagtgagtgatggatctacaagtagatggaaaagtgtatatgaaaaagagtatattcctccagcttactcagactttcctccaggaatgagtaactatgaaattgatcagtttttaagagagcaaagattggacgaattaatttacaaactgcaaatgggagaaatagagtatggtagtccagatattagagaacctagtccacctccaatttacgataagaatggctcaagaataaatacaagggaagtaagagtaagaaagaatatggaggaagaattatcaaatttaatagaatatatgtcaaaaaatgtggaaggttatgttgtaccaaaagattataaaccattaaaaaagaccaaaaagttgataatacctttagataagtatcctgactataattttatgggcttaattataggcccaagaggatataatcatagaagactagaagcagaaagtggcactcagatttcaatacgtggaaaaggaactactaaagaaggaaaaaaatgtgatcatcaaactgaagaagaattggcgatgccaatgcacattcatattactgcagagtctcaatacaaactggataaagctgtaagtatgattcagccgcttttggatccttttcaccctttacatgaagaatataagagggatggattgcaacaacttgctataatcaatggtacattgaatacaaatttgaataactctagtagccttattaatacattttcaagtggaaatactgctataactttggcaaaaggatgtttacattgcggctctacacaacatcctacttacgcctgtccagacgttaattcactcaattcatttaaaagacctgatattaagtgcagcatttgtggtgacaaaggtcatattacaaaagattgcaaacaatatgttcccaacaataatgtcgaagaagaatttaagaaaatgatgattgaacttggccatgaagtaaattataatacagaaacaactaataatgccattgaacattctagtagtgagtacaatacaagtggtgattattatgaaagtctttattctaataatgatggccagagttactaccaaaatggctacgatcagcaaaactacgaataccaaactgaaatgaataatgatagtaccaattttgcttatcaaacttaccaaagcagtatttatgataataatataatgtttaataatggtagcattcataatcaattgaatagcagtaacaacaatgatgatgacgatgataatatggatgaatcagattaa

SEQ ID NO: 1457 - DNA, 792 bp, Cryptosporidium hominis
atggaggaagcacagctggaaacatctccattagaagtatgtcttagtaatttgattggaattgatattagtagtataaatgaaactgaaataagtaaatctggggcaaataatttgcagttaatgttgaattcaatttggtcagatctcagcaaggaaaatacaaaagatggaactgttgtaagccttccaagtaaacaggaaattttgcttcctagagcatatcctcttccagcaaaaagggagaagactagatgggaaaaatttgctgaacttaaaggtattaaaaagagaaaaagatcaagaatggtttatgatcctattactgatgattttgttccaagatggggtagaaactctataaagaagattcaaaagaaacataatgaagctattattgaaattaagggtaatatggatgaaaacaaagatccaagagaagctattaacttaaagagagatatgatgattaacaagcagagacttagagagttaaaaaataaaatgaattcttctaaaaatataaataattcaaaatctgatgagtttgctttaggtattggaaacttgaaagatactaacgttaaaagaagtaagactcaagtaaaggaactttttgatagagtttctttatcaactgcatcctatggaagaagagataaagcacttccagatgaagatcgtacaactaataaagtaaaaaaagtaaagaaaattctcgatactaaaaatgaaaatgaaaagtataaaagtatttatagtaaaattcttaaacaaaactccaatctctag

SEQ ID NO: 1458 - DNA, 384 bp, Cryptosporidium hominis
atgctttcaactgaacttttatggcaatgtgttaagaaaaacacttctttcattaagaagagcaatggcttcacttttacctctgaaccattcaacataatgaacttgaacaccttaaagtactcaggtcttgctgcaagaaggtcaattagcatggatttagttccaaattccaatggaaagcttgttaagaatgccaagataaccaagaagaacactggatcaagtactattagatgcccaaagaaactcatttctaaggtaaatctctccaatgattttaaacaagcaaagaagacaatcaaaaatcaaatctcatcccgtccagatttgaagaatgttgctatcattagatatagaaagatccaaaaggctaagtgttaa

SEQ ID NO: 1459 - DNA, 689 bp, Cryptosporidium hominis
atgagtaatttaaaagggggtatttttgatgattcttacatgaataatgagtcaattatatctgctgatattcttagcaaaagaaatctaagaaaaatgaatagtgatttagaaactattgtacctaaagttaaaacaacaaatttagtgaataattcaacctttatcattagcaacaaaagcagtacagtggataaatatttaaatgatcaaaaaatagaacattctaatgtaactgaatcaaatgatcagcccaactacgggaccaatgccccaattgtaagagcttataaagcaacaattcaaacaattaattcaataaatgaatttcaagcgagtaacaatatagaaaagaacataaacacaatcaataagaatgtggctagcaatgaaacagattcatatttaatttattctcctgaagtcaaacttttagacttgcaacctacaagctatataggagctaataatttaaaaacgactgatacgaatttagcaaggagtaacaccacacctctattgaataatactagtaataataataacaaacagtactacccagcaaacttacttaatagtagaagcaatagcagtttttttaatatgaatgcaactcaaaatataacgaatactacacttttaaacggtaatatcaatatagtaccaaataataatacgaacaacaacct

SEQ ID NO: 1460 - DNA, 837 bp, Cryptosporidium hominis
atggcaggaaatgattcaacaagaggagacaatgctactttatggagtattgtaatcaaaacagcttatagaaagaggagatcaaaaagaaaacaaaatgaacagaatagcgaaaaagatggattgaatttgaatggtagtaataatagtaccagtataacagaaaatgatagctttggcgacaggtattcaaatgataatacttttttttcaagtaatcaattaggtttaggaatttcagatactaagaataatggaagtgacttattaaattacttattggatggaaattctggacaagaaaacaaaaggttggaggataagaataaaacttcaaatttatttgagagaattaatggtgaaaataattcaaataatagttttttgagtgagttattttcaatggataaattgaatggtgatggtaattcaaaattatcaatagattgtaaaggagatataattttagaagaaaattcattaaacaatagttctggaaaacaaatggactggcttggactaatggagggaagagtatatattaatgagaatatggctggtacatctttacaaccatattctggtgcttataaaagaacaaagggtaaaagatggtcaacagaacaaactaataaattttatgatgctttatcactatttggtacagatttaatgctggtaaaatcagtctttccagaatttaccgataaacagattcacgataaatttaaagcagaagagaagaagaataaggagagaatggatgatatattaattaataataagaaaaaattaactaaagaagatgttttaaggtttaaacaaaaatataagtaa

SEQ ID NO: 1461 - DNA, 258 bp, Cryptosporidium hominis
atgggtggagatggaggtagtattccaaaaagagcagatgttgtcaaaactaagggttatggatttaagagaaatttgggtggaatgggttacatgccaaatgcacaagtaaaattaacaaatgaagaaaattcaacaaaacttaaaatgcatgaaagatggacaaaatgctatctaactaacgtaagtttgtcattccattgcactttttttacaaaactatttctttgttttctttggtattctcaacatatttaa

SEQ ID NO: 1462 - DNA, 1443 bp, Cryptosporidium hominis
atgaataataaaatattttctttaattttccttttctttaatattttgaatttattaaatggagaagaaattgatagcaaaagttttcaattatcagacttaagccttcctaatatggaagcagagagcatgaattttgggattgatggaatgagttttaatgatggaatttatgaggaaaatggagataaaatgagtattggtggtacgaatattgatggatctagtattggaggtatcagtattggtggtactagtgttggaggatccagtgctggtggtacaagcattggtggtacgagcattggtggtactagtgttggtggtactagtgttggtggtactagtgttggtggtactagtgttggagggtctgatctcgaggaaaccagtcaaggctttgggagcgatacatccattgattttgaagatggtgactatggaaaaacatccggatttgaaacttcatcagacgaacaaagaaaagattcaacatccgtacaagattcatcaagtaatctttcaattggagggaatcaagaaggggatgtcgtctcagatgattctggttttactgaaaaaaatcaagatgatgaacccaacaattcaaacgcgaatggtgtttcttcaaatgaaaaccaagatgacccaaaagataaaatagtaacatatggctttggaggaggtcctgttgcaccacctgcatcaacaacaactttatctccagtcacaacacaatcaactgatgcaacatcgagcagtgacgcaacatcgagcactgatgcaactcagacaaccgtagtaacagatccgccaacaacagctacaagcccaacaacaactacaagcccaacaacgacaacaacaacaacagaaacaacaacagaaacaacaacagaagcaacaacaacagaagcaacaacaacaaaaacaagtcctccaaccactacaccaaccactatgccaactactgcacaaacaagtactcaacagactactgcgccatcaacagtttctactgaattaactacaactacggccgcagctacaactaaaagttcggtcgatccaggagtagtagctggagcagtagtgggaagtcttgcaggtttagggttattaggaggattgggatatggatttaaaaggaagaaaactagaggaggagatttaacaggtgataatattggaatgagcaaattaagaggcacggatggaacatttaaaactattgatgttactgatggcgttcaaaatcaaattcaaacttttggaggtctaggctatggacaaagaggaccacaaaaagcttctgactctccatttgtaatttctggtagtggtagtggtggtggtggtggtggtggtgaaggtcaattaccggaatacgctgtaagaggagtcgataattatgctgacggattttcattttttgaagattaa

SEQ ID NO: 1463 - DNA, 1794 bp, Cryptosporidium hominis
atggaaaagacaattactaacatttatggagaaaaatatagtaaaaataataatttggactcaaatttaatgagatatggtaaaaaagaattattaaatagtagcgaaataattagtttacctaaaaatgaaagaaagttaaaatgtgaagatttttcattaaataaaattgtaaaaaatttaaatcatgaagaattaatagaagaattaatgattgatttatcttctttattagtgaagctaaaaaatagtttggaagaatatcaagcagaaaattgtgctattaatataaagaaaaatgtaatagatttggttagagtatgcatatcagttggattaagagtaggtgcaatattagaagagaaatgcaagcttttaggtgaagattgtacagttttgagtaaatattcgttaagttacaactggtttatttattggaatgataattttccaaagagcaccggtatttcaaatgatatacaagaatttaatgaaatagaaatggataatattatttctcaaaataaaaataatattgaagaatatcatgtatgtacagtaaattgtgtaaaacatgaaaaatttattagtgattttaaaatgttaagtaaaatagcaaataatttattcaatcaagcatttattatgagtatttggaatacaaaaaatgataattttattgaaattgagtattttaatattaacaataatgttacatctattctagaaaatgatatttattatgctgataatcaagacaatgatcaaatattaaatgataataaattaattaataccaattttgaaaaaaaatccaatattgatcatcattattctcaaaatcaaaattcttataaattatctattgatgaaaacgaattgaatgttgatgaaatagattacgatgaagaaatcagtgacaatttaagtaataatgccaattatattttattgccagaagtaattgtatgcccatcatcaatacatgattttaattcgaacaaatcaatattagaagttaaccatagtaatagtaatagttgccaattttcagaaattcaatttggtttgataaatcaatcacgaagagcttctattgttatggaaaatattgatattgaatctcttatagaatgtaaaaacaaggttacaaatattaagcactctatgattaaaatacgagaagttcaaactgaaatttataaattaattattgaaagtactggagaaatagattatctagaagaacaatcagctttagctcaaattaacacagcacaaggtgcatcatctgttgcaaaaggaagtaaatcaaaagctaattggtggccatttcatggttctactgctggactagtttgtggaggtgctgctggattaattttaggtcctattggagtgagttttggtgcagcaattggtggtgctttaggtttaacttttggtaatatgatcaaaaatcattgtcatgaaaaaatggacgatattattaaagaatgtgaagcaagaacaacaaaaaaaaaaaatcatataaattcaaaccaaataaaaaataatgaacaaataatgccaaacattaattttataagagaaaatcaaacttattttaaaactattattaacaaaaaaatggatgaaaaatatcaattattatttgaagtaaaagataataataaatctaatcataaccatttaataagtgatagtaattcaataattgaagaaaaatatgataaatatatatcaaaagcaactttgagtgacatactagaaaacgttgatattataccataa

SEQ ID NO: 1464 - DNA, 2406 bp, Cryptosporidium hominis
atgaccaatttaaacaataaaaaactgaataataatgatataaattcggaattgaaaatatactcccaaaggaatgtacaacaatgtgcagaatcattcttgagagttgaagaaaataataacaatagtattgaattaattaatacatatagatttttaaacaaccatattccacaagattttccaaaatcaagaatatttaattttgataataaaaacatttcggaaacaaataattaccatattagaagaaaatcaagtaattctggagtaaagaataaacagaataataatgaatcaataactgaaattattaaccataaacttcaagaccattttgaaagtattaatcattttgaaaagataaaattcttgatttcaagtaattatgcttttgaaaatatccgaaaattgaatattcttcctccaattagaatttatgagctttggaaagggactccaatggatattagacagattttatttaatgcaatttccataattttaacaaatcgtataaaaatttggtccaatattgatgtaaaacaaaaagattactttattatatggggctgtaattatttaagccaaataagtacttatttatcaataccagaaataataacagaacaaatgataaaaatatactatttaaatattgatgatccaaatattgagaattttccagatattagaccattaaaaaatactttgatagagtattgtaaaaatgaattacaaccaaaacttgatattttatttaatgaatatagttgtaataataatagtattaataataatgtaagatccaaaaatattatgaagcaaaatagggatttaaatgctgaaacttttttactgatcagaaataatagtgcatttgaagtttcatataataattatgaacagaatactcatacacatccaagagcaagttcattaaataatagaatatcttcgaaaatattaaatttaccattgaatttcccaaatgcttttgataataatttgaagatatttaataatagcaatactcattccagtaataattgtaatgttaatgcaaaatcaaattgccaaagaagaaaaacttggcattcaggcattaataatctggaatatatattagatgaacaatcaccaagctcatttttaataataatattatcattattaagacttcatgcaattgatggaatattaaattcacgtactttatcaattctccaagaaatttatcttttgttgaattataataatgaatattttaaatcatcacttttaatttttgattctctccaaatgttaacttttaatgatattaaaaagagtgaacttaaatgcgataccaaaaatcttgaaaaaggttggaataaatcaatgagatatttaaaagttgctggtgctactattttgggcggtgttgtattggcaacagctacaacaattgcagcacctggtattcttgcaggattgggcacattaggattagcttttcctggaattcttggaacggccatgactgctggaacaagtgcagccacaatgtcagcagttgctggtgtaggaggtgcaggtctttcaggatggaaaatgagtagaagagaatctccattacaaatttttaactttcatcaagttggtgaaaatccggataaatctggtcttcttcctattttaattggtattagcggttggcttagaaataatgatgatatatttattccttggaaaattgcttttaatggaattgaatggatggaaagttatactgtagaatttgaacctgaagtgttatcaaagttaggtaattccatagcaataacaatgtcacaagatcttgccatttttgcaggaaaagctattttgcttcaaacagtggttggcactttaacagcagctttatcctggcctataacaattatgcaatatgctgcaactctcgataatacttgggcagtttcaagacaaaaaactgagcaggctgctataattcttgctgatgttttatgttcaattgaaactacaggtgatagacctattaaacttgttggttatagtatgggtgctagacttatatatttaacattacaaattatgtatgatcgtaaacaattcaataaaattcaagatgttgtattgttaggattaccttcatctttaaataccaagaaatggattaaagctagatctgttgtttcaaatcgaatgattaatgtattttcaaggtctgactgggttcttgcatttttttatagatatatgcagtggggattccatgtcgcaggaatttcacccataaatgtttctggtgttgaaaattatgatgttacgggaatgattacctcgcatgatcaatatcctgataaaattcgtgaaattttatattatgttaactttttttag

SEQ ID NO: 1465 - DNA, 687 bp, Cryptosporidium hominis
atggattctggaatttcaagaggaattagttcaagcattcgaagaaagctttccattctattggaaactttgagaaaggatcctaacttcgaattgtccatctatcccattggtcctgttagagatggatgcttagattacttttttttttttaaaactcctatggaccttattacagtttctaatctcctcttagatgatcaatataagaatattaaagaaatattccacgaaattgaattaacattttccaattgcctagaatctaatacttctcctttatgtcaacttattattgattcatgtgataaaggagagcacagatttctacaagaatggacaaaattacggttttttgataaatctacaaataagagactcgacgaattatctaaaggactgaacatattccaaccacccaatattagttcttgttctaatagccctattagttataataacactaatcctacagaaaccggttccaatacaaatcaatactatcctaattctatttttaacaatgagataattcccattattcccacattaacaatagtcataccaaatttccttaatagactagctctaaagcaaagcactcaacttgctcgctactattctacacacttctgcttctcctctaacggaaatcccattgagacccaaatccgcacaatcttgtag

SEQ ID NO: 1466 - DNA, 2052 bp, Cryptosporidium hominis
atgaagaattgccaagtaaaatcaattattagtggtgattgttatagttgttgtttgacagagaatggagaagtatatttgtggggatcatataaggatagtggaggatatataggattcccaaactttcaattaatgagtggaagtttagtgggttataaacagtataatccaataaaagttccaatatttggtatgaaagaagactcttcaaataaaagaaatatcggaagaaaaaagataaaattagaaaaggaaacaagtataaaaatggtaggaaaagctaaaaagattattggtggagagaatcatacaattgttataactgaagatatgagaatatttgcatggggaagtacggaatttggacaatttggcataaaaccagtagaggataaaatggaaaagacaaaatatttatatcctatagaaatagatcatgacactttgggatttcctaatcatttggtaatacaggatatatattgtggaagagcatccacattctttgtattaaaagatgttaataagaatattcttcaggtatttgcatgcggtagaaatggtaggaatgaattgggaatatttgagaaatcttcagaaaatggatgtgagaataataataatgaggagaatccaatagtttttaggccaaaaaaggtgaatatagtagattttgatacagaatgtagcaaatgtaagagtactaaaccaattaaacagattggaggaggacaatattactcagctttattaaattgttgtggggaagtatttatatggggaatgaaggactgttgtggtttggagggtcagttaattaagaatggaaatgagaagattttaaaagaaagggatattaaggtacctacaaaaattgaacatcttaagaatattataaaattaggatttggagcagatagctgttttgctattgatgcgaatggaatattatttgtttgggggatgaatttgactggtcagattggaattaaaaaactgattgattcagaagttgttttgaatccacaaattatgaatcctaagacttttctattagataatgatgattttgattccaattttgttttaaaagttgttggtggatctcaacattctatggctttgatatggaacggatcttattcaaataagttcatgcttgaagaagaagaagaagaagaagaggaaactgagagaagtcttaaaagaatgaatgcaaagaggtttgataaggagctggatatagagaaagaagaggaagtggaagaggaagaagaggaagagaaagaagaaaaaaaagaaaaagataaaaagagaaagaatacaaagactttatccagaggaggaagagctggaaagaatgatacagcaaagaccgttataaaaaagattgagaagagtaaatttgataatggcggggtcaaaactgcctcgaaggccaaaacaaagaccaaatccgaacctaaacccaaaactgaggcaacatccaagatagccaaaactaaagctaagactgaatccaagtcaacttctaaacctgttgctaaggcaaaaacgaccaactccaaaactaaggcaaaaactgaatctaaaaccgaatctaaaactaaacctaaaacttcctcatcttcttctaaagccaaaactgaatctaataccatcaaaactacctccaagaccaagacaaaagtagattcaaagacgaaggcaagcacctctaaaactaaaaccaaaactgaacctaaaaccaaagccaaaactgaacccaaaaccaaagccaaaactgaacccaaaaccaaagccaaaactgaacccaaaaccaaatccaaaactgaacccaagattgaacccaaaattaaacccaaaacctcctcctctactaaagccaaggctgaacccaaaactacaaaagccgcctctaaaaccaaggccaggactatgacaacccccaaaactaccaaaacaaaaactactgctaaatcaaaaaatgatacatctaaatcaacaactagttgtaaaaaaactactaaatgtagaaccaaagaatag

SEQ ID NO: 1467 - DNA, 2055 bp, Cryptosporidium hominis
atggaagatatatcaataatagaatgttcaaaattatatcctgcattatgttttgatttatacggtagcccaggttttcataatatatatgtgggattattggtaattatttcaggaatatggttagtaaatagattatcaaagatagtcgaattttatgaaatgattagaataatacaagaagaaggcaaggtgataaatattccatcattaggtccatattcaaatgatttgaaaaaattgataaagtcacatatttcacaaatcattagagaaagatgttcaatatctccaataaatgtaaaaaaattacaagtaatgaatatcatggaggaatcaacattaaaaacaaggttaataccaaattcttcatcttcttcaagcccagatgaaagttatagtttagaggtatcatttaaagttgatagttttgttcctcattcaatacaattattttggggtgttgattattttgcagcaaaggaattattaatagaagaaaaaaaagtagaaaatgaattaaatactattagcaataaaatgtcaagaagaatggcattaggatcaagtatatcaatgtttgatcaattaaagttaaaagagaaaaataacgaaaatcttgaagaaaataaggtagaaaaaaacacaaatattggcttagaatataataataatgtaaataattcaactaaattatttgaaaatatggaaattgatcatgatgaaaaagaaagaactgatttgaatgtaccatttgatttttcaccaagcgaatcaatgaaaagtctagcaaatattaatccaatattatatacaacagaaatatcaaatagaagatattacaattattttggtaatagtcatgatagagattattttgattaccatacaaatatgtcaagaagaggaatatttaatataggaccaagaattacaagaattttaccaaaaataaagcaattattaagagataatattattgtaaatacaataagtaattcattaaattattcaacatggaatagttcattgcttggtaataatgcaataatattaagtaggtcaatcaaaagattatttgaaaatgcattcttttataatacagtttctaatattaataataataataataataataataataatataaatcttggaggatttgctttaaccaaatcatcattattatcttcagcatcggttacaacagagttattattagataaatatcattatgatcaacttaaaagtaagagtggtagtaataacaaatataatattgatttaaaaaagataataaatcaaccaagtacaaatttggatgaaataaagtatcagatattaattgataagttgaacccaatgtacataacagaaaagaaatattatgaaaaaggattatcacaagattattctgagaaaattaaactaacaccagaatatttaacttcatgtaatttaaattctccatattatgatactcaagaacaagaaattaattctaaagatgaacatcaagtattaaatcatggtgattattatgagattcaaaataagtataataataaggaaatcttttggaatagtgatattattaattttaataaaaataatattgactcttcaatagtaaaaataaaaacagaaaatgaagaaaataaagaaatgccaagaataccattattgatattaattcgtgctaatattggagtaattgaagatgaatcaatattaactaataatattattgcgataaattttgatttaattcaagatcattataatattccatatttaatgtataaaccaataatattaaagcaagctatatcaaattctcatggtattttaattgaaccatatgatacatatggattagaagatgatgaattggattgtttgatatgtatgtcaaatcctaaggatgtaatactattaccatgtagacattgtatttcttgtgaatcttgtttaagatccttaagacaagataaatgtccattatgtagaacaacattttctggttttgttgttttaccgataaagaattcttga

SEQ ID NO: 1468 - DNA, 4473 bp, Cryptosporidium hominis
atgtcaaataaattcagctcaatattaagttttattgacaatctatttctaaataaaattgacaaaactgttaactatttatttaagaatcatcaaaatgatcaggaaaaaaacaaagataacagtaattataaatgtaatttaactactcttaaatctaaagctatcccatttggatatattattcattcagtgaaggaagatacaataactttggagaaagtaataaaagaaaaggaaaatcagcttggtgataagaactggtcaggatttgatatgtatttaagtatattaaaagcatttaaagaagattattgtaggtatgttatattgacatttctattaattgctttggatgcttttgttaaatacaagggaattctctttataggagctttaataggtactagaacagctggaaacaaagaaactggttttgttgcgagtattttcatttttattcttaaagctacttttcttttatctgatactcatctcaagtattatattatgagagttagagcaagagtaattggagctattaatggaatttcacttttaagactttcaaattgtgattctaatttttgtttatatcaaaatgaagattcggaacaacttccaaagtcgaagatttcgagatatcaaaatgtgattacagttgattctgatttttcagaaaatgctatctcatattcaattagaatattcatctttccgataaaaattgcttccacctttgcaattgctatcaaaacttttgatgatcattccatgaaattgttaatcttttccttatcaactttatttgctggagctataatatctttatttattagtactctcttcaaaaagccatttattgctcatagggaaaagagaattgctgaaactactaatattattgaaaattcaaggtctttaaatcttactcaagaccattttacttccacttttcacaaacttttatctgaaaccagacgaaacgaaatgctttttggatctttcagaaaatacttttttactattgaagaaattatatccaggtctatgggatatttctgttatggaattatttccatttatgtatggtataaccactttgatacttacaaaagtattgaaatgattattgactctgcaattctcgtcccatccttttacaccccacttcaggaattatgttatcttatatattacatctcagaaggaaataatgctcttaatagacttgcaaaactaatgcaaattacaagaagcaaatttcccgccaaaaatacgacttcttttgaagttattgacaaaaatgaaaatattattttgcatgcagattctatactttttggcgccaacattcccaaaaaaatagagatgaagtatggagtaccagtaatattttcgtgtaatgatatatcttataatcatttgttaactgatttatgtaggagggtggtttttggagttaatggaagggatggagttaggattgagttagaaagaagggatattttaggagtaaatgatcaaaaaattgaaaatattaataataggagtaaattgcaaaagaaaagagaaatatcgaatatattggcagacatttctaacccagtatgttatgttcccttggattcgtggattacagatggtatgagtctagctgatattattttgaatggaagagattatgaccaggattcatgggagagagttatagatatttgtgagctaaggaatgacttcgtatcttggggtatttcaacttatgatatggccaggagcactatattttcccaagttcaattcagtagaggtcaaaaggttcgcctttctctttcaagagcattatatcgaattgaatctaaaaatgatgaatctaataacgatcctcaagatggtgttccaattttgatattagattcaatatttagtagtttggatcctccagtttgttgttcaatacttgaaaaactatttaattatgaaaatggattactgaagaatgtattctctataatgattttggatactcaaatgcttaatttccttcctaataatattttggaatctataatacacgtaataccattcaaatatggtgaaaataggagttttggtgtcaatattgagtcaccaaaatcaactacaagtgttaatacgtcttccagcatacattctattattaatgatttctgttttgatactgatttttctaaagatttgtgggaactttccactgaagaggatgaagtcttaaatttaagtagtaattctaacggtaatgaaagtgaaattgctgataaccaaactcatacaaagtatgaaaatagggtggatatgggattaaatagtttaaaatgttgtgaggaaaaaaccgaagaatttattgagcttcttccaaaaaaagaagttttgggtggttcttcagaaaactcatactctactttatttttctatatattaaaagctgcaaatagatttaaatatccaaaaaattggtcaattactgaaaagattcaagaatcatcattagaaatgatactttatttggtattactattgcttcatcaattcattttattatttggagaaaaagtactattaggtaatttatcactagtaagtgaaacaggaaataaaattggtggaattataggtgttgatattctttatttcacatattttgtttgtattgttttggcaatactatcagtcgttgcaagtggtattctagaagtttacgttggattaagagctgcgaataatttgcataattcatttttattaggatatattggatcaaaactttcttcttgtatcagatatataccagtatcatttatattgaatagaatcagcttggaccaactcacaattgattattgtacaactaaaagggttggacaatttgttacagcagttaatagagtattggcaacaatatacttatctatattagcttcagaatatccaataatacagactatattattctcaatacttttctatataatatataaatatatatttaggtattttatacattcatgcagattattacataatacttacatttcagagatttcattactagtggatacagttagaaatatatgcgatggaaaagaatgtataagacctttcactcgttacagactttatttagaaaatggatatggccagcttcaagagattatgagaccaatatatattcagtcttctctggaagcttggctaaagattagacttcaagttggaattattattccattaacatttttcaatgtgttttcatcatatttttcaaatggaagttcaaaaatattaatagctttaatgattgctactgcttttggttctctaagcagaattgacgaggttgtgaggtatttaatgcgactagaaaaggaattagtttctgtggaaaggatgagaaagtatttggagcttattaaagatgaatacaaaatgaagaatgatttattagaaaacaataatgtgaaatatgatgacaacataaaaatgagccaaaataataatataatattagagtcagcatatggttaccattcaaatttatcaacagagaatgagaaatctcaattagatcgttcagaagttagaggaacattggtaaaacaagtttgttgtttaaataacataaatgttatagcaaataaaggagagataataggaatagttgggcgatcagggtctggaaaaacttcattactatttttaatagcaaaatctttgaaatataaaggaaaaataagccatccaatttcttccaataataatttactaaacagcaaccacttggtaaactgcaagttatgtagaagtaatgtggatgaagaaataatgaagatatttttggaagattataatatgatgagacatgttgcaatgcttcctgttgaggtattttttaatgaaaatacaacaataagagaatctgttgacccatttgaaaattattcaaatgataacataatttctgcattgaacatatgtggtgtaactaattatttattagagagagaaaccatgaataatttaaaccataagataaatttcaaaaattcttttgtaggagagaaaaaaccagatgaaagtgcacttcttttaatgggaaatgacagatttaccataatgaataattatttgaataggaagattagtgaattaaatttaccaatgcaaatacagaggttgttattatttactcattacttcttgaagagaaatgaaataagtattttactaattgatgagcctccagtaatttattgcaatgataatgtgaatatgaactctacttcaaacaagaaatcgactttaattacaaatattatttttaagtattttagccattcaactacatttattgttgctcatgatattagaaatttgaatggaattaaaaagttttggtatttacataagggaaccttaacaataaaaaagttataa

SEQ ID NO: 1469 - DNA, 4410 bp, Cryptosporidium hominis
atgttcaaatcattctttgataatatcttactattaaaagctggaaaaacagctgaattacttttaattaaagaacgtgaaaatagggaaaaacaaagaggaaatattcgatcttctgaaatacctgatgaatataaaaacgaggagtcaattaatgatattaaaacattagaaaaagccttcagagactatgataagctaaattataatgatggaaaggatatatggacttggttttcagtttatttagttatacttaaaacatttaaaagattttatggcatttattttcttctcttttcaattaatctggctatttcatactttgtgaaatttcaagcaaaagaattcttcaacttttttgtatcagaaacctcatcaaaactgaattggttaaatatactacctggattatttttaattatacttcaattattcagtatcatattaacaacacattgtgagtattataattcattgatacactttaaaatacaatcagccatttctggatcttcacttttaaggtttctagaatgtaaaaaacttaaaaataagcaagggctttgtattctagataataatagttcaacagaaatactatctttatatcaaaacattattttagtagattctgagttcacagaatttgccgtctcaaattccatcaacattatactttatcctatacacatattaatttcagctctagtagctcattcagtattcggaggcactcctcttattctttgtctaattgcattattttcatgctttacaattgcagcaaccactcaatatttaagttcaatgtataaaaaaccttttctcaaagcaagagaagaaagagtagaggaaactactcgtattctcgagcagtcaaaatatttatcagttactcaacaactatttccctctattcataatttaattaagagaaaaagaaatgttgaattacatttcaactctcttagaaaatatgtttgcatggccagcgaaatatttgataactggattaccttatcctgcactcttgtcattggatcttacattctatacaacaaactccctgttgccaaagcttctctaatgattattcaaagtgtatggttaattcctactttttaccatcctcttaatgatattatcttctttgtctattatattattgaaggtaaaatctctatggaaagaattgcacagtttctttttttaactcaaaatgacccagaccaaaataccagttctaacttaaatactgattcagatcctattgtatccagtattgtactcaataatattactttctctcgtggaaaaaatgtttctccaagtgttattaatctcaacctcacactctctcctggaacaccttgttttgttcttggaaaaattttgagtggaaaatccgctcttcttgaaggaattgctgggtttctcttcaattccactgcatgccaaaatggccaaatgcatgatgttggcgctggcgggctcttctcaattaagttagaaaatggtcaagtcgaaaatgtttgtgaaatctcttcaaagattttagttgggtatgttccacagttgatatggattttaagtggtcttccattatcagatctgattctctgtggaggtgaatatcaagagaaattatggcaacaagtaatatatcaatgtgatttagagttggacttcttaaattggggtgtaaaatcttttgatgatgcaaaacgtctcgttgttacggataagcaatttagtgcaggacaaaaggtgaggttatctattgcaagagcgatttattcttgcttatcatcaaatgaaaagaagccaagagtatttttaattgattgtgtgcttaattccttagatccatttgtttgtaagattgtaattgagagacttttctctaaaaatggtttattatctgattgtatatcaataatagttatagaacctccgatattggaatctgtaaaacaagcttcgagtaataatggtttttcttataaggtaattaatatgaataacaaagtgattacaagtactgaggaagtaactgttaattgtattcaaaattcatttgaggaattggtatcttttgattcaagtattaaggaaagatctaaccaagttgaagctgattcccgagaatatcttcaaaggtacaaaattccaagtaacgaaagaatggagacaactagtagaattgatataaaaaagaacaaattcagttattattatcctactaattacttttatatgtttatttctggatctaaaagattcattcaagacatttattctaataaaaaagatttttcaggttcttctatcgaatcctacttaatgatatttttattgatccttccaccaattatggtaaagcttggagaatctttacttttaatcattctcagagaagagagtattcaattaagttggaattctattgttttctttaattcaagcgctttagggagatttaaagcaatcttgtttggaatgccttcattctttggatataatgtactttctttttggttctccttctataatacagctttaattatttcaatggtttctatttgttttgctcttctattagaaatcagaattggttttagagctgcaagatatttccataattcattattacttggttatttgggagcaacttcaaattctattttaagatggttccctttgagctttatattaaacagactcactaatgaccaactacatattgactattgtattaccagaagaattcgattcgttattattattttaaattcagttatcatttctgtaattcctttgatttttggatctgctaattcattacttaccctaattataattggtcttattgggtcttcaatatattacttctttatacgatactttattaatgggtgtagaactttaagatcatgttatatttctgaatattcccctcttgtagatacgattcaaactattggtaaaggaaagaaatgcctaacttctacccaagtcaaagaattcttctttaaaattagtgtggatagaattaattcagtattgaagcctagatttgctcaaatatgtttggatgcttggtttaaaatgagaataaagattctattgacaattcctattacacttattaacattcttttaccttatatttcaagtggtcaagaatcatcaactagatctattctagcattagctatagctacagcaacaggattagctcctttattgtctattctcgttggttactggacaaaactagaaacagaacttgtctcagtagaaagatctagactatatatagctgcatctagagaggctggtacagaatatttaaaatgtggaataggggtacaacagaatgtgaaaagtaaaggacaagttaaaattgagcttgagaatattaaagcgcaacattctcgattagaatctcaaggaaactccaattttgataattcttatttaataggtacaaaagtgattcatgttacaagtatttgtggagttacagcaaagtttagtgcaggagaagttgttggaatagtaggaagaacaggttctggaaaaacaaccttattggatgtgctttcaaatatattgttatgtgcaaatggaagaatgacagttacaggtttggaaaaaaataatgagaaaatattagacaagttagaaagaattggattccaatttgaagatttcgatcaggaaatcattaaatcagtaattaagtcccaggaagatctcaatcacatagcttttttacctttagagatttacttccctaagaatggcaatattcgagatatgattgatcccctcaatgaatacgaattagatgatattaaatcagctttgaacatttgtggatttggatcatacttagaaagaagtgatagcttaaattttgaatcagaattaacagaatgtgatcaggaaagtgctttgttaaacgaaaataatacaattttaagatttcttgaaactaaattagatgaaactggatttggtattctccagatgagaatgctactttttgtgaacttcttcctgaaaagagaaaaattaaggattttactagttgatgaacctccagtcattttaagaaatcagatgagaaatcgtaaacttttaaataaagaggcagataaagatcattttaatgaaaatttgggaaataccaatagatctggatgtgttctttcatcggtcattaaccaatactttaagcattgcattacattcatagtatcacatgatatccgaagtcttcaatatgtaaaccgcgttcttgttttgagtagtgggaagatagttagggacacacaaattgatcacaattcatttactaattccgaactattcagctttgtcaaaacaaatatgggctaa

SEQ ID NO: 1470 - DNA, 3108 bp, Cryptosporidium hominis
atgaaagattcagagaatattgtttcgttaaataataacagagaaatggccaaattatcatgttatattagtaagaaatcttggattttagataattctaagcttgaagaaatgattatctgtgatcaaccttttgactatcatttatggaatttggttatcaatatttgccagttagatactgatatattcaataaaagcattaatttgaatgatattattaatagtaagcaaataagtaccggtcaaagaatcagaatatcctttgctaggtctctttattgtaagttaattcaaagttcagtgtatcgtattgggagctctgaaaatacaaaaagcttggattattcaacttcatcattagtttcaactggtcctttaggaagaaattacagtgtaatatattttatagagaatatttttgactcattggacagagagacaagttgtagaatgatttattcacttttcaataaagatgacaaactttcaggaatattgagttctagttttggaataatctcaataagtccagatttacttaacttattttttttcacagtttatttaaattcttgtaaaagtttgatatttgaagatagatataagacaatattagaatataacaaaacatgtacaataaaagtaactgatattagtgaggattctaagattatgagtcaatacattcttgggataaaggatttaattagagaagatccatgtgaaaatgaggaacttttgaagagcataatatactttattaataataatatgaatgagaatttaatacccgagacaaattcatcaattagcttaaaaaaggagaacagaaagatgggaatagagagggatttagatagcttaatatcaataagaaatagtggattgatctcaaattctttaaattattatttatttcatacaaatgataaaataagatataaatttgatacaaaaatgaataagacctcaagcattaagagaaataagtccttgatctttgtttatttattattgtcaacagttccttttttgtcatttaagataattgagtacaagataattaataacttgaagaaaacttcaaatatacttaaggacttagctaagtacatgcattattgctcagtaatcttattaaactttgtgataacaatttttctagaaatctatattggattaaaatctgctaattatattcataatacaattttatatgggtacctaacaagttattcaataataaagataattccagtatctagtataattagtcatctttcaaacgaccaactagtaattgactattgtatcacaaaaagaattgggcaaattcttcaccaagttaacaaaattattgcatttataattatctcatttgtaattaactttaaggatccaatgacttgtattccaattggttttctattcttgttatttatctactggaactacctttcatactttataaacacttgcagaactctcagactacttttcctgaattctcaaacagctatatcagatattgcacactctattaacctcggaattgacgatattcatcaaaaccaattatcctcatacatgatgcagagaagcaataggaaggcgctcgaaatggtggcgccactttattgtcaaaatatgatgtttgcatggcttagattaagattggattttttattaccagtagctttaacatcaataaatgttttgttttcaatattgtttccaaactctaaaggaaatgagaaaactattccacaaatagtaatttttattattggtgtaggattaacaattccgaagattacctcctcaacagtgaaatattgggtaaaaatggagaatgagctattagcagtaacaagaatgaagcttctcatagaggctatacaagatgacaggtttggtgaaaacctgaagattgattattctaactcaacagagaactcttctttattaatgacattgaacaatgttgactgcaaacaccttaaactaagaaatgatccattttcctcaacaataaataactataacaaccttatccagtactcttgtttaaggaaagtaaatttggatattagagttggcgattttattggtattgttggaagaaccggttcagggaagacttctttgttaaaggtgataggtgggattatggaagtttataaaggcgccaaaactattcacaggggattactgacaataggagatgatagtgagcaaataggagttgatgataatgatgatgataacgatgaggcggagaatttagtcaagggtggattactaggtttggaagacggattacgaaaagaagttcaagagaaaaaaaagtatttgtctatttttagaggtgggagaataagtggaaataataatagagggcgttatagccagtacctatgtaataagaaatcaactgaaaccaaaagctacaatgagaaagaggatgattactataggatgaaggaatcgtcattggaaagaattaaaaccataacgcaagtatcagaaattgatccaaatattcttttgaattctgttagaatgctcgaatttttgtctggtatagcttacgttccaatcaaagtagactttcctgggaacttaaaactaatagaggttttggattcggagaatattcgttcaagcttggaaattttagatttattggatttatttggacttgttgataaaaagaagaatttattgtttgaccaatcaactcaagataaggaatttttatcgaaatcttgtgaatcttttcccttaattctctcccccgtgaatctcaaaatacttgatttacctataagtgactttaactttaatgggaatcaaaaaagaatgttgcttttgcttcgtcttgctttaaatagtcaaaaatacagactacttcttcttgacgagctacctaattataggttaacaacagaagatggcggttacatttcagttattgattttattttaaaaaaatactttccaaattgctcagtggttattgccacacatcattttgaacaaatttcaagcattaaccgtctattgattgttaataacaactttagagtatttgaagcttattaa

SEQ ID NO: 1471 - DNA, 249 bp, Cryptosporidium hominis
atgagtactgaatacagagtgggttttgcctcgaaagaggatataatagaaaaaagtacttatggagaatgtgaggataggacaaaaagcttgagcttcagtagtgatgtgaatagtattacttatgatgaagcatcttcatcaagtgaggaatatccagaatatagtttattacgcactcaaagttctttagctccaccaattgaggcttctgcaatagtagatgtagaagaggcatggaaagcataa

SEQ ID NO: 1472 - DNA, 237 bp, Cryptosporidium hominis
atggagctgcttcaagatgataaaactattactttagaacagatttcacaagatgattctttagaagataatgatgaattaatgtttaatcatgaagatgaagctttatacgatcaaatagaggacgattatcgtgatgatgaagctgaagatgagagcgaagatggagaaaatgagtcgcaaatagattctgaaactttaaaaagaatgttaaaagaagatgtcaattggaactag

SEQ ID NO: 1473 - DNA, 1113 bp, Cryptosporidium hominis
atgtatgaatgggattgtattaaagacttagcaagaatagaaaggaatttctacagcttattacaagaagatagagaattattagggatttcaaatattgaagatgaaattaataaatttagaaattgcataaatgcaaatcagaattttctaaaattaatactttctcctgatctttattatgatcaaatagaattaaataataataataataataataataataataataataataataataataatagactaaatgaaaataagagctttaaaacctatgccaataaaaatataaattatattcccaatacaactttgaacaacttatgcaaagttaaagcaactctcagacagtttgtaagggactggagtgagcatggaagagaagaaagagaggagtcatacggcccaatgatacaagccttaaaagattatcttcccataaatacgaattcatcatcagaaaaaataaaagttcttattccaggagcaggactaggaagattactttttgaagttgctagacttggttattcttgccaaggtaatgaaatcagctatgcaatgcttttaggaagtaattttgctttaaattatatgttcaaagttaactcaatagtaattcacccatacgttctttcgctttcaaataggccaaagaaagaagacaatcttcggcctatacatattccggacatatgtgtgaatgaatatataaaacaaggacatgacctaagtatgtgtgcaggggattttgttgagatttattctaaacaagctcaagcttgggatgctattttgacttgtttctttttggatacagccaaaaatattattacttacattcgaaccattaccaatcttttacccccaaacggtgtgtggattaatttaggaccgctgctttatcattattctggattaaataatgttatttctattgaaccttcttgggaagagattaaaagaataatttccaaatacttcaaaattgttaaagaagaatggagaaacgctacatatactaggaataatagtagcatgttcaaaatagtttataagtgcattttctttgtcgcgattagaaataaagtgggattaagcagctaa

SEQ ID NO: 1474 - DNA, 357 bp, Cryptosporidium hominis
atggacttccatcaaatatctgagaagtttttaaacttattgaaaagatattataaagaaatttatgacgatttttcagagtcaggtttggatgagataattaaattgagggatgaaattttagattttggaaatgaaatagatttttctaatataatttcaaagaatgaagaagttgaagatttgaatacaaatgacataaaatatttattatattcatatataagagcagaaacaacaaggtatgtaaaagatcataatgtaccaaaagaacgtgtagaaagaagaaatgatttaaatgaaataattgaactatatttacaattttttaataatacccttgaaattagaaataca

SEQ ID NO: 1475 - DNA, 858 bp, Cryptosporidium hominis
atgaataaaagagattattcagaaattgaaaatagctttgaaggaaaagaatttcaagaaaaagaaccagaaaataaatcaagtattatagttgaaactattctaaattccgaggaagatttaaatcctaccatttctcaagtaaacttagtcttagattcggaattaaaatctaagtctaatttgacaaatgaaaacaataatacgttggaattgggatatgaatctgaacctgaacctgaaaatgataatgataatgaaagtgaagatgatgaggatggatatgagccatatatcaaatatttgcaagctttaagcttgtcttggagtagttgtcaggcttcatcaatgcttactaaagacttggttgaatacatggtaccaagatttcaagactgtagtactcctattaaagttagaattattatgagtatattatatattagtgattctcttcgtgaatcatgtaaacaagaatttatgaatattttaaattttggagaattagatagagatgattgggtaagaaaattatctagattaatgataccatatgtacaaaaaggagttttagatttaggagaaactgacacagaaactgccttcaaaattttacgatatcttgatgaattaagaatgagagaaaacattgatttcaggttaaaacctccattagaatctattcatatgtgtgatcctctaactgatgaatctataaataatgagcttccttgttataatgttgattatgacaattttgctcctcagaaagattttgaattattgcttgctgaagttgaaaaagatggtttacataaaatgaggattgctagcaattcatttgttaataataaatga

SEQ ID NO: 1476 - DNA, 2763 bp, Cryptosporidium hominis
atgacaggaaattctttattggtacctccaagatcagcatttggatctagagaagaattatgtgcatttgtatcatataaaatgagaagagcaactgaactatttacatttaaatgttctttatatcaaagagaacttaagttatatttaccagaaccagttccaaaacatagaagatggattgatacttttgattcggaaagtatcgttactataccaattagtaagatagaaaaagatgaaattgaattatttagaaagtatttcccagataatatggatttagattcgatttttcctggtgatctattacaaagatcttttaaaaaaaggatttctagtttattaacttctttagttaataaaatagtatttttactagttttaaaacatgatacatggtatgtacatcaagaagctagagatggacttagggagtatttggttgaaaagatttggccaagacaaccaaagttaaggttattatatagagatcatgttacaacttttgtagatacaagaattcgtcattttagagattctgtgggaagatattttagagatcttcatgcaaatagtaagaatggagagattattgcgaatttaatagtaacttgtgattataagcaatcagaattggatgatatgattaaaaaagctttagaagagcaaaaagttatgcttgaaaatgaaagaaagatggaatatattgaatcaccaaataaaagtaatattgaaaactataatggaaaatcatcatcactttcttctcaaattgagaaacttaaaagtaaaagtcataagatttataaaaatgatgatagatcttcttttaatcatagaaatattctagattttaaatatgaacttgaagatgagtatgaaggtaggagtaatagtattagagaagaaaatgaagattctcaaattgaggaggatctagaatatcatattcaagatcttgaaaaagaattggaattatatgaagatctagaaaatgatacagaacaaaatttagaacaagaaattgatgaacagaatacatatcaaattcaggagcaaagacttaaacaaagattgaaacaaaaacaagtacaaaaagaaagattgaaatcaaaattaaagtatgagagtgataatgataatgaatttgaattgggacttgaatgcaataacaaggaggaattagacaaggaaaatgaaaataaaagatatgtgagagattatgttcaatataatcatgaaattggaaagaatgtcaaatctatgaaaaggatggatgaaatccaaaagggtaaaagaatgattcactcatcagaaagaagtgataaagaattagatcaagaaagggtatcagatggtgatgttgagaatgaaaaaaatacagtttatcctcctcttaagaagaataacaataaaaatgatgagaacttgaaatatattcctcttaataatatagggatatccaatagtagtaataattctccatccatggtttcaataccatcgataccatcaattcagtcaatttctaccagtcttacatcaacaatgtcatcattttcttcatcctcttccttatcgtcctctttagttttacctccagccttatcttctgaattaaatgtaattccaggtataggatattatccgggccaaattcaaataaactctccaatagataaatcatctatttatgcttcactaatttatcctcaatcaagttcagctttcacaagagagaatataaaaaatttggaaagctcttcaaattctaatatactggcagaaaacaattcctcagtttctaatattgtttatagaaacatacagattgatacaaataacgtttcttctagtgcaagttctctttcaaattcatctatttcaagttcttctcctgtatcaaaaacttactctaagtctgatattttaagcagtggatctattggaagtggatctatgctaaataatcactttccaagttctatttctgattctgggctcgctacaaatccagggtttggcccaggtttaggtataggaataggaatgggagcgggaattggaacaggaataggagcaggaattggcccggggataggcctaggaataggaatgggaccaggcctaggaatggggccaggattaggaataggcatggggatgggaataggaatgggaatgggagttggcttaggattaggattaggatctggatctggatcagattcgggcttggaaatgaaaatgggatctgagactagtttggattcaaattcgaatccaatttcaaaatcaagctcaagcccaagttcaaactcaagctcaaactcaacctcaagctcaaactcaaactcaaactcaaactcgaactcaaactcaaactcaaactttaatacaaattcagtaatattagggccccaaggataccatccagctccaataacaaactatccatatagctttggaccaatcaaagactgtaattcaatgttcggaaatccattaatctattctcaacaacttaatcctaatattcaatcagctttcaatttccaagcttctccagcctactttataattccaaattacaactatgcattccaatccttatatccctcgcaaagtggactatcatctcaatttaatccctctttgttcccaactacaaatttaaatagtttttatcctattgatctgactaaagttaatggtaaatcatctaatatagatcaaataaactctaataatacaacttaa

SEQ ID NO: 1477 - DNA, 426 bp, Cryptosporidium hominis
atgaaggagaaaatagaaactttacacacagtaattacagagaaattaggctctgaattattatctagagctttatatatcttatttcttttgaaattagtaatgttaataggttttggaagttattatttcaataaaagaaaacaagaaaaagctaaacagttgaatgatatgagaatgagaaaaataagagaaaatcaaataaaggtttgggagaaagatataagtgaatatactagcgctaattcaaaaaacgaaagtagtttagaggaggatcaaaaagaagagaataaacataaaaagaaaagtaaattaagttggatgagcgctaattctaatagccatttaaatccacattttagtcatttatcaacttacaagccatcggtatctaaaagatacccatgtaaaaaatgttgtggataa

SEQ ID NO: 1478 - DNA, 2727 bp, Cryptosporidium hominis
atgggtatattaaggtcggaatctatgtcccatgggactcttgtccttccaaatgaccgagcaagagaatatattgatatactcggaagagaagtaaatttgcaatttgtagatatgaattcaattacaatgaatcgacaatataaaaagtatattcaaagaatcgatgaaatggaacgtatacttcgtgtactgttttctgagattgagaaactcccagatgtgaaagtattaaaagggaattatgagaattttttggatcatgatcatgtttatcaattagataaagtagaagaatctcttcaaagtttatatgggcaatttatcagttttagagataataatgcagatttaatccaccaaaaaagttctgcaattgaggaatgtgctgtagcaaaagcagcaagcctttcatttgctccaatatcaatgtacaatgaaagatcaaatagtgacttttacatgacaaacgcagtggaaagaggggagggtggaatgcatggaggaaatcccacaccgtcatctcctttaatgaatccaggtattatggatggaattaataatgtttccggatttggagatatgatgttcagtagtattgctggagtagtgaaacatgaagaccaagagaaatttgctagagctctttttagagccacaagaggtaacacatttacccatttccaatcaatagctgagaatattatggatccaaaaacaagtaaagatgttcagaaggtggtttttgtaatttacttccaaggtgcaacaacttcagcagtttatgataagattagtagaatttgtgatgcattcaatgtatcgatttatccttggccatcaagctatgaacatgcaattcaaagaattagtgaacttaatactttaatccaagataaggaaaaagcacttcaagcttatgaacaatatatcactcttgagattgagactttacttcaaccagttaactcaaataatggaaactcattaatagaggaatggagattattttgcattaaggagaaatccatttatgcaacattgaacttatttgaagggtcagatataacactaagagctgattgttggtatccaacagaagaggaggaaaagattagaaagattttgatagctgaaagtagcactcagcatgttggagcatttttactgactaatacatcaagtggaggtcatggagtagctggaatccatatttcagaaggtggctcacatgatgatgaggcgaatatatccaacacacctccaacatatattaagactaacgattttactgttgcattccaggactttgtaaattcttatggtattccaagataccaagaagtgaatccagctttattcactttagtttcattcccattcctttttggtattatgtatggtgatgtaggccatggtttcatagttttcttgattggtttggttttagttttgaattatggaaagcttaaaaagattaacgatgaaaatatgaagattttagtttctggtagatatatgattacaatgatgggtttctttgcgacttattgtggattaatttacaatgatttcttcgctgctggtttggatatatttggatccagatacaccctatctcatgataaattaccggatggaagtcacgtatttttaccaaataacaattccacttcagtttcttttccatatccatttggatttgatccagtttggaaaggagctgttaatgaaatgtcatttttgaatagtttcaagatgaaattctcagttattattgccttcttccagatgactcttggtgtaatacttaaaggttttaataacttgtactttaaaaattatgttgatttctttatggagtttattcctcaatttatttttatggttggatttattggatatcttaactttttaatcttctttaagtggttaactccaattgaaggatataataagccttctattttgaatgcattaattggattacaaagttctttatttggagctgatattccacttagtgatagattttatctatctcaacctgtcgtgcagaaatatattacattggccttattaatttctgtaccttggatgttcttccctaaaccactttatcttatttacaagagcagaaaacaaaagaaagctagtgaggaagaatctaggatcagacaacaacatctctcatcatactcatctgtctcaagtagattcacatctctcaccaatagctctaagaagataagtagatccaagagtaatcttctttctgaggatgatcataatctcattggtcatgaagtagaagaatcatctggtcactctgatccaactgagatttttattcatcaacttattgaaactgttgaattccttattggttcaatttcaaatactgcatcatacctccgtctttgggcactttctcttgcacacaatatgcttgcattggtagctctccagtttactattatgaaggccttaaactcaaaactccttattgtcaaagttgttcaactatttaatttattcttcatgttctttgcattcacttcatttatcatgattctcatggactcattggaatgcttcttacatggccttcgtctacaatgggtagaattccaaaacaagttttataagggagatggtattctttttgcccctcttaaccatatgagaattatcttagaaactgaagagttattaaactcatcttaa

SEQ ID NO: 1479 - DNA, 420 bp, Cryptosporidium hominis
atgcatggtatgatagatgttgcaaaagttgcagatctcgtattactattaatagatgcaagcttttcatttgaaatggaaacttttgaattcttaaatatattacaagtacatggctttccaagagttcttggtgttttaactcatttggataaaattgaagataataagactttaaggaagacaaaaaagaagcttaaaaatagattttggactgaaatatataatggagctaaattattctatcttagcggaattcataatggtttctataataaaactgaaatacgtaatttatccagatttattgcagttcaaaagtttgaaaatctatcatggagaagttcacatccatatatagtttctttaagaattgaagaaattaatgatgatgataatatgactatcataaaacaataa

SEQ ID NO: 1480 - DNA, 759 bp, Cryptosporidium hominis
atgcaagcaaaaagtaatattgttaagaaattgaagcttgttggtgaacctaaaaagatacataagaatacagcatttatttacaaaatgtttaatagtgatttagaagtttcaaagtttattggagctaaaattcaaacggttagtggaattagaggacaagttaaaaaagctataagtactcatggactttttagagcaacttttgaagataaaatactcttatcagatattgtattttgtaaaacatgggtttctatgactccaagagaattctataatccagtaatagatttaccaacatggagaagaatgagaactcaagctgaattaagaagagaattaaatattcctttagcaattaaagcagattctgagtatgtaactaaacaagatagacccgaaaagaagagatttaatagtgtaccagtaccaagtaaattagaaaaagaattaccatatgcttcaaaaacaaagaatgattctaagaagataaaagataagaatcaggtagctgtaataaagagtacatttgaaaaaagagtagctaatttattccaaagactatcaactattcaaaaagaaaagactgctaaacgtattgagaagaagagaattaagagagaaattaatattaagagaagacaaccattagaaagaataagagaagctaagaatgaggagaggaagaagagaagatatgcattacaaggtataaagatggataaacagagaagaaaattgatgatgaaggattaa

SEQ ID NO: 1481 - DNA, 579 bp, Cryptosporidium hominis
atgcaatattttgatcaaatactagaaaaccaacaaatttttgatcacaattctattcatattgaaaaggtattaaatcatctttctgaagatactaaagtatatcaaactgttcaaaattggattcaaaaaacatctgattttacatgtcttgaattctgggattttctttctaatactttacaaaaatcatccgataaatcccatcttactcttcttaaagaaattgtatttgcttatagttatccaagattagatattaatgtcagtaaagatcttggacatcttttaaaagctcctttttgtattcatcattctactggtagactttgtattcctattgatacaagtcaaaattttaattttaatccaaaaactgttcctacacttactagtattagaaatgattatgacaataatatttgtcaaaaagatattaaatcaaatacaacaacttatacaataccttcaagtataagtaaatatattcaatttatggataattttgttgataatttaattcaagatactaagaaagaacaagaagaatacaatattatgttacaactaattcattaa

SEQ ID NO: 1482 - DNA, 240 bp, Cryptosporidium hominis
  misc_feature (232)..(233): n is a, c, g, or t
atgactattaaatctgaaattgatcaggatgaaatatatctcagatggcaacatttcaaaacaattgatcaactaaaacaagaaattgttgcaagaaccccacataaatttgatattggagcaatctacaatatccccatttctgaaaaagaaatctcccctcttggatttaagcctgtacaaagagaattagtctttgatattgatatgaatgattatgatgatattcaanncatgtaa

SEQ ID NO: 1483 - DNA, 999 bp, Cryptosporidium hominis
  misc_feature (948)..(948): n is a, c, g, or t
atgccatctagagacaataatataaatatgtcatcttcatcatccagaattgctaatataagtgaagataatgaagtaaaaatggatattgaggaaggatatacaacttctaataataataataatattaataccgatccatatatgatgaagggtgcagaatacctcaacaaagaatcaagatggaaaaataaacaaagagtattagtattatcaacaagaggaattaattttagacatcgtcatttaatggaagatattaaaaagttattaccacatcataaatctgaggtaaaatgggaaaagaagcaaccattttctgaaatctctgaaatgagtgaattacgttcttgtaataatattatattattagaagcaagaagacatgaagagttatatatgtgggtagcaaaatgtccaaatggtcctagtataaaattccaaatattaaatatacatactttaggtgaattaagacttgcgggaaattcacttttaggttcaagaccattattatcttttgattctgcatttgaatctgataattatgttcataatattaatttttctcaagaacaaaaacatttgaaattaccattaaaattaattaaagatttatttattcaggtgtttggtactccaagatatcatccaaaaagtaaaccattccatgatcatgttattagttttagttttctagatggtaagatttggtttagacattatcaaattgctcctacaacagaaagagatcataataatgttgataagcaggtattaattgaaattggtcctaggtttgtattggagccaatactaatattggatggtactttttctggtcaagttttatatagaaatcctgattataaatcacctactttacttagaaatattattaaacaaggatattcttcatatttacaaagagtacaaagtaaacagaanagatcagactattatgatgatttgggattcaagtttgatgaatgtacctga

SEQ ID NO: 1484 - DNA, 750 bp, Cryptosporidium hominis
atgctttataagctttctcctaataaatacactccatggtatgtaaatggggctaaccattgtaatattgaacttaattggagagatgaacttatttcaaaagttagacaatttattctttatttatctccaaagcctaaaattcaatcatctaaatcttcttatatgactcatgatcatactttatcaatatctagaatatctacattatctagtcaaggatttgaaaacttatatcatgaattagatgatgacgacgatgatgatgatgataatatttacgataattgtcaagaatatgaatctacaagtcaggagtatactaataacaataaagatagttgttattatagagaaaaatcatatcctatcccaaaaaaccatacaaataatcatttaaattatcacaatacaacaaaatcatccaataaatactttaataatcaatcttctagaatgaaaatagaagaaaataatactatttctaattcttcaatttcttctaagtcaaactttactcattcgaatacataccatccaaatacttcaaacaattctcattcacataattactattctcaaacactaaatagtgcttatcaaactccttcttctggaaataatcatcaaatatctgatcaagttgtctttggtgtatctatatatgatgataatattaatttgcatgcaaatatgtattctggtaattgtcgaaaacctaaaaattttactcgtatttttggtctttag

SEQ ID NO: 1485 - DNA, 177 bp, Cryptosporidium hominis
atgaagaaatatagtaataattcagatgattttgcctcaaaagctgcatttgaactcggccaagttagaggaaagggatttagacaagaaaaagctaagaaaaaaagatgttcgtggaaaggcaatggaactatttccacaggtgttagttcaattcaatttagtgattctgattaa

SEQ ID NO: 1486 - DNA, 252 bp, Cryptosporidium hominis
atgattgacttagaagcaaaagttcaagatttaaagtatattagcaatacaatgagacaacaagtaaaagaaagtaatgatttactttcaagtttatctgaagaaatgggttcatttggagttctactaaaaggtacaattaataaaatcaaaacaatcggaggaacaagtagttggaagcatatttggattatgtcatttttcatatttcttgttttcttattaatgtatattttgtttaaaagaagttag

SEQ ID NO: 1487 - DNA, 579 bp, Cryptosporidium hominis
atgagcccattaagaggacgtaaaatccgtcgcatttatattaattcagaggataattacaatgaaaattctttgagtaaaattaataatggtagctatgatgataactatagcaggtataatcactacagaaaactttcaaagcttagtggaataaacttatcagaaattggacaagttggaggagttgaatcagtttcaggaacagaggtggcatcaggatcaggatcaggaatgttcattgagagaaaccctggtaatttagaaaatcctggaaatatttcaaattttagtgcagtaaatttggaagaattcacttgcaataataaacaagtaatgaatactggtataaatgattatagaactaatcaaggtataaatattgaaaatattagcagagatgatgtaaatatgctcaaaaattctcaagaaaacaatatgtatataaagaatctgaatcctatgcagcttaaatatctacaaaagactcagaagattttatcttatgaactttccagttataaatcaggtattaaacaacttttatcaataccagaatatttgccttgtgacatgtga

SEQ ID NO: 1488 - DNA, 330 bp, Cryptosporidium hominis
aacattctatatgaagagcctcttgattttggtatttcatccactttagaacttcttaagaaaagaggtaatatatcatcttcaaacaaaaaagacccaattacttctaataataatgaattcggtcaaaaaaatgaaaactattcaacagattccgccttaaattcagaattagattttcaagtctctattctccatactgatgataatggtaatattctaaatcctaaggaagcattcaaaaggctatgctggaaatttcatggacaaaaagttaacaaaaataaaattgaaaagatgctcagaaaccatctgcgaaacaaaacctga

SEQ ID NO: 1489 - DNA, 762 bp, Cryptosporidium hominis
atgaatgataatattcaagaatcttttaatcaaaatggtagtgatgatgaagatatggtagagcaaatgagttttaactctgagaattctgatactgatgaagtccaagaaagtgatgatgagaggtttacaaaacctgaaaatgaggaagatcttaagataattcagggaattggatcattattagttaacaaatcaactagaatggacttaatcgatggtagttataatagatatgcatttcatgatccagatgaggatcttgaaaacaatgttctaggacttccttcttggtttattgaggatgaaaataaacataacaagccagagcttccaattacaaaagaattgatggctcaatatagagcaaaattaagggaaataaaaaatagaccaataagaaaagaaagtgaagctttagcaagaaagaagaggaggtatgagaaggttatgaagaaggctagaaagaaagcacaatccattgctgattctgaagagatgaatgaagcttccaaatccaaaaccattaatagcttgattaaaaaagctcaaaagatttctagtaagaaaagagttaatgtatatactgtaacaagaagacatgggttaagcaaacaaataaagaataaagaaaaaagtattaatactacgaatcttaagacaaaattcgtagataaaagactaaagaaagataagagagccattaaacatatcaataagaagatgaaacataagagcaaacaacgtaacaagaagaggtaa

SEQ ID NO: 1490 - DNA, 6804 bp, Cryptosporidium hominis
atgattacttccgagggtaatcacaataattcaattaattcagaatccctacaaaatgggaaccttaaccaaacagatttagtaatacaaggtttccccacaaattcaaacataaattctgaaggtatctctaatctgggagaggggcttgacacttcaaacactggagaaagtcttaataaaaagcctagaatagatgaccaaattgggatgggtttgagcaatgaaacaacctctaattgttctaatttggatcagaataataactcacaatgtacatcagcaatagaaacatctgcattagtagtgccaggatctatagaatctacaaatcaacaaaatataagtactgtaaatacctcttcatctttggcagtttcttcaaattccggagttgatccagcacagactcaagaagctcccccagagcctcccaagaagagaggaaggggacgtccaagaattaatagagaagctttggcagcagcggcagctgcagctgctgcaaataatgcagcaagcagcaccatccaaaataataatatcattcagagagaaccaagtacaaggagaaaaggagctggtctcggaagtttgatagcagcagaggtaaactccagaagatcttttgcagatgacgatgatgatgatgatgaagattttgaagatggagatttacgtgcagatggtgagaacactgacaatgatgatggtgaagagttacctcaaagatttgtattaactccaattgttgagaagtttctcaaaagacgtcctcaaatgaagcataaagagaaagaaggcgctgagcacgataaagcaaaaaacacacattcaactggagatacagtaataactggaggtactgaagagagagattcagcttcaccatcaatcaaaagaagagtattacacaccaatacaagccagaggcgcattccaagaggaaagattccctatgaataccttgtaaaatatcatcatcagagctattctcaatgcaaatggataagtgaggacgatatagataacgatcctgatccaaaagtcagaataaaatatctcaggtatatacagagactagaacaaagaggtgttgaggggatagatgctaccgcatatattgaagatgtcccagaattgcaatatattgatggagatattgagagaattgtcgattgtacagacgttttcagatcattatacccaatgaaggcagcagagattggtagaaatgaatggtacatttattgtctgaagattattgacgctttggtatgctttgataggaaaggggtaaagtatggtattccatttttgcgtcctgtagacccgaatatggatggggcttctgattattattcagtgatttctcgtccaatggattttactacagtacaaacaaagctttatttacgtatatattctcaacctcaagaattttggagtgatgttcaacagatctttacaaattgcttccattataactctgtagatagtgatatctatgttcaggggaagttactaaaagctctttttgataagttatatggagaatgggctttactctccagacaaactcaggaggatctggtcaagcagaagagtgaagaatctccaaaagaatggcttgatgatcagacagttactatagaaactgcaatccaacatgtaacatttagagatttacttgctttaccaaagagaccaattatgtactttgcaaaatggaaacatctttcatttgctgataatacttgggaacacgaggtcgatattacagatagtagtaagattcttcagttccatcgtttcgttagagttccagagtatatcacaacagctcataatggacctgcagccatagcttatgacctttacaagcgaatgatttctgaaacttatacctatattagacatacattttcatggatgaataaccaatttggaatgaaactaatagctcctcaggcaccagcctatattactccaaatagtggaggcggaaataaccaagattctgatgattctgatgatgataatcatgttccatatgctacaaagaagaaatctaagaatagatattctattagaacctatgtaccaacaacattctccaatctcccacagttaactagtgcaatttctatttatggccatcaccatagtaaccaccaacctcaacataatagaagtaattatggacaaagacagcaaaattatggaggccatcagaatctacaaaggcaatttccaagccagaatttgggtaattcttcatcttcctcaaatatggctcaaataaacaagattattgatagcagcattttggatcaaattaaagttggctctgatggaaccatgaacaagaatgccatagctgcaactcaaaaactattacagatgatcacaacaaacaattcgaatgcagctaatgccttgagtatggcaatgaataacccagcagttgctggacttgttggaaaacttctacaaaatataaatcaaaataactcacaaacccaagctaagagcgagccagaaaacgctcaatcattatctacctctcctgctggatgttcttcttcagcacaaattttaccaaataactcttccaacactatggttgataaactttctgttccaaataacattacaaataatacatgcaacataaataataacattgttcattctggaataacctctgaatcctctacatgtttcaataatggcaatatggttattgcaccaaaccaaggagaagcttcaggccaacatatagactctggaaactataacactgaaagtaacataccaatgcaatctttctcaaaccacaatcacagacatgagcagtggggtggctcaaatattagggataataatagtaataacaactcagcaatcaatagtgatatctctacaaatctatgcaagaatccaaaccctggatttatggagtccaactctcaaatgaagataaataattttgactataaaatttcgattgatcaaatgggtaacagcgcttctaataacaatcaaagcaatcatacagattacgtgtcaaatgtgatgggcggtaaccacacacgccaagaaagtatggcgccagattgcgtggaggagaatataaatagaggagaggcatatataataagagatgatagcttagtaggaaatccaggcactgataattcgggagttgggataagtagggagggaattttaagctttggacaaagtggtgcaatagatcaggggaaagatatgattatagaccagaaggagaactataatatggtgtcgagtacaatgactgaccatcacgatggaaatggttgtgacagtatgacaaagacaattaatgatacagatttgtttttcaatgtgaatacagataatccagatgcaattaagtgtatgcctccaactgatgactcaaatgttccattatgcgatggagaagttaagcttagcaatgagagtttggagttgatggttttcaaaaatattgagataccctccagtatggagctttatgataaactagagttagaggaattctgcgggatagtgtctctggagaatgactatcaatctgaagggaacgaagaaattctctcatatagaattctggataatgtacaagacttttgcgatggtatggtatataaggaagatactgggagtataacaaaagtcgatgatactaatgctataattcaagcaaaagctgaaggagtctctgtggtgggagatatgtcttcaagtgtcgatcaagcacaagttaagattgatgaaaatgaaaaagatttgaaaaacgtggtagagctcaaagatgaaacaaatggtgagaatattttaactgaaaatacaaaccatccaatgggtcttgctagtctgcttgcaaataataagattgcagaactttactgcaaccagaaacgccctcccccacctcctccaggagtttcccgacattatccagtttccccaattttcaaaaatggataccaactttttgattaccaactagcaggtctaaactggcttctacaactttggtcagaaggaagaaatggtatattggcagacgaaatgggtttaggaaagacaatgcaaacaatgtcatttgtttggcatttagtttacaaggagaaacttaggggtccttttctagttgttgctccactttctactctagatcactggaaacgaacttttgaagattggactgatcttaatgtggtttcatattatgatgagggtggtagaaatggacgagatttacttcgtcattatgagttttaccatcaatgccttcaatttgatatgagaggaaggggaagaagtagtagctataatggttttggtggtaatattaaacattatggctattctaacgaacctcgtctagttcagactcagcattataagttccacgttttacttacttcatatgaaattctccttgcagacgctgatattttatgtacaatgccctggcagtttgtaattatagacgaagctcacagactaaaaaatagaggcgccaaaactttacaagtctttaagagtattgcatgcagacatattcttttactatccggaactcctgtccaaaataacacagaggagctttggcctctacttaattatattgagcctattaaattcgcaagtattgaggcctttactcaagaatttggagaacttcaaacaagtggtcaggtctctgctctacacgaacttttacgcccacatctactcagaagagtcaaagaggacgttatgaaggaaattcctcctttagaggagacaattattgatgttgaacttaccactgctcagaaagcttattatagagctatcttcgagagaaatcgtgctttcttatgcaaaaatgtgggactaggcgggaaaaggtcaggaagtaatgcaccaataccttctttaatgaatgttgaagtagagttgaggaaatgttgtaatcatcctttccaggttgttggagtagaagagagagaagttgctttatgcaagacttcagaagaaaggtataagaagatgatagaattgagtggaaagatggtattaatgggtaaacttttaccaaagcttaaagcagaaggacatagagtgttaatatttagtcaatttattcaaactttgactttattagaggagttagtggaacatcatggatggggatatgaaagacttgatggtagtattcgtggtactgataggaatgcagcaattacaagatttaatgcagaagactctgacaaatttgtatttttactttcaactagagctggaggtttaggaatcaatttaacatctgctgacactgtaattatttttgattctgattggaacccacaaaatgatgttcaagcttgtgctagagcgcatagaattggacaaacaagagatgttaaggtttatagattgataacagcaagaacatatgaagctgaaatgtttgaaagagctggtaggaaattaggactgaatactgcagtttttcataaaggagcatttagagaggagaataattctaatactgttaatggcattggtacaagtggtgaaccaacaaaacaagaaattgaagatttgcttaaacatggagcttattatctattagaaggtagtgaggcttcaaggcaattccaggaaagtgatatagatgagattttgagtaaaaattctcgtcttgttagatatcaattaagtggaaagaattcttcatttagtaaaacaagctttagaagtgataatgcacttcctgatttggatgttaatgacccagatttttggaagaaagtattgggagatagtagtgtttcatcattcctagtccagctacaaagtggaagtgctattagggatgatgaaagtagggaaaagtttattcaggatcttgctgatgcagttgatggtgcagcagctttagatagtttggatccactaattgaagctttggtccaagttacaaatatgagagagttttctgaactacagcgtcaaaaggctgaagatttacttgctaatgttcaggatattgttaagactttgcagccaaataatgagaatattgatgaaaatgatgaagaagataacttggatactgatggtagaagtaagtcccgtaaaaaatcaagaagagctaccagagctaaagagtttacaattgataactatgttcttgatgaatatattgatggggaaatggaagattctatgaatggtccaggaaaccatgtcgatggaagaggtaggaaatcaaaaggaaagaaaggtggaggaagaaaaagcaatgcttcagcttcaggaaagtttaataattatgatatttctgatgaagacgatgatgatttaaatgatgaatcgtttgaacctgttaaaccaacaaaatctagagagagaaaaggtactgggagagggggaagagctaattcatctaaaacttcttcaaataatgcgacagaaggtaataatagtagtggcgaacaagatggtaatcacaattcggcagaaacatcagtagatggaacaaatactctgtcaaatggagcaagacaatcaaagaagagaaagtcaacaaactctaataactcaaatactggagatgatatactggaagagaaggatcaaacttctaataattctcctgctaataatactgtagcaaaacgaagaaatagaagagattctgctgctgccatgcttgcattacttactgcaaaaattgcaaaagatgaagatgatgctgatgaggatgaattataa

SEQ ID NO: 1491 - DNA, 1537 bp, Cryptosporidium hominis
atggaacaagaaaatacacaaactttgaatacaatcaatagcacgccaattagaaatggtaatttgtcatcaaaggatgtgaacttggaaactccaaataaaagttcatcaagaagtattggcagtgcaggtggaagttcatcagttagacgtagtagtagattattgaaaaaaaatgatgaaaaatccggaggaactggagctttgactcctcaactgggtgcaccaggagggacaccttatctgttgagatcaaaatcaagagaaacattatcatcagcagaagcaaatttaaggaagaatgcaatggccatgccaccattgaatttgaaatcaattaatgatttggaaggaagtagtgagttctatcagaccaatgcggaaacaaataatgaaaatagtaataaggttggagatgtatataatatatattcaactccaagaaagagagttagaggtactgaaaatggcttcaatagtagtaacaataataacaatagcaatactggattagatttggatagagatccaggctctgaaagccagataagaagctcatcaagaagaaaaggaaatataaagaatacgcccgtgagcaaaagtagaagagtaattgatgaagactctgctgttaaagataggaagagtatattaaaacagtacgatcctgatggtattaatacatcaactatgaatataaagacccctaaatctcagaagaaggttcagtttggtacaaaaaatttgataataatagacgaaaataaacaagatttgaatattgataaattgattacagagagtgataatgatgaaaatggtaacattcaagacaaaagttttgcggatgatttgacagttgatagaatgagtatattaagtgagcttgatgatgctggtactggtcagatatataatttcccatcattggaggaattgataaatacaaaaaagactgaaaatacttcaacacaaaaagtttataacaatgatattgttgatagtgaaatttctaatcgatttggaggtgttaataatattcataattatcatcatcgtgaaaataaccaagataataaagcaaccaatccaagtgatttattcatccaaaatgaaaattctggaaaagacaaatctataactgatcaagatggaatgattgattgcaatgatcagaaaaatcttgatagtgagtatattaaaacaaatcagaatcaagttcaagatgaaaacaatatagataagaatattgaattgaccgatcagattaatatatctgattattcaataaattgtagagattcaatagctccaaatttacctggagcatttttatcagtagttatgcaaaatttatcttctgtaaattttccagaagaaaaaaaaccagaatcagatgaagatattaaaattcctaaattagaatttaatgatgataatattgaagatactataaataagaagaatgatttagatcaagatgttagtcttaaagaacagaaacctgatcaagactcaactatggaaaatcaatcag

SEQ ID NO: 1492 - DNA, 480 bp, Cryptosporidium hominis
atggaagataatattgaaatatattcagaaatcaggtgtttatttgatggctttctttctagtgatctttatgaattaagaactgaaaataatgaatttgataaaagaaccagtaaaggttcctttacagattttctttctcctgtagaatcttcaattggaacaaaaacatttgaaaacatcagtcgctcaagtagtgcctcttacaaaagcaagaatgagcaagattcagatagaagtgaatatgaatttgaatctgacggagaggatggagaagaatattacttagattctgactcaaattctgataaagatattgaagataataataataataataataataataataaagagtgttctccaacaaaaaatcaattagttactaaacatcgacaaattaatgatatattaattaatttaataaaaaaaaagaacaagtttgagtctcataatttcatctatcatatcattaagtaa

SEQ ID NO: 1493 - DNA, 1203 bp, Cryptosporidium hominis
atgactgaaaataacattaatattgcaaatattcaaatagtggagaacaaagagataagtaaattggaggaagtaaagccattaccaagctattatggcgatatgagccaagtattgacattagaagaagctttaaaacaatacgaccaattaaagttaaaaaatacaatttctcctagaaaaagcatcaaagaatatgcagataaacttaaattatcaagtatagccgaagtaagtaaattattatatgaaataagtttgaataatgattcagacacaaataatgtaatagggatattcgcattatctccaaataatgtaagccatttaccacctacagaaaaagatggtttgtcagggttagcagtactttcaaatgcactttctaatttgggatttactgtagtaattatgacagattcaataaatcagccagtaatttctagtattttaagtaataatgaattattcaaacattacgtggatattaatcaagaagtaggttatgcacctaaagatttaaatttagaaaaaagaaaaacatacgtaataggtgttgttccagatccaggtatagattctgaatgggaagaatttttggataatattcagaaaaagtttagtttactaatggtattaggtagaccaagtagagagttagatactggtatttatcgaaattcaagaggattaagaattaaccattattgctcaaatttggaagggatttacatcaagattatgcagcaagagaataaaattccaatttttgctttttcagattcatcagaaaaccaacttggagtatatcaaaaagatgataataggagtcaatataatgctaattatattattatttcacatactgtagattgggtatgttattatctatctgcaggtattgctttaagatttatctcaaatatcaaaaacttatatgcagataataataataaggaaaataatcagactgttgatgaaattaatgcaaagatgttacgtgatgcctttcaatcattctttccaagtgaggatacttttatttatttgaatgaaaaaatcacagaacttgaagtatgggatactcaatatggagataatattaagaaaggatttacaattgaaaacgattgggaaacaagaatgaaaattagaagaattgtatcacagtttggagtttctatcgaatttgaacacgtttaa

SEQ ID NO: 1494 - DNA, 186 bp, Cryptosporidium hominis
atgaaaatattagctagaaatgacgattttgattcaacaaaagttaatttatctaaaaaaagtaaattagaaaatactcattcaagacatctagatttgggagaaaacaataataatattgaaaattatggtaatggcggatatgaggatttggtactagtggaggagtggttatttgaaaattag

SEQ ID NO: 1495 - DNA, 1626 bp, Cryptosporidium hominis
atgattgtatttctgcataaagcattatcaaaagcagttggtagtccacaattcttggacgaaatagacttttgtttagaaaaagaggaagattcatactttgattctgtaaatgtattgggttatgacaataataatatagataattttacagaaactaattgtggtgttaatacaattaataatattcagtacataaataacgatgacaacaatcaaaatgataacattaatataactaattgtatggaaaattatgatttaatgataaagaatccaaggatattatcatatattagtgattcagctaaaaacaataatgaaattattattgacagaattgggaataatactacacaatatggaacaaatcaatatgataataaagttatggagatattagaggaagaaaatgataacaaaagtaatttagaaagtttaaatattagagatatgaatgatgaagatatatcaagaagtaatattgatactgtgggaggtgaattggaaataaagaatcatattcaacaaaataacattcagattgaaaaacaagagtatgtaatacatccattaatatcaaatttaggaatggaaaaaaatcaaatagctcaagaatttagctttattttgggagatgagttatataatactggattatattcacacaattctgaaatagttgataataatactaatactaataataatagcaatagcaaaatattatacgatgatgaaacttttcatgataaagggaagttattaaatagtaattatttacaagtttatcaaaatgacacgagtaaaaatagtaatattacctatagcgagagtgatttgaacttggataaaaataagacaacaaataatgtcgttaaatattttaatacaaatataattaataactttgacaatttaaataaagtggaaaaatcacaagataatttaatagaagaaattaatgaaagtaaatttcaaaacaatttagccgttagtgaaaataattgtcaactcaataataattatttatcattagggataccagtaatttctccaataataagaactaactttgaacaaattggaacattctattgcccaggaattaataaagttagatattgggcaatgtgttttattggttctgaaagatctacggaacctgaatttgatttaaataattatagtgatacaagacgagtattctataaacagtcaataattacaaaagtaagtccaaatcacgaaccagaacatcaaggagtagttcatcatcctaattgtttggaaattgtaccgaaacctaatgaaccatgcgaaaggtgtagcttatatattaataacagacaattagcgcgagttattagtaaaagagctactcgactacaagagatgtgggatagggtagtagctggcgaaagtattataaacggaggtaagatcccacagtctattatttctgcatataatcataggatagaccactggtccagatgtaatgatcccttagaagctatcacacgagctcttgctggttgtagacaaagagactacaccaacttcttttggaaaatacgtgaaaatttactaaaaaattccaggttaattaggaatcagctataa

SEQ ID NO: 1496 - DNA, 213 bp, Cryptosporidium hominis
atgattgctccaaaattggaagaatttagtgagcaagtcaaagatgtttgttttatcaaggttgatgtcgattctctccctagtgtcgcagacgcagagtccgttagagctatgcctacattcaaattctttttgaatggcaaggaagtaaagagtgtggttggcgcaaatttcgagataattcagcaagcagttttggctaataaaccataa

SEQ ID NO: 1497 - DNA, 624 bp, Cryptosporidium hominis
atgccatttttaaatcggtctttaaaaaaaccttataattcagtatttttgttaataacgttatttttattaatagttacaagaaattcagaatgcgtaagatataaggaaaggcttaaagaaggaggcttaggcaattttttacttggtcttgcaggttctgcagtttccacgggaatccaaagtgcaacaggttcaccactagttgttaaccctgcaatgactactcctggtgttgctaatcctcttgcgggagcgagttctgctggagctgcagcaaatccaatggcggcggctgctccaggagctgcaacagctgctgtttccggagctgttccaggtgctactcctggagcggcagcaggtgctactcctggagcggcagcaggtgctactcctggagcggcagcaggtgccactcctggagcgcctgcagcagttggtggaatggctgctcaaggagtgggaatggcatccggacaaggaggtattccaggagcaatgggaggagcagcaactcccagtgctttgtctttcactactattgcatttggagcaattgttacaatgatgatatgtatggtaatgttgatgtgtagaagatgtacaaaagatgatgactaa

SEQ ID NO: 1498 - DNA, 1014 bp, Cryptosporidium hominis
atgagtaatacagtattagaagagttagaaattgaggagttaagtcagaaattaatgttaaaattaagtccaaaaattttaaaggaagagaaatttgacgaagatatgatcaatgcaatgataattgatgaaagtagtaatggcttagttgataataactttctaacttttgataacaaaaagaattcagagcatataaaaacaactgattttataaacagttttaaaccaattgatcaaaaattgaataaagaagaaaacaacgataaactaaaaccaaatttaacaattaattataaatatattgacaataattgcaataaaattaaccaaaccttatcaaatagatcaaattccctaccaccacgtaataacaattattattgtaaaggtttaaatttacttaaaaaaagagaaatcaaagctataaataacgattgcaattcagaaaaatttaattataattcatttaatcaactttctcatggtttgaatcagaactcatatattaattctttaaaaaggatgaatattgaaaatacacatgaatttattcggctaatttttaacataataatagtttttatcacattatatataatatttggaataatatttgtaattaaaaatgatattgaatcaaaaattcaaatttcaatcactaacatattggatgaaatgaatatatgttcaaaacactatgttgataataagtgccacccagagcaaagagtgccagcaatggaatctaaatgtactgaatgggaaagatgtatgtcacagaatcccacaattattgcaagaaagtctatttttacagctcaaattattggcgaaattattaatacattccttgatcaaatttccttcaaatctgcactatttatatttggcttcattattgctttaattattggaaactattttgtactatcctctgcattttgctttaatagaaacattaatcatactagaaattctttagaatcaacatctattattaaaaaaaattaa

SEQ ID NO: 1499 - DNA, 879 bp, Cryptosporidium hominis
  misc_feature (707)..(707): n is a, c, g, or t
atggattggaaaattgaatgcattaattctttatataaacattggttgaggaagaaatgtaataactatttagtaatgataagatgttcgattaaatttttttcattatataggcatattaagagaaaaaatgcatgtatacaaatttgcaaagcattgagaagatatgtatgtattaagagagaagaaagagaaagaatcgaaagggaggaaagagaaagaattgaaagagaagaaagagaaagaattgaaagagaagaaagagaaagaattgaaagagaagaaagagaaagaattgaaagagaagaaagagaaagaattgaaagagaagaaagagaaagaattgaaagagaagaaagagaaaggattgaaagagaaagaattgaaagagaagaaagagagagaattgaaagagaagaaagagaaagaattgaaagagagagaattgaaagagaagaaagagaaaggattgaaagagaaagaattgaaagagaagaaaaggaaaggatcgagagagaaagaattgaaagagaagaaaaggaaaggatcgaaagagaaagaatcgaaaaggaggaaaaagaaaagagcaataatgaaattatatcgagaaactcctcagaacgtaaggttaagaggagcaggaatgaatctactgaagatatcgagaatgatacattatatttaaacgaccaccttaagatgaatantagaaaggaggcaaaggcaaatacattaataacacaacttgatgaaccaatggagttagaaagaacaggaacatctatatctaatcatgaaggaaaaatttaccaaataatgatgaagaggatgatgaaactgatcaaaacaattctccattactatgtacatcaacaatga

SEQ ID NO: 1500 - DNA, 642 bp, Cryptosporidium hominis
atgaatgatccatcgcaagagtttgatgaaaagctatgggagcaaacgcaaacagctcttaaaaacatacacaataagattaatcttaagaggagagaaaatatggacaataaggcaagaaatgcacctatattacctagaggaagagctagacaggcatctgctggtgaattaacaaaactaacaaatcaacttgatgggttaggttatgatgtatctaagctttatgaaagaggtagaagtcttgcaagaaaggaggaaaataagagagaaagaggaaggtctttaacaagaagggcagtaaatgatgtttctgatcaaatttctttattaagaagtaaaagatcaagaagtattacgggtaatgaagatattgaaatgttggttaatgatgaaaatacaaacagagaattattaaagagaaaaagattacctagaggccacagtcctgctcccaatcgtattgatgcttcacttaaacccggtaaacagcaagaaaaagccgagaaattacgtagaaagtctcagtctaagcttgggaagcttgctagaagaggagaagctgatagaagtattccaactaaaatgccgatgcatctattttcaggaaaacgtggtatgggtaaaaccgaccgtagataa

SEQ ID NO: 1501 - DNA, 1185 bp, Cryptosporidium hominis
  misc_feature (409)..(409): n is a, c, g, or t
atgatattagaaaatcaacttctttctaatgatagcattttttattttattgtaccaatcattaatttactatcaagagatccaagcttaatcacagattttagtagtattaaaaatggtgagagtgatcttcagtggcaacttgattactccagaaattgtgcattgatttcattatgtaaattaacttcattaacaaccaaattattaaatattaatgaaaagacgacaatgaatgatatttctggccagaactttaatataaattcaaaattatccaatttatttgaaatgccaaacatacaattaatattttcttttctttataacccatcttcatttaattttattaataaaggtcaaatggatgatataatgctaaatataatactttgtacaaatgacttgntaaaaaggtatccaaatattatagatccatggatggaaaaacagtattctcttttgaacttggaagataattctaataatacagaaattaacagtttaaaatataatattatgttgattattaattacttattgaatataggcttcataaagccaaaagatatattattgttgagttatctcaaatgcattaacaaaaaatcagaattcagttctgagctttccagtcttgcaaactcattctttcaagaatttttcaaggatttgaataatcaacttgccgtaaatattattccactattaatcaaccaactggcactggaatattctaataattatactgagaagacaaaaactcaaacaattattcaccaaacgcaatacttgcttcattttattaataataaagatattgtttgttctggactaattcctaaatttttttccagaatttctctacttaatgatccaaaagccattgaattgtacgttattgcacttgagtcactaaaactaggctcaaaaactaggtgtattagcaagattattgaaaatttgaatttgattaccttccatattcaagaatttgattttttaaaacaatattttgcaaaaattcttcaaaatcatataaattctagtcaatgtgatactaattctgaattgctttcattattgaatgaggaaaatttggcaacttctaaaattaattcaaaccatattaatgagggaacaaatcaactaatttttgatgctgaaaataaaccaaaaaattga

SEQ ID NO: 1502 - DNA, 1254 bp, Cryptosporidium hominis
atgaacaatgaggcgacatacaaagtcaatacacctttcataaataaaataaattgtgattatgtaagcaataatagaaaaataagtaatgattcagaccaaattattgataattatgaagattcagaattaataacagactctgaaagctcagatttatctttgcctattaataatataggtagaatgatgaaattatctatacctggctcagccaaaatttctagagagtcaaaaatgttaatgcaacaaatttctaaggattttattggttgtatttcatctcaagcaggagtgatttgtacgagtaataaacggcgtgtattaaatggtgaagacattattaatgctttatctacttttggttttggcgattatacagatacactgatcaattatttgaatatttggagggatgtaaagcaatctagaaacataaagtcatatagtaatatctatagatccaatagctcacaattaaattttaatgaaaattaccaaattcctacagaaaattccaaacaattttatggacttgatcagaaatttgaaaataattacgttaataaatctctaattgatgatcaaaagcctataaataatgaatataataaatatttcattcaaaacaatagcccaacaaataatcaacaaattacttatacaaatttaccaaaatgtatgaataatgctatatgtgaatatgttaatttgaacatagataagaatattaattcacaaaaatatccagaaaatactatagaaaatacaaatgctcattatagtacaaataaaagccactttaatacattattattatcacctacaagaagtatcaattttctaaatgaatcttctccagatactccaaaatcatcatttccgcctaatcaatgcggtaaaagaaaaagaattgaacaagaagaatctaaaatagaaaatgttgctgataatatcgaacagaatacagactttaatgcaaaatataacatgaattataatataaaaaattcaacagatgttgaattaattgaaaataatgcatttcaaggaaataaaaaatcgaccattaatttttcgagaaattgtaatagcttggagtattcatataatcaatataaacaagatgatatatttttaaataaaaacgaaactgcattcgattgttatttttcatcagatttatatattcaagaagaaagcgaaaatgactcggaatataatgcatacccaagtggattatttatttcttga

SEQ ID NO: 1503 - DNA, 894 bp, Cryptosporidium hominis
atgaaaataaagcctccaagtggagtcttgctatatggtccacctggatgttcaaaaacattaatggcaaaagctgttgctactgagagtaaaatgaattttattagtgtaaaaggccctgaacttttttcaaaatgggtaggagaatctgaaaagtctatacgcgaaatttttagaaaagccaggcaaaattctccttgtattattttttttgatgaaattgatgcaattggtgtaaatagagaaagtatgtcaaatacttctgatgtcagcactagagttctttcacaaatgttaaatgaaatggatggaattacaacaaataaacaagtcattgtaattggggcaactaataggcctgacttattagattctgcactacttagacctggaagacttgatcgaattatatatattggactccctgattcaaaagcaagaaagaaaattttgaatatttatttaaaatcaaaaaattatattcaaattgatgattgtaacaatgataataataatggaactagctttgaaggaaatttagacagtttaaatgttacgaatcataatattgatagcctagaagttattgaattatgtgataatataactaatatggaaatctttgatagttatgatgaaatgattgattcactggtaaatttaacaaacggttacagcggtgcagaacttgctttattatgcagggaaactatgatgcaggttattagaaggactattacaaaccacttagattctaacaaagattcaattagtaaccatgccaagtttacttggagagatatatcttttgctttaaataaagtaaagcctcgaatacctcattcgttaatagaattttatgagaactataataagaaaaacaatataatataa

SEQ ID NO: 1504 - DNA, 171 bp, Cryptosporidium hominis
ttttcatcttccgttcttaataattatcattcaaattatttatatacagttacatgttcaagcaccagtgtaaggtctcagcgtttgtatgatgtatgcatttcagatatcatcatgtggtcagatgcaagtctttatccggcttctatcgtttcttcagtaataacatag

SEQ ID NO: 1505 - DNA, 1350 bp, Cryptosporidium hominis
atgtctaagaaacagaacaaaagtacccaaaatatgttagttaagaatgaaacccttaataatatgggggattctgaaaagttaaatatgtacacaaatggccataatagtaacaataatgtatcaacatacaaagaaatgctattaaatgaaaattctcattccagtgagaaaacaaataatgatgttattaaattatccagtaatcaagaaaatcatgtcgatcatttagaagaagaaagtaatagtgttagtaatttaagtagtagtaatgaagaacaaattgatgatttaaaggattacaataaccaaaatgggaatagaatggagaataatataatatcatctttggaattcatttggtctgaaattagaagtgaaaatgtacttgaaaaaaaaaatgttgattactttgaatttgacgaagatagttttaatgatcgaattcctaaaaattttctaaatgaagtttatcaagtaccaaagaaattagagtacctccttaacttctcaatgctactttgcttcgatacaatcctatatgatttaacgtttctgccaattaattcaatgatagcattactaaaattatttttattaatatttttgaatattaccaatatatttatgtttctaattacaggtaaatcaacttatttccagaatgattcaataattcaaagagctgacaattataataattcagaagataatattgaaaatgattattctattgattcaaattcttggaatcttattcaaaatactaataaagaacaaaataatatgggatataaaaacaataatgaattaatcgagaattctagtgttgaatatttattcgaagataaacaaattaaaagtaaaagtttgataaatattccagagtacgataataaattgagatttagattcaacatgaaaagtaaggatgatggatttcttagtaaaaataacaattttttcccacaaattaaaaatcatattcactcatatagaatgaatgaccaaagatcatctttagaagaatcagaattacaatctatttcagcttctgacatattctatgatgaaattaatagtcatcatatctatactaagaataaacaagatttaaagccattattaagtattaaccttaaaaagtattttagattcactgctattgagttaactgacttctcaagattcttagttttattattatctatttatattttcagcaggcttgatatctcatttttttaccattatattagagggcaaggattatcaaagttatatgtcattcttaatatgctgggaatatttgagcttctcttcagatcttttggaagaaatataagttga

SEQ ID NO: 1506 - DNA, 729 bp, Cryptosporidium hominis
atgcaaaacttagaacaggaaattgtagacaggtcaagtactaataatacaaataatagggaagaaattgaaataaatgcagaaaatataataagcgtgattccaaggtcaattgttgatggtagtaaacttatcttacgtttaaaaaaggacgaaaagttaagctatgaatctccaacacgtattttattttcaaataagcaattgaaattagagcgttcaatttggtggcttacagatgtaattttgactgaaccttctttaatagttttggattcttgttcttctggaatgaaattttttccagtaccaatgaaaaaatttggtacgttatattcaagagagggagttgggcatgtaattactggcgatattattagaagcagaatatgcagtagaagtattccatatagaaattgcaataaatttgagcatgcaccaagaaatattggtaatttaagggatgtgaactcttcagataatgaggatgaagacattgatattgtctacctccgaggtgatgaaagtatcatccggtatactttacaaccaaatgaacaaattgagcttggggcaggtaccgtaattgcatggacatctggagtatcgttcaattttaaatctttttgctttatgaaatttgttacttctattgttggtgattcttcatctatctctactgtttggattgctaacagcggatctaagatgctttatcagcacggctga

SEQ ID NO: 1507 - DNA, 1251 bp, Cryptosporidium hominis
tttggtgttagtttatacgaggatctcattgatattgattcaatcgatgttgaaagaaacaattcaaaccttcaaaaaaccattgaaaatgaagtaactttaaagtcaaaaattgagactagcttacttgtttacaaagtaaattgtgaaagatctgatacaacaattatttatgaggaaaaaaatgttaatttcggcctttcaaatgatttaataggaaccggtacactaattttagaaaaaattgaagattctgatgtatttgcattgtcatgggaaggaaaattgctcgaatgctttagtagcaacaaacaaagcattcaagatgtttctaaatactcatttttattgcaatacattattgatattaatataaaaattattcaagatgatgaattctttatttttatcaagtctgatttccaacttgaaaatgaaactatttttcttcagttctcctttaactcagaggaaaaggcaaacttctggtataataatttaactaagtataaacgattaattgttaaaaaaacaaatgttgaagaaaatgataataatgctaaacaaactcaagtaaagagatctagagaatattcaaatgattgcccaattaatgatcaaaaacataaatctctttcatcaagtaattctcaacccccaaaaatttcaattcctttttatagagataataaacattccaaaaaatcgtcaaacattccaaacactcttagttattatcaatctgagaatctttttcctctggttaaacatgaagataaagttcatattgaaaatcaaattaaaaatctcatctacacaaatattagcaataaaaattatcttgataataattctaccgatgtatcatcatcttttgatattgaatctaacaaatccattataaagcaaaagtgttcatttattaaatttattgtcaactcaattcaatcaaatattgtggaaaataaaacttcgtcattgtcaatttcaacatttccaaagtctatccaatcctcatcatcatgtgataatacactaaattttcaagcaactaaagaaaattatgtacaaaattcccaaccccaaatttttacatgctcaatatgctatgaaaactttgattataatgatataattacgcttcaaccatgtggacatcaattatgtttttattgtgagcatagattggtggattctaaatgcccttgggatagatctaaatatactattaaaactcaaggaaagtgttaa

SEQ ID NO: 1508 - DNA, 714 bp, Cryptosporidium hominis
atggacaatgcttctaaagaaagtggcacagaagttattgaaaaaaagatgagttgcgagatattaagcacaaggttcagagcttttttatcatattttctcccgatggtttacggaatatcactatttagcgttgcttggttaaaggtttcttcaccaatatttattgcagtatgtttggcatttggatctattgatgtaatcacatcaatagttggaatgattgggattctttgtccatcaggactcgcaataaggtcaacaattcctcttttagcgatggagaatttagttacatttttgatttcaattgggttatttgttgaaagtattatgtataaaaatacaaaggactttttgatattagattttagtgttggcttgactttatcattcgtattaatgattagtactattttgagtgtgatatgtatttggaagatttctgattatttgaatgaaatagaagcatcaagtatttttgaagagttatctggtaaaaaatttagatcttcaaagtatatgaactctataaataaaatttcaagtaatttggataataaacctcttttatcaagaattaattcaagagatataaaagacaaagaagttaaagctggtgatgctactactactactactactactactaatgtcaataccaagaataatatcgattctgataacaatttagcaattgttattaaagagtga

SEQ ID NO: 1509 - DNA, 648 bp, Cryptosporidium hominis
atgctatctgagctggctgaagatcaagtagatttcgacgatgtagcattaaatacctttttcctaaatgaagaaattaatgaaaatttatttcaagctttcatgcttgaatataataaaaatatattagttttgagatttaatgattttacatcagatacagataaatctgattggctattgaagtattgtgaacatttatccgagaaaattaattcattacacgaaatcaatattaatgagttgcaagagcaatcaattcattcagattatactcgaaaaaaaaatatattattgatattagatagagattttcacaaatcacttaggaatgagcctgggcaattatctaaatataagtttttaaacaatgtactaataaagtattctgataggttatcactatctgttggttctatggggggagaaatatcgttgtttgaaattattctccgaatacatgaattatataaatatggagaaattaaatatttaataatcaatcaatttgataagctaatagatattgatgagcatttatcaaacgaaactaaatcagtaatttattcttatatttattcattatttgcaaatattagtttaggagataagtatagtcgagaattgaagattctaataattgattga

SEQ ID NO: 1510 - DNA, 924 bp, Cryptosporidium hominis
atgttgagaactggaagattccaagatgctcaaaactatagggaaggaataatgaaaataactcaagaatataatgggctttatgatcgtactagaaatgaatatattgagagattattggaaagacaaaaaaatcatgatatggaaataaaattaatgatatcaagccataaagaagacattgacaagatgaacgactattttattgaagaaaaaaggaagataagtgaacaacatgatagacaactaaacgagttgctgcaggagaataaaagaaaaattgatattatgaaatcagatcattctttagaattaaggttagtacaacagaaatataagcaaataattaatgataacaataaagaaaaagataactcaattcaagctttcaagataaaatttgagcatatattgattgatatggagagtaataaagatagggaattattgaatatgcaaatagaatatgaagataaaatcaacgaactaaaagaaaattataaaaatattatagataatttagaacttgaattacaaagaaaagaattgcaattccaagaagaaaagaaaatgataattaatgagtttgtcacagctcataaaagagaggttgagatattaaaaagtcaatcaattaaatcctttgattttgaaagagatattgacagccaattaattactgatactaatatttctagtaatgataacaataatgacgaaaacattgaaagcaataaaaaggataagatcatcttgggtgatgataaaaaatataacgaaattatcaagagattagataatataacaagtagaagttcttcaaaagctgaaagtggaaaaattggattgtttgaaaataagcattcatcaactacaaattcgactgcatcatcttcggctattccatcaaacaatatatgttaa

SEQ ID NO: 1511 - DNA, 456 bp, Cryptosporidium hominis
atgtcaagttcatcaaatttagggagtgacccttcaaatcctacaaataaatcaactgaaaaccccgtaggtggtacggcagaacatgattttgatccaaactctatgcccaatggacagatctcgtcaatttcttcattttcttcaataaaggatggcgttcaagattgtattattacatctatcaactctgttttagaccaatccactgaatataatgcttctgaagtcacaacatgggtagattcaattacaagtcaatgtttagagaatttacgcaagctgagcgagaaattcaagtatattgtgagtgttatcgttttacaaaggagtcccgcaggcttccatctgtttactacatgttactgggaccaggcaaatgatggaagtgttacccatcgttgggataacaaaaacttgcattgtgtcgtggtcgtatatggagttgcatattag

SEQ ID NO: 1512 - DNA, 2493 bp, Cryptosporidium hominis
atggatgagaatgtattatattttccggatgaagaattgaaggaggaggagataaatgagcaatcaaaaccagagtcaatttatacacgtaaattttctgacgtaaaaggattaaatgagaaattggtctctcaattaaattctttgggatacgagaaaatgactaaggttcaagagtcagttattccaaagatacttaatggaggcgatatactatttagggctcctacaggaacaggtaagactctttcatttttagtaccagcaatacagagaagtttattaaacgatattggaaggacaacttttcagagaagcgatgggacaattattttaatcttgacaccaacaagagagctttgtatacaaactattgaaactgcaagattaattgttcaaaaaatgtcttggtgtgtaacaggatgcatatgcggaggcgaaaagagaaaaagtgaaaaagcaaggctaagaaaaggaatcacaattttaggaggtactcctggcagaattctagatcatattgattcaacaaattgttttaaggttacaaacttgaaaactttaatagtagatgaagctgatagattattagaagaaggttttggggcatcttataaaaaaatttatcaatttgtaataaatcaaaatgcaaatttaagtagtaacggactatataacggagatgatgatgaagagttgtcaatgctattgaatgttaaagttaataaagagaaaaaattagataaagttaatagacaaattattcttgtttccgcaactttatcaaaacctgtagaagatttagcaagatattctctcaaaaataatcctgaatggttggtattggatcaatatcgagaaataggccataagaaagacgatggagaattagagatattccaagatgttttagagggaaaccagaatattccaatcaaaggattattctcagttccaattaatcttcgtcaagagtatgtgattgttcaagataaattcagaattccggctcttatttcattgctattatcacgtacaggaagtgggaaaagaactgtattgtttgtttctagcacccaggttgtagaattttactttgcattattacaaagtattagatggccatcaaagttattgataaaaggtggtcctaacgttaagaattcaatcaaattactagagaattttaaaaaggaaattgataataaagatttgcgtagcgaaacaaaaaacgatcgaataccaaataaatttaaaagtaataagaaaaagaaattgaacaatggttatgacagcgagtcagatacagatttaaatggcgagatgattctttctgactctgactctgaatttgaatcaaggatagacaagaaaagatctgataataataattttcataaaggccataagaaatggtttacaaatagttcacagttagttgaaatatttgaaagcatgtttgataaatatatatttaaaaattctattttcgatgatgaagtagagtatgatgagtcctctaatttaaattatgaaaataaatatcttgatgatggcgatattgtttcaaataacgaatcggttacacagccacctatttttatgcttcatgggcatatgaataaagatgatcgtcttggccaattaaattcttttgaaaaaagcaagaaaggtggggtaataattacttctgacgtagcaagtcgaggattaaactttccgaagatagacacagtaatacagttagatccacctcaatcaatagaagaatatgttcatagaatgggaagaactgctcgcatgggagataagggaacaggaataatttttcttaggccaacagaggaaggttatttggaaatattaaaaaattataatatcacaggtaaaaatggaattataaaattaagtgacactacaatttgggaaggtttaatttcaaacaataataattctggaaaaatagatgatatctctggttttttctattctattattaataaaattattacattagatccaaatgactcacataatgagttattaaataaagccaggagagcatacattgcttttgtaagatcatatatgagttatgaccgtgaattttcaaagattttttcaattaaaaaactacaccttggccatgttgcatcttcttttggaattaatgaacaaccaaataaaattattggccatattaagtatctagatggagttataagccataaggaaagaatgaatattaacaataaaaataatttgttgaaaaaaaacaaacctaacttgatagaaaattccaaaaaaatgatcaggaagacatttaacaagcaaatatccaaagttaaaaaggaaacgccaaacattaggaaaaaaagtgaaaataaatcaaatttcaaggattttaactttaaatctgatttaaataaatcaggaataattgataaggcactacaacttatgaagaagaaaagtgaaattcatgtcgaatga

SEQ ID NO: 1513 - DNA, 1890 bp, Cryptosporidium hominis
atgaataggaatccatcagaagatgtgtccatatttactaaaagactttctctgaacctaaagaaacatattggaaattttattaagttgagatttagccaaagcttgaaagtagaaattagcgtgaaaatacaagataataatttcaacgacattggaaacgtgaaattagaagatattattaatagtcagaatctgtatgttgctaaagttagtgtggtggcaaataatgaaaaatgccaacacttttattatttaattaagaaaaatgtgcctctgattgaatctgtaaacataaaaaatgaaattatatgggggttcccaattgtaccaaacataacatttataaaaggggagtcgaataatttttcatataagtggtatttacagtataatataaatgaagcaaaaacaaaacatgatatattgccaagtcttccagaaaatgtaattgaaattgatcaaaattatatttgtgatttgaaagcagaatttataaatagagaggaaatgtccaaaattctcgagaacattgagaactattcaataatatttagaattatgctaaattctgaaatatcttcattatttgacactatttatagatttaatcatattaataaaccgctggaagcaagttggagagaagaaagaatacaccgttttaagggtgatttgaaattaagtcctgaattgaatgttaatagattaaaaatagtgactttcaatattctgtcggaaatatgtgctcagacagataaggctctaaatgaaatgtatacaagttgtccaaaatatgcattgcattccaattatagaagaagtttattagctagggagcttattgacttgaatgcagatataataggtcttcaagaggttcagtcttgtttatacgagtcgtttattcatatattaatggaatttaaaggatattcaggtgtttttaattctgactatgccagtgttacaacattttacaaaaaagaattatttaatttattagaatctgatacaatacttttcaaaaaaatgttaattaatgattatccggaaattgttaaagaaattaaagtaaaatggccaaactttattgaatacttgctagataaaattttaacagtatttcaaattgtcgtattagaacataaaattaccgatgtaatttatgtgtttgccaacacgcacttctactatcatccttttggaggtcatgttagaattctacaggcaaagttactcatggatttaattgaaaagtatttgaagagattaagattgagttttccatctaaagaagttttcacctttttatttggtgacttcaacacccttgccatttcagatgctagaacacttttcactgaaggtattattaattcaaattcatccgagtggattcactctacacttcttaattataataagaaagaaagatcagacagcaatgacgaacaatgtgaaaatgttaatggccatcttaacgaagatgaactcaaaaatttagagttgcatagtttgggttttgatctccagaccaataataggtgtattgatttgctggatattcatctagacaaaaaatataataatatacaaattcgtcataaagaaaaagaaaggattgaaaatgctgattccaaagggtttagtagtagtttatattatcctttcacaaacaaagtcaaccggttttctggccagttagattatatttatctagtagaagaagaagctttttccaacaagtttaacatttttttgaacaactttttgccatatatagacgaagcaaccttatctccaattaacactcttccatcacctcaatatccatcggatcatatctcaataggaattgatatttcaataactaagaatgaaagttaa

SEQ ID NO: 1514 - DNA, 1992 bp, Cryptosporidium hominis
atgagttccactgagtcaaatagaccaatagtattggagaaaattcagctcgaatctagaaaagttttttcagtaaataataggagggcagtaattgaagaaagaagaaatgatagaaaattattcaataatgaattaatgaatggaaattctttttttgtaaaaagacaaaaattaattaatgaattaccaccgcatccaaagaaagtgcttttaccaatcatagaaaatcaatttgtgttcttagggggggttgcattgtcactaattcacaaggctttgatgagtaattttggaaagagcatgattgactttattattttaagatctatttttgggaatggattgttaatatttttgttatttgaaattcattatttaaaaagaagaattaatatgctatcaactacaaaaagatatctaagagattttggttcattggactcttcaacaaacaatgaaagcaatatctttgctagtctttctaaaaagtcaaagctatccctaattatatggatgtttatttctagtatttttacaatatcccaaccattggtagacaagtttttcccaattcaaataatttctttgtcccagccttttactccactaatttctctaataatactttttatatttacatataaatcaaataaagaacatcacttcacaaagtctgcaaaggacaaaatgatttatactaaattaggtatttgctataatggtcgatcagatacttcaactagtgttacaaacttctcagcacttgaaagcagcaaaataactgaaaatattaagcttgaagcagaaaaattatttcaaaggtcaagaatgattgctgataatcaaatttcttataaaaatttactgattatttttttgagcttcattgcacttctttcagccactccaattaaaggaatgctaatatactttgagaaaacaactatcagcttctttttgtgtggacttattccaacactaatacttccttgtttacatgaagtttttttccacataatttgtaaccgaatcttaagtgagttactagcagataaaattgaatcaaatccacaatctaacattgtcttcaccagaatcagtccgattgatgatttaaataggaaattatgtaatatatatattcatctcttcatgactttaggacaaatcatgatagtactacctacttgtattggtattaaagcaatattttatttgaagttttcacgattaatttcaactgatggaaatgtttccaatttaaacttgattggatcaattttggaatctcttttcgacattggaaagacagaaattgtcactattatattttcggtcgtttcaatgcttggaatttaccagaggtgtaaaattaacaatgcggaaacttttggattagcgggactgatgtcagttcaaggattccaaacacttttaagcacatcattaaaaagtagttggtcaacttggctaaataatcatcttactggtttaattttctcaatttcctcaattgcaatattaagatttcaagatattattggaactttgaaaattttctatttatatgctagatggactttatattttaatactcaagttattgctgggaaggatgaaagagcttatgaatacgaaaatattaaatcatataaatcaaatataagaattattggaggaagtattgatatcaattccaatattgcaaatcttcattttgtagacagcaaacctcgcctttcaaatcaaactttgatggatgatgaagtttcattgaaatcagatagtgaatctgagaatataaaatcattaattgaagacaaaacacaaaaaacatccaatgggtataatataaaaacaatctcattggaaaataagaatcatgatagcaaaactaagcataataataaatttgacttgaaatccaattcaaattatttcattgaaacaccaattatgtctgcgaaagttgttgttttgcaaaactaa

SEQ ID NO: 1515 - DNA, 669 bp, Cryptosporidium hominis
atgaatcaattaaataaagaaataaagctatgtggtgtatttgaatgtaattatactaacactggcggagaaattattcatatttctcccacaaataattactattcaaatttaaatattaatgaagaaattacaaaggttttacttccatattatattgatgtgaattttgacggaataagccagtttgaaagccaatatcacttggttttaagatttaataacacatctgaaaacatcatggtaagattacataggatgtatatagttcacgaaggtattcctgttcaagtccacaatctaaattgttatttacttggggaaaaaacaaaaattagtaatgatatgaagttaggtctactgggttcctcttcaataaaaaacaaaacacaatatttcaagtcgatcagagtagttattaaaattgaaaatccggaaaatgatgcaagcgaaagattcagtaatacaaattcgatcagaatcttgctagattatttcataaattctaatgatttaattgcaagcattaatgtaattcaaaatgatttaaaagacattaattacacaaaggatttacctattgaggaatctgaagaggcgttatcagaaacttgtagtgaagatcattcatttactccaattttaatgcctacaatggggcatagataa

SEQ ID NO: 1516 - DNA, 207 bp, Cryptosporidium hominis
atgcatgcatttattttagccagaggggggggggggggaaacagtcccacatccaaactaatattaacaaaaagaaaaaaacgagaattttttataaaagcttacataataatcaatttaatcactgaaaaaaaggaattttgtggatttaattacaatataaagaaaaaaattatttatttaaaacatttgcgagtgataaaataa

SEQ ID NO: 1517 - DNA, 1041 bp, Cryptosporidium hominis
atgaacactaaatcatttaatcctacgatttatggaggagtaaagaaagcattaaaacacgcctgtatttttcaatcacaaactgaacaatgcaaatttaacggttttgctgataatagtggggttacagaagcaaattcatcatattcaagtgtgaaaaacaagatagatagcattgatgagaaaagtagaatggaatcatcgctgaagcctctcaattattgggtaagaagtatagactctaaagtttcttctgaaaaagttacaaatgcttatagagaagcagtgtcaacatatcttacacaatctactactttttctcaaaataatacaactttaggagggccggagaactattgtgaaatggacctagaacagaatgctaactttttatctttaaccccaaatttggaaagctcacaaaaagaatgtatggatggctcatatactgctgaaaatgcccataatactaatgaaaatgtggattttcttgaaagtcaagttcgaatgaaaatggatgaaagctatatcaataactttaatactgactatgctttctctggagagcctaatgcattacaaacaatgaatgagaatttgcctctaaataaagattttgaagctaatgaggctgagtattcccagaatattgagttcaagccctttaaaatgtaccatgaccaagtgtttataaataaagactctgcgttaaatttgatgaatatagatgaagtgctcaatctttacagttctaatggtagtaatgtacaaaatgattcaacagatgggcaaactatcattcttgacgaggaaatatgtagtacagagaatctaattggccaagaaagcctttgcaattcaagcgttgcagactatatgaattcttttgaagattacaaaatctccgagccattaatttcaattagcgacccttacacaaatataatgcacttagatgacccccctactcttcacgatcaatacattaaaatggtatctccatatgaatacatcgattcgttcacattaatagaaccgtga

SEQ ID NO: 1518 - DNA, 651 bp, Cryptosporidium hominis
atgtctgaaaatagcgttgatattcgttctgtgcaagccacaaactgcacagagtctgacatggggcaaaccttaacagaaaatatacttaattcaaaagaagatagagaagttttactctcttttgacgacttttttctttttaaatcttcctcagatagtaagattgagaagattaattattccgatttggtcgaacatgattccgcagatttggacgataattcgatcgattatatatctaatccagataaaactcaaatggaagacttaaactttactggaagtacttcaagtcgctactctaatactgaattcaaattaaaaaagagtgcttcaaatagtactttagacgagtttaatagagggatactaaatgatgaactcgagactgaatatgtcaagttgatccctaactcagaaattgtttttgctaagtcatacgataaggaaatgaatattgcaattggtttgattgacgaggtactaaaaatgagagacgaatggaattacgagctacctaaaatagaacatgatcatttaatagctcacaactatgggaatttacaagatggaaaccctatattagatattgaatcattggtagatactttgccagaaaagatagatgccaaatatgaaatggattaa

SEQ ID NO: 1519 - DNA, 1317 bp, Cryptosporidium hominis
atggatgcaattaggaactgttttcaaaggtttgatagatttaacgagaaatataatccattcggttctaacctgatgagagatatattcttgaaatataacaatccaattaagggaaaatatcttgctgaaattacaaaggaagtaattcaagatttaaaaactacacattatcaatttgtggaatggagaatcagtgtctacggtaaagacaagagcgaatggaaaactttagcagagtggctatataataatggtttatattgtaaacatgtaagatggatcattcagattccaagactttataatattttttacaaagatgggtgcgttaaaacattcagtgaaatgctcgaaaatatattttccccattaatagaagcattgatcaatccaaaagataatcccctgatttttattttacttactaatattgttggttgggacacagtagatgatgaaagccaaataagtaagtattcaatggataacccgaacttttgttatccagaatattggagatcaggagataacccaccatactcttattggggcttctatctttatagtaatattcgagtgctaaatcaacttttatactctagaggtttaaatccattgatgttcaggcctcattgtggagaagctggaaaaatctcacacttagctacaatgtatttattagctgattctattaaccacggaatattacttaaaaaaactccagtattgcaatatttatactacttgaaacaaattggcattgcagtttctcctgtttctaacaatgcattgtttttggagttaatgaaaaatccattcccaaagttttttaatgttggattaaatgtctcgctatcaactgatgatccccttatttttcactttacagatgaatctcttctcgaagagtattctattgcctctcatatttggaaattgaacaatattgacctttgcgagatcgcgagaaattcggttcttcagtctggattttcaccaaaatataaggcaagttggttaggtgtgaaaaactacagtcatttaaataaatcactatataatattttaaatgatttggaaccttgtgaaatcaacgatatttcgaggtcgaatgtcccaaacattagaatccagtttagaaaagatatgcttaaaggtgaaatggacctcataaataagtatacagtttcaattgatagaatcgaaaatgcaataagtattgtaaaaaatttaagattgaaaaatgtttccgataatataagcaaagaaggagttaatcgtaactctaattccttaatgaataatttcccctaa

SEQ ID NO: 1520 - DNA, 432 bp, Cryptosporidium hominis
atgtataaagtgctggacaatataatcaataatgttaaaaacaatccagaaaaatttatcgaaataaatagggatgaaataaataacagagaaaaaaaattgaaagataagtatgaaattatgacaaattgcaaggaagaagcaaggttaacatatggtcatgcaaaagaaaaagaaattcagaatcaacgaagaataaatagagactttttattgaatagccatgcaacaataaataactacaatttagagcatgaaattcataatattgaaatttcaaacaaggatgagaatttagaatatatacatcaaaatactaaaaagcttcatagtgcagcattaataatatctcaggaattgaatgaacaaaataatttaattgaaggaatgacatatcaggtagaagaggaaagtaagttattaacccaatga

SEQ ID NO: 1521 - DNA, 1446 bp, Cryptosporidium hominis
atgatatcatataaagaacaaaaattaaataatttacccgagaacaaatataaaagtagccttggaagtaatgacagttttttggaaagtccaaatgaaggaatgagtttggaaataacttttcttatatcgagcattataatttgcattgtggtttccttgatcagtattgtaacgcaaggcaaaaatcagatcagggtaaattgtagcgacccaaatcacattgtagtaatgactcacgggtgggcaggaactccggcaaatatggacgttcttgcggaaagaattttaaataaatataatattttggttaatagtcaatggactgaaaataatcaaatacaaaaatctgaatgcattttaatttacaaaattcactcaaattggggatatttcagaagcatttttataacatctgatggtattgaaaacggtgctttaagaatgtcaaaagagcttcaacaagtaatcataagaacgccctctttggaaaaaatatccttcattggtcatagtcttggtggtctttataatagagcagtgcttcctttaatgagtaattaccctttggaaaaagaaattcaatctaaaaatagtactggtttaataggtggtctcaagccaatgaatttcatttcaattggcactccacataaaggcgtactaagtgatgattgtacttttttcggattcgaaattctcaaagtcttatttccatggaagtggatttcgtggctaccaactatttcgcagctgttattgatggataaaaataagccattaatagcagatatgatgaataatatgaatatgattaatcctctttcttggtttaaacacagacacacaattgggtcattaaagggagatttattagtcccaccaacttcagcatctcttctgcctttctgcattgataatgaaaacttatcattggtatcattcgatatctatgaatttggcagaaggtatcaaacaaataatatttacagacttaaaaactttaaacaaaactaccaattatattcaaaaactaataaaaatcattcaaatttcgttcctaatatcattaaggcaaaaagtggtgaggaagataatttaatcgaatggataacagtaattgattctggaaacgagaaatcttatgaaaataaaaatgaaatttactataggaacataaagaataaaaaaaaacttattaatttagttaaagaaaaatatcacaattttttaaatcacaaaacattgagtgatgtatttgataaaagcccaaatggtaatttagacaaacttgtttggatgaagacctctgtattgttcaaaagcaaaatacaccggtttttctcacatcagttaatgatgttttgttttgaaaactggggttattttcttttaggaaataatttccagctattagatcacattatagaaaatatgaaattctga

SEQ ID NO: 1522 - DNA, 2352 bp, Cryptosporidium hominis
atgaataagatagcaaatattattgatgataataataaaggtttcgaagtaaaatctaatggaactaaatttgagagggaaacctcagaaagagttgggacagtaacccagcaaaccaataatatttcagatgagaagaattccaggtcaaatcacagaaaaaataaagagtcaatttctgatatgaagggggatggagatcttgaagggaggcttctagaaaaagaattcactatgaataaaaattctgaaaattactctaataacaaaaatggggtagagctttataggtgtgatttggtttatgtttcatctagaaaaaaagtcccaataactccggtagaaagttgtgaattacaacccattgtgattttaagagacaaaatgggcaagctttgggatgatgacgatgaaaacccagaaaatcctgtaatcagtggtttggctagtattcattaccgctggagtagaggcccatctcgtgcagtttgtacatttcatccaagccaagttgcaacattacaatgtgccacaacattaagatgcttctgtggagttggctgctataagcaaggatttgctcagttaaggcgcttttatgaagttagggggatgagtcctatatctccgcatccaaatagccatacttatggcgttccctgtaggccgtttcaatttaatgacccagacaactccttgagagacagagatgatgcccatatttctctccttttaaagactggattagttcatatatcaacagatcaagaagagtggactccggtcggtgaccagaggaattatttaccagtttcggaagatgtcggtcaccaattgaaattggaagtctttttagtatttaagtcaggattagatcctaattcagaactttttgaaaaatctctatccgaagctagaagtttttcagaaacttattcgcaaatcactacagcctgttgtgttcctaatcttcctcaagctcctccaaggtgtattttaaatatgcctaataaccaaatgaatggagttgggattcatcacaatacaggaacggccataagtcattctagatttaaagtcttttcttggaatgttcttgcagaaatttatgccagccaagaagcatttcctcattgcgatgcatacatgctttcatggtcgtatcgtaaaactcgaattattgttgaaattctgagtcatcaacctgatattgtctgcctccaagaagttcaaactgagcactttgacgactttttcaagcccgttttgcaacaatatggctatgaaggtgtttataaacaaaaaactacagagatctttacatccggaagtggaagaaggaaagatgggaaatatactatggatggatgtgctacgttctataaaaccaataaatttattgctaaggaaaactattcattggagttttccgctcttatcaaagaagctacgcatagaaccctcccggctgaagtaaagaataatcccgcagcaattaaaagactgcttaaagataatgttgcagttgttattcttcttgaatatcgtcaaaatgattcaattggctcagattcaaatcattccattcataatcagctaacaggaaattcgtcaggagtaaataatagaggaattgttggaatgagtggtactaacttgatggtaaacaatgttcagaatcaagccggagtactcattccatcatcgaataaccaaatccaatctgatccttctaagaaatcgatgaattcttctactccactacaagttattattgcaaatacacacatagttgcaaatccagaagcaaatgatgtaaaaatttggcaggcgcaaactctagtgtcagtattagaagaatatctgcatgactgttacagaagacagcctgtattacctggccttattatttgtggtgatttcaacagtacgcctgatagtgccttatatcgtcttttagcaactggaacctgtgaaaaaacacacaaagatcttgccatggaccgttatggactactttctgatctacaacttggacactcaatgcgtttacgcagtgcatattctatggcaaaagctatggttgaaggtcacaacccaaacatgcttgtgtcatctactgaatctcttgaacctgttttcacgaattataccccaaactatcttggatgtctagattatgtattctacactgatgaaagactaagacttggaggagttcttgaacttttagatgaggaggcccttattcgtgaagctgctgctctgcaacttcctgactggtctctgccaaatcctcaaagaccgtctgatcaccttccattattaacagaatttgaatggaatatttaa

SEQ ID NO: 1523 - DNA, 1068 bp, Cryptosporidium hominis
atgaaaggaacattttccgattatttaattcaaagtagctcaagctacaatctagctgaagaacttcctgatgttgacctgcaacttctaaaaaagagaaatgcagcgattgaaaaaaaacttgataaaattaggagagaaaagagattgagctggaattccgcgcacgaaaaattgctaacttggtctctgtcaggatttagtgtattaatatatggattcggctcgaagaggaatttcttggatgaatttgtgaaaaagaaaataaatgggaactatgttgctctaactatcagaggctattttaaaaatattaaattcaaaacttgcctatttgaactattaaaagcaatggatcacacagaagattttttaaaagataacactaaatcctacaataatttcattagtaatgattgtagtatcgattcaatgattgcaaagattcaattgttgtataacaattccagtacatatttcaagaacattttcttaataatacacagtatagatagtatttcaattagacaatatttgcctgcaatatcgcaattatcacagcttccatttatgagtgtaattgtttcagtcgataatatcagatggcctcttctttggaataattcaatgcgctgcaaaatgaattttttatatttgaaagtatccacgtttgaagaatatgatgtagagttagatcacttatatgagagccaacttcctccatggttgggagcactttctgataattcacgcgagcaatgcaaactagagcagctaaactcgatattaaattgtctaacacctagtcatattcaagttgtaaacactattgccaccttgcaactcgaatatggatatgctgcagaagaccagcttttaaaaagtcttaaatcctctatgactgttacaacgaaaagttctctctcacagcttttaatcgaattgttcactcacgacgtgttgtcaaagcaattcttaaatgatagcgagaacaagaatggcaaaattatatacaaattgaagctttccagtgagcttataaaagaatacctaaataatctcgtctaa

SEQ ID NO: 1524 - DNA, 453 bp, Cryptosporidium hominis
atgcaagttgagcaaacatatttgatgatcaagccagacggtatccaacgccaagttgttggagaaatcatttctcgatttgagaaacgtggatatcgaattgcagcaatgaagttaaccattgctaccccagcaatattagaggagcattatgctgaacacaagggaaaaccattccttcctggcctaattgaaaagatgacaggcccagttctttgtatggtattcgagggcgtcgatgttatcgcccaggctcgtaaaatgatgggctcaactcgtccaggcgaagccgctccaggtacaattagggcagatttttgtcaacaagctggtagaaacttgatccatggatcagattctgctgaatctgctaagagagagatttcactttggttcaaaccagaggagattcagtcatacaaacttactttatctgactacatcttcgagtaa

SEQ ID NO: 1525 - DNA, 720 bp, Cryptosporidium hominis
atggttataagatatgatggaaggacaaatttggaatgtggtgcaatatcggctaatgtaggcattttcaatagtttaaatggatctgcagaattttcgattggactttctaaagttatagcaactgtttggagaccggaagaagcatctagtaataaatgtaaatcatacttggaagtaattttaagacccagaattgggcaacctcaggaatcgcataagctgattgaatatcatattctaagactctttgagaaggttatagacttcaactctttttccagatgcgttatttctattacactgcagattgtatcagaagacggtccgatcttgccagtctgtatcaatgcagcagttcttgccctcattgattcagggatccctatggaatttttcccattagccatctcaatagctgaatctagtcatttctacggggaaagagatatttctcatttaatgctagacccaacacaatcagaatttgagcaatgcattagttgttctacaatagttataaatacaactgaaaagaacattttttcctgtattactaataaaggtactggtgtttctcataataaattattagatgagattcaccccatctcactgtcggttgcaacatcaaacagtcttgtcaaacatttatcagaaattttgttagataatataaaatgcaaggtagtaaaaccgtataataacaatctattctaa

SEQ ID NO: 1526 - DNA, 1074 bp, Cryptosporidium hominis
atggacagaaacgatgtggatgaacactctattgatgaaagatatagtcgtctaactgctctggaaaatatgggagtagttgacgattattctcttattatgaaaaaaactattttagttataggcgtaggcggagtcggttctgttgttgtagagatgctgactagatgcggagtgggaaaactgataatagttgattttgacattgttgagttatcaaacatgaacagaatgttttataatatgaatcatattggtatgtataaaacggatgcatgcgttgatactttaaagctaataaatccaaatattaacattgaaaaatataacataaatattgtcaaagactattcaattttttataatattttcaagacaaagaaaattgacttactagtatcctgcgttgataattattctgcaagaagtattattagtcaagtctgtaatgagtttgatttagcatggttcgagtcaggtatttctgagaatgcaatttctggtcatattcaatttgtaatcccaggtatgactgcgtgttattgctgtgcgcctcctcttgttaattttgaaagtaattttagcgaagataaaattaactctgttatgatgaactctgcaaatgaaaataattcaaaaaaactatcatccaggacttgtgcagcatcactatctactacaacaagcgttattgctggaattttagttaacaatattttaaaatattttttaggatttggagaaaactcgaattttctcggttaccacatgattgatgattattttcctagatactcaataattcctaataaagaatgtattgacaaatggtgccggttgcgtcaaaaagagaaagagtacaataaaaatgagaaagcaaaaaataagtctccctataaagaagagccatcaagatccgacgtttcaaatggcgaattacttgagaattactctaattttgaagtaatcgaatctgatattcatatggaatcatctaaaaatttattggaaagtttaaataacttatcaatttccgagcttattaataaactggatgaagtttcgtcaaagtaa

SEQ ID NO: 1527 - DNA, 687 bp, Cryptosporidium hominis
atgcgatcaattggaaattccaaacttgaatcgttttcagttacttattccggaaatcttcataagttaagtgcgcattcaagtttgttttcgaactcacaatttgagtcatgcaatactatgtgcgatgattttgatccaacatgcgactgtaacactgcttctacaacagaaacagaaataactattgatcaagttgatagttggattgaaatcattaaaaaaaatgctgaggctgctgcaaaccctattttaaagaacgattctacatcaagcactacagaaacaacagattctagcaatcaatatgtatggattggtattggtgttggagccattgttcttattggattaattatattcttcattacaaagtcaagatctaataacagtcagggtcaagatcccaatgcaaactataatatgcagggaggagccccaggaatgatgccaggtggaatgcctggtatgcccggtatgcctggaatgccaggtggaatgcccggtatgcccggtggaatgcccggtatgcccggtatgcccggtatgcccggcatgcctggaatgcctggaatgcctggaatgcctggcggtatgccaggtggtatgcctggaatgccaggtggaatgccaggtggtatgccaggtggtatgcctggaatgcctggtggaatgccaatgcgatag

SEQ ID NO: 1528 - DNA, 1080 bp, Cryptosporidium hominis
atgccgaaagaagatttggaaaaagcctctcaaaataaggagtttgtagaaggagaacatatatctgattttgaagagagatataatgaaatttctaaagcgtttccagaaataaatgatgataatgtagcaaagttctcagaatatgaaaataaaactatagacgctgaaaatatcggcgatattcaaagtaagaactcagaaaacataaaaattccccataaatttgattacagaagcagactaattgaaattgaagagtggagatttttatgctacgattttgagaaatttgatttagaaaaagatcattcaaaaatattgagtaaactgagaaagggaattccagctcaatttagaggattcttttggatgaagttggcagaagtagaaaacataaaaagcgagcatagcgaaaatctatattatcaactatctgaaataaaaaatgccccatgttgtggtgatatatatagagatataagtagaacttttccaagacattctttatttcgtgataaaaataatcatggacaaaattctttgttttcagttttaagggcctatagtctatataatccggatgttggttactgccaaggaatgggatttattgttggtgttctgttaatgtacatgtcagaagaggattcattctatatgctaatttctattcttggaaagtataaattttctggcttgtatcttccagggttgccattattgaatactcatttagagaagttaagaaaaatatttaagaaacggattccaaatctttataatcactttagaaacgaaaatgtggatgaaactatgtatgcttcccaatggtttatgactatatttgcctacagttttaatttggatgcagttgcgagaatttgggacctgtttttccttgaaggtgtagacttaatcttcaaaatttccattgcaattttgaaaatcttgaagaactctcttttcaatcagtcatttgaaaatattttgcatactttgaagacagctccttatacaataaatattaatgatattattcaatgcgcactaagtttcaagttaaactacaaggagtaa

SEQ ID NO: 1529 - DNA, 1482 bp, Cryptosporidium hominis
atgaagggtagctctgaaaatgagaatgagcttcttatgaggttatcaaaaactttaactagtatcagtcctgcgagccgcaaaaaaggtctagacattataactagatatatatcaaagcacaacaattcaatgacgcgtttacaaatgttgaaaatttggaaggggctctactatagtatgtggctttcagataaagttttaattcaaagagaaattgcagtgaatatttcacaattacagaaaagatttgaggtaaaagaatatctattctcttttattgaagagttttatctgatgatgagatttagatgggatggcatggatcattataggatggataaatttacatttttacaaagaacaatgcttgctgaatcactaaatttactcagtaaaaaaaactttgatcctgaatttgcaaagggcctgtttgatgtctaccgtagatgtttatttgttgaaaatatagataatgagaattctataggtaaaaaaaggaagtttttaatgattagtgaccaaataggaagcggcaatgaagttgatccatcaattaactcatattcgaacaggtctacaggtattggagtatctttaattttttgtaagcaattcccacaagaatctgtttatttattatatgagcaatacaaacttattaaagaaaatccatcaaacaaaaatttgttgaatgaatacatttcttcattttttattgaatactctgagtttattattaatgtcatcagaacttgtacaactcactcaactttaacagaaaatatttatagtcaattgattctaaaatttgttgattttgattcacttcttgatcaagtggtatgcgacattgatgatttaaatattaatcaagaagaaaggaatttaatctccggtttcttattggaaaatatcgtcaatctcatgtcaaaattgtattcaagtctttcgaatctctccaaatctaatgaaaattcaattactcaaaataaaagaaataatatatattcgactttggaaaagataagtaactttttaaaaaataatttggcatcttcaaacagcttaccaaagatttcaagaaacaagaagagaacttcacttaacaagcagggaaatgctaattacgaaagtaaaaatgaagataaagagaaaagagtaagatttgatatgtcaaagaatgtacgtatgctcctccctgattcaatatctacatcaagagcacttgtaaaaatttttgataagaaaagtgatatgaagggtagcaataaaataaactgcattttatttaggtcttcaccaaattctgatatccaaaatgattctgaactctgctcgtcagattcctgtaaaaattacaacttgaactctcttaaaaatatagagataatctctgctgaaaaggcactatcaaagccttctgaatccaatagttctccttcgaaaagtattttaaaaagaaggggaattaatatttaa

SEQ ID NO: 1530 - DNA, 1434 bp, Cryptosporidium hominis
atgagcgaagatgatcagctacaggcatttgttgaccctttgattttattgaaggatacgattacaagagggaaaacagatgaaatgattaaattaggagatgagtttcatttcgagttttacaattgtgcattgaatgttaatactcccaccagatgtagaaatagaagaggagagtcattaaatttagatgatttatatttattcattacagcttctaaaagcaagaagtacacaatgaaacttgctcaagataatggactaaaattcataaatattttagaaaagaaaaatattttggaattcctgaatgagtttattgaaaaaacacaagattcaagaattccatctacatattccattgaagatttaagtaaatatgaatgtataaatacggaattttccttacaaccatgcagaatattagataaaagtaagaaaattataaatttaaattatccgtgggttgaatataaggtaaaaacagatattgaatcaattaacggaaaaagcagtgaaaatataatacattcaaaagttgcaaattcgatccaattaaaaaatagggatgaaattatgtttattaaaagaaaagttaatttaatttcacagatatatccaataaatattgactacatttgtcaaggaattgatatgtatactagaattaatagcttgctaacatttatgaatgaacctgcaaaaagcgagaacaaaaaaagatcagctgaatctagttcatatattcataataatccggaaaatacaaaattgaaagatggtagaagatctaacactgcagattttggaaaaagaggttcagaatctttgataaatacttcaaatatatcaaaatcaaggaacgtaccaaagtcaataaattctcaacaaagatcaacattattagcatacctaaattcaaataatctcaatccaataatactagttccaccatcatccaagagcccaattacattaaacaatataattcagttcttacgagataaagaatttgtagacccgaacctagcaaagagaaattttgttggtaacgaacaaactgttacattaagttttggctcaggaaccactgtacaaaaggttacatttcgaatcctcgaatccactcttaactttaggaaaagggattggtattcactaattgcagtgttccttactggagcagaatggcagttgcagtctttcccatttaaaacgattcaagatatatttacaatggtaaagggatatcatataacatatgattcagagcaaattcctgataacatccgaaaatggaatgttgatgtcgtaagaattaataggacaaatcgccataacgacctttcagtttggtttcaattcatggagtctattgaatccgttttagcgtctagtagagatcattctaaattagatagaagtaaattatga

SEQ ID NO: 1531 - DNA, 1995 bp, Cryptosporidium hominis
atgaatattgaagatgacataatcatgagcggtgtaaatccaaatgataatcaaaaagaaaattatatattcaattttaagaatatacattactttcatagtaataaacagggtgaatttataattattacgaggtcaggacaagatttagtaaaatttgttttcgagtttgaaaatatggacctacatattctttcattcttatcgtataatataacattgtctcttcgttctctctgcagtataaaagatcaaattccaatagaattgtatgaacacgatgatacaataactaaaaagaaaagagattctattttgagctttaacgctgaagaatggaagccaataagcctaaatgctatttgcgagcttttgtcgagtaaagacttcaaagacacaattttttctattaaaaatttatcaggaaaaggcgaagtactgtttgccagtataatcggggataacattctttttttgcctaaattaagtgaaagagttgttgaattttatgggtttaatcaggatgaaataagaaaaagatatagaattcatttcaaaagaatacagaatgaaggcgaagataatagcaaatccttctatagctcagaggaagaaattgatggatttattgctaaacttttagagcacatagatcaagtaaatccagaagaaaaaaggccaagaaaaagtgtttctgaaatcattaaaaacgaagtttcagactatggagtgagttataaaatggacctggatgataactataatcccagcaaagatcagattatgtgggaatgcagcgataatgaaagtgaccgcacttgttcagctgatgaagtagaaaataaatgttattcaactcctaggagagtaacaaaaaataacgaattgtatttgaatcacaaatatatgttaataggacatgaaaatacttttgttggtagggcaaataggcgtaatggaaagtcagaaattgccgtatttaaaaacacagaatcggaaggaagcaattataatattagtggaactcctgcaagaaatatttctgtaattaaaaatattgaattcgaaaatcaaagtgtacttcctgtaggaggccaactacacaactgtgaaacccaaatgttgtttctgtcggaaacggatcctaattatgtttatcaaatggatttgacaaatgaaaaaattttacggcgttgggatgcaaatggacttccgatttcttgtttaggactgtcaagcaaagattctcaatccactccagttccaacgtttttgggattaagtaacagcgcaatgtttataatggatagtaggatcaaggagtcttccaacagatttacttcaaagatatataggtctaatgttctttttagtagcatggcaactgataaagatgggcatatattgattgggaacgacttaggtgagctaagattatatgatggcacaatgaacaaagatggagaatttaaaaaggcaaagacactacttaattcatttgggtctccaattatatccgtagatgtgactagaaatggtaattggattctcgcaactacgaaaaattgtattcacttatatccagtaactgaacaagaagaaaactctggatctgaaggcagaaatggatttgtttcaagcctaaggaataaacctccatctaggaaactgcgtttaaagcccgaagatttgtttcattacaaaattacagaagttaacttcacgcctgccagatttgaccaatgccaagggccagaaggattttgggcagaaactaaaatcgttacaagcatagataattttgttatagtttgggactttgaagctgtaaaaagaggtaatctgtattcttattcaattaaagaggttgaaagtagagttgaggattgttctaccttttataataatagcgattcagttgtactggcgtacaaagatgatcttaaaatccacaaacttaatagaaaaaacaagagaaatatttattcaaggtaa

SEQ ID NO: 1532 - DNA, 282 bp, Cryptosporidium hominis
atgttaaaaataatagaaaataaatcacatgctcttacacacaagataatacactctggcttgttgtttgtttcaataagtattgatcacggagaagaaagtaaattctcaaagttgaaatgtgctcctaaactttactttattatcccaagaataggttatttattatccttgattgacactattcaggactattacgcttctattgataaggaattttataatttaattgaaaatactttctcttggtttgagtacgatggcttggtcataaataggtaa

SEQ ID NO: 1533 - DNA, 237 bp, Cryptosporidium hominis
atgataactggattttcagcagcaattttccaggtaaaacagttattctttctttcagtagtcttgatattttcaagtataacaacctcaaacaatagcgatttccagagaacgattacactcattgggttcctaactatggggtttatgtccatctacttcatgcctaataatgtattgcttgatcagagaggcgcatctgaaaacaattctacaaacactaatattggaagctaa

SEQ ID NO: 1534 - DNA, 2820 bp, Cryptosporidium hominis
atgattcagaatttaactttgcttgcagaagatcagcgacaatatgcccatattattgcaagtgttattttagaagaaattccgaggtcagatattccaaggaagtatgttcttttatgtttggtagactctattgttcgcaaatgccgatcgggttctatattttttccatattttttgccttatatcgcaccatactttgccgaagcttacacaacaaaaacatcacctcaaatactacgttccttagaaaagcttttgaaagtatggagtggttcgtttcctcaagatattgttcaaaaacttatttccactactaatagtgtaagatcaaaattgaatgagccaccaatagaaatagaagttaataatataaactccgtatcttctaaattaacaagccccaatttaaacactggaagtaatatatctcccagctctagcgtgtgtataagcgggactactacaaacacagctgaaactttacatgcaggaacggaagctgctagacttagcgaaatatatacaagtatctcaagaacaattataaaaaagtgtaacatttctgatggaggtaatattctattgaataagttagtttcagatcctattgtacataagatagcatacttaaacatttctgggaagattcaagagtcccaaaagttaatggacactttggtgatgaatatagagtcaaataattttgaacataaacatgttaaccctataaatgatcaaattccagttagtaaaagacaaaaacaagaggttataattaacaaagtaaataggagctcggaggttaattcaatgaatcaaactcactttaatcattcaaattcccaatctgtaaaacagatcggaatatcttcttctctacaacagcatgtgcctcctcctcaaatttcttctaatcaatctattaaactaccagcaacttcaaatcctgttgtatctccatcagtttcagcagcagcagcagcagcagcagccgctgccgctgcagtagtacaatccaaggcacagattcaacatcaaaaacaccaacctggtattttatccgcacaaccaattatttcccagcctcaatcaaaaatgaatattcctcactccagcaccgccccacaacagttgtctccaacggtatcatcttcaatatcttctgcatcgacattaagcacatcagggattgctggtaatattaaaaaaacattttcaccaagatttttagaaaatagtacatcatccattttgttttccgtttggaatcaactatttcgtggtaattcaagaatagaatctgataatctaaggagaatagattcatacgttgtagacggtagaggggatcaaagtatttttttggaaggccttcaagttaaagaaataagtaatttgctacttttatttaaaaaactccaagagaatgttgacgcttcaattcagttcaaaagatctgtttggttaaaatcacatttcattaggaaaagaataattgataatataaatgatttcaatttgcaggcaaatgtttcgatgtattatgctgagagaccaaatcaatgccatacttgtggctatagatttattgacagcaaaaagaaagaatcgcatattcaaattcatctaacgaaaaatcttatatttaggcaaagaaagcagagttcaaactttcaaattttatggccttctcttcaggattggatttacagttccgataaaaatatattaggtgagacctcgcctgaaatttctggtgaaagtaaggattttatgagcgataatgacaaattaggaaattcaatttgtgagaaatcgaatgatttcactaatgaagtttctcaaattagtgacaagaatatcagctttgatgatctatttaactcattgttcaaaagaaagtcaggaaagcatatggcttctgaaacaaatagagaacatcaagggattaatgataattcaattgaagccaatttaattgattctaattctaatccaactgttaaaatttcatcttctatcggtgtatgcaaaaatatcttgttggctcaatacataaattatttaaaaaatttttctaactttgattttgaatctttattaaataaacttgtaacaatcactaatgatacaaacaacgatatttatggaaaaataattaaagatgtagatgacatttgcaatagtttgtcttcactttggaatgaaatgacacaaagtgtaattactacctatactccagttgatcatttacatatggtttgcgatatttgtcatgaatcactaaatattaaatggtgctcaattaataaatcttggatttcaactgacgcaatagctctcacacaaagttccactaaatatacatttgaagatgaaaataggaaaagctcatctcataatctaatcttggctgtggttgatacatctcaagacgcaagtattactaaattaaacagcattaaggaaaaaattaacgacaaaatgttaagctttattcagtggaagttccctacaagagtattaaataactcgaaccaaataattaaatttaggccctttaaggaaaattgttcatcaattggatcaggaaatagttccgtccagaatttagttggagataagtttgttaccgcacataagtcgtgctttatacactatttcatttataacgatattaataatagaatctcaaactttcttaaagggaaaacaaagaaatataagtattcaattccaaatctaagtgatattaacataaacagtattaatatcaaaacagttcagaagaacaataaaaagtttttatttatgtag

SEQ ID NO: 1535 - DNA, 306 bp, Cryptosporidium hominis
atgcagcagaagattgcaaaaactttagaaaacatgtccaaagaatactctctttcaataatcgtcactaatcacatgacaaacaaatattttgatgatcaaaaaaaaaaagatcaattcgcaaatgttgttacaggaaaaaaaaatttagagccttctctgggattatcttggaattcactgatttgtgaaaggctaattttgaaacgtgaaaaggatcttaaggctgatagtgaagctttaaataccatttccgtaaccaacagttttggagaagttgcattttttaaggtaatttattcctaa

SEQ ID NO: 1536 - DNA, 1314 bp, Cryptosporidium hominis
atgacaatattatttaaaaaacttaaagaaaatgaaacatttaaacatttctttcgtcaaatctcaaaatacttggaagttaactcagatgaaagcaaagaaaataaaagtaatatctctaaatgtaatttaaagacaaattatcaattgataaaaagagaaaatggcaaagaaaataattatattagtgtcaataacactgagttctcatctggaatttttgaatttagtaataacttcgaaaaaaatgaatataatgaatcaaaaccagttaaaaaattcaaatttaacatcgggcagattttcacaaataggattatttctaaacaaaatgatcataatatgaaaaggatttatgcatattatagagaatgttacaaaaaacaaattgagccaggtaaaaccttaatagattttagaagagagataatcggagaaatgtcagaaattatttggaaatatcaccttaatgaagaaatacttttccttacagtgcatttcatggataatgttcttattaaagatcaaatagaggaagaaaactcattggaaagagtaagatatttgggtttcacatgtctatatatcactattaaaattgaaagagtggtgaattttaattttaaagaaatgattaaaaagctttctttaaattctattaaattaattaatatggagaaatatgtattaaatcaacttacatttaagttgaaccctatttcatcactctttcttctacaatttcaaatgggaattataatggaaagctatttaaaggatattattggagtagaaaatattgactattcaaggaaaaactcagaaaataaatattttaattatagttattcagataaatataatagccaggttattcaaagttataattcaaatagagttggaaacgaagatcaattggagaacagctcatcactattaatcaatgtattgaatatgaaaagtagtaaagggataaataaagtattggaatatttcatcagctgttatttattggagatatgcctctatgatattgaaatattaaaatattctcctttatctcaagcagtttctgcattattcattgcaaaagaatgtttaggagcgagaaaggatagcattgaggaagaatgtattaacgaatatttgaatatggaagtattgatcgaagattatgtgtacagaaatattaatgcgattaaaagaacattaaaatatccttacattaaaaaaatttctacaacaaagaaatacttaacgaatgaatatatgaacgcagctaattatgttttgaggcttatatacccaaaataa

SEQ ID NO: 1537 - DNA, 1026 bp, Cryptosporidium hominis
atgaatgatagtgataatgcttttaataaatctaagacaccatgctgtattttagaagaagatctcgaaaatgaaattattagaaaaaatggatttcaaaagccattcgttgcattacaaattctgatttgggcattatttggctcaaacattttggcgtattatacgtttgttattccctctctaccactattgctagctactattattggaataatttctgcaatactttgcgtaattgtctttacattaggatggaaagtaacagctattaatcccggttattctgaagaagactctttatttaactcatcgaaccttaactgcagtgagtgtaagatttgtcatttattttttgaggaaaatagtaaacattgcaaactttgtaataaatgtatcccacgctatgaccatcactgcaagtggcttaatacttgtattggagaaaaaaattatcggcatttctttttgcttttgttttttgtgacaatgctccttattatgattattatagcaacaatatcttcgataataatggaaactatgaataataacacatatatctattggaattcaagactttatttttggtctccaataacgttttataccataggagtattaatactggctattgatattcccttgttaattttaaatggacacctctttgtattacactgttatttggttttcagaggggttacaacttacgaatatcttacaaagattgttatagaagatgaaactagtaaaaataggccgggaatttgttgttgctgtaatacagatgacttttgcagacaaattgtttcgtctgtagactggatagttgcagatcggaaaaaaatagctgcaaaaaaaaataaaataaaagaagaaaaagaaaatacgagcaaaggagactccaattatgataatgccaatattaacaatttagtaggtttagagttatcaaatattaaacaattagactacgaagagcaatcaatttctcctgcaagaggatcatttcggacaaaataa

SEQ ID NO: 1538 - DNA, 1749 bp, Cryptosporidium hominis
atgtcgtcatattatgaaagtaatacaggtacaaagttgaggccagtagttgattttggggatgatagatgggtaactttatctactgcagaatacaaaaaaactttaataaaaaaagaacaagatgctgactcggattatgatgaagaggatggatatgaatatcatgaagaagacttggaagatgaagttgaagaagaggaagaagaggaagaagagaaagaagcagatgaagatgagtcgtttgatcgagtatttgataacaatgaggatgagagttattataggatgaaaaacaaaaatgatgacgtctctatttacccagaaatgattagatatcacttcaaagaggcatttagtgttaacgaaggagttgaagccagggaattcgggtttaacgatgatgatgcagaattagaagagttggctattgacgaagaaggagggattgcaaccgatgaacataatattgacgaggcagacgttgttcctgatgaactaattcaaccatgggatctggagagcattcatgagagtgttgaggtgagatacactgaaagcaaaggaagatgcttatatgcacgaaagtgttttaatcccggtgatattatttttgcagaaagcccgttgcttgtagtcactccagaacttgctccagaactatcagagttcttagaagatatgaattcaaaagagacttttactcttcctcctttatggcacgtagcagctttgtgtacattaacaatgcttgaagaagaagataaagccatttgtttagataaatgggtcccagatccttctgccgaaccaagttatgatgttcaaaaaattatagaaaatactgggatagatgttgatccacatttatatgaaagaaccttgaatgcttggaggtttaattcattcaatcatacttcaaataatggaatagttttatataatgtaatcagtatgatggctcataactgcggagcaagctgttgctggcactatggcgtagataatacatttgttttaagagcaaagacgcgtttagaaattggagacgaaataacaatatcttacatttctgatgatgatttatttaaatgttctaaaactagaagagaattacttagtaattggttattttattgccaatgcgagagatgtaacaatcccacagatctttctagaggattgaagtgcgcctcttgcggagttggaagcatgtttttcaaggaagatgaaaatggagtaacaagatcaagtagatgttccgtctgcagatctcatcctgatagggaaattattgatagctatactgatcttgaatcacagtatgttgcaagactggaagaaacagataagaatgatgttgaggatgttgaagcagtatatcaagaggctcaaaaagtgtttactcagcactggattatgtacgaattagatactatgctttttgaagcatacaaagagtcgcagcagttttcatttgcactttcttgtctatataatagactgaatttcgtaagaaatgtcctcccagattgtacctatacattggcatggataactgaggaattaggggacattcttagcatattgcaagatgaacgtcataaaggtaaatccaaaaccaatcaagaagtttctgcaatacaaagatattactacgacacatggtgctatctcagtatattaacaggccctaatcatcattttacagttgctgcaaaaaacaagtatgaagcaatcaccaactga

SEQ ID NO: 1539 - DNA, 264 bp, Cryptosporidium hominis
atggcaagaaaaaacgataagaataagaaaaaaagatacattgagtggttgaaagaagtggagaaggacagtagaaaaagagcagaagtgaatgccatgaaaagacgaaatatgaaaagcaaaactgagaatataattaatggccaaaaagatgtatgcatggatatagttaaggtaaagaagaaaaatgttaaattagacaggaaaggccaaagaagactaaataaattatctggtaagtttccttttattaatctctcttga

SEQ ID NO: 1540 - DNA, 1335 bp, Cryptosporidium hominis
atgaaatctggcaagccttcatattctgaaaaaaattgtttgccaaatatttgtatggtatctgactttttttatcctggtttaggcggagttgaaatgcacatttatgaattatctcaatgtttgatggtccgtggatataaggttattgttgttactcacagcaggaatgatagatatggcattagatatatgggtattggcctgaaagtttattatttgccctacaaaagtatctatgataatgttgtttatccttctttatttaccctattccctttattcaggcagatccttatcagagaaaaaatagatattgttcatggtcatcaatcagtttcaatgctagcactagaatgtttatttcatgctactacaatgggatacagagtggtatttactgatcattcattatttggactttcaaattatgattcaattcacgcgaataatttttttaggataaatttatcctgtattgacaatgtgatttgtgtttcacacacaaacaagaaaaatttgatatatagatcattaatttctccaaaaaatgtcactgtaataccaaatgcaatagatagcaatgattttttacccaatccaaattacaaatctccaataaataatgaagtcattgttatttcaatttgcagaatgacttataggaagggtgttgatctacttgtcgagataattccaagaatatgcaacagtgacccgaatgtaagattcatactaggaggagacgggccaaaaaaacatttattacatgaaatgtgtaaaaagtacaatctttcaaatagagttgaacttcttggttctgttcctcacacacaagtttgccgagttttgcaaagagggcatatttttttaaatacatctttgacggaagcgtttggaatcagtattattgaggcagcatcatgcggtctgcttgttgtttcttcaaatgtaggaggtattcccgaaattcttcctcaagaattccttaggctttcaaacccttctatttcaaatatggtgaacgagcttaacattgcagtaaatattattagagaaggaaaatttgatccatattcatcgcataagaaaatctcagcaatgtattcatggcatgacattgcaaagaggacggtttctgtatatcagaagtcaaatcaagttgatattatcggtactaaggaaagaatactgcgtatatataatacagggaatttaataggaaaaatatttgctctaatagcagcgctagattattttatctggttctttctagagtttttctacccaaaagaatcaatcgagcattgcatcgattttcctggaatctcttag

SEQ ID NO: 1541 - DNA, 282 bp, Cryptosporidium hominis
atgtcatcaaaatgtgaggaaatcgagaaagaattatcaagtgtccataataggtatgcattattattagaaaagaagaagaatctattaaaatcgatgagagattcagaggatgtgttgcatgcaaaaaaaaaaatgtatcagagtatttctatgataacttggtcattgatttccgaatcttttatacaaggccactttattccagtaaattgcccaacaaaaaccgaaacatttcaactacaaattcatgaaaacagtaagtttccaaattataaataa

SEQ ID NO: 1542 - DNA, 240 bp, Cryptosporidium hominis
atgtttgaaacaattcaagatagaaatagggttgggagaggagttagaaaaatgtctatttcgcctcaatttaatgaaaatattaaagagataatactgttaacacaggaaatagctggtatttatgaacatttagggggcgaaacagatgttctatctcagatccaaaatgaaattgttgaactggaaaattatattaaatctacttatgacaagctgcagatgctaattgatggttag

SEQ ID NO: 1543 - DNA, 1908 bp, Cryptosporidium hominis
atgtttaaatcgttgggaaagaccatattacttgcctttttttacattgtatttgtgaaatgcgacttaccaatacatgttacaaccgcagatattataggaagatgggaatttcaatattctgaacctgctaataattggattgatggttgtggttcaggggttccaaacaaaaacactcaaaatttacaaccaagcttggctgattataacaaatggctcactacaaaaacaaacggcaaattagagaaactggatctgatattaactgatcttttattttcagaaaacgattatagtgatttagatagatcaatgtttccaggaaggaacgattggacatttttggcagttaaagaccccgaaaatggaaaagttgtcgggagatggactatggtttatgatgaaggatttgaaatagtcataaacaatatgacaatttttggaataatgaaatataacttattaaataatggaaattgtagtgcaaaggacggagataatgagacgacaaagggtgaaactttgtgttatgaaactgactcgtcccaaattcaaattggttggtattatctcagagattctaaaaaaagaggttgtgtcagtggtagaaaagatgaaagttacgagaattcacttgatattgttaaaaatagggtagagatcccaatcaagaaatctttcgagtctagtataagaagtttatctaattcattgcaggaatttgcgcataggcataatcgtaaagattcaaaaaactggagggcaagaagcaattttagtttaacagatgttgctttctcgcatcattcatattatatgaatgctgtaaattttagaaaaatacatccgtttagaattatgggttcgcagcactcgtctttcatcgagatgtttaaggacggagtggggaatgttgataattacgacaacattgtagattcaatttttgcatgtaacgtagtcaggaggaaaactgatgaagtaaaattgccctcctcattttccattggtgatccatttacagacgagaaatataatgattttccatttaaccaaggtaattgtggttcatgttatgctgtatcttctgtttatattttagcaaaaagagcagagttgaaattaaacaaattgacaaatggagcttcgagagaagaaaaaattttgctttcaccacaatcagttctttcatgttctccttttaatcaaggatgcgagggtggctatccatttttggtcggcagacaagctgaagaaataggaatatcgtcggaaaagtgtatgggatactatgcggattcaaatcaggaatgcaacttttcgccatttataacacctgaaattgaagaccgaatttattgtgaagaagatgaaagaatgtatgcagaagaatatggctatgtaggcggttgctatggttgctgcgatgaagataggatgaaagaagaaatatttaagaatggtccaatagcagttgcaatgcatatagatacatccttattggtatacgaaaatggggtatatgactcaatacctaatgatcataccaaatattgcgacttaccaaataagcaattaaatggatgggaatacaccaatcatgctattgctattgtaggctggggcgaagaaaatggtattccatattggattattcgaaactcgtggggagctaattggggaaataagggttacgcgaaaattagaagaggaaaaaatatcggcggaattgaaaatcaagcagtatttattgatcccgacttttccaggggaatgggcttctctcttctgaataaataccaaaatagtacagcttacagaacgaatttaccagatatcaaggacagccctcaaggatcagagaatgttaatgtcgaaattgtaaatggcggagttgatcaataa

SEQ ID NO: 1544 - DNA, 1482 bp, Cryptosporidium hominis
atgtcgcctgatagcattaaaactgaaaatacagagaatgttggcgatcaagagcaagtcaataatcttattatatctgactgggggatggaaccaaaaagatacaactatcaagtgaatgtgactgatcctgaaaataaatccataggattaggaaagtatacggtatatttagtttctggggttactccagatggtcacaatttttctactagaaagaggtatagtgattttgaatggttaagatctactttagtaattcagtttccaggtgtatttattcctccaataccaaaaaagaaaaaagttggtagatttgaaaaagattttattgaatttagaagacgttatttggaggagtttttaagaagaatatttaataggggataccttatttcctctaatttggttagaacatggctaaatagaagtgatagtggtatggaaactttgaaaaaagaggaagcaaaccgtcctcttttcgatattgttactcaatactttagcagttttgacaacgttttatctacagataatcctaatagcagaccgggaaaaccttctaaccgtttttcagttccaacagtagatattagccctatctctgaattttcaaatcgtttagagaatcactttattcaacttgaacaactaagcgagcatttgaatacaattacatcctcatataaccgtgcacatatctctttcaaggaaaccccatcactgtttcacaatatttcgctgaataacacaaataatgaatcaagacttgatctatcttctattttccaaaatttgtataatattaattctaattcttctcaaaaacattttgacatgctttatagtataattgcaagagagatgaatgacactgagtgtatgctcgaagcagttcaaactttagagaaaatgcaatgcttattaaatacgaataactcacctatgcaatactctgatgaaattaatgcaggagacttgagatctaatgcatttgcaaattcaaatattaacaatagctcaataacgagtgtagttagttcagctgccaagggacttgtaagcggtttttctttattttcttcgaagactcgtgaaggatcatttacttcagacacaaatctttctaaactagatagatatagggaagaccagtccgcactaaaaacgcttctttcagccggaagggtggtattgattgtacacgaaatgcctcacttcttttcagaaaaaataaatatatttaatgagactatccaagaatttattataagacagtctcagtcttcaaatattgagaatgagttttggagtagggttctaaataagcttaaatctcttaatcaatataacgataatttacagggtcaaaacacctatcatgatgaattttatactgatgatagtagaaactatgtgaataaccaatataataaaggaaataatactaatgagtggggttatgaaggctatgactattga

SEQ ID NO: 1545 - DNA, 1029 bp, Cryptosporidium hominis
atgattggatctattgatttttggaacaaggaggccaaagccccattattaaagcgaaatgctggtatgttttccagtaaattaaaagaaatggttccacatataaatagagctgaaagttggctagatattgctcttaatccaaataatgacattaagcagctcaatgaaagtggaaacgagattagctgcaatagtgatagcctgattcagttagatcaaaatatagaaattaatcttgttgaccatacggataatccagaaattgatcgaatttttaaattagatgcagaaagaaccttctcagacgaggaaaatagaattaagatgataactgttttgagcacaatatatcaagagatcaaggattatcaccaaggtttagggtttgtggttgcattctttttattgcaattaacaccggaagatactgttcgtttagcattgtctttaaatagatattatttacctggatattttaagacagctccatttaattatgttagagatgctaaggtttttgaaaaactattaatgaaaagataccctgatgcagcgaagaaaattgaggagtcggcatgcgcagaggcattttgttcaaagtggtttgttggattgaatgtgcatgtactaccttttccttcactatgcaaattcttcgaaatattgtttgaaaagggcaatttatttctatttcaatttggtctttctattgttgatgtgtgcagagaagatattttaaatgcgaaagacgcctcacaagtccttgccattttacgattagatgagaaagtttaccatgacttattggagcacaaagatttcttaggtaaagaagaggagagggcagggagttttttcttacatttggtagataatgctcttgatataaaaattacccaggatgaagttaataacttgagggaaatcgtacttgaagagatgatgcaacaggaggaaaagagaaagcaaatcgaatcacaaatgaattttgatgaagatgaaattgttttttctgatgaagactaa

SEQ ID NO: 1546 - DNA, 1167 bp, Cryptosporidium hominis
atggataacaataaaacggaaaaaaaagaaggagttaaattgggagagctaaataaggtaggtgattcacctattggcgataatattaaagtgatacagcaatcaatatctactattgcaaattctaatgttaacacagcagacgttagtgcaagcaaactcacaccagcgcaaataagaacattccaagaaaattcaaaagctccccttccaaacaactctccagttgaagaaagatggcctcatctagatgtagttacagatattggaaccacaattactgatttgaaaagcggcttacttgattattatggaactctgttcatcccttcagagcaagacttatcatcaaaaattgactctctaagaactcaagacacaatccatgggaattatgaatcaaataggagatttataaataatagtgagataaaagttactaaagataataatggattcgacgtttttcataaaagaaaaaatgctccgcttcttgatgatatcccagatccttggtctcctgttccgaattctatatttttatatagagatgcaaatggtaaccctatttcagaaaaacttaagatggaaaattcagagatggtcgactttcacgggcttacagagatacctggtaaaggtagtattagagcagcaactagtaagtctaataaatctaataagggcgttggctcaaaaagtgaaaaatcaaataaagttgcttttgatcaaattagtatagaggagaatggacctgagaatcttcttgggtttgatttgaaggatttagcggcgagaggtgctttaagcacaagagctagggtgccatacaatgatattggagaaatgatggagtgtatttctagaaactgtaaagatgttcagaacaagcttttattttttgaagatactttatcatcatatcaaagtaacccaaatatggctcagttcattcctcctgttaatgagtcgagacgttttttaaagaattttcattcaaaagatccaattgccacgtatatttacacattatatagagacttatataataaatcagaaattaattcaagacgtatagaagttattaaagcaaaattaaaggttttacagtcgcgttctaaacctaaaatggttcgaattgctgctcactcatcacttggtatatga

SEQ ID NO: 1547 - DNA, 2184 bp, Cryptosporidium hominis
atggccagaagaagcaaaaggttacaatcaatactacctgaaaacaatgaattacttcaaactaaattggatgctggctatggaattaaatcaaatgtctttataaatgatttatctaatcaagaagatttaaagaaaaatcaaggcgtacaaactcgctcaatggctagatcaaatattaataagaagaattttgaaattcaagttactaatatagcagatgatgacacttctaagcttgctgagctagaagatacctctcccaaaaaaaaatccaagactagacttaaaaattccaagagttcaaaattttcaactaaaacaattcaagaaattaaagataatcatagtaatatcatcaataatggtaataattcactttcagattctaaagaaaagcttgttttaatgaataactcgaaagatgtgttagcttctaagcatttcgacacagaaaaaacgagttttaatgatatatctcatctagatagtttattaccacctactgcccccgagtctcaaaataactctccaacaagagaaaatgacaatctagaacttatttctggtaaggcatcttgtttcactaatgtttgtgaatttgaacaaggaaataggcttgaagctcttttatctaaagaccaaaatacaaatttatcaatttataaacatctttttaaacaaagtaacaaagccaattttgatagattgaagaaaattaaattatcagaaaaatatgaatacttaatcgaaatctttcaaggcttggaaatagttttaagactacttgaaagaagacaaaagccattcttttatcctacttttattaaagaacaggtagaaaatataactaaaaaaacattttctcttgataacttgcttcgaattgtttggatatctcctcaattgatatctatcaaatggtgtaaagcaaataaaattaataattctaggttagaatcaccaaaaaataccttaaacgaattttacgaccagtgcgagctggaaataatcttgaatgatggaatcaataatccactaaaaagactttcccattcaaatataaatgaaagagtagatattttcagattcatacttattgaatttactatgattcaacaagaaatgtatttgagacaaatgatgacgaaaaatatggaaataaatactgatatattagagctgaaaggttggtcatcctttttcaatattgaaaactgtgttgaaatcccaaaagcaaaattacctcaaaaaaaaataggtaattgtaatttaattaatagttttcagaatagtggtaaaagaatcagcagctcaagcttgactccaaatataaggagcttatataatttaaagataataagtaacttagttaatttagaagaaaatattgaaaaggagaaaaataatagaagatcattatctgcagataatataaaaaaggatgagagtaatcaaacgttcacaaccccattaaggagcaaacaatcaatatgtgaagcaaatgtaattaatttaaataaagaaaaggataaattagttactgattctcgcatttcaaacaatacaaatatggtatctacgcctattaaaaacattaggtcatcatacatgctttctcgttcgatttcgcccacacttactccaaataatgtgaaaatacaattatctaacacacaattttctaagccagttacaatactttcgaaaaataaaaacttgttgactccttctcaaagaaatcttcttgaaagtgtaaaaagaagagaaaagataaaagagataagcaccatgataaatgtcgaggatgaagactttaataaaaaacttgatcaagtgaaaaatgaaatttggacaatacagcaattatcatttgtttttcttagaacaaaaaagttaattcctgcaactcagcttcctttgttagcaaagaggttgacaacatatgcaaggaattctccggaaattggagaggtacaagactctataattagactgtctaataaatggccagaatatattaagttgggcgattcaacggtggatagaggagtaaaactagttaaactccatatcaacgacgaaaacatatctgatataattataaagttgaataaagaaaaagattcaatatttaaacaaagagaagagtttagattggagacaatttctaaataccactag

SEQ ID NO: 1548 - DNA, 435 bp, Cryptosporidium hominis
atgaatattttcccaggcattgatattacagtaaagccaaaagctgatgcactgtttccttctgtaagtggcgcatctattttggcgaaggttaaaagagacgattttttgtcaaattggtggacgcaagcatccgttgagagctgtgattttaacggtaataaaattagtaactatgaacaaggtagtggatatccaggtgatccaaaaacaaaagagtttcttaggcgtgtttttgaccctgtatttgggtttccaaatattgtccgattctcttggtcaacagcaagtgaaattatagaaaaagatgggtattcagtaaattggggggaactcgaattaaataataatcaacagaaaataaattttaatagacctcaacaaaatggtaagttgttttcttcaaattttgcattaaatgaagacatgcattga

SEQ ID NO: 1549 - DNA, 246 bp, Cryptosporidium hominis
atggaacacatatttgaggagaatattcacagatttgagcataaggaagttatattgggtattgatgaagctggtagaggtcctgtattgggcccaatggtatatgcatgcctgttttatcctaaagagaatgaaaatttattaaaaatgatcagtgttgatggtaagttgctagataaatttgattcttgttcaaacaactttaattgctcattaagattccaaaagattatcatctcaaaatag

SEQ ID NO: 1550 - DNA, 1371 bp, Cryptosporidium hominis
atgcagtttccagagctgcttaaaagttatttattaaaaaaaaaaaagttggaagacttatccccaatttatgtcgaaatactgaattggttagattcagattcagaaaattatagcttaacagttaataaattaactcaactatgcaattacatgttatcaaatttcaattcaaatggacagattaactcccacttaaaccatctttgcgctgatattctctcaattatttatgatagaagctcaaaatatatttgttttccttccagttgctattgtaatatatgtaatccatttgaaaatatgaaaggctatgaacaagaatacgagttctggaaactgcttcgtgatctttcaatgaatatagctttaaagtgctctcctaaagaaggctatataatctttattgaagtaatcttaggtagtattagtttgccaatattctcagataaagaagaattgtcttcacagaaaactcgagaagaaagtcagaatatgtatgaaaaaatcaatccagtgctgttctcagaagaaaaaaaaattcttccaaggttttatagatatttgggactttattactctcttatatgtatctcaagaatgaaaagaaacaaagcgcaatttattactagtgtgtgttcattggtactacgaaaacttgtgtatgatatagaatgtaattcactttatgcatgcaattgctatcccaaaattaacggaatgcacagatattgtacaactctaaagatgctttttttgaaatatttagttgataatatcataaagcttctgtttgattgcttgacagaaagtaagagtgatgctgaatataaagatcaggaaattggaattttcaactcagaattatctgaaggaaatattaatgttactcaacatactatttattcatttttaatgaaagttctagaaaatatattagtaatcgatctacacaacgttgaaattttgaacaattctggaatttactccaaaaataagaactttaatcaaaacactggcttattttcaagcgttttgacaaataagtcaaaagagtcaattttgaatattatttcatctgaaatattggattcggaacttcaaaagaacttcagtaataataagaatgagtgggcgaaaataatttataaattatgctacaatattagctatttatcgccatattcaatgattgatactctaaacaatatccctatttgtgtacacgatgttgagactcaatcaggagatctagatgttacaaaaataactctttcatgctatgcatatgcactattcgtgatattggaaatcaaatacccaattgcagtaaattacctatacccaaaaaaaataatttcactgacagca

SEQ ID NO: 1551 - DNA, 1845 bp, Cryptosporidium hominis
atgggagttttatgcggaacgagcacatttatcgctggcggatcatatattagtggattaacttgtatgggatttttatttgcaaattttagattaaggttactatcaagaatttctagtttgcctttaagagaaaattttgctcttccgtttatttggatcaataatatgatattgatttcaataattaaatatacaaacagcagaaatcaaaaaaaaaaatggattttactttatttcacatcggttatacttctagaattctggcaattttctgcgtttgtaatttccactcaaatattatcagtttatgctctgtttttgtttggatgtgatcattcgaaacttatattgattataaagacaatgatttttttcaatatgattgccatgtttacttcatatctattacattttttcaattattatattttattgacacctctgcctcaaattggagtttcaattttactttcaatttcactttgcaaaatcttgtttaaacgggaaaaattttcattgttatactctttcacttctggcattatttcattagcgctatttttagttttcaagttaattctaaatccattttcagatcacgatacacacgtcttcgatatgctaaaaagtgcaatttttggtcaggagtttgctaacttcgacacgatgatttacaaaatgggaggttcagaattttcttttattactaaagaacagctggagatgataaaaaattcaggagtattatttatttttatacctggcacctttcttattttattctcaataattattgatacagcaaatattcgggcttcaaaatatttcccatattataaaaatatcgaatcatcgttttcatatcagtttgaggattgttctcaaattaatgatgagatatccgattcttcatcaaattcttcaattgtctctacgacagcatcttattctcctgaaacagctatttcgttgaagcaaagcagcgttcactgttctaagaataatttacaagatgaatacccgaaaattttgaaagagaagcaaagcagttacaaaaataaaaaaaatttagtacttgataagttgtataatataaattttgaaaatcaagatactgcgatatcttttttgacttttcaaaccatttttttctgtctattggcaattattatttcaagattgagggtattggccttaccatatattgcacttgtttctagtttatttgcatcaaggaaatacttaagttttatatttaattactataaacctattttattatggatatttagaattaaatataataaaaataaagcaattaatccaaataaaagatattttaataatagaattgctcattttatttttttcgcaacttctattatttttctttttttttcaatttcaaagtttccatttagtgaaattcagacaggacttatcccagaaaacaacgcatcctcttcaaagtctagattggttggttggattaattcaaatttaccaaattacacaccaatactttcagatatggttgtcagcgcaacattaagattaacaacgaagtcaaagatagttacccatcctcaatatgaacatataaaaattagaagaagaactcaattcatgtattcaatatcagcctgcatttcactaaaagaactatatgaaaccatgcaacaacaatataaaactgaatatctgttgcttagcatttatcgatgcgcagttgctagaggcgataaaaatataatcactatgattcatgcgactaattccttggacaatataaatcaccggcgcgataatcaagaaaaattttttcaaaggacatggctgtag

SEQ ID NO: 1552 - DNA, 1653 bp, Cryptosporidium hominis
atgaaccttttaatttttttgattacaaccttattcgcaattattaagggaaaaacgatcacattacccttgtatggaaatgtacacaaatatggttattactttattaaagttaatgtgggatttccaattagtcagcagcagactcttattatagatacgggaagctctcttactggctttgcatgttcagattgtatttactgtggaacacatgaaaataagccatttaatattaatttatcagaaactagtaatattattaaatgtaagagaaacaatactccaaataacgaaacagatataataaataaaagtattcatggaagaatcggtatgaattatgccaattataatgagagttttctgaacaacaaatgcgtttacgatattaaatattcagaaggtagccgtatacttggatacttttttgaggactttgttgaatttgaaaataaactgtcatccaacttggaaattagacagaaatttaagaataagttcgttttcggatgtaatatcattgaaaataacttttttaaatttcaaaaagcatcaggtataataggccttgccaacttcagtaataaaaaaatgaatcaaataatcaactatattttcaaaagtggtgaagtaagaaaaactgattctgataaaataatttcaattttttttgaaaaagatggaggaaagttaacttttgggtctacctgctttgatcaaactaaaatgatgaattatccatttgaaaattataatattacgaggtgtattaatgatgaaaggtactgtgcttatataagcaaagttgaagttgattcaaatacccgtgaattagataccaaattaaatgaaaatttgttcaaagcaatttttgatacaggaactacaatttcaatttttcctgctagattatttaaaaaaattaccagaggtctgtttaataatgtttcaaaatactatccaaaaatttctgggtatgatgaaaaagatggtcttacatgctggagaatgcttaacgggatttcaactgataaatttcctaatattaaagttgtgttcaaaaataatagaaataaattgacggaacagttagtaataaactggcccccagagtcttatttatacttaaataaaattttagaaggtaatattaaagtttattgtttaggaatagcaagtgataacttgataaattcagaaataggggcgaataagaatggagaaaactcctctagtaacgaaataatacttggtgctactttttttatttacaaagagatcacttttattttgaatgaagataaaatcatgataagatataactatctaaattctaaaaatagaaacggcatcttaccaaaaactacaaataatttccgacacaaattaaataactctaattccgatataggaggcacaaactattatgaaggaaaattgaagaatacccacataagggatgttcacaaaaatttattatccaaaatactggtaaaaagatatgtcgttttaaaaaacgaaaattatgagatttggggggggttaatttcttcatctctaataatagctattttattttcctttttaataatattccacaagttctttagaaaattaaatttttcagaaaaaaacaattatggaatttag

SEQ ID NO: 1553 - DNA, 3711 bp, Cryptosporidium hominis
atgtacattgaggaaataattcttgatggatttaagtcctatcaaaagagaacagtaatagggagatttaatccaaaatttaatgcaataacaggtttaaatggaagtgggaaatcaaatattttggattcaatttgctttgtgcttggaataactaatttgtcacagatacgcatcaacaaacttgaggaactggtttataaatctggtcaagcaggaattagcaaagcatccgtttctattatttttaataatgatgataagtccaattcctcgcctttatatagggacttggacaagattacggtaacaagacagatcgctactggaggaaggaatagatatttgttaaatggaaatgttgttaaaccaattgaaataacaaatttttttcattcggttcagctaaatgtgaacaactctcactttttaataatgcaagggagaattacaaaagttattaatatgaaacctaaagaattactatcaatggtagaggaagctgcaggtacaaggatgtatgaaacaaagaaacaacaaagcttaaaacttatcgaaaaaaaagatagcaaattagaagaaattaatagaatgctagaggaggatataataccaaaacttgaacgactcaagaaggaaagatctgattatctcaaatggaatagcatcaacgaagaaatcgagtttattgagagaatttgtactttgcacaattataataacttatcttcggaggtatcggaaattgagggcgaactaaataactctgaaattgcattaagtgggattgaaaaggttatatctgatggcaaagaaaaaataataaatttaaaaaaattagttgaggaagaggaaaataaattgactacagagtggtcagccccactaaaaacctgtaaagacagaatttcagatgtagaatcaaaagttagattaactcaagttcagcttaatgaattgaaaatagatctgaatgacgaagaaaacttacttaaaaattattttaaccaaaagaaaatgatcgaggataagcttaatcctcgtacaaattcaaatcaaggaaacttaataaagaaatctgaagaattttttaaactggaaaagcagattagtgatttgaaagaaaagatggaagcaaataaaaagtctcttcaaggaattagagcaggatgcgatattaattcgataaattcagagcaaaagtcactgagacagtcgttatttgatactgaaaaagaactggccaaagtctctgttcaagaaaaaaaagtcaaaatgaaaatcggggaaattgaaaagaaaattaggcctttaaatgaccaaattatgaagagctcatctaattcaagcaagcataagtcaatgactctagacgaagaatatcaatacatgaatggtcaaattaaaaaactagaaagtgaagtaattaatttaaaggaagatgcagagttatgtgaaaaatataatcttgaaaaaaggaaaataaaattagacaatgactctttagaaattcaactgcagccaatcgagatgttcattcgcacccggcaatgtatttataatgcaggaacctccagtgagttggcaatacaggctcatataaatgaagtggatactctattagattattcaaaagctcagaaaacaaaagttaaggggtctgtatttgagcttatagattacttggactctaaatattcaatagcattggagatgatagcaggagggagactgtacaatttagtggtcgaaaatcatgaaattgggaagaaacttctgagtagtggattaattaaaaaaagaattacgataataccattagataaaattatggatccttcaatttcagaaaaaacattaaattctgccagaagcttaattaattgtaacagtacagaagatttacgtgttttaagtgcaatgaacattttaaaatttgataaagagctagagcctgctattaagttttgttttgggcatacaattatttgtgaagatgaaaatatcgccaagatgataacattcaatcctggaatactagcaagaaccgtaacattaaatggcgatatatacgatcccagtggaactttatcaggtggatctattccaagtaaccaaagaagtattctatcagcgtataagcaatacaataatcttagacttaaaatactatcaaataacaaaaggatcgaagaaataaataaaattttattggatttgggcaaggctgcagatacatacaggcactccctaatacaattagacataaataaacaccagcttaaacttttagaagaacgtataacaagactgaaagaagaatctgctgaatcaaagattgaagaatatttgaaagaaatagtggcactaaagaacgagcatcaagggttacttgataaagagaaatttttgaaagaaaataaatccaggcttgaaaacgaaattaaagtatttgaagatacaaaggaatctagagaaaaacatttggaagtagaaatagatcatttaaaaagagaaattagagatttaactgcctcatataaaaatttggaaaaaatgacttctgacactagaattgaacaaaaagcattgaagacggaactggagcaaatatcagatttaattttcggcaaaactaataatattaacgagataagacaaaaaatcgaggatcaaaacgaaactttgaagaatttccaatcccaacttaatgaaagcaagtcttcgttaatgaagcttcagcaacaaattgaatcgagcaacgatataataaaggagtataaatcagagatcaagaaaattgaaaaattgattaatggcaaacagattgaaaattctaagattattcatgtaataaaaacacttaagaccgacttgtcacaaaaaaataaattaaaagactcaatgtccagaaggttcgaatggctcctggataaaaatttcactaataaaattgatttagaggcgtattcatataagagttgtgtagaaaagttggaagaactccagaatgagcaaatctcactctctaaaaatgtgaacagaagaattttaaatttgtacgatagagttaacgccgagtgtaatgaattaatcaataaaagggatattgtaataaaagataaggataaaatcgaagatgtaataagtgatttggatcagaaaaaaagacaagctttggaaaatacttggaaaactgtgaactcatcatttaaatcaatatttagtactcttctaccaaattctagcgcagagcttgtcccttatttcaatccggaaactaatgttgagagtttttatgaagggctagaatttaaagttgggtttggtggaatttggaaaaagtctttgactgaacttagtggtggacagagatcattattagcgctatcattgattttatcgatgctaagattcaagcctgccccagtctatattttggatgagattgattctgcgctcgatctcgggcatacgcagaacattgggaagatgatcaaaaaccatttccctaattcccaatttataattgtttcacttaaagaaggaatgtttaataaggcagatgtattgtttaagactgaactaattaatggtatctcaactgtaagcagaattgagaacttcattaacggaaatgaattcgatgaaaaattcggagaaaaaaatgaaataatgattgataacaaggttcgtagaaaaaataaatga

SEQ ID NO: 1554 - DNA, 318 bp, Cryptosporidium hominis
atgagctccataaattctctttcatcaatttattgcttttatttgtcagaaatgatacatcaaattagaatgatttggctttttataaagtttttatgtttaattaaggacaaaaataaaaatggaatagaatggagaaaaatatataataattttctgttctttgactgcttaaatagcaatatcaactcagttattgcatatatatatataatatatatatatatatatatatatatatatcaaatcggcgctaaaaaccccacaaacgtgtgtaatatttacaatgaaaaaactcaggttattaatcactggtaa

SEQ ID NO: 1555 - DNA, 249 bp, Cryptosporidium hominis
atggattcatcgagtaataaaggctataatacaaaaaaatggagtccagaaggtttcagaaaacacgaaaaactgcaaactagaggaaaagatctgggatctaaattaaccaataaccctaaaagcatattagttgaatcaaaaaaagattttcaaaacttttcgagtaagcaaagagaggcaaacgctttgtttagcggtatttcaaatactcaaaaaaagaaatcacttttcatagttaattcttag

SEQ ID NO: 1556 - DNA, 393 bp, Cryptosporidium hominis
atgaatattagcgacccaaatgaattcaattctggaaaaaatggaagtaataacgttggcccgattgaaattaaccaagaatttaaccagaaagtcgatgatcaaaagagaataattgatgatcagaaaagaggcgcattgagagcaattttagaaaatagttcgatagaaagattaaatagaatcgcattagttaagcccgacaaggtttcacaaattgaggattatatattgcgtaccgcaagaaatcatgggtattctccttatagaaaaatacaggagagcgaacttataaatatgatttcaatgatgaatgagacaactgagaaaagcagttcaagaataaagatatgtaggaaaggagtttttgatgacgatgattatgaattttga

SEQ ID NO: 1557 - DNA, 1656 bp, Cryptosporidium hominis
atgggaaacacattgaactttgataatgaagaacaactggtattattaacaagtcattctaaccctttattaccactgaaaaggtcacattctaatttggatttaaatagcggactatcgtctagaacggattctttgcaatgcatatctagctctaaagttgaaaattctatttccaatgtactctttaatatttctgaaagaatttcgaaaacgaatggaatcatctactttttttctaagatggagaagaaagaaatagggcttgatcattcagatcaagaaactttttgtgaatcaagttatgtttttgaaataatggatctcaaggaaaaaagagctcagaaagagtcgaatatcattgaatcaaatggctttggctttggagttcgcacaattaatggagcagaaagaaatctaagtcatgaaagtggatttgggtttgaaaaaaaagagtcaattgaaagttgtgaaatttcaaagatcgaaattgatattcctgagatccaaaattcagtttctatattcggaagtaatattgcaaatatgttaaaaagcattcgtgtaacgagtaaaaaatttgttatatttggtaataagaataaccacaaaccatttttaagccctggaattattgactcatttttaccatatattttggacgaaactctattatcctgtttcctggtttgtccccattggctcctcacaataaccgaattcatcaatgaatattattgcaaatctattgataatcagtttagagaaacttacagaaaatatctcgacttagagcatacaactattaccatacagccagttctaactgttggtggaagcgtacgtatagatcgagttttgtacgctaaagtattaaaaaattgcgtaaacaaaacttcttgcctaacttacaactttaagtacaaaaatacttcaataataaaagattgtctaaaaaaagagaacatctctcagagaaactctctttgtccaataataaaaccattaattaacaaacctcatttgtactctcaaatttcaaatactccgttcatttcttgctacaaattcgtggctaataaaacaggtactaaaagaatacaatgggcgcataaggatttgtctagatgccattgtgaagaggttgcagttgctcaaacaactactacatcaaatgtaaatgttggagatcgtattgaaattgcaataaatttgagtaattcctttggtattgttgatattgaatcaattcacttcctgccattacaatttgaaatagctagtcctgaaaagtgtgaaattgaagatatatacacttctggggcagattggagattttataatagtgatgacggggacattactgagtgctttaatgttccaaatctactaccgcaatttaaggtaacttcgctagaatatgcagggaccgatataatcacctgtaaaattacgtataaagctatttcttcagggcttttagctaattcaaaagaacacttcggagttgatatatctgtcgtaccaagagaatatgcaatcatttctgcattgaaaagaaaaggactccagcatgatcgatatagcccgcttcaaatgagggtcgatgatcaactagttttgtacatctcaaaaggtggagcaattcctacatag

SEQ ID NO: 1558 - DNA, 3966 bp, Cryptosporidium hominis
atgccattaaatcaagaacttgaccagatatgttgtatttcaacttggcataaggaaacaaatagtattaacttgtacaatgaagagctatgcaactcaaaagttatgttcccttggagcatgggaaatagagttcctattaatagtgtaagttgttcagagtcaatatttaactgcaatgaaacaattaatagtggaccaattgggagacaaaagctgaaaacttttttagaggcgagcattcaatctagccaaatttacaacctcagcataccgaatatttctcggattctttcagactggagaaaggaaaacgaaattaaaaacacttttgttatggaactggtagattttacaaaattatgtggaatcaaaaaaaataaaacttatagagatttattcgagttgctttcgaaaatattcatctcaaaattaaaaaataaaaaaatccttgattatagaacgtacacaaagtttgataatttagctctaaaatgtgttaaaatgattaatgttcctcatttagttgaatcagtaattgcacttttaactaaattcaaccgtttatctgataaggttatcaaagaaattaccacgcctgatctttatttatttccaagatttctttctttttataaattagctccgattaaattgcgtcagcaaatgtggcttagaagaccgaggtggtttgtatatgaaattattccacttattattctctttacaaaaattttctcaagtgtagattactattcaatttttaatatttcaaatccaagaaactccaatgatcaaaactcttcttttgaccttattagggaatttctaagatctgccaaaattaattcaaggggaaatgctggattggatttaaaaactgaagttgatagcttcttttttgaatttgttaaaagaaacgaatactgcagtttgtatgaaagaaaattttctcaacaaacgaattctattgattctatttatacttttgtttcaagaatccaatctctttatgtttcatgcgttgagattgaacacgaaaacattgaacgcctcggagagtcctgtaagtccctagcatttaattttatggactctggagatttctataaaagctttattcaacttcagaaagatgaattattgttacctgaaaattctataagcgcatcaattagtgcaaatgtttgctccgcaattcacaatatatccagcatacctaaaattaacaatgtatcaagccattcgttacactcaaatccattaataaatggcagatcaataaataataatttaagtaataattctacaattaactcttcgtgctgtaacatgaccatttgtgggaacattttaagactaggtagaatcgttgcatatatttcttattgtattgggaactacaaagagctatatatttattttgtaaatacgttaagacagctttatattgactctctttctcataatattgacattcaagcagtacaaactgacttaattacatgcgttaatcaaattcctgtatgctccaacaacacaaataattctattaactcaaattctataaatccacatattcactttccctcaaaaactaattctatttctcaaaataataaaacaagcaaaatcccggcgaataagttattaaatggttctagattagaaggggatttcagtaatgctgaagagtttcatagaaaaaatgttcccaataatatcgactgtaagcaggaaaacagctttgtactaggagataaaaagcaaataatttctaaattaaacgaacaaagattgaataacttttcaggagagccctatctatcttcattgagaattttcgttgcattgagaatattccacttcaataacaaattgaataggagcgaagaagaagaaaaaaagctaatagaaaatgaaaaatcaaatttaatgaataataataatgaatttaactcagaaaaatccaatcaaactgaattatcaaacttcgaagcattaagcccattggcaatatctgagtgcgattcaatcgcttggccctgtatacatattgttggaaatatattaaaggatggcttttcatcaaataaaagtcaagagtcattagttaatatttcttcaacattaataattaagtcaaaagatgatctatctgacatatcttttatattttcagaaccccactttctattcatttgttcggagtttattcttgaaacatctattctaactatgtttcactcatcaatggatgcaatgctagttctaaatcctcaaagaagaaagatccccattgctcttatatcactagggttgaattctccttttttatcatttaaaaacaaaaattcacttcttagaaattcttcgttcttaacaaattctagtataaattcaatttcaagttcagtcactacaagtagtatcaacgatcaatctgttggaaaatctgcttcaagatcgatttcaccatttagaaagatgatttcaaatgatctaaattctcaaaataataatttgtctactattccaagaaaaagatatagaaaaaatatcaatgatgcagctactatacaaaatcacatagaaaataatcaggttagctttgcaattaggtttgatactttactgaatttattaactacattcaatttaaacaaagctcaaattaaggaaaaccctcgaataattgatgcaggcgactgctcgtattcgccaaatattacacaactgatggatttaaaagataaaaaaaaaattgatgtatctttccagcaaacaactttttgccatgtctcatcaacaattgatagcaatattcccagacttcacaacacagttttttctacatttcttccattaattgacaggtatctagagctttcaatatcatctcaaaaatcaaattttacttttcaaaataatgaatgcgaaaagaaaaagtctacacggaacgaattgctgaagtcaataagaaacgaattgattggttatattaattcgatttctgcattaaaatatcaaaactattctgatatattgacgttgaaatttgttagaattgtttctacttctttattttttacaggagtcaagccaataattaaacaagaaagttgttcagtcaactcacttattcattatagtattaatggtctatcatactatcattcgcattatgcccaaactaaaaaaaatcctgatatctcgttaaataaccaaataatagccccttcacttccttcatgtattaatttatcaataagattattggaaacatctttttcttctgactggatcaataaaatatttctcaaatctatttttgggcttttacatacatatccaagggtgtataatcggtttgataatccgaatatgaaaggtgaaaacgaagtgtttgcagagacggttagttacatgaatgataagaattctttgtttgcatctattcctaatgatattattcatggtttactattgagagtagttttgccaagtattaaagacccttctatttcaagtactgaaataaatactatatatgaaattattaatgatgcagaaatttgctcaatagtcgatacaaaaacaaaaaaactttttattgagaggttttggctcttaaacccctttcatttcagtataaatatttcaaacgataaaaaagatcaaaatgaattaaaaaattctccaaaaatacaaattaatgatctatttcaatttattcaaaataaactttgcaaaaatgaggttaacttttatataaccatagaagctccatacaaaacgatgctctgggaacaccacttcattaattctaatgattgttatttactatttcaaagatggtttttgtacttcgtaaatgcatgcaaaaaccacgacagagataaccaatactataataaactattatcactttgtgaactaataaaaaatatcgatggagataaataa

SEQ ID NO: 1559 - DNA, 927 bp, Cryptosporidium hominis
atggaatcgattgaattgcgacccaacaagataaatttgtccgaattcattttaagagaaataaaaattcacaataggaatattgtagttattacaagtggtggaacttatgttcctttagagaaaaacatggtaagatatatagacaatttcagcacaggtacaagaggtgcgcagtcagctgaatactttctaaaatctggatttagcgtgatattttttcacaggaaaggcagccatataccattcacaattgattgcccatcgaaatatgatatgttaatggcaatggcgaataatgttattagtttaaatggagatcattttaacttgttaataaatgagcaatttaagaaagtcatcgaagcatcacaaaatctaacaaaatattcagatagaatgtttctcatggaatttggttcagtccatgaatacttcaatggagttgactacattacttctcattgtactgaatttcctggtaattttatattcttcttagcagcagctgtttcagatttttatattccagagaatctgttgccgaagaataaaatatcgtctagctccggtatatctttggacttggaaaatggacctaaaactcctagtattacgttagaattatattcaacgccaaaatatgctcgatatattcgaaacaaattacctctttgctttcttgttttatttaagcttgagaccgaatatgaaatattatttaaaaaatcagataatcttttgaagatttgcgatgccaacgtaatttgtgcaaatttgttacaggatcgaagagatcacgtaataattcttactgcaaattcaagaactgagattaaaaaaatgtctggacctattgaagaggcaatcgtttctaatataatatcattatacgagaattactctttaaataatacgcaatattaa

SEQ ID NO: 1560 - DNA, 933 bp, Cryptosporidium hominis
atgccatctccggagaaagcagcaaagaagaagcaatacttcgaacgcctgtcagaatatgctacatcttacccgagaattttagtagcaaatgcggaccatgttggttctaagcaaatggcagacatccgtctagcattaagaggcaaagcagcagttttgatgggaaaaaataccatgataagaactgctctaaagcagatgcttggttctcatccggaattagagaagctcatagagttggttcgcttgaatgtcggactaattttttgtattgatgagccctctgaggtgaggaagattatagaagaatacagagtgcctgcacctgcacgtcaaggtgtaattgcaccatgcaatgttgtagttccagctggagctactggattggatccatctcaaacttcgtttttccaggccctcggaattgccacaaagattgtgaagggtcaggttgaaatccaatctgatgttaatttaatagatgaggggaagaaagttacggcttcacaagcagtcttattgcagaagcttaacatcaaaccattctcttatggacttaaagttaacaatatctatgaccatggtagtgtttacagttcatccgttcttgatatcacatcagaagacttaatttctagagtcgctgaggcaaccaaatatgttgctgcattctcaaaagaaacggctataccaactctgccttccgctcgcgacggtattatttcttcattcaggaactgcgttgcgcttggtttggatgttgatttcgacttcccagaaatgcaagccattaaaaatgcattagcaaacccctcttcatttgttactgcctctgcagcagctgataatacaactgctgttggcgcgtctgccccagtagaggaagaagaagaagaagagggtgatttaggtttttcgttatttgactga

SEQ ID NO: 1561 - DNA, 1143 bp, Cryptosporidium hominis
atgaatatgcccagaggaatgttaatatacgtttttctgagctcagtgctctttgaacctgcctttgtttcaatgcttgtatttatggccggcattatatttccttttatcttttattacttggagtttatagaatcattcaatctgcctcatatcatgaatggaactgctattttagcatatatatctgttttgcttggcatttgcaaatttatttcgcttggaaagtgtttatcggagaaaacgctgaaagatacaaacataatgaaaggtaagactgttgtaatcaccggttgttcaagagggattgggcttgaaacagttaaacaactagcatcatggggagtgtcagaattaatcttttgttgccgtgatattgccgctatggaaaatgtcaaaaaccaactcacttctattaggttgccacctaataaaatccactcgatagagtgtgacttgtcatcactacatagtgtagaattgtgttcgagaaaaattttatcaacagtggacaagatcgacatattaattaataatgcaggcattatggcaccaccatttcagctaataaacggagttgagaagcaatttatgactaactatcttgggcactaccacttaacaacgaatctaatccccctgcttcaaagaagcaaatgcaggataataaatgtctcaagtatcgctcacttagctgtgccttttggattcaacatttcagagatcgagaatattaacgagaaaagctataacaaaatgagattctatggtattagcaagctatgtaatatttatttcacgagagaactgcaaaaaagatttggatcagctggcttaactgctgtttctttgcatccaggatgtgtagacaccgatttaggaagatatgtccgtgaaaatagtattgcttttgctttactatacccattaatgaagctgttttcaaaaacctcattttcaggtgcacaaaccacactttattgttgtgcaatacctgaaataaaacttgctccagggggatactattctcaatgcacgctagatatatcttcgcctgcttcactagatgaggatgcgtcagcacaactttgggattattctaaactcctctgtgataaaattataaaatcaaaaatgaaatag

SEQ ID NO: 1562 - DNA, 762 bp, Cryptosporidium hominis
atgatgtttatttttaggaatttatttgagtggtgtaagcttgatgacaattgcttatcggtagttgggtcttcaatgccaagaaatcctccaagcaaagagtctactctaaaaagcatgttcagcaatcaagtataccttgaatatgaagatcatttagataattatttattgaagaaagaagctaagaaattgactgactcatcttccgtaatgaaatttatagatgaaggaacagaggagacaaaaaaagaggtcaataagtttatagaattaagtcaagcatttgcaaatgaaatgattaacggagttaatattgaacttgtacttggagatggaaaggctcatatattgcacctatcactcagtaaagatttgaatgcattgtaccttcgaagaagtgggaaaaaattaattcttcctcttaacattgttagcttagttgaaattccatcagagaaactaatttctgaagcgccagagcttcaaaatgtagatgattgcgagcttgaacgaattgtggcaatttcgacagtttctgatgattggtatatttttataatgaaaaatcccgaaatgagagatagattttatcaacaaatgagattgttagtagcatctattaaaatctcacttgtaggaagtgacagatattgggggaaggcatataacgggccattgatggattctgtacatatagagtcggatgatgaagcggtttttttgtttcaagaagaagaaaatgaagttacgaatatttag

SEQ ID NO: 1563 - DNA, 3189 bp, Cryptosporidium hominis
atgaatactgataaaagagatgaaattgatacaaatctctacagtcgtcagatcggtacgctgggccttgaggcaatgggaaagctgataaagttacgcgtattgattgtggggcttcgtgggcttggcgtcgaaatagcgaaaaatattatattggctgggccgaaatcaataacccttgtggatgatgagatatgtagtttttctgatatgggtgcaaacttttatattacagaaaatgacgtaaaaaaaggagccaaacgctcagatgcatgcttaaacaaacttgcatctttaaacgaatatgttcaagtcaccgtatttcatggagaaattacaagccaattgatcttcaaccacgacgtaattgtttgtgcggatgtaccattatcactacagataaaatacaacgaattatgtagagaccatactccaaatattgggtttatttccgccaactcccttggtctttgtggctccgtttttgttgattttggggattcttttaatgtattcgatggaaatggtgaagaaccaaagagtgccataattgcaaagatttcaaggggtaaagaaacaacatctataacatgtctagccgagaaacttctcccatttcaagaaggtgactatgtaatgtttagagaagtacagggaatgacagagttgaatggtacaggtcctcataagatcatctcaacaggaaaacaccaatttacaatccaattagattcgagtatgttcagagaatatgaaagagagggtttggttactcaggttaaagttcctataaattacagcttccggagtttaagagatgcactcgaatatcctatttgtgatgaacagggaattttaattgttccagatctaaataaatttggcagatccgagcagcttttcttctcaataaattctgttcttaaatactctgatattaaaggttctcgtccagaacacaccgacctgcaagcaattaatgaatgccattcgcttgcagtggaaatgaacgagaactcaaagaaaaagcaagactcaaacgacgaaaaaaaagaatttgttatttcagttagtagtattgatagggatatactcgagaaagtatgcaaatattctagatgttgtatatctcctatggctgcttttctaggtggaattgctgcacaagaaattgtgaagtttgttggcaagtatacaccattgcgccaattcttcttctttgatgcgttcgaacaattagatctaatttcaaatgagactcatacaaaagaagagtttatgccattagggagtaggtacgatgatcagataatcatattcggtagaagcttccaaaatagactatctgagaaaaatatttttattgtaggagcaggagctttaggctgcgaatttttaaaaagcatggcgctactaggagttggatgtgggccaaatggaactgtaacaattacggatatggataatatcgaggtttcaaacctgaatcggcaattcctatttaggcaagaacatgtgggttcaccaaagagtgcaattgctgctcaagttatcagaacaataaacaaagatataaatattatctctcttcaaacccgagttggcacagatactgaagatgtttttgatgatatattttggaataagaccagttttgtgattaatgctctagataatgttccttcaaggatgtacatcaatgatcgatgtttgtggtacgaaaaaccattactagaaagcggtacattgggaaccaaagctaatagtgaaacatatctcccgcataaaacccagtcttattctgataatcgtgatcctgcggaagaaagcatccctttgtgcactttaaagcacttcccgcacgcaatagagcacacaattgaatgggctcgtgacgcatttcagggaatttttacatcagacccgcaagaggctattacttttcttaatagcccatgcgaatatatccaaaatctgaaacaaagaggaaatcctaatgttatccttgagaaatctcaaaaaatatttgagctaattaattggatttcagagaaagaccctacgcatgaagattgtattcgaatggcaataaatttgtttcatgactacttctattgtcaaattaaacaacttttgactaacttcccccctgaccatattaatagtgatgggcttcctttttggtcaggaccgaaaaggtgtccaacgcccataaagctgaatatacaagataaattgcattttgactttatcctttcagcttcaaacctatattcaaatatggttagattaccagaaatatccgactcttcaattatattcaaggtctcaaatgaaacaatccttccagaattcaatgctaagactacaataatcaagattgacgacgatggcaatacttcaagtaatgaaaatagcagctcaagttcaataatattggatacaagtattgctgaagagtacacaaataaattactttcatttacagaaaatagaattaaaaggtgcttaaactttatacagcctattgaatttgagaaagatgatgactcaaactttcatatagattttatgaattcttgtgccaacttaagagctaggaactactctataaaagaatgtgacagacataaatgtaaaatgatcgcggggcgtataatacctgccatagcaacaaccacagcaatgataactgggctcgtttcgttcgaagcgctgaaggtatcttcgtctggcgaatacaaaatagagctcttcaaaaattcattcatcaatctttctctcccgttgtttgtaattacggaaccccttccagccccaaagacaatttcaaaggaatttgatccaatagttgaaggtccattaagggcaaggcctgaaggatttacagcctgggataagcttgttatcgaacaaaaagatggtactgttcaaaacattatcgactatctgacaaataaaatgaatcttgagacacaaatcatctcgtttggcaacatatgtctttacaacgcgtatatcccaaatcaccaagaaagaaagtgcattcctattgctttattaatagaacaaattaccaagaagaagttgcacgttacaaagaatagtattgcgttagaagttagttgttgtgatatcgatgatggggttgacacaattattccgtcaatcaagtttattttcaaatag

SEQ ID NO: 1564 - DNA, 687 bp, Cryptosporidium hominis
atgtcgataatagaggaatttaatcaattaaaacgggatcttgaagctcttttttcatcaaaggaattgattgagaaacaaatttgcgagaaggcatcgagaatatttatgctaaataatgaatgcatttctctttcaaacaataatgaacatacaaaaaatgatgttcaagaggcatatttagaaatttgtaattatattagcgatattctagaagttagacttaatagcgatagttttgttgaactcaaacaatgtaaagcgaataatagaaatataactgggaaagaggaaggtaggatagtgcaacatcgaatttcaagtttagaagatgatcagagtgaaaataaaaaatcattgatacacgcaaatagctatgcatttaagaatatttataaacttgatgactttatgaacacaactaattggctttggaacaaggaacttaagtcaaagattgtcgaagttgtttcaaatagaaataatgagtttccgaatgccacaaagccatcgcaaattggtggggatttctcatccatttctctagggcataataaaatgcactgcaatgcgctcccaaagttggtgtgcaaaacagtaaaaattgaggaaaacaacccagaacaaacaaagtatataaatccattgaaaagctacatagagaaggcattcaaacttgaatcatag

SEQ ID NO: 1565 - DNA, 2490 bp, Cryptosporidium hominis
atgctttatattctttcaaaggaattaactgggcatgaagggtgtgcccgatgtgtctgcgttctaaaagataacagaattgtgactggaggattggacaatcaaataataatttggaattacgttgaaaatgcttggatacaagaactccatttgttacaccataaaagttacgtattggcattagaaccttctgatattctattgaatgaagaatctcatgagatcttattttattcaggaggtcttgacaaaattatttaccgtttatctgctaaagatgggaaaatacttgcaacttacaaaggacacaaatcaacgatttgtagtattaaagaacattgtgaattgaatattttgatttctggaagctgggatggaagtgcaataatttgggatttaacttcgtcagaatgcaaacacacattaaatggtcatcaacatgctgtcacagtttcaattatttcacaacctatcagtggaaagttctttttattaactggaagtcagaataaatccttatttctatggaaaattccagaagcaaaactaataaaaactataaaaaattcccatgatgatattatccgttctataagcatttcaaacaatattttcgaaaaagattctgtagttgctataactgtttcaaatgattgcgcgataaaaatttggcaactttttttaaaatctggaagtgagaattgcattttaaaaaatacaaaaaagcatcacaaatcttttatttttgacgtaaaattttcgaaatttcatactgaacgcttttttactgcgtcagatgattgcagtgttgcgatatggaaactatcaaataattttgaagttatattgttgcaaaacattactatgacttcaaccatttggaatataacagaaatgaaggataaagattctatattaacagtatcagaagatggaacttgtagaatttggattaattctctcgtagatgatctagaattagaaaaattaacagattcaaaaaaaattgatacaactgaaagtcacaaatgcgctaattccgaggatttacaaaataatcaagaatataatactaatatattaaatgaagtcccagaaataagtcagttgaactcaattattgcagaaaaaattgggacagttcagatttttaaagataccagcaaattaaaggcatatgaatgggcaaactgttgctggaattatttaggaacaataactgaaattaataatctaagtagtaaagtaaaatatttaggtgataaatacttcgattctggattatatgatttggttattaaaattgaaatagatattgtttgtaataataataaagtaccttttaactttggcaacagtgtaattgaattgaccgaaaagttctgtttaagggagggaatagacagaaaatattgtaaagcaattagtaattcaataataaatggcattcatattgttgaaaacgccacgacgtttagtgaattatttgaatcatgttttgaattcaaactatttaaaaaattcaatatagatagcttaattatctcttttggtaaagaacaaaaagcttatctagatcagcttaatacaaaagatcgaataaatttagataatactagttatcttcttgatgctgaaatagaacatttgaatgacttttttattaaattaaagagcaaaatttgcaatgaaacaaattcttttacttcattccaaataaaatatattgaaatggaaataatatacaaaaaactatcgaatttcattggaaataactctcttagcgttccaataattgacttgtggagaatccttgcgctccacccacaaagcagtgatattcataagaaaaccgaccaagggtggtggctattagcattaatattgaatgtcgttgatttgatttccattgattatcttaattatccatcaattagtggaaacaatgaattcagaggctcactctttctaatttgtattcgattcttatgcaatatgttccataattctacaaatagagaagcaatgttgtctaagatacaaagtataatattaaagatcgataaatcaacaactagattcacagaaagaaacttccaactttcacttaaggaaaatacaaacaagaattcgatagtcgcatgcttagcatttatgtttaactatattgttgcactaaacaataaaaactgtgccttcgttgattcaaggaatttaataatcttatatgtatgtaaatttttccctttaacaagatgtggtgaatttgcggagtacgttgatgaaattcttcattatcaactattaattcttactaacaattattattacttaattaaacttgaaagttattctcatatatatatccctgaagacaaagaaattcgaactatctctaatctgatattgaaatgcagtcgttcttcgaaaacgctttattatcagcttgtcacatcattaaatataataaagaacgggagaaactga

SEQ ID NO: 1566 - DNA, 315 bp, Cryptosporidium hominis
atgtcagatgcatcattagactggaagttttcaataggtttctatgctgcaatatttgtagctttactccctatcggcatttcattgacatactggtatgaaggagtactttggcacaacgtattcgaacaggatagactccagtggcaacctgaaagaaacaatgcgcaaaattttaccaatggtaatcaatataactatattcaagttccaactgattttaatagcgtgatggggggactacagtcgccttcagaaatggcaagaacaattgaaaggaacatagaaaagaaacagatgaatgaacaaatatag

SEQ ID NO: 1567 - DNA, 450 bp, Cryptosporidium hominis
atgaataaaagtatattaaagctattaagggcgttacttatcttgctctccttaattctagggtttctttcaatcctagcttttgcttggattagtgagtcaaactcagaatattcacaatattatttagatggagtaaagttcagtaatgaggaaaagaaagtagcgtttgcagatgcaataaataaggcatgcagtttctcagaagcttatgaagttaacaaaaaagatgcaatggagaatcaacaattttccaaattcttctctgggagagatccaatgattgatcctatatcttattgtgaaactatcacaagttcgaaaactccaagtattgttacagaatcaatcttaattaccattcaaatactgatttttctaatttctacagtatcaaatacaaagtttgttcaaggagcacctgatgctgttacgttgatcaaaaggtaa

SEQ ID NO: 1568 - DNA, 1038 bp, Cryptosporidium hominis
atgtcccataatgcatcttctagaaatcaaggaggtgatacaggtttgggaatagggtggaagctgcttgcagcagttggctttactgcaatcgttcttcagataatatcaatcattttaaatggatggagggttgcgccagcgatcacgtaccaatattaccaaaaaagcacattgaaatcttggcaacttcaatcatcggaatatggtttgtatatttacaaatttaataatggcgcttctacaagaccatggtcaactgtagaacaatttgtgtgtagttggattgattcatatgtatcgatatcacaagttgaacagagtttatggggaagcacatgctctacagattgccaaactgcattaaggactaggtgtacgtcatatgtgaaatttgcaaatggtggatatctttgtttgggagcgttggttatttctataatagtaggaatagtaggagttgtttggttatttgtatttggaaaaagtcgtaattttttattatttgcttggagtacttcttcaatactgtcttcatctggtattgcctattggtgttacacaacaagccaagctattaaaggcataattggtacacaacaatatccatatccatcgcttggatatggggcatatctgggaattctttcaactgtatgcttcattatttgcgcattcggagtgcttgtagttcattatctcgaatcaaaagcggcaatggatgccaggcaagctgaactaatgaaagaagcagctgcaaacaatgagtggatgggtcaatcaggcatgagcccgcctggtatgggtccgcctggtatgggcccaccctggtatggctccgcctggtatgagtccacctggtatgggtccacctggtatgggtccacctggtatgggtccacctggtatgggtccacctggtatgggtccacctggtatgggtccacctggtatgggcccgcctggtatgggcccacctggtatgggtccacctggtatgggcccgcctggcatgggcccacgcggaatgggaaataa

SEQ ID NO: 1569 - DNA, 1065 bp, Cryptosporidium hominis
atggcatcaattgatgagatatctatagtttttaaagtctcaggaggtacccagtttaatattagtgttcctagaaatactatcgttaaagatctgaaagataagatttcagaaccatcaaatataccaagttcacaacaaaggttaatatataagggtagaattcttaaggatagcgattctcttgatggtatgaaggttgaaagtgggcatactatgcatttggtgaaatcaggagtacaggttgaaaatcaaaagcctacaaatattttagatcaagctgctgattataattcttcttctggtaatggccagacaaccaacaacaataatgcacagaactttaattctataccccctactagtaatgatactaataacggaactaacaacaatacaaacgatccttttgctgcaatgatgaatatgctaaatggctctgatttaggatttcaagctcagaacttgagaaatttttctcaaaatagttataatggatttgggggaatcccaaacaataataattttgggaatataccagatttaaattctctaatgaattcaccgatttttcaacaatcaattaatgagctagcaaacaatccacagcttgttaggaatattttgcattcgaatcctatgtttgcccaactttctgcaaataatccaatgctggatcaaatgttgaacaatcctgagatgatgagaatgatgctgaatcctcaaatgattcagtctgtattgaattctaacaacatgaacagttctgctacaaattcaaacctattctcttcgcttaacgggggtcccaatgccactcaaattaacgggttacttaatgactctagcattgcctctatgctatctggtgtggctaatggagcaaacagaagtgttaatagtaatgcgcctaaccccgcgcctcaaatgtacgctacacaactaagtcaacttcgtgacatgggttttattgatacagatgccagcctatccgcattacaggaatcaggtggagatattaatgcagcaataaataagttattagagagaggtgttggacagtaa

SEQ ID NO: 1570 - DNA, 1599 bp, Cryptosporidium hominis
atgagcactgaaatgaataatcaatctcaaattagtgatacgctagacagcgtacactatactgataataggtacaaaatgatggagtgtataaaggacgcaggcagaccgttttatccacacaagtttaaaatttcgatgtcgcttccagcatatgctttgaaatacggtaatgttgaaaatggatatattgacaaagacacaactctttcactgtctggaagagtcacatcaattcgaagttcaagctctaagttaatattttatgatattttttgcgaggaacagaaagtgcaaattatcgcaaatattatggagcacgacattagcactggcgagttctctgtttctcactcagaaattagacgaggagatgtggttggatttacaggatttccaggaaaatcaaagagaggagagttatcgttatttagcaagagtgtagttttgctttctccatgctatcatatgttgcctacggcgatttctggtctgaaagatcaagaagtaagatataggcaaagatatcttgatttgatgttgaatgaggaaagtagaaaagttttcaaactaagaagcagagctattaaatatattaggaattattttgatagactcgggttcttagaagtggaaactccaatgttaaatatgatttatggaggggcagccgcaagaccatttattacttaccataatgagcttgagactcaactctatatgagaattgctccagagctctatttaaaacagttaattgttggtggtctagacaaagtatatgaaataggaaaaaactttaggaatgaaggaatagatttaacacacaaccctgagttcacagcaatggagttttacatggcttatgctgattattatgatttaatggatctgactgaggagttaataagtggcctggtgcttgaaattcatgggagtctaaagattccttaccatccagatggtcctgaaggcaagtgtattgaaatagacttcacaacgccttggaaaaggttctcatttgttgaagaaattgagtctggattaggagaaaagctaaaaagaccattagactctcaggagaatatcgattttatggtagaaatgtgcgagaagcataagattgaactcccccatcctagaactgctgctaagcttcttgataaattggctgggcactttgttgagactaagtgcactaatccctcatttatcattgatcatcctcaaactatgtctccattggcaaaatggcatagagaaaagcctgaaatgaccgaaagattcgagcttttcgttttaggaaaagaactttgtaatgcatataccgaattaaacgaacctctacaacaaagaaaattttttgaacagcaggctgatgcaaaggcatctggcgatgtcgaagcttgcccaattgatgagacattttgtcttgcattagagcacggattaccacccacagggggatggggcctcggtattgataggttaattatgttcctggcagataaaaacaacatcaaagaagtaattctgttcccagctatgagaaacattaaacaaaatgcccaacatagcaaccaacatagcggaaattag

SEQ ID NO: 1571 - DNA, 2721 bp, Cryptosporidium hominis
atgatagatttaaaatgtagaaagcatatagatttaaaagctattttggatttctataaattggagctggagtctgacaataaaacttatatcaatgaggcattaagaagatatagccttgtgagcaaagttgtggggaaggactattctgagttatatttattaccacttgtattaaaagtattagaaattggaagctatgaggttaatcatattgtttcagaagaattaatcaatattattgacccaaatactcagtattctgaagaaagtaaaagaataataaaggatatttgtaattatcttttatttaacgaagagatgagtattcggatggaaagtattaaatctcttgaaatcgttttttcaagattccaaggcaaaagttctatactatcttttattgaggaaattctacttccaataatcaagactaaatttgattacttcggcgatcattatacttcttcaaattcatcattaacagataagctttctctttgtaatataataccatcactcatgtttccatattgtaacaagtttgaaaaaaacaatctgctattactttatctctctttatgcgatgatgaagttccttcacttagaattggtgcatcacagaaattagtacaaattttaaaaaatatttttcctttaaagtgcggaatgagtaaatttgaataccaacaattaaagctttctgatcaaaatattattacagaaaagcttctaaacctggtattagcattgtataaggatcaaacttgcgatatactgaagccagcatccattggaatcgcaattcaattatacacaaatccaattttttatattgaatttattagttgcgatgacaggaacagcctactacatttcatttgtagtgtttttgaaggtagagcatatttgcaaagacaggcagtaatagaagaactaattccactttgcctatctttaaaagggttttatgagttgagtcaagaaggcaatgaaggaataaagtttagtggatatatttcaaatgataattgtaatattctttctaatattaagactattaattattctgtggacattattcaattcgtattcgaaaacttatcaaaagaagttgatattgaaattagattattgatatttaaatttatcgaaaagttattaaagatgggaattgatgtatttgaatcaaataaaggtctaatatcagaccaaacaatagagtatcaaaggaaatctgcaatagacgaagttgtaatttcaataattttctatataaataaaaatatttccgagctgctggcaattggaagtattcaatttaaatgcatcttttgtaaaatattggtccaaatgattatatattcccaacaattatttgaatatgaatcatcgaatcaaaaagtaaggagtttaaataataatatggaacatttaaagattaaggatatttttatcaaagtttttgtttcgcactttaatgacccaaacattaatgtggttagtaccgctatagagaacctacataaaataataaacttagtaagtgaagaacaactcagcgactttatattaccgaagattaagtctgtattgtttgttgacgttgatttagtcgcatataataacaaacgtgttgagaagtccactgcattacataaatggagaataatcaggtgtatcattagacagattcctctttggattagatacaatcagctttgcgttagagtttgcccattttataactctattattgtacgttcaattttagacacagcattttcagtaagtatttctgcattgcaaacaataatgaagattatttctaagttcaatgatctcaacgaatgcgcaacttggataaatgaatttattattccatccattctactaccatatattgagaatagaactcattcgataaaatacacattcgatgtgataaattatattaattacaataatatcgatgacttcagttctaacaaaaacattgaaatatatgaatacaagtttgaaagctgcgattatatgaacagaattttgattattaatctaatttttgctatttaccgttccttattttataaatgggcatatgtcaactttcaggaatttaaagactacttgaattcgattactttaaatatgcccaattattttaaaactaatggatcaagcatagaaggacaaaacaaccttcctattggagtgctatcaaatattttagatggagaagagttatttgtcaaattctcaagactggttgtaccggtaatcaaaaactccatagatgactcaataaaaaatgtttcaatcgcaacatcgcagttattagttcaagttatcaaaatattttcgttggatttgtatttcatttgggacaaagaaaagttcgcttgttctagcttcggggaaagagacgaatttagcgcaaacgacgctgatgagtttctgaaagaacatttactaaatcaatttgaatttgactctgcatggcatcttagaaggataatgtcaaataataaaatagatcagaaggatgtttatctttttcctaattgtatatatcaagaattcatctctgtgtttgagaagatcgatgaactagaagttattgagagcgatatagaattagtttctccaattaattcaataaaaaagtggtacagcacttataaaaataatccatcaaacccagggaaatgccttgtttaa

SEQ ID NO: 1572 - DNA, 1416 bp, Cryptosporidium hominis
atgttcacgatgccaacagataataatgaaaaatttcgtaaattattaatttttacttctgcaggaaaacctatttactcatatggaattactgacaaagaggtatttagcttattttcaagcgcattgacagcaatgttcagcaaaatatcatttgtgatgtcaaaaaaggtttacattaatgaaggcgatgagcatacgcaaatattagattatcttaaatggatgagctcagaatcgcacgttattgtagtattggagagaaaaaatattatcttatgttgcatttcgccatttccaagcgacacagttcgttttttaaaaggacttctagaacatgtttattatcaggttgttatgatgcttactggatcaattcacaaaattcttgactccagaccaaattttgatatacagcagatgcttagtaatagcgatattaatattattgatcaatgcgcaaatagtgcgcaaataaaccttgattctgtatattgtttctataacttcaataaaagttcaaagatgattaaattgcaggggcaatcaaataaaattgaatactcttcccccataatacctaaaattttatatatagagtcgcaacccttggaatacagatatagaaaggaaataaataaaattatcagcggaataaaaatggaagagatactgggtggaatattgttcgagtccaaaaaattggtctcttggtttggatcaaagtatattaaaaatctaccatctacagatttctcgttattaaaaaatattacatcgatctttctaaataaaaaaactttaagtaatgaattttggattcctatatgtcttccaactataagtacggtttcatatgtatattgttacattcaatgttggcctttagttgacgaattctcaaactcaacatctaatacctgttttgttttattatcttcaagcggagatacaaaagtgtttgaaaaatgctctacacattcaaagaattgccgaaaaacacttctcgaaactgggtattataagattttagagtcaagtaaaattaatgcatttaatttgagtaagctaatgaatgaaaactgctgcataaaaacagagatatttcaccttgtttatgtatctattgcgaagaatagctacatcatcagtgaggcgcatcctgaaatccatgatttaaaaaagatcttccaaatgtattacaatctaatagaaactgcgcatactcaaacaagaatgcaaaatggctcatcaattacaattatattaagcacaaaaaaattcaaatacttgatagttactactcaagagtttcatatactgtcaacgctcccctctaattcaaagttagatgaaataaacttgaactcgataattaacaaccttaggaaaaacgctaaacactttttcatttga

SEQ ID NO: 1573 - DNA, 2430 bp, Cryptosporidium hominis
atggatagaatgtataaggttgaaaactatggccagaatactcttctggctgaggctagtagtgttgttaaagagcaagcatattatatgaaacgcgcaatcgatcaagacggacttagagatgcccttaggcatgcgtcgaatatgttatgcgaattgcgtacatcctcactctctcctaagcattactacgagctatatatgcaaatttttcaagaaatgcgcgacttatctcacttttttgatgacaaatctcgtcatggaagaaaaatgagtgatctttatgattcggtacagcatgcgggcaacattgttccacgcctctttctgctaataactgcaggtgcgtgctatatcagatcgcttgaagctccagcaaaagatattctgaaggatatgtctgaactatgcaaaggagttcagcatccaatgagaggattatttttaaggtactttttaattcaaacttgcaaagacgtattacctgatacaggaagcatttatgaagaaaatggcggagggacagtaatggatacatgggactttttatattcaaatttttgtgaatcaaatagattgtggatacgtttacaaaatcatggaactccaaaagataaattaagaagagaacgtgagaggcacgatcttagaatacttgtgggtgcaaatcttgttcgcatctcgcatttggaaggattgactcagcaactctacattcaggaaatactaccaaaactgcttaatgtagttttatcatgtgaagatgttctagcacaacaatacttgctagactgtattattcaagtgttttcagatgaaaatcatctcaaaaccttagaacttttgttatcggcatgtatgaaaacattacctggggttgatttaaagccaattttaactaatctcatgaataggctctcaaactatttaagccaaagtaatgacaagagtttaataaatgatattgatatttttgaattattcagaaaaaacctttccgaattacacgaaagaccaaccccaaatattcaaaagcagatttccaataatttggaaagagatttgtctagtttgctggaattgcacgctgcattccttgcattcactctaacgttatatccagacaatacgaattatgtagacttaattcttggatcaacagtaacactacttacaaatgcacttggagtgagagttgacggaacatgtggatcgcttctggatagccgatgtattgatacaatcgttgagatactttcgctcccattccagtcaatgcccctatccattatggtggagatgaaccattttccaaacctcctttattttctaaataaacaagcaggaaaaaaggttgcgctttctttgatcaacacaattgtggaaaacaacactccgttcgatgatgcagatgcattgcaaagattttgttcttttattctccctatgctagatgaaaaaggtacccatacaggtgaggaagttgatctatcaacaactgaaaataatgaatttatttatcaacaaatgaaagtttcaaagttagtccatcagatcaaacacgaggatgtgaaccaaattttcagcatgtacggaattcttttcgacttatttagtcgtgtagatagttcaagatttaaatatacattcccaactctggggtattgtgccataaatcttattgaaacaactttatcaaaggaaaaaacagataatgaaccttcaaaattatctgtaaaaaagatatttcagtttattcataagatcgcaataatccttgtaacttgtgcgccagaactagctcttgacttatttctacagggatcaataatggcagataaaacgaacgactcggatggatacgaagcaatttgctacgaattccttacccaaagtcttgtttgttttgaagaggagcttgcagagtcaaaaaggcaatttcagggactaatgtcaattattggaacgctcgtagggcgaatccagtgcttaagtaaggataactacgagctactagccgcaaaattggcacaatactccgcaaagttgctacgcaagccggaccagtgcagagcaatattaatgtgctcccacttattttggaacaacgaagaaaatagggatgcaactagagttttagaatgtttgcaaaagtgcctgaaaatagctgattccgcagtacaagtagctccaagtaattcagtactatttatagacatcctagaaaagtatatgtactatctagaacaagggaatcaaaacattacaacagattttatctcaaaactggtggctctttgccatgaacaaattcagttttcaggcagcgagatacaacaaggtcccaagattctacttaataacttaatgacccatacaaaaaataatcatgatttgtataaaggcgttaagttaactagtatggattaa

SEQ ID NO: 1574 - DNA, 1929 bp, Cryptosporidium hominis
atggaaaagctttatctaataagtaataatggaaagaaaagaactatttataatatatcaaaaaatagttcaaataacaatatcttcaaacatgaaaaaataagaaaaactgaaattagccatataattgattatggaataacacgttgcgaagattttcaaataaatttccaagagaatctagaaaaagactatcaaacgatcaatcacggaattattgatgtaacccactcaaatactaaaaataattataaaacattcaatgaatgcaaagatcactgtaaattaaatcagtgctttatgaaattcaaagaaaatagcctcgaaacaggaaaattacttttctcagattacaaaaacactacagaagtttcagattcaataaactgttattcaaagtatcctttattaaatgaaacccaattaattaatcatactttgtataattcaaaaaatcaatttaatacactgcaactaaacaaagaggtgtctcaactttttagtcagagttcaatatttcccatttataatgaattcgtattcttgatgtctaatttgttgagaaaaacaaatttttgtttagttgactatattcataaagaatcgaatattgtaaagtttttcccacggtacttgatttattatcctcagattacaagccaaccattaaattttccaatacctatggatacgcaatttttaatatcttcgtttggttatccatcatatccattgccaccaatacataatatagccccttcatgtaacaaatgtttattacctggatttcatccaattactgcatggctgcttcctcccagttattttgaaaaaggacagttgaaaaaaagcgcatggtttttaaatggaatgccaactaacttattcaatacttgtttttcaattaaaagcatgttaactgtagaatcaacatatctttttgtttcaaatttaaataaagaagaattcgaatattgtaaaagagaaaatttttttttattagaggaaaggtgcaaagaatcaatatattattttgatgattataaaccaaaactagggacagatagtgaacaagatttaatattgaataaaaaatcctgttttcagaatagtttttcaaaaagaattgattatactattcaaaattctattttttgtggatttgtttgcatagaatctgataaaaaatactctagcgttcttcatgaaaggaataatacaaattttgagtgcaatataaaaccaggggatctaaaaatacactcaagttcatctacaaatggcaccaagattattaacataaatgaaaaagttcaccctaatgtaatcagtgattgcgatatttttttaaaaagtgataatttacgcgattactcgaataaagatttgcaactaaataatttggaagagaaaataacacttttaattccaaggataaaatgcttaatgaaagaaagcagggctattgattcaaatctaacgattcttaaaccttgttacttgttgctttggaattataatattagaaattgtaataatactacaaaagatatcaattggataaatattcaatgtaaatttgtcagattgaaattctttgggcaagcgtatgaaaattcgattcctataaaccttaatcctcataaagagatcattcttgaccaattaaatcgtattcgaaatgttgatgaggcaagagtttttgcatggatgctcgcaggttgcatgcaacatacaattaacgaactattgattgattcatatactaaatcattattttttagcaatagttatattagaataactgatgagataaattactttagcaactgcatcaaaagtggcccatttagtggttttcccgattctccattagattgtcacgggagaattaaatggaaaatattagaagaattagtcgaagattag

SEQ ID NO: 1575 - DNA, 1800 bp, Cryptosporidium hominis
atgattccgaattataaattcaaagaaattgtaacttattacaaagttaatctattagttgctttattaatatgttttttactctgcgatactgttttgacttcaaattcaacacttcatttcttaactaatcaagaaaatctaggtggaacaataaataatttccaaagttctgaatttatatctgatggaggttttcgacaagagactcttagttacgactgtaagtctttattcgaatcaatttatttggataaaaatgctggagaactagtaagattactttatcatttaggagtccttgagaaatacgaagaactatctgaagcgaatgattatttactggagtatattaaagaggagggtttagatcatccaaatagaaaaaactttaaattgaataaaaaattaattattttttttgaagggcgacgtgtaaaaggaaataaaataaacttagaggaatgtagagtaaataaagataccggaatttcattatttaacattggagaatctttgttacactctgcagttatttctggaagattgaatattgttacattactattgcttactggaattgatgcaaatataaaattaaaaaaaaatgaagaaagtgacttaccaattttaggttcaattggtggttttattggagatttagaaggaatgacagctcttcattacgtttctctcattcaagacctagaatcgattgaaatatctaaattgcttctaaaatttggtgcaaaccctaatgaaaaagataaatatagaagaactcctttacatactgttggtttgtccagaaatctacatccaaaaagaatggcttcaatacttctaggcgcaggtgcaaaaataaatgcgaaagacttttcaaaatttactccactccatgtcgctgcatcaagaaacaatattccaatagtcgaccttttaatttctttctacgacaaaagcttaaatcaaagcataatagaatattcagttgattatgatgggaacactcctcttcatattgctgcgatgtacaactctggagatataataccgcttttagttagaaataaagatgatcttctgaaaggaaattatcatggtttatctcctttggaactttctgcattccctgttggttatagagcggttgatccatctgaagtacctcctatgtcgttttctgcaattcaatctaaaattgattctgaaatctcacagggagaatataatgaaaagttgaatgaatcatattacaatacaattagaggtggttatttgcttatacttcaaaaaattctttttgctacgaggtcaaatttacacagcattcctagtaaaactttagatatcaataaaggaattattcttgctgaaaaaaaaggaaattcaaaaatatcaaaatatttaaagacgtttggattcacaactgtttgcccgaaccctcccagcgtcgttaattcaagttacaaattaagcgatacagtaataggaaataatattcgtgtaggtgatactgtgacatatgaatgctatgataattttgagttggtcggattttctacactaacatgtaatttaagtgatgaagatgcattttatattcctgaagctcctacttgcgtgataattactaagttggaggaggtagtacatgaacataaaagtagcaggcttcatatttttattttcgttggtattggaatcattatactattaatttcgtcaataattttaataaattcatggaataaaaaacgtaaaaacagaatttacgagtatttatataaagaaatttga

SEQ ID NO: 1576 - DNA, 924 bp, Cryptosporidium hominis
atgaatatccattctaacaattcgacaaataatttggttccttccacggggaaaacatttaataataaattaagaaatttaatgaaaaaagataatgaaacatcgaatagcctaagaaacttagttagtaattcagtaaaaattaactacgaaaattatctcgaacaaaaaaaacttgatttttttgtaaagtatttgctggaatatattttaataaatcaagcattaaacattaaaaaaaaaggatttttagccgaaaatataactaaaaaaatgtctggcagatttatgaattcgttactaaatttttttattgataaaactgaaagtatccaacaaagtaaaacttcaactaaattaacttatgaagatttattccatttcaattaccaagaaaaatcgaaatatgatgtacctgattggtacaaacatatttgtattatttatgcttctttgaaagagaaaaatagaatactttttgagggagaaaatgatgattgggtaccggtaaacaatgtattgaagacaaataacgaatatttatctgagttaaatgatggaattgccgaaattgataaaattcttaatatcgaaactaaatataactcttcacttaaggatattccgaattttaacgaaactgataacattgtaatggaaatgaacaaaaatgaaaataatatatttagagatcaaaatgaccttcttggccctcacaacaatactgaaaataaatggtatgatagaatgattaagtattcaatacaaagttatagacaaaatgggattagaggagtaataacaatgatattagatattttttccacaatttttagtgctacgccaattggttatttactcattactttgataagattgattgcatttatgacagataagctgctgttattatccagaatgtga

SEQ ID NO: 1577 - DNA, 588 bp, Cryptosporidium hominis
atgcaattcctaaatcttaaaatattcttcgttattattgttcattttattagtttttcaattggagaacaacagccttcaccaaatgaatttctacaatatttttcaattgctgcaggtataaactcacttattttttctttgtccaatactatatattcaattaaaagtcttaataaactcaaaaagaaaaataggggatttaacgaaggaataaatgaatctataaatagatcgaaagaacacaaatttaagaaacaaataactaatgatcaagcaaatagtttaataagcactgaaaattcatacctctcaaatgaagaattggatgtaaatcaaatgaattttactcaattaatcatccaatctagtaaattggcagatatatatatggtaaaagataatctctttattggacaatccaataatactgactcagaattaaatgtctctaagagtattattgaatattctgtaaatccatgttttcctccaaataattccaaaatagaaaacacaaataacactaatgctcaaaatattgattttaatattaataaaaaattcagagggctaattattgaatag

SEQ ID NO: 1578 - DNA, 510 bp, Cryptosporidium hominis
atggcgattgactgtattaaatacattaaaaataaggatattaattattccgacaagcagatttcgagagagcttaaattagatagtatatacaattcaaagttgaaattattattgggtttgtacaaattagaaataaacaatattgaggatagctcaatttattttggccctgtatcaacaagcgtttcaataaaaaattgtaaaaattgccttattgcagttgcatgtaggcaaataaggattcatgattcacatggacttaagatccgattatcttgctgcacgcaaccattaatagaaaactgttataatatcacattcgatattcgtgcaaaaaataacgtaaatttttatataatattcgaaaaccatttgcaggaaatgggtatacacaaatcagaattcctgacaaaagataatttcaaggtatccgacttaagttggttaaaaattcaagattcaccaaattggaaatttggaaatgttgatttagaaataattgaatag

SEQ ID NO: 1579 - DNA, 900 bp, Cryptosporidium hominis
atgaagttatggtttttagtctttgccttcgtaataaactctgcgtttattgagtcttcaagggttctttcttcatacggttgctactcgttgttgggaaaattgccgcgaatgtccgctctttctcgttcaattactccgataaatgctcacgaatataatcaagaggatattagtattgtttgtatttctttagttaagggcgctgaatttaagtttaatcaacgtgattcgattattgatttgtcaaataatgctcacggcattagtctcgtattacctaaatcagaaattttatccgggctttatggatctagtttggaaccaataatcatatcatcttgtaagaaagcaaaaattcttctatcttcgcaaccaaatacgaagttgatgcttttacaaccatttatcattttttcttgtattgaagtagtcaagcaacaaactccaatccctcagacacaacctgaaaaatcaaagagtcatccgcctcaaattgactatttatcccttggatctgggattccgttcggaaaaaggccatatgaatgcagatttgattctcccacatttgcaaaggaaggatcatcgattaattacaaaaagaaacaagtttattggacatgtttttccaaggtagaagaactcttagtgattaactttttttcggaaaataacatatccgaaaaagtattactttcgattgtcgatgatatgcgttcaacttctaataagatttccgtgaaatcgccttgtaatgggacaatgcacgataataaacaaggaattctaaataagaatcaagtgtttttaagaattgaatgcgaagaagaaaatttgcctaaacttttaattagtaaagactttggacttagacagacccaattaagaaaaaaataa

SEQ ID NO: 1580 - DNA, 807 bp, Cryptosporidium hominis
atgctagatatgttgctcgaactatttactgttgtgtttgggaactcgcaacaggctgaatcaatattatctgttcttagattaatagtttatctgataaagtcagtatttaatatattcagcaacatctcgtccaatagaaagttaattggtgttacaagagttattccagaggaaatagcttatagtcctaggttgttacaattgactatggataaaattaagaagaacatggattccgcacaactagaaagggatataataaatagtcaaattcaagaaataattaagatttcagaacctgataattttgagctcgttgatcaagaattcgataaatacttgacctttaacgctacagaaaatctcttgaatgaaaccaaattgagaaggaatgcgtctgttgaagcaagaatgcatgttgcggagtactaccttatgcatgatcgtcttctatctgtatctgagtcttcagtaatggcaacagaactcaattttaagtcttggatggagaaggtaggcgcattctttgataattcgtatgaaaaaatcaaacaagtcataaagagtatatttgcaactatttttaagggtaacaagattgtcgcattcattgataaattgattgacctcatcatttcagtaataaggtcaatctatcatgcctttaagaataaaagtacgcagagacttttaattcaagcaattgaagagtgtgaagaacaggagatacacaatttacttcagaaacagctcgaaaatacattgaaaaatgaagacactcctattttgagattattactttaa

SEQ ID NO: 1581 - DNA, 603 bp, Cryptosporidium hominis
atgaatttttcaattttatttttttctgtttttattttggctagcaaaattcattgctcaagttttagaagcttttcggagaatgatcagttgtcaaaatatgaagacaataataagacgaatagtttaattactctctctgctaatcactcagatattattgaatcaactttagatagtccagtatctagggttatggatgatattttaatacaagagaagcccgtattattgaacacaattcctcacacagcattaagccacaatctgtttgtaaattcgtcaggtctattcacaaacattaccgtcatacttacatctacagttccaattgcaattgttagcccggaaaatgactcgatccatagaattttgtcaggttccgagactaataaaactctaggaagcataaagatggatcttgagaaaattagtgagaatatttcaaaaagtatggataaactcccaaaggaaataatgaatgttgtagaaaacaccggagagtattttgaaaagctttcattgcttttggcgggagtagctaatttgggtgataattctggatctaattctacggtctcagagccagcccataatgaatag

SEQ ID NO: 1582 - DNA, 714 bp, Cryptosporidium hominis
atgtactttgtttggattctattttctatatatctctttatcttatcttgcgttgacgtcatttattctgatttgcaagacacagacattttcttggttgatatttatcgacttaaccaaaatgtgattgtttcatctatttataacgcctcaaatcctaatgaatatattacaaatatttctgaccctgaaggaatttatccaataattacgaagactcctattgacgagcccaaattaattgattcagatactgtgcaaatacttggacaagaatataaagtgaaacaatataaacctcttgggttgcaaaagtgtttaaccccatcatataatattaactcttgccaaaaaatatgtgtttctggctattccggaacagttttgtccgtttttaattcttatgcattagtctatatcactcaaaataattattttcaactgaatattactaatgcttctgaacttgaagttgacggaaaaaaagtaaaatatgcaatcacaggttgttcagtttcaacgctaaatactgtgatctggggatttctgacatttactgtaattttttcatttttagtatttgcattatttgcttttgaaatcattgaatatctaaggtttaaggcagatatgaaagacccactaataattggtggtgagataagaactatttcttcaagggacttttctttagaatcattttctactgcatag

SEQ ID NO: 1583 - DNA, 417 bp, Cryptosporidium hominis
atgacgaaattcaaacttgcttattcatacctgttttttttattaatttttacagctacagatgcatttaatcctattggaaacataattatgagctcaattggtttttttaacccactattgagggtctttaagtctttttattctatggaaaaaaattcaaattcaaaaattagatataactatattaaacacttagggtatgaacatttacagagtgcgtcaaatcaagaggtcggatccagcataaatcatgctgaatctagaaaattaaaaaaaaaattactttttttccatgaggaaacagcaaatacaactctcaacattacagacaataataaaattctgaatgatacgactcaaaaacaaattttaaatcttatccaaaattttacaaatgaaacaaatactgtttgt

SEQ ID NO: 1584 - DNA, 822 bp, Cryptosporidium hominis
atgaatcctcatcatttgtcaataggagaaaggctaataattcaaagcagtagattttctttttttgtaaatcgcaatcaatttttaaatgtgagatcccaagtgtcacatatttctataatgcaaaataaacatgataatgacttaagacgtgctttagagggattgatatcaaatgctgaaaaaactagaataaataaagaaaaaagtcaaataaatgagttagattcaaaacaaattaaagaaaagaaaaagttaattatccaagaagacttcgtaaaaggaataatcgatggcattaaacaagaacaagacctacttaaagagaaaaagctaagttcaaattcggttgatctagtaattcctcagccaccaaataaaagttcagatttagactttgaagacaatgatcaagatactgtcaacgatttcaaaaatagtactgcttcttcacgaagcctatttgaacatttgagaatccccgatattgaagataatttgcctacaagtaatcgtcttaatggagagaaaactcccagaaaactacctccaggagcagaattggagttggaagaattttttgcaagacaatctaagagaacttctggtaaaaatagtccaagagcaagttctggatacggtaacaaacgattgatatcaagtaagtataatagatcagcaaaagatggtaacccatacaaaccatctgttagtacaaaaaataatgtcccttatcttgttgctacgagccatatggctggtgctgatagacaattaattggtgaaatattgggtgaatccagtagtagcttatcacaataa

SEQ ID NO: 1585 - DNA, 822 bp, Cryptosporidium hominis
atgaacataaagttattatctttccgaattctgttattactaagcactatttcatatgcctactcagaaaagaaaagacagttaatgtcggattctgaaattattacttctattaatgaaaatatatctctcttattaaaattcgaaagaattatttttactaaaagaagcgatcaggcaaaaaaaaagtgcaatatcgctttaaaaaatctaaaaactttgaactctgcaacagaaagtagaaatatacagattaatcctttaacgagtatcactcttaatggtataatttggcactcagatccttgcagcaatcccgatcaaatgatcaaacatattgagctgtataatctaataatccatagcaaaacatttagtcaaatatctgatcctaatcaaaaaaataatagtgaacaaataaatatgggcacctttaacaaatttttttcccctcgaaataatgggttaaaaaacgctgtatttagaagtaatacaatttcaaacacattgatcaagaacaaaacccatactaaagcaatttcacaagggatacgatcaaaaatggactctttaatatcaagcggagatgataataactcttcaattattgattcaacttttaattccacaaatatcctagatgcaagtgaaaaaataaatccttgttctcaaaacaaaactatcgataatagttacgcaacaaaaaaaactattaaagaagaacttgaggaattggcaaagatgaaatccgtttctagtaaatcttcaacagggttttctgattctctcagtaaaattttatcagaacgcagtgtttcgtaa

SEQ ID NO: 1586 - DNA, 693 bp, Cryptosporidium hominis
atgtctaatattggaaatgaagagaatcatattttctcaatcatagaaatctttattaaaaaaaaccataaacaatacgtgtttaattccataaggattaactcattagtgcgtgtttttaatggagtcacgccagaaattttattaaatttactaaaaaatgctggaaaaaacacggaggaaggcgattcaaagatttatgctagttcgaatactacagatgtacaaaaggtgctttgctttataagcaaagacatagttaccgttaaatttcataacacccctgatataactcttgctagatatttttttgaattcgacgaatgccatataattctatgcaactgttgttataaagaatcgtataacttaaatacctttgacttaatattttatattcagaaccaagaatttggccgctccaatgaaaatcataacagcaaaatgacgctaatatctggaagttcaagaaaatcattcacaaataagtgcatggttccatttggatcggtattaactaattatggaacaatttatgtaatttattcacttttcgcatggttggtctatatattgatggctatcaaaagatatttgagcacaaaagtctccgaagaagaaattgaaaaattatttatcaaaaactatatttcaaatcttgatatccaaacatgcaaaaaaggaaatatttaa

SEQ ID NO: 1587 - DNA, 1206 bp, Cryptosporidium hominis
atggcatgttctctgggcgagtcgcaaacaattatgtctggcaatacagactgtgaaaaatatctgtatggaagccttaaggagcttgagaaagaactcaactttttgagtattcaagaagattatatcaaagatgaacaaaaaggtttgaaacgtgaattccagcgtgcgaaggaggaaatcaaacgtattcaatcagttccgctcgttattgggcaattccttgaaatgatagattccagatacggaattgtttcttctacagcaggctcaaattattatgttagggttcttagtacaatcaatagagaagatcttaaaccacctgcgtcagtcgcgcttcataggcacagtcatgcaatagttgatattcttcctcctgaagcagattctagtattcaaatgcttcaaatgcaggaaaaacctgacgtaacatattctgatattggagggatggatattcaaaagcaagaagtacgagaagccgttgagttgccgcttgtgtgtccagaattgtatcaacaaataggaattgatcctccaactggagtgcttctatatggacctcctggaactggtaaaactatgcttgctaaagctgttgctaatcacacaacagccacgtttattagagtcgttgggtcggagtttgtacaaaaatatttgggtgaaggcccaaggatggtccgcgacgtatttcgtttggcaagagaaaactccccagcaatagtgtttattgatgaagtagattcaattgcaactaaacgttttgatgcacaaactggggcagatagggaagttcaacgtattttgctcgagcttttaaaccaaatggatggatttgaccaaacaacgaatgtaaaagtaattatggcgactaacagagcagatacccttgatcctgcgctattgaggcccggtagacttgatcgaaaaatagaatttccattacctgatagaagacaaaggagattgatattccagactattactgcaaagatgaacttgagtgaagaagttgatcttgaagaatatgtctccagaccagaaaaaatatctgcagctgatatagccgcgatctctcaagaggctggtatgcaagctgtaaggaaaaatagatatgttattctacctaaggattttgaaaagggatggaagatacacgtaaaaaagagtgatagagattttgatttctatagtgtatag

SEQ ID NO: 1588 - DNA, 1062 bp, Cryptosporidium hominis
atgaatgatttgcaaatagaatatgattatacggatttcattaattattacgataaatttaaagtaataatatataatgttttagaaaaattaccattaaatgatgaaataagaaaaccggtaatcgaatattacttaaactgtattgattataacgtaaaaaaaggcaagcatattcgtggaaaaattttagtgttaatctcaagtttaagttcagcatattcaaatataaagagagactccatttatttgttagggtgggtggttgaagcaatacaagcattgatattaattgcggacgatattatggattctggtaaatttagaagaggagcgccttgttggtatattgttcatggtcaatcgaatgcaattaatgacatttttttcctgaaaatgttatcactttcactgatctttgagctttctagtgtattcggggatgatattgttatgaaaatccagaaaatatacaatgaatctattttttttacggtattgggccaacatttagatctgtcatattttgatttatccaaagttgacaaaatatccgaaagatacttttcaatggtagaaatgaagacttctcgctatacgttttatatgcctgtattttttggcttaacactttctgaaattcaagtttcttcagcacaattaaacttgattgaagctatcctctataaactgggcgaattctatcaagtgcacaatgatgtttctgactacttatttaatgatagcaatgccgatgatatttgcaggtttaaacttacatggccactgcaaaaatcgcttgaaattgctgatgaagaaatgaaacttaagatttctgaaaactatggaaaaaatagttcggtagtaaaagattgttacaatttattaaaaataaatgagcattatttggaatatcaaaggaatgcattggattatttaattaaattagtgaaagatattaccgatgatagtttacagaaagtatttattcacctgattcaccaaatttcagaactaattacaaatagtcgatcaaatgcagattcaaataactcattataa

SEQ ID NO: 1589 - DNA, 222 bp, Cryptosporidium hominis
atgccaaactttcaaacacccattaggaatgccgaattaaaagaaaaaaagagaattagttattctttaagcagccacagaaaacaaaatttgcaaaagttaatcaatgaaagaaatagtctcgaaaaaaatgaagttatcaataaattaggtggatctttaaaagctacatctattgaaagccagatagtatgtttagaaagaggtaagttatttggttag

SEQ ID NO: 1590 - DNA, 2649 bp, Cryptosporidium hominis
atgtttcggccgttgttagattgtaatggagaaattagcattaatagattgctcggaagtcaagatctatccgaatatgtaatatccgttcgcacatttgaggatgtagtaaacaaattgaatatagttgtaagtgaaagactcatgcaattgcttcatgaagttgatgtagatattgcactagatacatgcaaaagtggttcttacctatataaatatccgcgttcttgtattggtagtagacgcttttcaagatataactttgaaattgacctagattctggatgcgtaaagtggtataaaaaaaaaactttaatttgttctagaaaagtggtatttattcagactttatatctaaatgatgtaaaccacattcttccaggatctgatagtgacttttggaggtcaaagaaatgtacaaagaaggagtatatcaattctaattttgggattgaactagtagtaataggaaaaagaaataaaacactaagacttttatgcgcaaataaagaagaatggaaattttggatggtcgggctattagtaagtcatgctcttgctcaaagagagaaattagtttcaaaaattaaaggaacaaaaaaaattgttgatgctaaacatttttacactcacgactacatcaggcgtcaatgggaactttcagatttagataactctggttcaataagcttctcagagttaatgcgtttaacaaagagattgcagatgccagtatctaaagattatactcacgctctcttttgtgaatatgataatgataataatggtgcacttgattataaggaatttagaaatttgttaactcagcttttaatactccctgagttgcgtgatttatttgatgaatataaggatccagatacaaatgttatgagtgcgaataaatttcgtaattttctgatagatgttcaaggaatggatccgtcaaactcattagaatcactagttaatgctgtattaaatatgaaagaaccgtttattgaaaggggtggtattactgaaattgggttcaatattctaatgtcttcagaatttaactccgcatttgatccattaaaaagagatgtatatcaatcaatggatgaacctatttcacactactggatagcttcgagccacaatacatatttaactggcgaccaactaacttcaaaatccgagattggacaatatataactgtattacttcaaggatgtagatgcgtagagttggatgtttggaatggcccagatggattaccaattatttaccatggccacactttaacatctaaggtttactttgaagatgtaattcgagcatgcaaagactatgctttccagatatctccatatccgattattttatcacttgaaatgcatgcatctgataaacaacgtgaaaaggttgcggaaataatattgaacgtattaggcgattctctttatattcccccaaatgatgggagtgatagacttcccaccccaaatgaacttaagtataaatttcttgtcaaagctaaggtcccaaaagaagatattagttttgatttaagagcaggggttattaatgaagataatgaaaaaaatgatctaaacccagacatattagaaattgaccttgaaatgtccaataatacagggattaaaaatgaaaagcaagccttgtcttacaatcaaaatcagactaagaggagattatattctagtctaatttcccttccaggaaatgcgatacaactgtccaattttgaaaatcgaagaagaatgagcattggttctcttgttgaaacaaaatttctgcgctttgcgaaagactcaagtatgagccttgcaaagttccatcaagatcatctatgtagagtttatccatcaggtacacgtatatcgagttcaaactataatcctttaataccatggtcatacggagctcagattgtcgcattgaattaccaagcagttggaactgctttattattgaatgaagggagattcagacaaaatggtggctcaaaaagtggctacgtattaaaaccaaaaatgtgcctaaaaaagtgctttgatggacgggtattcgatcctatgaaccctttagaaactttagagctctttgatatccctcctgttagagtgtgtatccaaatattatcagctcaccagctccctgacaatctatcgcagttctcacgtggaattgcaggcctaatatctgggaataaactttcaccatacattactatttctgtttttggagggcccagcgaagagttcaagtcatacagaacgcctgtaataaataataatgggtttaatccaaaatgggaaaacttgtctccatttacattcaatgttctttgcccagaaatttcgattattaatttcgaggttaagtcatcagattcgatacagtctgaatttattgcagcagcttcaattcctgtttcatgccttagacctggtttaaggtggatacaactatttgatgcaaattttattgatatccagtgttgtgggatccttgcgaatatttctataacaacagaattaccaaaaacatatgtgttgtcatcaattttaacgggaaacaatggaagttcatcaacaaatctacaagaaacattgcaacagtttagaggaattaaattttga

SEQ ID NO: 1591 - DNA, 1497 bp, Cryptosporidium hominis
atggagagaataactcttgtttcaaatcataatggcatatattcttttgatagaaatactgggactgtatcgcaaacattcaaggattgtaatgcatccaagtttagtgtttcctatataggtaattctacaaaatatcttgctggcttccaagcaaacaaatcaactttacacatatggagcaataaaagcgatccaatttacagagtttcacttcctgaaataataaaatgctgcgagtttcaagatgatggtggtattgtttatgcaggtggtctttcaggaaccgtttacatttgggtaataaccacagggcagcttttaaattgctggcttccgcattataaacctataaataaaataaagctgatacaaggcaattcaatattggttacatgtagtgatgattgctatatacaagcatttctgactagtgaattacttgaaagcaacaactccttaacttttccaaaaccactcattaaatggaatgctcactctgcttcaataaatgatttctttcccttaaatttgacaaacagcttttcggatatatctattatttccattggaggagacttttcattaaactttcttacattcagatctgaaaaacccttagcaaacctaaatttctcgactcaattatactcctgtacttcctcagaatgtggtaaattagttttcataggaggtggaaatggcataatttataaaatatattatgacagtatacctactctgaatagctgtatttccaagttatttggccattctgggcctgttaaagcttgcatttgctctaaggataaaatattctcatccgcaaatgatggagtaagaatttgggatataacaacggggtcatgcattgctcaactacctcaatttggagatggtatactgtctattttgaatactaatttgtcaatcagttatttatctttatctattcctattttcaaacctttacaaaggaatatttctaagtattctaatgtaatgggggttaatatcccaactaaagataggagagcagacataaaaaatgaaatttatcatctttcaaacagaacagatgctatttgttatttaaatatgtctttgctaacttttaatggcatttctaaaaagcgtttaagccaaatgaatacaatgaaaaatagtacctttacgagtgaatataataacatgatcaaacttgcagttgaaaaatgcatttctctggaatcatcaaagctgagatcaaattatagtatccatgataataactttgagcttttgagaacttgtactattccctattccaagtttaaagaaattaaaactataaaagctgaagaagaaaaaaaagttcaagtcgcaagtcaaaattttaaaagtctaccaaaaattaagtataaatttatcaagagctgtagtataggtaaattttccagaaagcaatacttaagaatgttacttagaaaaaaatacctaaaactctctagacattaa

SEQ ID NO: 1592 - DNA, 2445 bp, Cryptosporidium hominis
atgttggttaatgagcaatcaaaaaaaataaatgatagacttggtagcttgtcttataactggaaaataatgagtgatgctcctgaactttttaatttacccaccaataaatatgaagagttaggaaaattaaataaatcaaccttgagaaagaaaaatcaactttgttcaaatattaatgtaaataaagcagaccactcaaaggctttcgttcaagaaaataagaatattgtctctcagctatccaaagctatgaataaagatcattctattgaatatgagcagccaataatcgaaggttggctacataaatggactaatatggtaaacacttggaaaccgaggtattttagactttaccctggaattttatgttatatgaagggttcaaaaatcaggaaaattaatataccaaacaaatcttgctacatcgacatttattcgagtaaatgtaatcgaatttcgctgagataccccagtgattcaaatagtgacttgcatttgaaagcatgttcactcgaatcaaaacttgcttggataaattctctaatttattctatgaacacaaaagcacttcttgggaaagaattgttttttaacaaaataaattctcgtaattcatctatttcatataaagattcgcttaacattcgtaacattccttttttaacgaatttattatatgagctaataaaaacaagaaatttgattttagacgaaatttcagagaagagagttaaatctagcaaaaataacatcaccaaatatttcgacaaattaattgatacggttttcgagaaaacatgcaatattaatttagttaaacttcatgaatgcgatatttattcatcgctattcagtttaataaatacagaagaggatattggaaaaattagtattaaaagcaatagagacttacacgcctctgaattgacagaagaaatattttatgatgctttttcagattttgaaaatgatactgaatcagagaaaacattgaatactcccaatatctttcctaaaaaagatgaatgtcattgttgtttttggaaaaagaacccatataaatatcgtatgacattaccgtttcttcaacaaaagccacgctttaatttgtgggcatccataaaggaatctataacgaaggatatttcacgaataacaattccaattcagttcaatgaaccaacatcattattacaacgacttgcagaagattttaggtattcatctatactagagaatgcgtccctttacgattctagtatagatcgtcttcgtgaaataactatattttctattactccttatgtatcttcaattgggaggatatttaaaccattcaaccctttgcttggcgaaactttcgaattttcccatcgaggttttagatttattgccgaacaagtaggccaccatcctcctactacagcattttatgttgagcatcatccaacaaatattaatgacaaaattccaaaaattgggcatacaaataatcccttgtattcagtatggggacaagttggaaataaatctcgttttacaggtcaaagcttagagcttactgtgataggaaatgttaatgtaatactgaatgataaaggtgataattacacctttaaccgaccaaaattactcattcacaatataatatttggtaaactttggatagaaattgtggggattagcactataataaatcgaaaaactttagaattttcattaatcgaatatcagaaaggtggatggtttagtaatgatttgtttaatattaaaggacttgtgtttaataagtatggaaaaccaatctataaaataggagggaaatgggacactaagatttggtatgaatcttgtaaatttgatcaagagtttactaaagaaaatatcttcattaaatcaaacttagactcagaaaaggtaattaaacagagagaaaattataaactctacggggaatcagttgagacaagttcaaatataattcctacaagttgcttatatttactgtcaatttgggataaaattgaatctatcccttcaactcgcaagacagcatgggtagccgaagctaagcccttccagagcgaaaaattctttgggttcgctgaaatgacatttgaactcaacgaaatttcaccacagtatgatattaatatacctggtgtaaatatgccttgcactgactctaggtacaggccagatcagagagcatatgaaaatggacatattgagtgggcaattaaagagaagagaaggctcgaggaaaagcaaagagcaaacgcaaaaaaaaggttaaatggcgaagctgattattctccaaaatggttttccaaggaattagatgattctaccggaaaatttaattggaaattcaatcataaatactgggctcataaagaccagcaaatcgaatttgcagatttaccaaatattttttga

SEQ ID NO: 1593 - DNA, 1047 bp, Cryptosporidium hominis
atgcctggtatttatttaattattttctacatgatggtgagggcaaaagcaagtcttcatttagttgctcatagaggcgcatcttatttcgtgccagaagaatccttagctgcatattctcttgcagcaaaacatggagtgaattttattgaatgtgatgtcgtctcaactaaagatggtgtattgattttgaggcacagcccaaacttatccgagtctacaaatattgatgatttgatcgaatttagccacctcaggagaacagaaatcctttatgataataacagtaatgatgcaatcacgggtatattttcatgggatcttacatatgaagaaatcaaaagaatcaaatgcactcatgaaaagaaatacaataacagaaatccaggtctaaatggaatatatgatatacttacactagatgagttcctgaagtttagtgtttctgggttcgatggcaatttccctggattatatattgagattaaatatcccactttacatgagagaaaaggaattgataacattactgacaaattactagatgcattggatagatttggcattaataaaaagactgatgcagtttatattcaaagttttgagccatctaatttagaatatatacgcgctaagagtgaggtaaatttggtacaacttttaactagagatagtgaaaacaactttgtatatgcaattgaggatgtggaaaatggtggagaaatgaaatatgtgacttgcgatatagagtacatttcgaaatttgcaaatgttgtgtctccttataaagaggacttgatcgatctaactaacacttcaaataatactttgcctagctcaagccactttgtttctaaagcacatgaacttggtctaattgttgtaccgtatacatttagaccagagtctatattgtcgtacttcaaagatatttacgaagaatacgactattttattaaaactttaaaaacagatggtttgttcactgacgactctcaaagtattatgcaatacgtaaataatactggtacacaactttatgagtga

SEQ ID NO: 1594 - DNA, 1038 bp, Cryptosporidium hominis
atgagtaaaagcgagataaaaattttatgtacaggtggagccggctacataggtagtcataccgtaatagctcttattgaagagggttattctgttcatatactagataatttttcaaattcagaccccgaagttgtaaacaggattgaaaaaatcaccaaagttaaggttcctttctttgaaattgatattagagataaagaaagaatgttagatttgtttttgaaagagaggtacaatgctgtgattcactttgcaggacttaaggctgttggagtttctgtttcccaaccattagaatactacgaaaataatgttgtcggaactattagattactagaggtgatgaaagaagctaattgcaatattttagtattttcctcaagtgcaacagtttatttaccaaaacctacacctcttttggaaactgacccattaggggcatcaaatccatatggccaaacaaagttcatgatagaacttatgatgaaagatatttacactgcatccaaaaatacaaaattttcaatactaaggtacttcaatcccgttggctgccatccatcttccttaataggtgaagacccggaagagccaaataacctacttccatatatacaacttgtatcaattggaagaaaagagaaattgttcgttttcggcaatgactggccaactcgggatggaacaggagtaagagactatattcacgtaactgatctagcaaatggacatgtcaaggctctcgaaaaattattgaatttaagcaacacggacaaaactctagatatttataatttgggttgtggaagcgggatttccgtactagaaatggttaaaaattttgaaaatgctagcgggaaacaaattccttatgaaataataaataggcgtcctggagatttggcgagtgtaattgctgatccatcaaaagcagaaaaggagctaggatggaaggcgaaacacagtatttttgatgcatgtaagtctgcttatgattggcaatttaacaatccaaacggatattctaaaaagtag

SEQ ID NO: 1595 - DNA, 684 bp, Cryptosporidium hominis
atgattaataaggagaaaagaattgatcaggaaaggatatttttagatagctttgattattcagagctagaaaaagccgacccaacactatcaggcggttttaatgttgtatatagaagaacttgccctgttgaaattagattaatagattcagacgatgtggaagaaattggaacaacggagaatattaattttagggtaatgataaaaggaacgaagtcgctccctgacactataagatttgaaataacatgcgataatgatctttttcttttttacacacgcgatttttcagtctcagattttaacgagctgaaggttgtgcaaaatcttgtctgtgactatagcgacttcacagaaacattttgcagaatagtaaataatactatccaagatcaattgggatgttttgcaaagttttgccttagagttgatggaagtgcaaagttaacttttattcaagttatggaatataaatttttagaactgctttccattgactttcaacagactccagaagaaattataagaaactcgatttcttttagatactcctttatgaaaagtaaagttgcattaatggaaggaagattcttagaaatttcaaatctgttaagcatcagaaatccaaatttattacattatttacagaaaaattcaaattgtattagaaacaagtattag

SEQ ID NO: 1596 - DNA, 975 bp, Cryptosporidium hominis
atgtcagagtcactcgagaataatgatgcatacatatttaaaagtaaccaaaggaaaaactttaatgatatgattaaaatatttaggggtaagatactaagtaaatctgatcagttaaataataaacggaatagtattaattgtacttcgtcaactaaaaaaatcagtgaaaaattcatatttgaaaattccgacataaatgatgacaaagattctcatataaatattgctcatttaagtaacaggcttcaattacgctcgatgaaaaatgaatttgaaggtggagagattattaatttaaagcgtatttttaattattccagacccaatagaaatttttttagacgaaaaaaatcagaagaaaaattggaaattcaagagaaaaaactaacatccaaagatttatttgagcggattgaatctgctcgagatatgggcagagaaagaattaaacgagcaaatttctactataataaactattgagttatgttaagtattatgctgttgatgaggcttctgaatttattataaatgatttgagtaggagagaaatatatttactagttgagcatgactttaaacacgttttttccgacgatcttcaagaaaaaagtctacaagaagtctattcgcaagttagatccaaattatacaatagcgccattgataataaaggtattccattaatgtttgaagagattatagatgaaaaactctttgaaactaaagaggcagaggaagacttcaattttgattttttggattcattttcaaatttaaaattgcaaagcgatgagaatctaaatgcatttctaaattctataggaaccagcaatgcatttgttgaattttcaattgaatatttgctctctagaacatgtaacgtatctcttgaagtaaacagaactgtagttgactgtattaaaaaagacataattgatatagatactggaatatacaaaaaggggagatag

SEQ ID NO: 1597 - DNA, 474 bp, Cryptosporidium hominis
atgacaatggtgcagcccaaaaagaaatttagaaaaatcaaattacaagatgaaaatgatgtttggaaaagaggatctattgaaaagaatattgatgatagtttaaattctggtaaattatttacttttgatactaagatactttttaattcacgaagtaacttggatcgtaaaaaaaaaaattgtgatactattaaaaaaagatgcaagcttaagtattttaacaaggatggtgctgatgcaagtatgtccaagcagcccttggagaaggttcgtaacctcaatccaaatgaactcgatatttggggaagctcagtttcaacttcgaaaagtgtaaacagtagaatgaattatccaggcgaacttttaaggatcaaaggtccctctattcaaattcctcattccggtcaatcaatcaatccatcagagcctgataggcaagatgcgttacttagatcatcttccgttttataa

SEQ ID NO: 1598 - DNA, 375 bp, Cryptosporidium hominis
atgttaattcaagatatcgacgaatttagctgtaatctagagaacagaaggatttatttgacgattctaaaagagcaaatagaatctgcgagaagattgggagttttgtcaaagattaaaataggaaggaacacccataaggaaaatccaattggaactttgtcggaagttgatattcaatcaagtaatgggtctttaagaaagttgcacatagaagataaatcattttctagagatatcgtttctaatatttataggagggggttaatagagattccacctgccaacgatgcttactatggcagaagattacaaaaactcctcaggagaaaaagaaggtcgaaaaaaattgttaaaaaagttcggtttttttaa

SEQ ID NO: 1599 - DNA, 1881 bp, Cryptosporidium hominis
atggaaaaggggactaaagttagaaatagaacaatttcgagttctaatttctcatctaatggctatcttgtttcagtaacaagtgtgtttaatgttcccaaaaatgataatattaatttggactcaaaaactaatcaatctgaacattttaaaataattgcccagcttacaaatagtaatagactttataagatttcccccgtaacgaaaacattgtctgagaatcaaaaccaaattatttactttgatatatcactctataatgaatggtcaactgcatgttcatttgttaatacaggcgatgtaattgaaatttttggtggatacgtttctaaaaataaaaatagcataacttatgagttttcagtttcgaagagaaattcctcaatggttgtctggaggagcggttttgaacatattcctgcagtattaactcacgcagcagtattatgtagtaaaggcaatatttatcttcctgcatgggcaagaatatacaatgacaggactaaattggaacctacagaaattggtatgaataatcaaaattcttcttcagttattgaatctttggatttcaatggaagttttgagcaatttaattgcattaccaataacttagattataaaaaaagcaatgaaatttatcattccatcctcaaaaaaagaaaggcatcaagtgcttataagaatgttccccaaaccattcaatattcatatattgacagattgtctgatattattcccaaagttagcgtaaatctttatggcgttgtattagaagttggaaacaatccaataaaaagatgcggttcacgcacctcgcaaatttttttgaatgtaacgctaattgatccttctgttattgagttagttccaatggatagttattcaatttcaattcttgatgaattactttcaggaatatataattataaaaatcggccacgattaaacccaaacttcccaacaatttctctagaaatagctaccgaaggtgatgcaaacactcttccaattatcaattttggagatattataagagtccatagagtagaaccaacaatttcaaaacagaaatacattgatttgccatgtaatgtaaaaaatacttctatacgtgtttggtccattcatgacttagacattgaaagtatatattccaagtattcatcggatgaagagatttttgatagccaagattgctatttcacagtagaaaatgctataaaagtagggggaaatcagcaaagaacaacttttactaaagatgattcattgagattgttaaagttacaaagatggttttatgaattgtttcatgattttcctttcttttccatttctccttatacgaaaacgcttaaatacctttcaaattcaagtgaaaatcacaacagacaatttggagatattattgtatttattcacgatatttgtattctatctgatttttttaaaaaaccaacttctgaaaataacaagtttcaaatagaaaagaaactccctaaacaagaaaatttatgttttattgtaacagagcataaacaatgtgaaaggattaatttagatagcctaatgaaaaataattatgatcaagtatttgttgtttatgtttctgaaaatcataactttgggttaagagattattttattaacaataaaaaaccattatcatatggagactggattagaataaaaaatgtatcaatccttggtactgattactttacacacataaatggagaacttgttggcccatttactgtaatagatacgaatagatctagaattacgcgtcttccattttggtcaggagatgtcaaattaaactcaagtaggatttctcctatttcaaaaagtaaagcacttcagacgcattga

SEQ ID NO: 1600 - DNA, 831 bp, Cryptosporidium hominis
atggaaactatattgaatttatttttcaggaatactccatattcaattgttaaaagacgagttatatatttgttttattgtgaaaataattattgtagcatgaattgggctacttttaggtcctctcttgaatcaaattcactcaacgcaactgaaagttttccaaataaggaaagtggcattctaactgatgattggcttcaatcagcaggtatagatattaatacatcagttataaatcaaaatattcaaaacgattcaaaaataattgaaaatttatttagtaggaaattggaccgaaaaagttatttgatcaaatatatatcagaaagtgatgttgataatagtgatatcaaaattaaatttttgttggattcttacatttctaatgccgataacgatccaattgaaatcgaaaaatgttcagactctgatgtctcatctgataaaagcgataacgaacatttagatccatctaatactgaagaaagttgctatatatttgataaggatagatatttgcacaatttttcttcagaaatctcaaaatttccaagacaaataattaggtattgcttcggtggtactcctctttattcagaaagtccgaaaaaaataaatattccaacttgtaaggaatgtggttcaaacaaagtctttgaatttcaaataatttcttcaataatatacgagtgggaaaacttgtttggagaaaaagatattttctgtaaatgcagttctgaatggtcaacaataataatatatacttgttctaaagattgtaatacggaattttctgaagagacagcaattatacagtactttatataa

SEQ ID NO: 1601 - DNA, 1062 bp, Cryptosporidium hominis
  misc_feature (1045)..(1049): n is a, c, g, or t
  misc_feature (1056)..(1056): n is a, c, g, or t
atgaataataatgaattggtagatattattgatacattcattagcgtggaggagttaaatagaaatttagatgagtttatcgactctcatagtgaatgtatcggtgccctacgtaaatatttacttgatagtattcgcgagtttatattcggggaaagtagcactaatacgcgattaaaaactattaaaggcattaactcatccttaaaaggcttatgctgtaactttgggcatcttgtttttccctcgaatggccttattcaatttttttacaggcttataagtaaaatttttactaaaaatttttttttcttaccctacttaaatgtaaatgaagaaaatgaagttttttttcagagatcaaatgacaatgaaatgatttattgttgtgtctcatcgcttctgaccattttgaagctattgtcgaatggaaacaaatatttatatatggtatttgttaacgaaaccataatgaatataaataaactaaactcagctttgaaatacaagaaattttcgaaaaacagttgtaatcattcacaaagcattgatatttactcttcatttcttcaagctattaagttgaattctaagcatataaatgtagcagaatctcctgtttgtgttgacttgccaagggaaaataattggtttatttatttaatgggacatatcacaatacaactacttttaaatcaaattatttgtttcgaagattcatccattagagacagattaattattgcttggctcagggtactaaattcatgcattacaactagacaactagaatttattggaatgatattatacatcctgaagaacattacacttaattttaaaaaagaagtaagtaatccaaatattttctatttgataaaaaataatactgttgaatctctttatgacgaagatgtagtaaatcagttcacaaatattttaccatgctatattgcacactgcgtacataatacttccactatagttctgtttggagaatttacaatttggtacttaaatgggtttttgagggcatgcttatttnnnnnattaaanttataa

SEQ ID NO: 1602 - DNA, 1047 bp, Cryptosporidium hominis
  misc_feature (752)..(753): n is a, c, g, or t
atgacagcttatttacaaaacagtatttttggaaaagattacttgaattattctcaattccaactcaatttactaattttatcaggagaattcttgcggaaccatcttatgtgctactcaagaaataatttacttaccagtgaattgacttttcctaccccactagtaatatctaaaattattagtgagttaatagatcctgaaaccttttttttcacaaatgttgaagacatattgagaatatcacttttttttgggcctgaaataaaagattttcagaaaactttagatcaattggaatcaattaaacacgcattttttggctatgttttcaaaattaatgaactggttaattatttctctaaaaaaaaaatgactagtactgaattatatgttacacttggtatttgtaaaaaacttaataaattattcaattgtaaatatacagatttacagttgactgaaaattctcaaatattgttaagtattgcctctatggaagttaaagttcaaaatattatgctgattacaactgtatttaccgatgaatcattcagcaattttttctcttcagcgttggcagctctgaggcttgcagcaattggattagaaaataattggaagttattatggcatagaaatagccttagtgaattttcaaaaggaataatacctgagaaaatagtgagaaatgaatcaacctatgttttcaagtataactcaaaggtaatatacaatacattatctgtatnntgttccgtattaatgaggcagaataccacactatctagtatttcattatctcctgaagcaaataaattaacatcaatacaatgtcattctttttttaattccaaaaataagcatcctaattggctaatttcattacttggccctacttttgtatatctcacacctaatttattttataagtctttttttggcaataacaataatttttctaatacagtttttttatacttaaaaaaatatgttccaagctcactttcatttgataaattattaatccaaataccatttttctga

SEQ ID NO: 1603 - DNA, 3684 bp, Cryptosporidium hominis
atgactatatacgaacaaatgtcaacatttgcgcagggaacatttgataagcagcttattgagtctttattgagagaggattattatggtgctgcgacaatatatgaaagaatcatttcaaataattcagaaataaaccacttaatatttagaaactatttaaggtgccttcttaaagcaggatttcctcatattgtattgactacattattgaatacaaataaaatagttggcttcaaaacagaactcgaaaatctgtcgcaaaattttaaagagaacaatttctctaatcaattaaattatatcaatagtaacttattcatctctgaagcattggaagcttgttatcaattaggaaattgggaattcctagaaattataatttctgataataaaaataatgtagaacaaaaaattcagtccaatttaattaataatatttatatggacctttttataccttcaaatattgatacaataatgcaaaaattcgatatttatagaggaaaactgttattacaccttcatttcgcaaaatctaatattgctcaaaaagataataaatttaatgaatcttttattaacacactagaaaaagcaagaagccttttattaactcctttaagcattaaatggaatgactcaaatacaagatcaagcacaatactggaaaagttacatatacttatggatattgaatttgtatattatttttttattagattgaagaataaacaaatgattaataaccccttgatcaagaaatttgattttattgaaaaacaaaacaaattagaatggattaaggttagtgaacttttcgttctacgagttgataatgccaaaattaactctgaaaaaaagtattcattactttctcaagccaaaattacattagaagttgcaggctttgaattatcttcttttcttttgctacttgtattggaaagaagcaaaatttcaattttaaattcaaattcttctcagtcatatataaattttttaaattcatttgaaatgattgggatgcaaaatcactcactagatcaggattttcacttattaaacaataatgtttctgcttttgggattgctgattcgagtttgatggatttacattcgataaattattatggtagggaaagggttcctggacttattcaaatagataatttaattagtatttcttatttcgaaaaaatcttaggcagagatgttaattttgaaaaaatcaactggtcaagaacagagaaagaattacttgacgaatgggagttatattgtaaaaataaatacataattactctgaaccaaaacttgctagttacatatttatttaagctattccaaagaaatcagattaaagttgctattcacttttatgaaatgatcactagtaataggtcaaacgatttgttagatgatgttacattttcagaaatcaaccttgtgtacttggattgggcgattaaatcctctatgatttcaccagaaaatatcatcaatacattccgtgaaactcttgaaatacgatcaaattgtgaaaaaacatattttcagtttgcaaattatctggataattattttcatcttatagtttctagttcagaagctgaaaacaattttcctacaagttcgactacatcaaaaaacaattataatcttggatctatttttcaatgtgacgaaaccatttttttgtgtattaatatgtatttaagttgtcttaagtgtggcaattcatttatttacccttccctttccagagttttatttttaatatttaactattcaaatattattttgaaacatggaattgtgcaatcttcaggtaaatgcgaaaacacaaagatattacctgatacattttttagattaaaaaaagaaattatggaacttcccccttctctttggtatgttgttttacctcaattattaagtaggtgccaacatcctggccttgggtcaatcataatacaaccgttgatagcaaaaattctcagaaagcttccacgccaagcagcatggagttttgtttcaatgttaaaaagtaatagttctgaaagaaaaggcaccgcaatttctattctaaagatgtcaaaggttataacaaatgaagaaaacgatgaagaatttattaatgagacggatttttcactgattttagatgaatatattcgcttatttgacaacttgatggttttagcaatggactctagctcaggtagcaatattcaattgcaatcaaaagatcaaagagcatctaatagagcttcaaacaaatgtatgagtttacgttctgactttcaatctctttaccattcaatgaagagtttaaataaatctaaaggactaataattccaacacaactacaattaagttttaactactcttctattagtcatgctaaatgcaaatttttctcgaattatttacccacatgcaaaaaacgaaattttaactctgatcagcagtttctacctaactattttaaaaatagccaaatgccaaacatagttcgaaatttaataacaatttccggaatggaagatacgatttttgttttgccaagtaaacaaaaacctaaaaaaattggattgattggatctaatggagagacatactattacttagttaaaaatgaaaaacgtggtgatttgcgcaaagatatgcgtctaatggaacttgctcagctattaaatcaaagaatgtcaaatgcaaaaggattatctctaagaacgttttctgtggttcctttgtctgaagttgcaggaattattgaatgggttccaaacgtgaccactctaggaaatattgtaatgggtgaatggagggaacttataggtagctcaaaattccataggcagttattggagactcaagatattttgagacaaaattctttgcagcccgataaactgtataagttatattctgaagaaatcctacctaaatatccgccaatgcttcataattggttctttaaaaagttcagtacaaaatctagctacatttggctgaaatcaaaggagaaatacacaaaaagtacagcagtctggtcaatgtttgggtatattgtaggcttaggagatagacatgcagaaaatattttaattgatactcaagttggcgacattattcatgttgattttgactgtctatttggtaaaggatttttacttgagataccagagatagtcccatttaggcttacgccgaatattgtaatcgcaatgggtagttgcggcgtagagggaactttcactggaacctcaatatcatcgatgagcatttttagaagcccattcaataaatcactaattatgacatttctagaggctttcatacatgatcctctcattgaatggatgagaccaggaaaaacaactcaaatctcaaatttaggagggagtgttgatcctatttcatttttagccgctgctaaggggcattctcacctaaggacaatctacagaaagttgaatgggatggtagattgcttctcacaaaataagaaagttgctttagctctatatggacccaataactgttcgcaaagaaggccgttccacgaaagaggtctcggtctttcagttgaaagccaagttctcgagctgattagttcagcaaaatgtaaacgaaatttgtcgcagatgtacgcaggctggatgcctcaattgtaa

SEQ ID NO: 1604 - DNA, 750 bp, Cryptosporidium hominis
atggcattcgaacatagagaagtagtaatcaaagacttagaaattgaaagtaacccggcagatagtatatttatttgtaatcttgaaacaaagctcaggcatgattttgtgaaacgcgtctattcattactttcaattagtattgcaattacatttggcattgtttcattattttcattctatgaaacagcatcaaaatggttaatcgaacactattgggttagcgtggtattttccatttgctcgttaatttttataatattgttttcgtgtattccctcaattgctaagaaccattatgttggagtaacattgcttctactactttcattattttttgggatgagcatttctgggattgctgtttgcgttaataaattttcagttttgctcgcatgcggaattacaatcttaactttcttcgctttaactattttttcaatacaagttaaattcgatttcactggatgggggccttatttattaattggggttttaattgttctcatttacagtataatattgatatttattccacgaaataacattgcttatataatcttgggtgctctgggagttatgatattctcattttatataatatatgatacgcaactaattattggaggaaaacacagacaacatcaattttgcatagatgaatatgtttttgcaacgatttctctatatttggacattgtaaatgtttttacatatatattgatgatcataaattctattgatagataa

SEQ ID NO: 1605 - DNA, 1200 bp, Cryptosporidium hominis
atggtttacataccttctgtttctgtcctcgaaaattgttcaagagtttctccagagttctacccaggaaagctttctgaccctcaaatactgatcttatcatcgcttgaatgtcttggaatgtggctgtataacccaaaatattcttcattattatataataatacttcactaattatacaaacgttagtgacatttgcaatatttactcccactacttttaacggcaatgttatttttactccattagaaagcgaggcgaccattgaatataactatgatgcaaatttgcaagcaatttcactaatattttccttatattctttatttgcaaactttgaaggcaaaacacttatttctcaagttgtacatactctttgtatcgctgcatcttttggtccaaacattgtgagaaatcacacaataaatcgtatacaacaaacactgggctctcagcatttatctagctcttggtttgttagcgatccatggatttggttagacttaattgaaacaagtttccttccattaattacatttgattttgaatttccctacaaccttgaaacaagacgagcaaacgaaaatacattaatagttttagatcaacaatttaaaaataaaacagccaaatatattcttggggaagacactgtttataagcgaaaggttcaatctattactattgtatccaaaattattcttgctagaatagatctattattggtgccagtttatattccatgcgatcaccaaattaatgatagattcagttctttttgtaattgtgaaaattcgggtactaaatttttactattgattccagtgcttatgaacttaataaatgtgctaattaaacattcaacaggatcatcttctgtttttttttcagagactattaagaatctactgcttgtagtgctaagtacacatattactgcaacttatgatgaattaatttcgaatccaattctatattataaaaaattaaatcaaagcgaaatggaaagtaatctatgcaagatattgcaaggttcttcagaagctgatatatcaggaatcgtttctagtattattaataactatatcgaatctcccatgcctgatgttgcatctgagctaaactgtatattggaatcactaaaaaaaaacaaaagtgacaattgtaataaaacacagaattctatagagaataaataa

SEQ ID NO: 1606 - DNA, 1956 bp, Cryptosporidium hominis
atgccttttttttatatcaataatgtattgaactatctttcaatatgtaacatttctattggattcattcttgttctgaaaaaactagcccaattaagttctgaatacatagaaaataatgtcccatctaatttctcaatattttactcaacggaaacgggaaattcaagaaaaatatcagaattgttcaagaaactactagatgaaataagcattgaagccaatgtccgtgagataaactcgatactagaagaaaacatgtatttaaatagtaataattcggtgtttgttttcgtagtttctacatgcggaaatgggaactttccggcttcgtcaaggaaattcattcgttatctttcaaaaatgataaaatctgggaatgaaatatttttaggaaccaaatacactattattggccttggaagctccttatatgaatactcttttaattctgcggcttttaagcttgataaattgatctcttcacttaaaggtgagaaatattgcgaaattgcactcttggacgaagtgaatggtaatgagattgatttcaaaacatggtggaacaatatatttttaaataggcttggaatttcagattcaaaagaacatttgaacaaacatttcagtatagctgtaacgagaaaaaaagatgaatttgtttgcaaattgaaaagtattaatgaaatctcgttttataatcactctctctctgggaattgccacgtttccgaaagttacttcaagctaatagaattttggcctattaacagagaattattatgtgaaacaaaaactatcgatggcattgaaagacaaatttttaacttaaaacttaaacttcctgataaagtacaatataagacatttgatattatcgatatacttccaccaaacctcgatgaaaacattgcttttttttcaagcaaagtattgggaataaacagtatcgaagatttaaaaaatattactgttgaatttgtgccaataaataacatgagaagaaatatcagtgtcccatttcctaataatcgctctttaatgcatatactaaagtattattttgatcttatgactttacctcctcactcagtaatgctacaatttgttccttatttaaattcaatagaaggagagcttatttccaacgaaagtttttttaatgaaaataaggatccttatgagttttcttttcatttatttataaatcgttttatgaaaagtcttattccaataccaatagaaaagtttgttaaatttactggaatcagacaatatccaaggagctattcaatttcatcctcctcactcgcttcaccatcaatgattgatttaacaattagtacgtgcattaagggccaaattcctgccccattgaatgagataattagcgaaggggcgaatagaaagaattccaaaaaaattatcaaaggattgtgttcaagttttctttttgaatttgatttgaattcgcctgtactaggaatgataaggtcatcttctctcaatatagacaatgtggcatcatctgcactgatgttttcacatgggagtggtattgcgcctattagagcactattacatgaacgaaaatatttaattaatgaaaaaaaaattataaagccagcgtatttattttacggatgcagaacagaaaatgaaataatttataaagacgaacttaaggactttaaaagaataggtgcattaactgaagtattctttgctttgtctaagacacaaaaaaaatacgttaaagacataattcctttttataaacacataattttaaaggttgttgatcaaaatgattcaataatatatatctgtgggaaaaaggaatttgtttcagggatcaaaaatgaagttgcatcgatcatttctaataatcgttcgagaaatattattaaaaaaatgtttgttgaaggtagaatttttatagaatcatggaattga

SEQ ID NO: 1607 - DNA, 234 bp, Cryptosporidium hominis
atgaacttagcacttaataacgttatttgtaattcaagagatggaaatggtttttttaagatggttgagtgttatattagaggtaataacatcaagttaatcagaattagcgatgaaaatataaatactgcaaaagatgatatgactcaaagagaaactgctaggcttggaaatagaggaaggcccagaaatgaaacaagagcctcgagagttagatcttctaaatgggtgtga

SEQ ID NO: 1608 - DNA, 4587 bp, Cryptosporidium hominis
atgataggaagcgatgattcttttgaaccaaatatacaaaatcaaactgttcaatcttctatggctacaaagtcttcaaatacgtttcattccatcttcaataaggacgaaaaattgcttgaaatgagttctcagtcctctataaaggatgtgaactcatactcaccaaatattgctacatataattgtataggaaataattcatccccttcttcaagaattgtatctccaatttcaagtgcaagtttttttgttgatatgacgcccaatggaaggcatttactgcacgcagaagtagctgatgaggaaccaaatccggaaacttgctcgcctaatccccagaaattccttcaaaataggttaaatttattagctagtcgcaacttgctgaaccattatgttaattcaaacgagaacaattacttcggaaaacaattaagctctgatgttatttcgagtatacctgacttgcagtataatgaaacggctgttcaagatatggttattaataagctaagcatgtcaactcaaatgttaccagatacaattgaagaggcaagaaaaagggatccagaatttgtctcaaaagcactagaacaaactttagaatatagtgaagcgcagaaaccaatacactattggagtcaaattgaattagatgtgctaattaacgagctatctgcaaatatcattgatgggattgatgaagataaagcaatagagctcatggaaaaaaaatatggcccaaataaacttcagaaagaaaagcatgaaccaatttggagaattttccttagccaattcacatcgcttgttgtttcattgctattagttgcagggatagtttcactagcgtttcaagaatgggttgaaggaattgggattttatttatcgttttgattaacgcaagccttgcaacatatatggaaaataatgcatctaatgcacttgcgaaactagcggacttatcttctccaaaatgcacagtaataaggtctggaatcataaatataatacctgcatataatttaatcccaggcgatattgtattgttgagaactggcgatagtgttcccgcagatgttaggttaattgaagctactgaaattaagtgtaatgaagctttgcttactggtgaatcggaagatgtatcaaagcacttggtcagccctgatccaaataatcctttcccaacaaatatttgctttgcgtcaactgcaattacaaatggaacaggcaaggcaattgttgtacttaccgggatgaatacacaaatagggaggattgcgcaacaactgaaacttgcaagcggtggttcaaatagtggcactccgttacaaatcggattaaataggctcggaggatttataggatttatgtcattaatcgtattggtaataatagtaattgtggctttgcttacaaactataaagatccatctcatccgaacagtaaccctgtattcggtatcattcttgttgctgttgggtttgccgtatcatctataccagaaggtttacctatggtagtaacaatatgtctttcaattgggtgctctgaaatgtgtagaaggaaagctaatattagaaagctaccagcagttgagactttagggtgctgctcagttatttgtagtgataaaactggaacgttaacagaaggaaaaatgacagcagttaaattagctactttctgtaggaataataccaagacattaaatatatctcccacaggcaatgagcaatcaccttcttttgttgaataccaagaaagtaactcttgtgttttctcattttaccctacaagaggtagcgacccaaatggaggaatttttttgtcatcttctcttacacaaaatattaaagaagaaataatgaacctaatacattttaataaaaacaaaacaatagaaatgacagaaaatcatatttttgaaagtaattttgaaatacctccagatgacagaatcccatataaattcattaattacaattcaatttgtaaagactttggggaccctttaaatagccatcttccccaaactaaatatgttaggagtgcgcttttagcaggatacttaaacagctacggaactgctttagtgtatgataatgaaagcaattcatggaaaaccagaggaaatatgagcgaaggagcgatagttgtagctgcagccaaagcatcttatggaataaaaaataaaatttttgactcaaggaaacaagataatgaatcaaaacaaagtaatacaaagaaaagtggtcatttaattcgttcgaaattaaatgatcagaactttaaaatcattaatagtgggaacaatcctgctactgaagttgctacttctggtagctctcctactcaatgcgcactcaattcgaactccactgacagcaataaactaaaaaattatataattgatggagtaaatacagaaaataagataaatttggttattgaagatgaagttgagtatttaagggtcccttctgtagaagtaccatttacttcttccagaaaaatgatgatgactgtgcattctctttccacaccaaacaaatttggagatatatttttttcaaatactgattcaaaatcaaataaacaaactaatattcaaaataaagtttcaaattctaattctcagaggtattcaaagacagtagataaccttgattctggcgtttacactcatgttgcaatattaaaaggtgcccctgacagaattgttaaacatataggtttcatgcttaatacagattggaaaaatgaagaaccaatggttcatatagattattcggaaaaaataaatccaaaggaaatctttgaaatagaaaacacgaataaaattttgagtggggaagctttgagagttctaggaattgcaattctcccattaactagtgaagatttttttgatttagtcgcagaagaatgcagcgataaaaggttacaatatgttttagacaaaaatgaacttactcttttggggctgataggatttcttgatcctcccaggcctggagttgagaaggcaatcaccaagtgctgtgaagcaggtgtaagagtaattatgattacaggagatcaacaaccaacagcatgtgcaattgcaaggtcaattggattacttgcagatgaacgtgaatataacaatagttacgaaagtagtgcagacttacataatgcaacatctgggtctattatttgtaaccaattgcatgagaacggtgatgcttctagaccgcatttatcaaatgagttatttgataagattgtttcatctgtaagcgtattttgtagagctcaaccagaagataaaatagcgattgttcgttcacttcaaaggcagggggaggttgttgcaatgacaggggatggcgtaaatgatgcgcctgcattaaaagctgctgatattggagttgcgatggggataagtggtactgaggttgcaaagggtgcttctgaaatggttttgcttgatgataactttgtgactatagtaaatgcaattgaggaggggaggaaaatatattcaaatgtacagaaatttgtcgcatttttacttgggacgaatattggagaaataatttatttatcaattgcaattgcagcacaacttcccattccaatagctgcacttcaaatactgtttttaaacttaatgtcagatggtgggcctgcagtagcactcagcgttgatcccccagatccaaatatgatgaaagttcctcccagaccaaaaaaaagcccaattatgacaagagactggtggatatttggaaatattcctcatgcaatcttcgaggctatttgcgtcctttctgtactgataatttcaatgtatacatctttaggagtttttcaaaggaatgcgattgaatcactttgtctccatgattcaaataatagatacttctgccaaactaatgaatggagattaaatttaattgacttagaaaaaaccggatgggtaacaaatattgatttttataaccctttaacaaacagcatggaacaaatcttaggtgttactaaaggaaagttaaattcaacactctcaccttctgaaattccatatgttaaaggtttatacgaaaaagcggagagattgggaatttcttgcgtagctgggaaacatggttggtgcattcctcaacagaagatcacaaatgacgagtatattgatttggttgctttcggtacaataagaggcaggactgcctctttcattgctgctgtattctgtgaaatgctacgagcgtatactgttagaacttgggattggtttacaaaacctctatttaacaatccatggcttcattttgcttgtagcttaagcgctagtagcacactgattgtaacgttcacgcctggcttacaacaaatttttggaactcatacaatatattggtggctttacattctagctattggtgcgggatttctgaatatggcatttgatgaattagtgcctaagcctctataccgaagaattgtcgaaagaagaagaataagggcaaagttactagctgagagagatgtaaattggattactagatctgagcaatttgaaagtacttag

SEQ ID NO: 1609 - DNA, 2961 bp, Cryptosporidium hominis
atgtacaaatctgcgcatgaagaattttttgattttatattaaaatcgcatgtaagcgatccaaagctaagtctgagccacgaaactaaattcaatgagtcacttgaaaaaaaaaagttatctggtacacctactcgaaacataaaatcagaattggatgagaatgtacatacgtctaacaaatcaagaaaaaaaaatcgaaaattaaatattgaagataattcgatgcttttgactgaaaatccaaaaacgactaatgacctacttaaggagttggctcagacagttaaggaaggacaatctttacaaaaagatgtagaagtattgaaaaaagttgtctttaatcaaaattcaagatctaaccaattctgttttatcccaaatggccttgaaattgtgggatataattcaactgaacttgatcagccaaaagacaacttaatttcgaatagctatttggaagaaaaaaatttaggcttttctggccaactggaatattatgtcaacaatattgaatctattgattacagtcaaaaaaatggaattcaacctatatccgtaccaattctacgtatgaatactattgatagccgaaaaaatgtgttcaatactcattcaattgcacaacactttaaatttaatttaatgaggattttgaaaagaatcaagcaaacagaagaagttcaagtatatattagaagtttatatcaacaacttaaatcagaaatgatttgccatattgaagaagagaaggctattgtagctaaattgattgatgaactaaaatcaatacacaatataaattttaagtacaaaagtagtttaagggagaaagacacactaatagttaaactaaatggttcaattgacacattaaatgttgaaaataaagatttgagtgaaaaatatgatactatttttaaagaaaagagattattcgaaaaagaaatgagtactcgtttatataatttagaaaaagagaacaatgatcttaagtctttcgtagaaaaaatcaaggatgaacacgaacaaacaaaatctgaactaaagaaagcaaaagaacagtcgagtgaatttgacaaatttatgtctcagcttaagagtatgggaataattgagaagattgacggttcaaaatacctagttaacaataaaaacaggacactaaacgatgaattgaaatttttaaaagatttactaaaggataaaagagacagagaagagttgctacataagaatatttcacagttatctgatgagaacagtaaattaaatgcaagttataaagaaaataaaacatgtttagataaaaaaattcgagaaaattgtattttgcagtcaatactagaaaactataaagaaagaattggagagcttgaagaaaaaaattgttcattgcaatctgaaataaataattggaaaattaagattgaacttgggattgaagaagaaaaaaagacaaaaactagaattttggaattagaatcggaattgcaatcttgtaagcatgaattgaatgcaaagtcattggaatttaataattctttaagtagactcggacaagcatatgtcgaactgaatgaaacaaagcaatcacttaaagattctaaatatgaattggaaaattttagagaaaaaataaagtcgatgaatagagaaaataaggaattaaatgacgcactctcaagccaatttcatttaaatagaaagaaagagatcgaaattgaatcattaaaaaaggattatgaaaaaattacgaataatttagaaaacgaaaagttatctaataataatttaaggaacaagataacagaacttgaaataaattgttcgaaaatggaaaatgaaagatttgagattcataaagaacttaataatagatgcataatcgaaattgaaaaaaaagaatctttggaaaaggtatcaaaggaatacaacgagttgaagaaggaattagtgcagaaagatttgcaaataaacaaactcaaggatgagttaaaagagacagttagccgctttgaaagtgaatctttaaataaaattaatttattagaaaaccagctaaatgaaaaatttaaacgtgaaattcatgcaatcgaagaatcaaaaagaaatatttgtattgaaaatgaaaacttgcttgaagaaatgatccaccaaaaaaagatgatacaagaactaatttatgagaaaatatcgttaaacagtgaagttaattcattaaaagaagctgcagaggttagtaaaaagcaatttgaaaactcaatccaaattctctcaaaggagctgtcagcgctacaagaattgggaagcagtaaaattattgattatcatgaagagagcaatattagaagttttattaaacatattttaaaacagaattcggaagttgatttactggatactgaaaattgcattaatcaagttgagttacaccaaatacaaagtacaactgctccaccaagtaattatagtgtattaaaaacagagaatgattattttagtcttgatcaaaatatatttaatgacaaattcttaaatacacctataatagaatgtagtgattttttccaagttgaagcgtccttatctgctcaatgcgaaatggcgtatattgacataatttcacaaactgaaagatttaaagacctttcaaataaactcaagagccttgaggagattttgattagaaatggtgaaaagagcatatcagaaatagtactaactcttttttgtgaccttgaaaatatgggtatttcgtctagagagctacttaagatagtgaattcagaaaacaagtcgaagattgaaatagacaatgagctttcaaataaaataacagaaataagccgagcctgggttcttgaagcagaagcttctaaacaaatacttgacaatgctcataaaataagaaatgccgcagcaaaagaaagaatgatgtggatagaaaaaaaaatttaa

SEQ ID NO: 1610 - DNA, 867 bp, Cryptosporidium hominis
atgttaagaagaaacgcacgacaaagaaaagaatacatttctaggaaaggtttagaaagagttgaaaagaacgtattcgaaaggagcgttcgttttaaggaggctctggacgaaggaaggcaaattccgacagaatataagaatgtttccgataagattgttgcaaatattgacctttttgatacatcaatcgatcctaaatctattgttgatgatgaatattctttatctgggttatatgaaccaaaaatactaattacaacatctagaagcccgagtagtaggctgttacaatttgttaaggaactaaatttggtaatacctaatagttttagaataaacagaggtggctatgttttaaatgatttcggggacttgtgccgatcaaacggagctacagacttagtagttgtacatgaacatagaggagagcctgatggcttaattatctcacattttcctcatggaccaactgcatattttgccataagtgatgtagtgttaaggcatgatctctcgatcaaaccatcagccatgtctcaaagtattccccacttgatttttcaaaattttaattctactcttgggttaagagtgtctgatattttaaaacatttatttccgaaactaaaaaacacatctcaaagagtcatttcatttgtaaatgtcaatgataatattattttccgtcattttagttgggataaagatatgactgacaaatcagaagagattcaactgaacgagattggtcccagatttattcttaggttatataaaatagaacttgggactttagagatgaaaaacttatcaatagaatgggcacacagaccattttttaataaaaaaaaaacttctttgtga

SEQ ID NO: 1611 - DNA, 1290 bp, Cryptosporidium hominis
atggattgtaatgcagtaagctcactttcgtgggttccaagaggatacgcgaaggaaatccctattaaaaatgctcattataccatgaacgacgaagatgttgaacaatattttgttagtcacaatatcgagcatgaaataaataatcaaacaaagactattattgacacaaacttgaatacatctggtagagatgacaaacatagtagggatttttctttttatggtgaaaacttttttcatacagttgagagaggcttatctaaatttggtaaagacccaaatatgaaacaggatcaatttattgattctgatgacgaagcactacaaataaaagcaggtgattcactgttggcaacaactacaattgaagatgatgttgctaccttgcaggtatatttatattcaattgaagatggaagtttttacgtgcatcatgatgtcattattggagattatcccctttgttcagagtggatttctttggggtctcagaataaaaacaatattgttgcagtcggatcatttaatggcgaggtaaatctttggaacttagattttatcgattcaattgatcctatattgacattatatagtgatgtaggacattctgatgcagtaatgagtttggcagcacacaatggaaattcaaagttattagcatcagggtctgctgatgaaacaattaagctttgggatttaaatgaaggttcctgcattatcacttattctaattctacaaataaagttcaatgtttagagtggcatcattctgagaacaacatattaatcgctgctgattataacaggtctctacaattgatagatattagaacagttggccgtcaagctttactaaattacaacaaagagcatggggatccagaatctattgtattgcccagtgcgggcatttatgataacggaaatactgtcataatttctacagaaaatgggctaatttcagggtatgatatcagaatgctttctgaaaactgtgctaaaagtagattttcagttgtagcaaaccacaattcaaaaccgatcacatctatttgttgtacatctatttccaatatgttggttagctgtgatttagatggtatttctaaggtatgggatttgtctcatatgaaggaatgcgtcattgaaaagcctctcaaaggaggaaagctatttacttgcaaaagctgtccggatgagaaggcaatagtagcttttggaggtgagtcaacaatcctttggaatatttctcaagaagatgttgtatcaaagaaatttgatgtatga

SEQ ID NO: 1612 - DNA, 201 bp, Cryptosporidium hominis
atgagggtattaagtggaaatacgattaaccaagaagtattggaaacactaactgatatatcaagcttattgagcacaggattagataaggaaaccatattaattttaattaaactattagaattgggcgtacaaccagaaacattatcagaattggtgattgaaattcgcagagaaatagaaagctaccaaatttattag

SEQ ID NO: 1613 - DNA, 1674 bp, Cryptosporidium hominis
atggaacaaaaaaggtcatcaaatagatctatttttgggaatgagtacttaaaaaaaggttctttaactcaaaatgtggttgttctttgggcatctatttcaccttcagcagttttactgcttccttcgtgtatgaaagagaccggaattattcttggacttttaatcatgttcttttcatgttttgtgctctttatgactcaatttgtattaatgaaatcagctgctctactttcggcagataactatggaaacactcttttgaaggctattttatttaagagctcagctgatacaatagaacaggtaaataacaataaagaaagcgataaaccgacggtaaatgcaaaaattattgcattttttgttaatctacccatattttttgctatggctattacattaccatgttttctaatcatttggtgttcatgtattgaacaacttatccctccattttcaaccaaatttactacatcaggtatttcgtataatcaagtatttctaatgacactttgtgcagctgctatgttcccattctctcttagaaaagagcttcaaacaactaggcatattagctggttatcattgatcgcaggttttctatttgcaataacagtcattcaatattacttttactttggagcatccttggatcgcggaaaggttgtttggtggaatgcagatattaaattattaccgtgtataaagatgctaactgtttcttgttttacgttttctaatcatgaaaactcacccgcttctgcatatgagcttttaaaccccacaacaagcaggatacttgctctttctagtactgtttcaatatcaagttttatattattttcagttattacagtattttcctatctaacatttggagaactaacattacagagcgtagcactaaactatggcaatgaaggtaaattgctcattttatcgaaagtttttttgagtatatctaacttagtagcttgtactctttcgcttcatgctgcaatttcatcattatcaaatattatagtagcacttaaagggaactcacatgacatctttgacagtaaattaactcatcaatccacaactgtaactgagcctgtagggtacaaccagttttcaactaaaggatcttcgtgctcatctacaaatacctatagccgttcctctctctcaagtacactcgataatattgaaagacacgaatgctttctaagtcttgatgaaaaaaacacgaacaaaatttcagatacctcaaatatatttgatgcctccgtactagattctctggaaaatggcaaaaataaattaaataatatttacaaggacagaatccccattaatactcataagcagagaaatgactcagaggtacaaacatctgtggatacgaaggtaagagcaattattgtattcttattcctagttttttcgatatttttggcaactaatttacaggatttgttgttgcttgtagaagttgcaactggtttatttgaaactataatttgccttgtttttccagctgtagtatatttgaagttattcaaatatatatttatttgcgacaagtacttatctaggcctgtctttatacttcttacatttatttgctcacttggttgttttacggcttccatttcagcaatatttagtgtccgtagaactcattaa

SEQ ID NO: 1614 - DNA, 1083 bp, Cryptosporidium hominis
atgagaggtttattaatatttttactatttctatttaaactctttgatggtacctttggaaagtcttactatgatattttagggataaaaaaaagtgccagtgatacagaaattaagaaagcatatagacaaaaaagcttgaaatatcacccagacagaaatccgtctccggatgcatcagagaaatttaaggagattgcaacggcttatgaggttctagttgatcctgagaaaagaggcatatatgataaatttggtgaagatggactaaaacaacatctcgaaggctttcaatctaatgatccatttgatcttttctcaatgggattcggaaatctatttggaatgggctcagggagaggagatggtgaaaggtatagggttccagactcgacattcaaaatatttatgactcttgagcagctttatttcggagaaatgatcgctatttcatttatcaggcccgttttgtgcataaatgcaaatgattgtttaaagaataggagtgattgtgcagctgcagggacaaaactctttactcagcagatgggccctggatttatggtccaacatcaagttaatgacccaacatgtgttgcaaggaaaaagggatgggataaaaattgtaagcagtgccccaatgggccgacagaactagagactgcaaaattaaccgcatatattgatccaggaatgtattctggcgacaaaatcaggtttgagggctcaggagagcaaaaacttaatcaggagcctggtgactttatcattgtaatttttgaggttgagaataacaaatttaaaagggtagggaatgaccttcataccaatatggaaattacccttgctgatgctttgctagggtttaatcttccattaaagtatattgatggaaaaaatataaatattgagaagaatgacataacttcatttggagatgtacttaaagtcaagaataagggaatgccgattcgtaatacaaatgaatatggtgatttatatgtaacattaaagttcaaaatgccatcagaactgaatgatgcgcaaaagcaattaattagacaggcaattctagatacttaa

SEQ ID NO: 1615 - DNA, 1287 bp, Cryptosporidium hominis
atggctagtagttcaaaagagaaaataactcatgtgggcttattcggaagttttattagtgaagtagggctgaaaaacataaaagaatacagctataagagtgggggggttacatttttagattatgcaatgaatcctttttgggagttctttgcataccaaatcccagaatgtatctctcctaacttgttgactatattcgggtttttatgttctcttattgcaatgttattaacaatgatgacttgtccaatgctagatagtgcaattcctttaaatctctcattattcatatccctacttttgtttctttatcagacttttgatgcagctgatggaaaacatgcaagaagactgaagattagctcacccttagggcaactgcttgatcatggacttgattcatacacaactatttttttttcaacaatattttgtgcatgttgcaagatgggatggagttataaattctttatttttttgtctatagttcagtttaaaatgttctcatttatttggttggagtgtcactgtaagatttttcggtgctcgtcctcagattatttaggagtaacagaaagccagttgatcgtgatgttttttacagtctattcttcaacaaatggttttaatattttatttaagaatttattcttcaatatttcgacaattgatttaataatattatctattattgctacaggtttcattacactaataaatgatattctgtcaggcctgggtgagtgtagaagcagaaattcaaaaaaagtcgcatctttggaaatttgtggtgtattgtgccatttaacgttccaatttctattcttaagttcgaacacatacaaaaaattcccaattatgactatgttcattttgactacaagcagttcaattgttgcactcagaatgaacgtatcatcatttacactcgaagaattaccttatgtacattggccagcactccccttttatacttcttcggtatttcttttatttgggagaaatatattcggcaagttttttgactcacaagtaatattactaattgtagcattatggaatataatatatacgatagactatgtatccattattatcaattcaatttgtcatcatttaaatatttctctaatctctacaaaaatcccaaatggcaatagtgcggaaaaaaatacttctcataaagctacagctaataatttctcaaataatcgagcagaggatataagttcaaaacttaaactatctatatcgcgttcatttaagaagaatcatcgtaattaa

SEQ ID NO: 1616 - DNA, 1137 bp, Cryptosporidium hominis
atggtggctcaaggtaagcttatacattttgaggttgaacctgtaaaacacggtgaagagattgaggagaattctaacattaagtttgaggacatcccggttgagtgcacctgcccattttgtaaggaagatatcgttacacaagtggaattagaaagctcatggtttacttacatcacctcggttgccttatttctaataattggttggatcagttgtccaattttgcctttaatctggactctaattcaggattcggttcatacctgtccgagatgcctaaataaaatatccaggaacagacgtattaaatgcccttcaattaaatctgagataatgacgctgaagtgtgggagttgtgcagttgtcttaacaagaaggtatgtaattactatatttttgatattttttacaataattgtttttaccacgcttcgaacattgttaaaaatatatggtttgcctgatattgaacatgggcctcctatagaaaattcatggatgatgttcatcgaatcatgcggtgttaaatcgtatttgggaaatcctattcgtgcagttagagaattcgaggatagctaccagtataagacagtctcttggacaggaagagtaataaaggttcaagaagggttttggaaaaagcattttatttatataggtatgaacccaccgcagattgtaactaattctggcaatccaataccagatcttggactcacgttcaatgaggatttattgccccaaatttctaaaattaaacccggggatcttttagactttaatgctactttggtagaatttggtaaacgtgggcaccctcattttggtcaaatgtggaattttacaaagttggatgatgagttcaatatgatagatatccttctaccgagacagaagagcttacttctcatgataccactcattgaaatgatgaatcaattatcggaacaactttcaaagcctataggttcagaagaccaagataaacattcaagtggacatgaaggtattttaaattcaaatatacaagatattagcgagtttgatatagcgaaaaggtttcatgacgaaacctacagactaccagagtcaagttccagttcaatagacgagtctgaaaaaattgacaagtaa

SEQ ID NO: 1617 - DNA, 3312 bp, Cryptosporidium hominis
atgtttaaaataaaagagctcatcctttcgatattagtgatatatttaaatctaacagctagctattgcagaagaaatagaaaaacaaaatactcatctgaaaagaatttatataataatgctgatgttaaatactttgaagttggcattacttcaaatacagaactcaatacaataaaaagtataagagagcatattaatctccttgaaaattataatgaccaatcatatgattcagctgcaaatttgacgaactcaaaaaatttcagcaaaagtttaattgatgatgacgtattgtttatggagtcgtttatttcttcattctctgcacaatcaaatatttctgcaccattttcaacaaatggtgtgacaatccattcaattcccattcactcaacaaattgtaattctgatataatatttgaaacaagtaatgaagatattaatgtatcaacaaataatcatttgatttctaatctaattcctgatttagatcaaattaatagaactatttccgttattccttggaaagtgattaataacactattttaaatttggttcctgaaattcgaaaaatatcgtacgagtttgctttaatttgcacatcaataagtaataatattgaactgttaaaattttattcaaatagttctgatattaagcatgtacaatgggaagcattacagatggcttcctttgcaaggggttattcacgatatgtacttgaaacagtttctttagctgtctcattagcatctatatcccctgactctaaagacgagccttccattttttctgatatcaatttttactcaataatcaagcatccgaataaacttctaaataaattaaatgagaatcggcttgaagagaaagagaattatgagtgtatggatttttttggagaaagggatgttaatggctcgtgtattttctgtttctctatttttttgactctatattctcgaattcaatgtcaatatgtagaagttggaatttcgcgtgagtcaatacttggtgttaggtggttggaagaaattcattcgcacatttaccaattaaataagtttttattatcagtatggaatcattttgttattgaaaaacaccctaacagttctcattacactcctccaaaacctagtatttcttggaaggcctttaaattgaaactttatgaagagtttagaattgggcttaatttacaacagagaataaagctcaattctgaattggatttaagtgataatattttttttaaccgttactccaaaaaagaatcggatattaataactctattgaactaaagtttatggaatccattacaaattcattagaattaaatcctgctgaaatgaatataatcgaagaaactattcgagtttataacattattatagattcaatgaatttttcacaaaatgaaattttgttaggatctattacaaaactaagtaactcgttaatgtcagtagcaataatattaggaacatatggagataaaaatttgattaatttaacaatccaaagtttgaaagaaaaacacactgatattttaagtgaaaaatgtaaaaaacttcatagagaagtgataactaacgattattttgatcaaaacacattcacaagcatttttgtaaaatacatttactgcaaaaataatttaggtttggaaataagtaagcaagtttcacttcagtataggtatgaactaacaaagaattttttaagaaaaatattgatttctacaagaaattcattatttgaaagaataagagagagagttagtgcatcaaaagttaatgaaaaaattaactttaaaaattcttttactaaatttttatcacagtttcaagtaataatgggattagtcaagataattagaataaagatggaggaaataaattctagactaaatgaattattagagctaacagattattatattttaaatcttgaaaagttcaaaataaaacttataagctttattttcaatgatagatacttttttttggagaagtcaatagttggagagttaaatgatgcatcttacccaattatacctattacagtttctttaggcccatatttattcgatattgctggtagtaatttaaaaatgacagtaaataagctgcgttcaaaaatatcgctattgaataaattgatttcgttttcaagaaatatatttattaaaagaagatataccattaatgatggttcaaattaccatactaagaacaaaattttattttcaactgcacttagaatttacaataacagagatgagttaattgtaattaatacttttactatttttttgtataagactctgaaaaatctcggaagaacgtcactaaagactgctattacaaaaaaactaatagacgaaaattaccgctttgattttgggaaggatgatagatgcaatttaaagaacaacatcttatctttgaaggaaactgaatttattggatgtaagttgttcaataaggtgattgaaataatacaaattgacgagctttttagtttattacagaaacagttcgtcaatgttgataatgctgagagaaaaatatattacgagattagctcactgtttgatgaaatttggaccatccacaacttaaatggaaataaagttgtatttaaaaatttatcttcaaagctttacactttaaagagtttattagaaaatatgttaatttttagtggcattgcaagaaactccttagtaccttatataaatgatatgaaaaactctgaatgcttatacgactttttattaggtagtattagtagttttgagagtacagttaaagaatttccattcattataaactcaaaggggccaagtgcgttctttaaaaatattgcaagcgcaataaaaggaatattctctagaagtgaaagaataaaaaacagagaaaaacacattattacaaaagaagttacaaagtttagcaaaatactgtcttcattggagccatatataataaatatcgatatttccttcaacttaaacgtcgaaaagctacgcttcatcaagatagaatctcaagaaagaataagaaaactattctatttatacacgcattgcatttattcaacattaaaaaatacaataatggttggaaaccttgaaaaacattttccaacagaggtcaaagaagaatggaatgaatttataagacaattgaatatagtccaagcttcacttcttggacagttatatttaattttggtaagaaatttttatctgtacgaactctattccttttttaaagctttattcatacaattggaatag

SEQ ID NO: 1618 - DNA, 993 bp, Cryptosporidium hominis
atgaattcaaatgtaggtagtgaaagaaaaaatgtagaattgaattttgcaaataataatctatcaaacaataactcttctatcgaagattcaattaatcttcaagatcaaaataatcacgacaatttttttacggaaaatattactatttcagattcggaagacaatatttcacttgaatcaaatttttcagagaattctattcataagcttgattctaccgaaaaaacaagaatttatgtgccactttcaattgaaactaaagacgacaatgcattcttttcaaataaaagtaaaagcttgaaagattccaaaaatcaaaccaaaattttattaaagcaaaatgctgattatatacaaagttctgagaaaagacttaagaaaaatagaaaatacagaataaaaaaagatgcaataaacacggaatttgaagaaaaagaaaagaaacataataaaaagtcatcattttgttgttgcctacagacggaagacaacaaaaaaaataaaaattccaccgaagatcaggctcccaaattgaatgattttacggaggtcaaattacaaaatgcaaaagtaaaagagcctaccgaacagaagtctctagaagacaaacctaagaatacaaaagatattgggcacaaaatcaacaaaattcagttagagaaggaacttgaaaaaaagccccagttcattgaaactagacttaatattgttaatgaaaagagcccaaaaagcaaaagcctagaaaatatttacaaaatatttgaatataaaatgaatattgaaatcccgaaattcaatgactcaatggatttggggttcttgtcaaaaagattcggagagaaagaaaccaatcaaaataaaccatcatctgtaaaatttccaaatttttatgaaaagacaattactgaaattatatccgatactcttagttggtatgaaatgtataaattaaatagagtaaaaagactagagggaatcttggatagttga

SEQ ID NO: 1619 - DNA, 534 bp, Cryptosporidium hominis
atgattttgaatattaggccagatatattgcatcagtgcctgctttcactactggattctccactgaataagagcggaagattattagtatatattcgcactatgagtaatgtattaatcgaagtgaacccacagctttctgtcccaagaagctttaaagagttttcttcattaatggtcaacttactagtcaagcgtaaaattactgcagttaatggaaatacttctttgatgagaatagttaagaatgatatcgataaaatcctgcctgtgggaggaaaaaaatacgggctttcacttaatggtactcagaagagcattaaggctctgattaatgaattatattcaagtgaagactccaaaatacgcaatagttcagtaacatttgtggtcggtgcggtcgcttatggcgatccaatacagagttgtgattttatagaagaaataattagtattagttcatacccactatctgcagcgctttgttgttcaaaaatttgcaatgaattcgaatatttgtggaagatttgctag

SEQ ID NO: 1620 - DNA, 807 bp, Cryptosporidium hominis
atgaaagcaaaggcaaatgaagcttatattattattcgagaatcgctagaactcataattaaattatgtaaaacaaaccaaaacataattgagtctctccctaagggcccagaattatcatacgactttaatttatatcttgaaaaatatatacatgatcaaattaaacctctggaaatagttgaaatgaatgcatcgctcatagaagcaaatggtaaagaaacgctcaagcttcctccagggattagagtgtatacaaagctaagtaaaatgactacaaatgtcaaattaaaggtttatttgacattaccatttatgggatcaaatacaataatcgaaaaaaaccaactcacggagtatattttcaatacatattttatagaaacgaatattgaatctgaaagaaaagatattttaattaagctatctggagattgtgtttatttcgaaatttcagatatattattttccggttttcccggtgttacagaattgtcatattatattggcgtccaagtagcttttcacagctcattttcaaaaataatatggaaaaaagtcaagactaagctaccaactgaatctgagataattaaaggattctcaaagaatgggattaaaagatacttggaattatattgcagaacttggggccatgaaagaaaatgtgtgcaaaacatattttctgcagcaaaattgtggaacataatcgataatacgccacgcaaagccgaattaatcaaggtgttaattacgttattggaaaactcatataaaacattgctaatccattcacaaaatttttag

SEQ ID NO: 1621 - DNA, 732 bp, Cryptosporidium hominis
atgaataaaatatctcttagatttttatcaattatttatatttttttttcgtttatatttgagaaaatttttgtgcttagtacccacatatcaaaaaatctaaataatgcaaacttgaacattttggaaagaattctaattgggcaagcgcttgaactacctgttacatcatcttggcaactacttcttatttcactatcagataattgctatggcttatctattactcaagatattaatgaattttttgaaagtaaaggcaaaattgagaaggaccttgaaaaatcattcaaattctattctcaccccgcaatcaacatatcatcaagcatattagtatatccaaagcccgaattcctagaatttatatttaaatttatcgacactattaactttgcgagtaactccaaatatataaatgtttccttgctcataaatgacaaaaggaacctggttgcatgtaactacatggttaaaaagatgttaaaatatggatttgtcctccaagattctgatcgtaaagccactccacaaaaccagtttgaaatcaaccgaaatttagggaaggctacgaaaaagaatttggaatattcgattgaacacttttgtcaatcttacttattaaagatggtcaaattgtttgataaacttgcagacataaagaaaaattcaatcaagaacttaaagtctaaggcattgttatataacaaaatctgtcaattactaaattaa

SEQ ID NO: 1622 - DNA, 1365 bp, Cryptosporidium hominis
atgcgtgaagttatttcgatacatgtagggcaggcaggaatacaaattggtaatgcttgttgggaattattttgccttgaacatggaataaatccggatggaacaatgcccatgtctgagcaaaacatgggtatttcagatgatgcattcaatacattcttcagcgaaactggagctggaaagcatgtgcccagagcagtttttgtggatttggagccaactgttgttgacgaaattcgtagtgggacatatagacaattgtttcatccagagcagcttattaatggtaaggaagatgccgctaacaactttgcaaggggccattatacagtagggaaagagatattggaagtatgtttggatcgaattcgtaaacttgctgacaattgtacaggattacaaggttttcttatgtttaatgcagttggaggtggaacaggagctggtctcgggacattattactagaaaggctttctgttgactatggcaaaaaatctaaattgaatttctgtacatggccatctccgcagctaagcactgcagtggtagagccatacaacgccgtcctttccactcactctctccttgaacatgcagatgttgccgttatgctagataatgaagcaatatatgatatctgtagacgaaatttgaacattgagcagcctgcttatacgaacctaaatagattaattgcgcaagtaatatcctctttgaccgcatctttgcgtttcgatggtgcattgaatgttgatatcaccgagtttcaaaccaatttggttccttacccaaggatccactttatgctttcatcatatgctccaattatttccgctgaaaaagcttttcacgaacaattaagtgttgccgagattactaatgcagtttttgaacctcaaaatcaaatggctaagtgtgaccctagacacggtaaatacatggcatgctgcctgatgtacagaggtgatgttgttccaaaagatacaaatgcagcagttgcaacaattaaaactaaaagaactattcagtttgttgattggtgcccaacaggcttcaaatgtggaattaattatcaaccaccgactgttgtgcctggtggggatctcgctaaggttatgcgtgcatgttgtatgatttcaaactcaactgcaatagctgaggttttcaatagaatggatcataaatttgatttaatgtattcaaagagggcattcgtgcattggtatgtcggcgagggtatggaagaaggtgaatttagcgaggcaagagaagacttagctgcgttagagaaggactatgaagaggttggaattgaaattgcagatggagaagatgaagaagttcattacgagggcgatttctag

SEQ ID NO: 1623 - DNA, 1518 bp, Cryptosporidium hominis
atggaattttccctatttagttatagtcaaaagcggatccttgctgcaggtgtgttgtctttattatctggatatgtgatcggtgtgactaacataccgagggctgttttgctcaattttttgtccttttcttggatgaaatggtctatgcatgtccgtggctatcaaattaccaataattgtataaattttgagagttttatcatggttctcatcaattcctcacttttacttggtgcttccataggctctattgcttctgtgtttgtggaaagatattttggtaaggttaaaggcattctctctgcatattttttgtttggtattggttctgtattttgtttgaacaaggatttagtaattttcttaattggaagggttctatgtggtgttggagttggattttcatgtaacttagtgccatcttatatttttgagctcactaacaaacaaaatcaaacattattttcgactttacacaatgtattattttgctgtggaatattacttagctatctactttcaatcggggctatgtatatagctgtttatatcgttaaatttaggagctctgttaacagtattaatgaaacagatcaaacgataaccaacattatttatcatgatcctgcgagtccaatgattcagagcaatttgggaatatccaaaaaaactggcatagaattttccattattgaccattcatactctattttgtcaattagaatcttgttcataatacctataatattttccttgattctttctttaatttggattttaaagctaaatggtgatactccatctcattatataaaattaaatgatatccgtgcagcagaagagactacaagacaaatatatggaatattcgacacaacaaggattattagtcagcttagagaagaaaatgaaagagaaagtatatcaattcttaaacttttcaaggctatttctaagtcaccgatgcggaatgtatttattttcattcccatattaatttgtactgaagtttttactggatatatcccattggttatgaacagcaagttgataatatcacactttggtatcattgaccaagtatcgtcaaattatgtagtattaactggctgttttttagtgaactttactttatctggtgttttctttgaattatatattggaagtaaaaggctatatatattgggattaattttagttatattttcatatattccaatttgcttattattattcttttcaaataatttaattccaatgagtcaaccctttataatttcgcttatttgcgtattcgcatcattcggacttggtatagttcctactgcatggaagctcgtatctacttacatgacaatacagttttatttttcagttgcgccttacatgtctgcgctattttggattaccgcagtgctctcaactattttatccgaactactcccaatacttgtatttacatttattcaattcatgctttacctttttcgtcttaatttcattttttataattaa

SEQ ID NO: 1624 - DNA, 1311 bp, Cryptosporidium hominis
atggtttttcagaaggaaaataagaataataatgactgggttgctaactacgatgcacacaatacccaattaggtagcgctttatttgagattacagagaaggcagctaaagtcaggacaatattggaaaaaaaacgaaggaatgaagaaatttgcaatttaatttcatcatctaatgaacaaacattaattaataatattaaaaaagagatagcaagggaaaatcaagcatcattttgtaaagttgctgacttaattgaatcaaaaatattggattttagtgaacaaaataagaaatgcataaatatcaatattgaaagaagcatagaggctagcaatgaaacaataaaaataaactcatcagaaataattgagaaattactctcaaatatcatcaaaagcaacgatttgaatagtttaaatgagtcattggctaacttgttacttgaacaaaaagataatattaataattcattaaaagaattgatcaacactataaatcagaaggaaagtaagatttcacaagaggtctgtgaactcattagggaaaatggtgaaaaagaaaagtcaatttatctctctcaacttaatattatacaaagacaatacgaattaattattagagatttgagaaggagaatcatgtttttagaacgcgatatagaatctaaacaaattcgtgagaaaaagttatgtgaagaaatcaaatcaatggataataatgctaaagaagcagttttgatatttggggaaaaagatttaaaaattaacttcttaagttcacagataaatcaattaaaagatgaaaataaagagttaagagaagaaattactattctgttaaataaaaaacaagaaatcacgatgaattattcaagtaaatattgcttattaaagaacaagtatctatttctcgggattgaatttctaaacgagactctagaaaaaattatttcttcgaggcgtaaggaagtattcaatattctaaaatacaactctgagttcaattctatcaattctaatatgaatgaaaattcagcaatggcgtacagagactcaaacaaatacaatattaatactcaggtgcgaattaagataaatgaaagcaacttatttggtcttctagatgttgaaaagcgtattgaagaacaagaaaaggagcgaagtttaattaatgcattgttaagcatgattaatggacacaactttgcacagttagcatcgtttacaaaaataattaaccaaaagagaatggaaattttgactaaaatatttacaatacttaagaaccagaaaaatataagtccttaa

SEQ ID NO: 1625 - DNA, 918 bp, Cryptosporidium hominis
atgaattgtaaaaacgctattgagaataaacacacaaatagtacatttaatagccagctaaagtatttggcattactctcaaccattaggcctcttattatatggtgtacaacaagttcgatattatctttatttagcactttattcttatattttaagtttcagaatgggattataactacaatatctgtatcaatattttcaaatttagtatgccagcttgtttttctcttgctattatttagcagagtgatgagcattactatcgaacactacttaacagcatccttgacattgtttaacgatttgataattacttttccaagatatgttctttgggaattgatttttacatcaagatggatatggctatcattacacttcttttctgcaacgtattcaatttttatactttggaatatttgcacaatgtttttattagaacttcctaattttttgtcaacattttttttcgttgctggcggattatcatttattcgtttttttggaaagaatcaaaatatcttcttgttgtcatctcaaatatctataaaaccaatattagtgagatttaatctaaaagaacaaaataactttttattacaattccttgaagtaattgattattttatttttaatggcttctcagggaatatcaagaattcatttatttttacgatactaactttatttataacattacctatatattactttgggataaatattcctggaatctcaaatttttttaatcttataaataagttctattttttaaggatgggttttaaattgaagaatgaattcaactcgtttatcattgtattttgtatttatttcacttcattcattacgggctttttttattgggattggattgaactacagtcaactaatatcagaacttatcatcaatag

SEQ ID NO: 1626 - DNA, 5388 bp, Cryptosporidium hominis
atgcaaacctggtcatcggaagttccattaagtaggtttgatattgatgaattttatttaaatatagatgattataaaaatattaactacttatcaaaaaatctaacttattcaaggcatgggacatttattgaaagtgttgatttatttgataatgattattttaatattacaacttatgaatcttcaactatggacccacagcaaagaatattattggaaactacaagtgatgcattacatagctcaggatataacccaaagaatatttccaactcaaatattggtgtatttgtaggatgttccgggactgactggaactatctttccacgaaattaaatatgacagcaacttcatttacagcaacaggggcagctgcttcaattatctccaatagactttcatttatctatggtattaaaggaccctctgtaacaattgatactgcatgttcatcttcattagttgcattagatattgcaaaaaaagatattaattttggtaaaataggaacagcaattgtagcaggcgtgcagcttttattatctcccttgtattatatagttttttccaaagctaatatgcttagtcctaggggagaatgtagagcatttgatgaattatctgatggattcttaagaggagagggttgtatatcattgataatagaaaatcatttacaatccttcggaaaaaaaatatatggtcgaatttgtggtacagctgtaaatcaagacggaaaaagtgcgagcttaactgccccaaatggaccttctcaaaaacgtgtaattattaatgcaattgaagattcttgcatttcgaataatgatatattttatatagaatctcatggaactggaacacctttaggagatccaatagaattcggtgcaatatcggatgtttttaaaaatagggcgaataagctttacattggaactctaaaacctaatattggtcacttagaaggtgcttctggagttgctggaattttgaaagctatattagtagttaataatggagtaattcctccgaatattttaatagataacttaaattcaggtttatcttttgatgattctaatatgaacataatatttcctacaaataaagttgaaaccaattcaaaaagtttaattgcaggagtatcatcatttggatttggtggaacaaattctcatataattgtagaaacaggtgatagtgtgaattcatgggaattacctagaatagatttcaaaagaaaaaaatttccatggattaagccaggacatccatatattggaccaaaaatctcaggatctgataatttgtctcacccgtcagaattaggtcttataattgatgaaatgagcaatattacaaatattaaaaaacctgactcaaatacaaccagatttgtaagaaatgttggtcaaaatgtgttctcatcaatagttggtcatgtaatacaaggaaagattatttttcctggatctgcatttattgaaatgtcaataggtggaatcattaattactctattcggagtggaattaaagatataagcttacttactattagcaacattcaattcattaagcctttaattttcccaaatgaattaggacggaatcctcaaggaaaattaatatgtgacatttctccatatgaaaataataatagaaaattaaatatacgtatttcaacatcgggaattgaatatggtattgacgaaatgatctatcattcaacatttactgcagaaattagtaatgttaacgacaatttgaagttttctgatgagacaataaactttgataaatgctcaaattttaattctgatcaattttattcagagttaaacaaaatagggctaaattattctgaaaaatataaatctattaaaaaaatatataaaaacaagactgagatatttggaattattgaaattgatcctttaaatcgagaaattgatacatttttcttacatccttcattattagatggatgttttcaattatttgctttatttattgaaaatcatgaaaataaagccaataaaccatttattcctgtgagtatcgaagaaattatatttaaaccaattttcaataataataaatatattgttccttataactcattaactaacctgaaatttattcatccaataaatagattatttgcttgtattaaaaataaaaaaatactaaacagggaagaaataaaagtagacataaatatatatattagagacgaaggaactgatgggttaatacaaatatatgaaattagaaatctgcacttcaaagaattgattccgataaaaaccataaattatcttccaataaaagatcattactcatggataactacttatagagaattagaacacaaatttgatagtgatgaagaattaaataagctaaagtttctttttacatctttagaagtgaataaattatcacttgaacagtttgattactttgataacaataaaattctgaatttgattcaagaaaatattttttccttcagtactatacctgtatatattacaagcacaaacgaaaaagattcgtataaagagcttatttttatacaaagaattcttcaaaacatttataaaaatattgattcatataataaattaacaattatttttgtcactatcggtgcgaatttattatgtggcaaaaatactttatcatctcactttcaatcatctttactttcatatttaagatctgcaagcaacgaattcaatcaattaggaaaaataagtttgattattgttgattggaatagtatttcaaacctaaaaattaacaaaaacttttgccaaatattgaaattgatatataacaacgttatcaataaaaaatggtttgaaaaagaatatcagttactagagtacaataatgaaattaaaatcaaaactattaaaataaaagagtcaattagtccatataataattgtatggctttaaagcttacaaatagaggagcaatatcgaatattataaccaatttacagaagtttagggttgttcctatggaaggggaagtggaaataagaataagagcaattggcttgaatttcagagatgttttaaatgttatgggattatatcctggcgatcctggaaaaccagggagtgatttttcgggtacagtagtatctgtagggcctggagtgaaaaatattcaagttggtgacgatgtatttggtctttctcagggttgtattgaaacatatcatactacaaatgctttgttggttacgaaaaaacctaaattattaacatttgaagaggctgcatcaatcccaacgattttttcaacagtaaaagtttctttaaaccagtattcaaaactaaaaaaaggtgattgcgttctaattcatgttgcttctggtggagttggattagctgcaatacaaatttgttctagaattggtgcaaacgtcattgctacagttggaagcattaaaaaggttgaatatctcaaatctattgggattaaatttgtttcaagcagcagagattatacaaaattctctcaagatatgaaatattttatgagtgaattgaatattgatggtgttgatattgttataaatagcttggtaggagaatttattccgttgtcaatgaaatttttaaagagaaatggaacttttattgaacttggaaaacgtgaaatattaagtgaaaatcaattaaaagaaattaggactgacatcaattatcaaactgttgaattcgacaagttagttgaaaatgacattgtttggttccagaatttattacaagagataatgatagatataaataaaggaaaaatccaaccaataccaactaaagtatttagtattcaagataaatcaggaataattgacggatttaggtatatacaacatgctaaccacatagggaaggttatactgtcaaatccaagcacttcaatttcctcatgcggtaaagatgcatacattattaccggtgggatgggctcacttggtttggttgttgcaaattggttagttgaagaaggaacgaaaaatattatattaatgggtaggagttcaatagattttgaaaataaatttgcaatcaagctattagagttaagtgagaagggaaaaataaacttggaaatgcttaaatgcaatatttgtgatttaaattcactatttaatattattaataaaattaaaggaaaatataatattagagcaatcattcatgctgcaggcgtccttaatgatgcgagcatactttcgcaaactgattcaactttcctgagtacatttcttcccaaatctatcggggcctggaatattcattacattataacttccttattagactatattccacttttaattatgttttcatcaatatcagcactaataggaaacagtgggcagactaactattctgcagctaatggcaatatcgattatttatcagagctacggtctcaacttggaatgaaatcaatcagcattcaatggggtccttggggtgaacaaggtatggcaaaagaaaacttaaatttaaaaatgttaaaagcaattggactagttccaataaaaaattccttaggtcttatctcactaggaggaataatttctaattgtatgataaggaaagttaataaatatattgtacaaccattagatccttcggtcgtaaaaaataatggattaacacgcattttcagtgagattgaatcagatgtacaagaaaaaagaaatggatatctcttttcaacaatgaactcggaagaattgcatttattcgtcctttcaagtattaaagaagcaatttcagatgcaattggaattgatgttaatcttattgattcagaattgccatttaaagacctgggaatcgattctttgtctgcagtagaattaagaaatactctaacttcaaaatttgaagttaatcttccaccaactataataattgactatccaacaatttcagaactttgtaaatatatagagatggttattggaaacaaaaatgttaaggaatttgataatacaaatataatacattctaattttaagaaaagtgatatttttatatcaggaattggaatcagagtccccggggatgcaagttcagtttttaaattctggaaaaatatgattagtctggtaacctgtatatctgaaatcccttatgaaagatgggatgtagataaattatttggaaattataatgacaaaaatgcaacatattatacaaggaagggaggatttatttctatcgttgatattttcgactactctaaatatcaaatatcgaaagaggaagcaattcaaatggatcctaatcaaaggatagctttatatacttgcttttctgcattatcggatgcaccaaattga

SEQ ID NO: 1627 - DNA, 615 bp, Cryptosporidium hominis
  misc_feature (540)..(540): n is a, c, g, or t
  misc_feature (590)..(590): n is a, c, g, or t
  misc_feature (595)..(595): n is a, c, g, or t
atgaacaaatcaagaaaaataacagtaattggtaattatgatgacaaattttcgaaaataattctatctttgggttgcaaattaaatattgataatttatctaagccagattgtttaatacaaataggtgaagaaaccaaattatttaatattaatcaagacccaattgctaaatttagaattggaattaatcatgaggtgacaaatgaatgcaataatgaaactatacttaatcctaattatcaagaatctaatcaacttaaattagagttatcaaatccttattcaaataagacagaaaaaattaactttgttaataagtttggattaatactaattacaggagaaatgaaaaacattactttgataataaactgtttatttgctttgggttacaaaaaaattgcattagttaaaatggataataatgctctttctgaaaaaatttctgaattcggagaaaatattaaactatttaactgtttacctaacaaggtttcgataaacaattgttttaataaaattatttccgaatatcanaatttggaaataactggttatatccacttaagctctattgaaatacttanaacanatcaagaaaaaagtgaataa

SEQ ID NO: 1628 - DNA, 660 bp, Cryptosporidium hominis
atgattattgggaatatacatttaaaacaactaaatccatatattgttcattacgaaaaactaataattccaaaaataaacacattaatttcaattgaaagtgaagtagcttttgggtcggtttcatcatttggatttggtggtacaaattctcacgtaatagttggtgtggaaaaaagtgattttgatataatttcatatattcaaaggtctaaatttaataattataagagaaaatcatttgaatggaaaaattttccaatttacgattcaaataaaccaattattgtatatacaaaaaacagttcaggaatttttgaaaaatgtgattcaatattattaaataactttaacccaaatattgaaaacatatttagagagttttttaatctcgccaataagttacagaataacaatgaatttggggtcagaataaccaggtttaggcactatgctcaagaaaaaaatgatttatatttattaacttatgaaaattgcaaagacaagtatcatgtatctctatggtctattgaatataaattaattagagaaaaagagatatttttggatatgttctctcgaggaatttcaattatttcggaatgcattatagacaaagactatagatttgaatattatttatttggaacaaaatattga

SEQ ID NO: 1629 - DNA, 798 bp, Cryptosporidium hominis
  misc_feature (746)..(746): n is a, c, g, or t
  misc_feature (785)..(785): n is a, c, g, or t
atgaaagataatattgatattatcaaatcttcaacagacaactcttatccagatttattgattactgatgaagttttaaatttagacctaataaatataatggataataatggaaaaattatatcaattaattcaaaaaatataaattattggaatgaaattgaaagaaaaaatattacatacgacaatatttccatcattgacatacttagtaaaaagaatatgaatcaaaatttcgatttaaatcaattaaaaaaagaaaatattttcaattttccgattttaattcaagaatataattttgataatttaattatagataactgtaaaaactttaattatttgggtgaaatcgtatattcattaagatctaatttatcagaaaatatattttctttcagcaaggaattattcacttcatttaaaaacaatgaaatgaatgcgtcaaaacataatttacgtaattttattatcaacaaattattaaacaattattctagtattataataattgatggagattatttttcaatagaagatgcttgggaaatttattattcaattacattaattcaacttagcttcagggaaatctttatcatattttcccaaaataataaaaatatagaatacaaatatttagcaaagaaaattatagaaaacggattcaaagcaatgattgaattaaaaaatttcgatcaaatagacaaatttaattcaataaacattcctatcttcatagactntaaattgggaggttttaataggttattgaataatgatcntagtttgttctaa

SEQ ID NO: 1630 - DNA, 3168 bp, Cryptosporidium hominis
atggaatcaaactctaaagttgttggattaatccatgcatctggggttttgaatgattcattaataaaaaatcattcaatagagaatttggagaatgtttttagacctaaagtttttggagcaattaatttacatcatgcaataaagaacatacttccatacaagctaaggttctttattggtttttcctctatttcttcattatttggtagttttgggcaatatagttattcttcagcaaattcatatcttgattcattgattaattatcgaagaaagttcaacgaatctagtattttagatctaagcatacaatggggaccatgggcagaacaaggaatggcagcagatttatttcaacatcattcatcatcaggtatcaaaccaatttataattcagaaggcttaaaatgtttatcatcgatctttgatataattgaaggtagaatcaaagatatcatcctgccctctgaaatcgcaatagcaaatattaattggagcgagttcttaactatttttgaaggcaacccaccaatcatttttagtgaaattaatagcaaatttttaaacaatgtatcaaaactcgagagtggttcaaaaattaaggataaatttgaaggaattactgacattcgaaggcatatagaggaagttttattaattattgcatatgaaatatttggaatggagaaaaataactgtgatttaacagaaattgattctttaatggcagttgagtttagaaattctatatctaagaattttggaataaaattgccaatatctttaatgctctataatccaactttagatgaagtcatttcatatttagaaggagaggttaggaaagagttgtttggatctagtacagaagaattgacttcttctaagtctaggagatgggaagaaatcagacaagatattaatttagatggaaagatttctttgttatcaaattcttccgatgcggttcgtggctttagattaccatctggagaaaaaaacaaattacgtgaagtatttttaacaggaggaactgggtttatggggacctgcatgattgaaaatcttgtaaagttgaacagtgatattaagatttggtgtttggtgagatgttctgacaaaaaaaacggtaaagaaaagttattggttgcactttataaatattcagttcagaatgcagatttaattttaaaaaataacatcaaaattgttgttggagacacttcaatcccatattttggtataaataaaactgaatataaagagatagtaaattcaatagattccattattcatattggtgctgtggtaaacttcacatcttcttattcaaatattaaaaatgtgaatgtattaagcattgtagagttgctaaaactttcttctgctcccaaccattgtggcaaaaattgtactgaaaaaggaaaatgtaattcttgcattattccaatacatcatgtatcaactttgggagttttttatgatcatattgaaaatcctccggtagagccgtatttatctggcttggaaaatactgaatttatggaaagaacttactttttggatgatggaaggagaatattttacgaagatgacccagtgattacaaatgacgatgaaggaactcatcacaaatcactattattgggttattcacaatctaaatgggcagcagaaagaattcttagatcagcaagaaaaagaggattccctatagctatatatagaccgggaagaataggaggaaacagcattacaggcgcatcaaatatttcggacctcccaaatgcatttgtgaaaggatgcattaagatggggactttacctagaacaaagatggcaattcatttagtttcggttgatttttgttgtcaagtttgttgttttggaatgaacaatccgtctttatcaattaataatgattttaatttagactctgaaggatgggcaaatatgaatgatataaaaacagcacttaaattattggatattgagttagaaatggtagaattcgaagactgggttgaacagttattagacgaaacttctaaagacagaaatcacccacttaccccattacaacacatgtttgttaaggaaaaacctgcagactcaattatgccatattttgatatgaaaaacacaaataatctaatatctaattctgaaaatattaaacatgtaccttgtgactcaaattatttacttacttgtttcaagtatttgcttgaaaaggattggatttattcaattgattctattaatagaaccatgaataaggacgtttgtgtgaaggaatatattttcgaatttataaatgacgaattgaaggttggcaatttcgaagttgctaactttatgatatttatttgcgataaattgtttatattaaatatccaagaattttgtaataaaatacaatctaaatataattgcaaatgcattatagttacaattccaaattctaaagtcgacaatattttaagttcattatcccacattattcatgaagcaattaaagaaaatatttcaaaaataattgataaaggaaattcaaaaataatattggcaagttggtcaatatcaagcaatcttgcgttgcaaatatataagaacttaaattataaaattttggattatgacgtaaaactattgttgattgatccggtagttccagttaaattaagtgatagtaatgactcgagaatagatgaaatttcattcaaagttttaaagaaattagtaaaatcctcaagcttactatctaactctctcacagaaccaataatagatatattgaataattctgattcaattatagatgcatacaataaaataactagctacacaaaaaaagatccagaaactgagtttgaagagttgaaaaacgtattagagagattaagaactacattcttaataagcttaaatatctctaagtccgtattagaagttgatgaaaaagtatattttgttttgtcacgctcttcaataatgggggacgtattcgaaaagaacgggtcatacgcaatagttaatgctcaaaatatttacgaaataagggatttagagctagcacatttatctgatggaagccatttcacaatttttgatttttcaaatgttgaaagtttggttaatggactttcaagaatttttaattag

SEQ ID NO: 1631 - DNA, 2052 bp, Cryptosporidium hominis
atgtcaaatatttcaaaattgaaaaaactagaagaacttagaggtattatgagccaacatggggttgacgcatatatcattagttcaagcgaccctcatatgtcggaatatactcctgataaatacaaacgaagagaatttatgactggtttctttgggtcacagggaatttgtcttgttacacagtcgagcgcacatttaattgttgatggtagatatattgtcgaagcaaagaagactgctactcctgagtatcaggtccatttgttaaaaaagggcttttacgctgatattgtagatattttaaaagaagaaagttttgatggtacattaggaattgacgttgaggttacttcttggatgtcatttaaagccttagctaattatattgaactttcagatctacatttaaatacgaacttccgaataaaattactaaatttgaattttgtcgatgttttacggccacaagaagagattgaacaaggtagaagtgagatttttgttcatggaattgaatacgctggtgaatcatctaagtcaaaggttaacaaagttttgttggaaatgaaaaaactgaatgcaaagatattgtttctaagcagcctaactcaaatttcatggctacttaatttaagaggttcagatgtacattgcacacctgtatttctttcatatctaattgtcgaaattcttgatgatacagttggaatagataagaaggaaacatcatttaatcttaaagtttttgttaatgttgaatctattaagtgttgcgaagaagtattgaaaaatgaattccaggacaaaatttctataattcaaattgaaaatataatggatgaactctttcattcatttagtaaattgaattcacatacaaaagacaaattgaataaaatatggctgcctgagaatttttgcaacttagcagcaatggacacgttatttaaagtattgaaccctcgtgaaaattgcaataattcgagttactataaatatttaatcgactacttaaactcttcaaaattactgataacttctgagtcccctatcatcatgctacgtgcaataaagaacaaaatcgaattaaagggaatgcgcgagtgccatatttatgatagtttagcacttactaaattcctatattatttgtacaaggctggaagagataagactctttttaatggaaaagtatccgaatgggatctttctcaaaagttgcttgaatttagaaaacaacaaccaaaatttgtctatccaagttttgatacaatttcttctataggagaaaatggggcgataattcattatcgtcctgaaaaagaaaattcttcaattattaagcctgatctttacctttgtgattctggcggacagtaccatactggcacaacagatgtaacaagaactttgttcttgttcgggattggagaagaaaggccaacaattgagcaaattgaatcatttactcgagtattgataggttttattcgcttacataagctagtattcccaattgggacaaatgctactgcaattgacgttcttgcaagagccagcctatgggaggctggtttagattatttacatggtactggacatggggttggctcatttttatctgttcatgaagagccctggtcaatttgttataaggttggaagggatggtgcttctaaacaaaatctagctgcaggcgcagtagtttcaattgaacctggatactatgaagaaggaaaatacggtataagaattgaaaacttggctgagattattgaagcagatattgataatggctacaaaaagatgaataaatttctcaagttctcacctcttacatacgcacccattcaaaaagagatgattgacatttcaattctttcagatgatgaactagattggttaaattggtatcattcaaaaaccctggagaacttagaaccgctggtagatgatgaccccgagtttttgaaatggctagttcaagtatgttcaccaataaatagatatatttcaaaaattgattttccaaaaacattataccagtaa

SEQ ID NO: 1632 - DNA, 1086 bp, Cryptosporidium hominis
atggaggaagataaagaagaattatactttttaaggaataaagtaagaactatcgagtcaaaagtcagagattatgaaaaggaattagaaggggccaattgtttgaaagaaaagatactattccttgaaaatgaattagaaaggattacaaaagaatttaacgaattggaaatatttcaaactgaacaacttagaattgcagatggtgaaattctttctcttactgaagcgaagaacaccctttttaaagaaatgcatttagtaatgaaggaaaatgaaggtttgaagctaacaaaatctgtaattagcagaattgaaactcactataaaaagatcaatgatgaaactgttttgcctaatatagaagaagaattaaacgatgcaataaaagactttatggaagataggaatttcaacaataatgaagcgtctttgcttgcattcgaaatatgtcaatcaattattccaagacttgcgtatgagattgcagaagaaatagttgttaacctcgataatggttctaaacaagatgaaaaacttaaaaggtcatttattaaaaaaaatgcgtccattcaggtgggctttccccttctgaatggttcaacaatagaacattcagaaataggtattatttcatccagaagcgaattaatatcgttaagaagcgaaaataacaaattaaaaaaggaaaatcagaaattaaaacaggatcttttcttaatgaaaagaattaataatcggacaaaggatcatgctaagataaagtgtacaaaccgtatgaatccaaggcaaaccgacctaataaccgaaagccaacaagaagaactagttcttagtggcataaagtggctaacctcagttgttaatgaaatagatgagcttgaacaaagatgcagtagcattaaaacttgcaataaaaaatcagaatctaggcgctcaagtgcatataattccacagttgcatcttttgaagagattaatattgatattaacgaccagcaaaatagggacgaagtaagtcttgataaggaattgataacattaagagagaaattaataaacgaaggaatcctagttggagaatga

SEQ ID NO: 1633 - DNA, 411 bp, Cryptosporidium hominis
atgagcgatttagacgaattaattgaagaatatgatccctatattgaaggaaaattttctgagaatttagatgaaagttatgacgaaaatagtatggaattttgttctccaagatttggtgaattaaactactctgaagaaaattctggtggtgaaacagataaaggagaagatatacacatttacaaagaaggtgatttacaactttattctgattcagaagaattaattgaagattttaacaaagataaagaatatttattaacagaaattggcaaaaataatgaaaataatgttattcacaatattcaaaaatctaataatcttattagcaaatataataaatcaattatatctccaaaaaaactaataaatagtgatgaaaataatgaacccaatctgggaaactga

SEQ ID NO: 1634 - DNA, 2046 bp, Cryptosporidium hominis
atgaataaaggagctgcattattagaattatctagtgaatggtttttgaataactataaaggttcaaatgacgacttaaaatatgcaaaattgatttgtaaccgaaattctataacaaatttagctaaaaatattggggaagaacttcattatcaacatttcattaatacagttattaaattgggaagtaaagtaattgaatttaataatagtaattcaatattttgctattctgttgacttagtttatagtttgttttcattattacagaatgaagtatcgatgtattcgattaaggtagaggccattaaagatgagtttattatgctacaaaatagcttacagtcaattaaacttttgcacgaaaagattcaaaatttcattgataaaacagttgttagttatgatttaatagatgaaataaagaatgccgagctcaataaggattattatattcccttgaaaagtttattagacaaattaaatactataaaaaacacgtacattagaaaaacaaaaataggaagggagctttatttattatatagctcattgtttaatattgttgtaaatagaataaagtgcaatttaaattcgttattttccaataaagaatctatgttcataataatggaaacaggatattcaaattcggtcacattttctgaattaatcagattgagtaaagtcataaaggaattaaccttaaatgcaagcgaaattgatttttttagggaaagatatattatgtttgcatcaaggctgttttcacaaattgttaaagaaatagaagggctttgccagaataaatacgaacaaggtgttataattacttccaaagattatgaaaaatatcactcagtactattcgaaagagaacaaattttaaacaacttttatttgtcgatcggtgaacctgtagaggaatcatttttttcaaagccaaaaaagatatttaaaatagaggagattttttttaaatcacagaagatgatatataaggcattcatatcgatcttcgaatttactaggcaactttttgataatgcattaaaggatattctacatcaaatttttgatgatcatttgataaagactttagaattatttcaattttcaatattgaaaacaaacgatactaccggtctatcaatattgtacaacataatactcaaatttaagcgtcttactgaatcaaagttgaaagtctttgtaaatgctataacagattcaagctctttgtttgaatattatggcatgcaaagtcaaacaatttacatttcattggagtcttcaattattttccagatttattcattgtcttctctctcaaaccgtgaatttatcaaattatgcatttcagacaaacgaccgcatctaaatcctattactcgcagagtttcagaattattaacggttttaacaaaactaatagatgaaccggatggtcacaacgatcaaataaagaaactaattgacagagttcaatcgtccctaatcaattggttgctgtcatcaaatgaatttttgcaaaatgaaaattacattggacctgaagaaggttgtatatttataattaacaatgctgacgcgataatttcagtgttacgaggaaaaaacggaatttccttggataattttcagcatttattccgtgaatacacacaaaaatatattgaatatcgcttgaataattcatattctggaataatgcaagttattgattcaaaattctgcttaagcgaagttaatatagaatatattaacaaaatactcacaagctttaataatacttggaaaaaaaatattgatattgaattacaagctacattaacgtcattttcaaactttcatacaagcgaggagatattaagactgcttggaactaccattgcaatgagatattccaagttcataaatgccataaaaaatgaacacgaaataagcggattattggaaaagaataaggtagatattgaggtaatattagattatattcagagttgtttataccctactaatacaagaactgacttatttacctga

SEQ ID NO: 1635 - DNA, 321 bp, Cryptosporidium hominis
atgccagacaaagacaaggaaattaaggtcttaaaaatgcaattagactctaatctatctattgcgtacttgaagctccaagactatccaaacgctatacactatgcaaataaggctctggaatatgaatcgaataatttgaaagcattacaccacaaatgtatagcgctattcgaattgagcgaatataaacaatgcgttgaatgtgcggatatagctttgaatgttgagcccaacaatgttgttttcaaaaaagttaggtataatgctctgttaaaacaaaaacaatacatttcaaaaagcaaaaaaattgtaagttaa

SEQ ID NO: 1636 - DNA, 1068 bp, Cryptosporidium hominis
atgtgcaattcttactctgaatggaattcgtgcataaataactttgaaggtccagatggttttgaagatatatacaatcctggagtaggctcagtttttaccacaaatcaatttcatgaacttacattacctgcaagagcaacaattggagatgaatatatttgggtttctcaagaagtagaagaagatagtattcattcgaaccaaagattattcgaaggtttaaatgctactcaagtgtgtaatgaactggaatattcagaggctcccaactattggaataataattttagagagtatttaactagttttcaagcacctaatcagaacatatattcaaatacaaaccaaacttcattaaatgcagatgacacattttctttaagcaataattgcggtagagtatcatctgataactcgtcagtctctcacacatctaccttgcatggtgtttgggtcattccaaatagagatagcgatactaatttagtgacaaataaaagtaaattcgatcattcatcggatgatgtttcatcttctattgaaacgagcaattcagaaatacgtaggaggcttcacttttcacgtcaaaagtcagatataatgatcgatggaacacgaattaaaaccgataaccataaatataaaaacaatgatgagatttccatgttagttgcttccggaggagctcctttaggaaggcttgatgaaattgagggggtagagtggtatccagaaagacaatcttggaaagtcgttggacacactggaatctcttggtgcgttagaaggaaaacatggcgtgtttggtttattacatcgggaggaacaagagcgaccagatcatttaaccccaaagaacatggaacagttgccgctgcgcttaaagtagcaattgagtttcttgagcacaagcgcgcagagaagtcgccagctcagaagaatttaagaggtagagcacgacgttcgaatttatattcaaacagttttgttgatggtttttcaaaatcgaataatttgtcattaaatgaaagtacttatgaacatgctagcgatttaatcaattaa

SEQ ID NO: 1637 - DNA, 678 bp, Cryptosporidium hominis
atgagcttagaaataggagattacgtaatatctcgcgatgtatgtattgaacggaagtcactacctgacttagtaaactcacttagtaatggaaggctatttacgcaattgcaatggatttcaaaacattattccacccctgtaatattaattgaattaaatagcttgatagaaatattaaatcatcaaggaatgcaacaaaattttttaccagtgaagtttaattcttgcgacatttatttgaaattaattcttctaacaaggcattttcctaatattaaacttatttggagttgcaattcgtcattttcttcattagttattctccgcatcaagaaagatagagagcaacctaatctgaaagatgctagtactttgaatactggaattcttaaagcaaatgatattttaattgaaaaagaaaaaaaatctaaaggtaaaaaaagaaaagtatcctcagactcgaccaaatccaattattatgcaactgcatttctaaggtatctacctgggataaatgccaaaaatattaaagttcttacctctaactttcgctcaattaaagaaataattaatgcgccattggaaaatttaataaaccatttagggatctcatttggaacatctcttttcagagcattgcatgagggctactcagaaaatattaatctgagataa

SEQ ID NO: 1638 - DNA, 1899 bp, Cryptosporidium hominis
atgcagctattaccttttcaaaaatcaatactgaatgatattaataatcacaagtcttgcctaatcatcctaagtaaaggccttggtatttttaatatcgtctacaaatacttggctaacacagaaatcaatgcagggaattctatttttattttaaacttatcagtacctgaagttgattcttttaagctgtttgtgcaaaatatggatcaaaagcaacatgatgaaaataaagataaatttacgagaaatggttctcttctttctagtaaacttgtggctattaattcagaaatgaatttaaacaaaagaaaggcattttacagtaatggtgggatatatattatcacttcaagaatcctattaaccgatctattatcagaaaagctcgatttttcacatatagatggtattatattatttaatgcagagagcttaaatgttagaaattggaatgatgcgtttattctacaattatttaaaagcaaaaatccaaatgggttcattaaaggaatttcacaacgcccagaaattctaaatcagggatattttgggcccggaattaccatgagatatttaggggcaactgatttatttttatacccaagaaataatattattgttgaagaatcgtttaaacttactcagaaaataaaagtaatagaaaagtcagtaaaggcaactgaatacttttatgttatacaaaagtgcattaaaatattattggaaaaagggctacacgaaattttgaaatttaatccaaacattgaattaaccatgtatgacttgctatataactcatcaaaaaaattaaaaaataaaattgagtcattaacgcaagatttgtggtataaaatgacgtctaaacacaaacaaattacaaaggatattatatctttaagaaatttgcttgaattgctatatttatcagatgcatctgaattctttttttgtttagaatgcattcgatcatcaaaacttattgatacttcttggatgttaactacagaatttgaaactttatataaagtatcaagatcaagaatatttagaatcaacaatgaagctaataataatagcagtggatctgaaactccttttactctttctcttgaggttaatcctgtatatattcaattaattgatattatctcaaatattggtaaagaactcactgataatgatatttctactttattacaagaaaatgatttatatgctaggctttcagtcaaaaaaaatcaaattgaattgaactctaacttaaattctttgggaaaaaatgctgaaacaaaaacttgtgatgaaacaatttttgtagaaacggatggtatcgaatatgacctggatcaaaacgaatactcgcaaataaatgaaaaatatgtggaaatatgttcgaatacattgaataataacaactttgcgcataaagttccagaatatagagttctacttatcattcccgatgaattctaccttacaattgctgatgtcgaatttttggtactaaatggcccacaaaatttttctgctatgaaattaattgaaactttacaaaatatcgaatttgacttagtgtctggagtgtcgaatataattacaaaaataatatcttcttttggagctacaacctgtactaattctaatgaaaaacttcattcttttaatcaacttagagacctattatcaaaactaattaaaaataatagtaatctaaattgctcatactcttataatgatttaataattaattctatcccaaatttgagtgtatctgaaaataatgatttaaaccaaataatcaaaaacgacagaattaatccaaaaataatcattagttatccgagtgttaaagtgcaaggtaagaaaacaatcgtttttcttctaaaatctaattaa

SEQ ID NO: 1639 - DNA, 1266 bp, Cryptosporidium hominis
atgttggtatcttgttttcttcctcccacagtagatgaacttgataaggcaatgagatatgcagttcattacactaaagaatttgtgagaaccgaatttattatcattcaatgtttaactaggacaaatattctaagcgatggcagctcaaactttctacagcaattttattctctattacctacagaatataaaaaaaatctaaaaaaagtgataatgtttcattatggtgtaagtaatcgtgcattattaacgattacaagttcttacatgtctccgaggtttatgagaaagctcgagtatgcagattcaataagagaattatatcgctttattcctgacatttcagaagaagagttactaaatagactaccttttattgttaagcacgatgacgcagaactcctaggattagaggctccggcattattatcgatgagcttattggagcaatgtatttgtaatggttataatgttccaggatatggtaaaataccagccatcattgttgatttcgtccaaaagctatctaaacctgacattgttataattccaaatttgtttagcttacaaacatctgccgacaaacttacttcaataattggagaagttgatagtggagttccattcagatctgctgattcagatccatctaccctagtgtctgcatttaaattgatactcaattctttggatgagcctttactaggttcggaaacatttcattcaattgtaagacaatgtaaaagctcaggcacccatgaattagcccacagcttctatattaatttccttaaggagactatttcaaagttaccagatagttcaaaattggtaataaaattcttagttgatttcctacattttgtttcaacaaagtcaagcattaataatatgacagcacataaaattgctgaaattttatcccctgcattttgtagacctaatagtatgaaaaacattacgatgtatcaatctattccaccatgtgttgaatgtatcacagtacttatttcagattgccaaagtatttttaacaatattttacccgatattaattcatttgaccatctgcgtgaagtaaaagagaacctcagaaagaagcaacttgaagaggctgaagaagaggaagaagcagaagaagaagtagaagaagaggaagaagcagaagaagaagtagaagaagaggaagaagaggaagaagggcaaccagaattattaggaaccggggacaaagacgaagttgagagcgaagaaaacaactga

SEQ ID NO: 1640 - DNA, 1344 bp, Cryptosporidium hominis
atgatttttaattctttcaaaatttggaaggaagagagaaaaagtacaataggattttttcatcctcagtgtggtaactttggtgggggcgaaaaggtattatggtgtattatatatgaagttctaaataccaatataaaaaataaggttgtgatatattctacttgtaaacttgataggactgaaattgttaagaaagttgagagtttatttagaatccctttaaatcgtcccgagtttgttgacaggattaaaatcgtcgaattaaagttagggtttcttttacaacttgcattttttagactctggagtgtaaacttagcagctttaattgtttctctggagggtttattgtttagctggccatttccggaagtttttgtagaaacagcaggattcccgtttgcactaataccagcaagagttctcccaacaactaaacatatttcaacatatattcattatcctcaagttagcaaagaaaatattgaaagtgaaagggaaaggaatattctaagatatttttacttaaaactattcttgtttgtttataaacttagtattggtcttgcaaacaaggttgttgtaaattcaaattggacgtttaataagcttaatgagctttgggagaaaaattctattgaaatgagtgtttgctatccacctataaatatagatcattcactaaataagttagtagatccaaaactaagaaaaaatgtgattatttcactttcacaatttagagttgaaaaaaatcattttgtacaaatacgaattttctctggagtacttaaaaggatcaaggaaattattaataaagcgagcaaagaagagaaaattaggcttgaaaaaatctatgaagaaataaggtttaaaatgtgtggaacttcacaggattcaaatcctaaatacaaggattatctaaattcccttaaacaaatgatagtagatgagaagcttgaagagaagttagagctagttattaattcaagttcaacagagttgcagaatattatgagcacatcaaggtttgcaatccacacaatggaagatgaacattttggtatctgcgttgcagaattcgtctgctccggcttgttaacgtttgcacacaagtcaggagggcctgagaaagacatcctaacgagattcaatggacaagatgtcgggttcttggcatcgaacatccaggagtttgtggaaaaactcacacatgcaatcatttactatgaaagcccagctattcaaggcattttaaacaatgcacttaagtcagtatttgaaaggtatcaggataatatctcgtttggaaagacatgttggagagctctaaatatataa

SEQ ID NO: 1641 - DNA, 2109 bp, Cryptosporidium hominis
atgtctgaaaaggagataggcactcgtgatcaacaacagaatgttgaacgccggaaggatggggcatatatccctccacatagaaggcaacaagggttaagagaagatcctaattctaatttggcgagcttttcaggaaatcaagctaattcctacaatagtcaaagaaataattctagtagaaataatatagatggtaaacgtaatgatcagactagtaatttaggcttcagaaaacataacaattcttttaatgaatcaaacataagtgtggatcgatttagtgcgttgggagagaggcaatcaaacgcctctaactcgaagtaccaatataatgcagttacgggtggtaataacgatagatttggcaacctaaatgaaaaacctcaggaaaggggctacaataagtactacagaaatcgtattggcgtttcaggtactggatgggacgtaagagatggcagatcgctttatcgagatgatgaagacaaaatattttcaaagtcaaaagaacacagagcagggattaattttgatgcatacgataatattccggtggaaatgacaggctctgatacaaacaaaatcaagccaatgcaaagtttcatggagcttgaaggaatacacgaaatattattagataacattagaagagttaaatatgaaagacctactccagttcagaagttctccataccgactgttttaaatgggagagacctaatggcatgcgctcagactggatctggcaaaacagcggcatttctatttccaatagtaatgaaaatgctaaacgacggcccccctccaactcctcaacaatcttctcttagaataaagagaatggcatacccggttgctcttgttctatctccaacacgtgaacttgctattcaaacttatgaggaatctaggaagttctgctttggaactggaattcgaactaatgtattatatggtggaagcgaagttaggagtcaaataatggacttagacagaggttcagatattatagtagcgactccgggaagacttagagatttaattgataggggaaaagttaatctcaaattaatcaaatttttgattctagacgaggctgacagaatgcttgatatgggttttgctcctcaaatacgggaaatcgtagaggattctgaaatgcctcatagtcttgatggtagacagactgttatgttcagtgccaccttcccacgcgaaatacaacaacttgcaaaggacttcttacacaactacatttttttgactgttggaagggttggcgcaactagcggttctattgttcaacgtgttgtatatgccgaggaagaccataaaccccgtttactagttaaacttttattagagcagggtgagggtttaacagtcgtttttgttgaaatgaagcgcagagcagatcaaatagaagacttccttattgaccaaaacttccctgctgtctcgattcatggggatagatcacaacaggaacgtgagcatgcactaaggctttttaggagcggccaaagaccgatcctagtggctactgatgttgctgctcgtgggcttgatatccctaatattacgcacgtaattaatttggatatgccctgcaacatagatgactatgtacacagaataggtagaactggcagagccggaaacacgggcttagccacgtcttttgtcaatgaaagtaataagcctatattaagagacttacttgcagcattagaagaaagtggtcaggatgcccctgaatggttccaagacatggttaagtcatgcacagcctcattcggaaggtatggtaacagattcaacaagggtggggtatctagttctcaaagaggaaatagagggttacacagctttggaagtgtagatattagaagtaatcagggaggaagtaattgtagctctgttaattctagctatggctattctggtaataactcaagttctggaaaccaaggttctaataacgagcaatggagaaacagaaagggtccggggaaccactcttacaatggggtagctgggaacgggaataatgcttcgcactctaaagtttccaatagagactttgatcacgatgatgcatggtaa

SEQ ID NO: 1642 - DNA, 258 bp, Cryptosporidium hominis
atgaatcaggttatcactgagaattctaccccagatccgtatcctgagaagttagggatcatctcatcgattcccaataatttaacgccaatagactgggcgagactaaataaggaagcgtttttacttaataatcaagttcaattaaataaggagggaaaaatttgcacacacatattatatacatgtattccaaagggaatgttggaagaaaggtacagagagagacaacaaaataaattgggttacattaataag

SEQ ID NO: 1643 - DNA, 816 bp, Cryptosporidium hominis
atggacataaacgatgttacagcgacagttaaaactgcattctgcaacactcaaattgcggaagcgtttgctgctgctgtagttgcatcttctaaggggaaggaaaatgtgattcaggaaagttatgatttagagattaaaaagctatcaaatgaactaaatgctttaaaaaactgtattaacgatatgcaacaatcatttttaaataaatttggtgctgcatcaaattcaaaaaaaacttctgaagttaatgatagtccgatatgtgaagaaaacaatattactaatgaagaattcctaaatagagaatggaaaacaatgcaaaaatatatttatgagcatttcaaaaatcaaacggaaatacaatcaaaagttaaagaaatagaagatcacattattcatggcaaagaacatttctcactaaaaagtagcgaaattcattctctagaaaaaaatctggaagttagcactgagcacattacaaccttggcacatttaatagagaatcaaaaggacaaaattaatttgttagaagaaaaggttggtcttttagagagtaaaattaatcgcctagatgataggtttatcactaattttcaaatattggaaaatgtggcaaaatcaacggattcgcttatgaatatgcttaatagccaaacaaaatcatgggagaactcccgcaaaatatttaaaaaattaagtagtgatgctgattatcttttaaaaaggactgcagatacttttgaaggaaatagtattgcggatgaacttgtactactaataaagaagtttactgatgtaatgcagggtgtctaa

SEQ ID NO: 1644 - DNA, 1155 bp, Cryptosporidium hominis
atgctcgtaaggctcgcgaaattagtcattgttatcgtattcataagtaaattcactccaaatagttgtcttacccaaaatccttttcaatttggttataaagaagtagtccctgttgaagaaaaaaactcgagaacatttttacttagggaaagggctgacagctcagatattcccttaccgaaccattttcctaatgaacctttttactctacgaacgactacacgcttgatattaaagtcaagctagcattctacggagattatattaattctgattttgaatatattaaagtcaaagccaaacatggaccaaggataataaatacctgcggtcattttgttcacaaaagtttacctccgaaatatacgattatagtctcgctgggtggattgagcactcatgcgtgttcagaagaatctcttaaattttttaggaaatatatcaactacatttcaagcatctatggcctggaaattgtaaattctacacaattcatttttcttaactggttctatcttgtttatcatggatccaacgacctttatttttccaagaaaatggttagatactggatcagcaagcctaaaaaaaaagatattattatacctgcagtgagctctgctgctttcatcaacaaattgttccgtataggtgtaattccttcactttctgatacaggagcatatggattatgtatcggaacattgaatattgcccttgcttcgttattaatcaaagaaaatatgaaagtcgttgttcttaatgcaccgtcctttttttggaaaaattatctggaggatgtagtggatgattcgttggtcggaaagaaaacaacaaaatactttattcttagtggaagaagtgataggatcttccattataagagacatggcaagaaactttcaaattttttgtctaactattcagattatgttagatattttaaactaaatgcagatcatgcggagcttattattacatatatttatacaagcatgcgaatgattgcgactgttctgcttgacaaagaatattccattacatatattaaaactaaggattataataaaattcccaaatcattctctcaatcacactggtttagatatgtcatgtatcaacttaaagaaaacgagcatttagaaaaataa

SEQ ID NO: 1645 - DNA, 993 bp, Cryptosporidium hominis
atgggtatagctgtgttgttcctcattatatttttgcagctgtttatgagtattcgtggcggactgaatttgtctgatggcactgtcgaagttgttggctctgattatagatatttgagaaagataagtgatttacggccattaagacttagcacatttggacacttgtctcgctcagaaactcctaaatatactgttatatttatgcatggatttgtagttgacagtagcgctctatatcggctaacctcaaaattttttgttagaatggtacgccacctggatcactacgatcaggattatagcaataatgttcaactaattgctccaaactggcacaaagaatttctcccttttactgaagagataccaaatgagactattaccacattcaaagcaggaagaccttctgctgatcaatacatcttacaggtattgagtttaattgccttcattaatagcttggtaaggcaaggtattattccttcacttgaaaatacaggtatacagggaaattgtctgggaggtattattggtattgctgcggcccttggaatgaaatcaaatattggagcagttgcaacatgcaactctgctttattacatcctgacttaattaggaggaagatacttagaaagtctgctataagtacttcttttttgttagttcaaggtgatgaagataagataatctaccacaaattcgcatctgtaaccgagtccattcttagagattggggtgccaaaaatgtgttactacataaaacaagaggtgggcacttctctgtcatggcaaagcatttatatacaggtttcagattcattgcatccgttctccttaaaaggcaggaaatattccgcctcgaagattcttataacactaaattaattgcaaaaactaagaggagagttgaaaatgtctcagaaattgttccaattgttcctaaagtaacacctaatgatgatattcaaagctttaatagcactacatga

SEQ ID NO: 1646 - DNA, 1317 bp, Cryptosporidium hominis
atgatcgttcacagatattgtaggcaatgggcaccaagcgttgtaagaggtatctcgaaggttgcatttttttcatcaatgagttccattgctaaaaagagaccagcatactttgattaccaagctacaacgcctgttgacccaagagttttagataaaatgatgcctttttttacggagaagtttggaaactctcattctagaactcatgggtatggatgggaagcagaagaagctgtagagaatgcaagaactaatattgcgaaccttattaaatgcttgcccaaagaaataatctttacctcaggagcaactgaatctaataatacaataattaggggagtatgcgacatttatggtgatatagaaaataaaaagaatcacattattactactcaaatcgaacacaaatgtgttctgtcaacattaagagaacttgaactaaaaggtttcagggtgacttatcttaaagtcaacaataaaggccttatttctttagaggagttggaaaagtccataatccctggagagactattctggcttctattatgcatgtcaacaatgagattggagtaattcagcctatgaatttaataggagaaatttgtaaaaaatataatgttcttttccatagtgatgtagcccagggactgggaaaaatcaatattgatgttgataagtggaatgcagactttttatctctttctgcacataaggtgtatggtccgaaaggaataggagcattttatattcgtagtaagcctagaagacggataaaaccactaatttttggtggcggtcaggagcgaggaatgagatctggtacgatgccagtaccattagctgttggatttggtgaagcatgtaagattgcttcttctgaaatgaattctgattctatacacgtcaagtctctatatgataaactttacaaaggaattaccactcaactaccagatgtagaactcaacgggtgcggcgtaaaccgtatgtttgggaatctaaacttaagttttactggagttgaaggggagtcactaatgatgaagctatattctttggctttatcatccggaagtgcatgcacatctgcatcattggaaccatcgtatgttttaagagcaatcggcgtcggagaagatgttgcccatacatccattcgctttggactggggaggttcactaaacacgaagatgtagataaggctgttaaagaaattgttgagtctgtaactcttttgagaaagatgtcccctctttgggattctattacagatacaaaggttaaagatgaggagtcactcaaatggacatga

SEQ ID NO: 1647 - DNA, 1101 bp, Cryptosporidium hominis
atgaagatttttatattcaatccatttggaataaaaattctaaaaattttatttttaatattaataaactataatattttcccaggagtaaatggaaagtcggcatatactgttatcattcctgatgattatacatatttggtacgctcaaaaataaaaacagttgacaaacccatcgatatgcttttgcaccttagtagatctgaagctccaaaatatacggtcgtactatttaacgtatatactgctattaaagctgcgaagaaattaagtacgagtatgtacgttcatttagtacggcacttagatcactatgatagagaatttagtgataatgttcagttcattgttccaaacttttatcctaatgttagatccataatttcatccatgggccataaagtacatgcttctttgatttcagggactattccggaagaaaaatatattgaagcagttgtcgcatccgtttcgttcattaataacgcaattagaaggggggtaattccttctcatcaaactacagcattttatgggaattgcgttggcggactaattgcttctgcaacttctgtagctttgagagaatcattagctgctgtagtattgaatggttctgcgttatttatgccggatgttgtaagacgcaagcttgctagaaaatcagcacttaagagcgtcaagtatcttctcattcattcttatgaagatcaagttattccatatattcacgcagaaaatacgaataattcgttggtcagttggggagctgattccacaatttatagtgttgagaaaattagtcattttgatacaatggttaaacataaatatactggtctaagattcattgcctctgtaattttgaaaagaccggaaatttacaggcctctcgatacagaagatcaagagttgattaaatcaactaaaaaaagaatgaaagcggaagacattgaaccaattgtcccaccaaggaattccacggtcggcacagatgatagtagttctcctagtagtagcactatttcaagacaaagtcggcctaatcttgtgataaaagaggagggaaatgtagtgtatattatagatcaatccggctaa

SEQ ID NO: 1648 - DNA, 216 bp, Cryptosporidium hominis
atgcgtattccacatatacaagtattcaaaaaacatgtggaaggagaaatagatcagaaaatatttaaaaaaacaatatatgaaaataggtcaagaaattggctttgcgggataaatcgcatattgcgtgttctaatcagatatatatatatatatatatatatatatatatatatatatatattttatatttatatttatatttatattcagtag

SEQ ID NO: 1649 - DNA, 429 bp, Cryptosporidium hominis
atgaaggaagtgaacgacatgccacttaaatatgttattgggatgcttcttggtgttttttttggaatatggatattgagtatttgcttcaaaggtgaaacaaagaagcagacacaaaagaagaatactcgcaggcaatcaacgaaaagtgcaacatcaacaaaggaaaaactcgcttccctaaatagtaaggaagagacagttgtgacaaggagaacaacaaggtcgtctacaaaacaaaagactccaagtagaaaggtaacttttgagaccacgcaatctaaagaggtaaagccaaagcaaattagttataatgcggcgccagccaggagaactactaggaacagttcaaaaacttcaaacgagaaaccagcagaaacatcaacaggtaagagaagagtaacaagatcatcctcgaaaatgccgtaa

SEQ ID NO: 1650 - DNA, 471 bp, Cryptosporidium hominis
atgcagatattttttagatatggtctcggtaacaccagatcgttggaggtggattcaacgatgagtgtgagggaattaagacatattattagcgagttttctggcatttcaattgactcccaatgtatcagctacggttttggtactttagacgaatttgaaaccttggaacaagcaggtatttctgaccactctacattgtatgtttcagaagcaatgttgggaggtgccaaaaagaagaagaagaattttaccaagccaaagaagattaagcacaagaagaagaaggtcaagctagcagtactcaagtactacaaggttgatggtgacaaggtagttaagctacgtcgtgaatgtccagcagaaacatgcggagcaggagtctttatggctcagcacttcaatagaacaagctgtggcaggtgtggtttgacctatttcccttccaagggtgatgaaggcaagaattga

SEQ ID NO: 1651 - DNA, 1617 bp, Cryptosporidium hominis
atgaaaagcttgggatcatttttgtttgcatttggagctttggtatcagtttccaaagtcaatgcacagcacggacaacatttgcatgggcatggccacggtcaccatgttattccaacaaatgtaaattattacgaatcaaatacagacgtgctcgctccaattattgaatgcccacaaggatacacaattagtggaaaacaatgcacaaggacaatatttgttccaagttcagtaaattgtccaaagaagtatgagctgagagaagggcaatgtgttaggaaagaatacagctcagctgtcttagtttgcgaaccaggatttgaattgattggtgggcgttgtattactagacagtcagtacaggctgagagaatctgtccgcatggatttgcattggctggagaagagtgtatttctatgaaggaatttgcggctgattatagatgcccaccaggttttcaaagaaagcatcaagaatgtgttagagatatctcaacagacccattggaaagttgccctcctggttttgagccagtagataaacatgggaggatggttcagtgcactagaacagaaacagtagatcttatcctctcttgtaaacaaggatatgaacttagaggcgatatttgtgtgttagttgacattatgagacctaacttaaagtgtgaaaagggtttccaacttaaggatggagtttgcaacagacttctccaggttgattctctttcacagtgtccagcaggttccatcccaagaggccacaaatgtattgtaataacgaacgttccaatcattccttcttgtccatcagactttgagttggattcaacagggacaagatgtattcgtatggatgagagaccaattatccaggagtgtccacagggattcaaactcgaatctgggcaatgcgtaagcatttcaaatgtagaaccagaggtttcttgcccacctggctctaccccccatgggcaccacaacaagtgtttcaatatcattacagaacaaccgatgatacaatgtcctcatggttatattgaaagtggaaacggagaatgtatttcagaaaaaatgaaaccagcttctgtagattgtccaatcggtttttcaagacaaggaagccagtgcgtaaagattatctcagaagtaccgtctaagagttgcccatcaggtatcttaaagaatcatagatgcgtttcatttgagacagctccaatgattggtttctgtccagatggaagtgaagtcccaccaagcggcctatgtacagcaacaacaggaaaaccattttcattaaaatgcccacatggttataatcttgagaatggacaatgcattcaagaaattgttactaaaacaagttatatgtgcccatcaggtacaagcgatggccacggaaaatgtgtatctcttgctgcgacacctgcattaccagtatgcccacacggaatggttctcaccccagatggttctcaatgtgctaaaactgagcatacaaaaatatctctttcttgcccagatggatatcactttaatcacggaagatgtgagagcaaaatacacgagaagcaccatggaaaaaatactaggactgcaaatacccactattaa

SEQ ID NO: 1652 - DNA, 4896 bp, Cryptosporidium hominis
atgggacaggtgcctttgatcgctgccaaaagtacattatttgtgtattctggtattcgttcaattgttgtaggcaataaagaaaaagtggtcccacaaaggccacctgatttagatataatagcatctggagaaagagatagaatttcagatgactggagatggctcgctttaaagtctgaaaaacggcttaataatatgaaaaagatgaattcttcgtcggagcaattgaaaaaaaagctaggtagtacatttgatataaaccaattttcttgctttgttccgagaactgtattggaggcgattgctgacaaaagaattggatatgcagatgacttcgacgttattattgagagtttcaaaggagcgatcatgttttgtgatgcatcgggttttactgctttaacggcagcacttgacaagcaattaaatggcgcagaaaggttgggtgaatgtattaataacttttttactccattaattcagattatccattattggggaggtgatgttattaaatttagtggtgacgccatttgtgttgtttggccagtagatgatgaatctattaatttaaataatggaggggtcaatctgataactgaaggtactaacagttcgtctcaagctaatgcttctgaatgcaacccacaatttaacaagttagcacgagattcaagtaaattttcaaacaagtcaaaagtcagtatagatgataatagcccagctacttccgaaaaaagatggaataaagaagagcaattggaatcggaggaatcaccttcacaatatagttcaaatgctgctgatacatattctgttgatatgtttcatgcttgtaggttggcatgcgaatgttgtatggatatacataggactttacacaacttccctactccaattccaggaaggcacttaactttacatattggtgttggctatggtaggacaacaattttacaagttgggggtgtaatggatagatgggaatatgtcgtaggtgggccaccatttgaagaaatagcaattgcagagccattagcaaagagtggggaaactgttatatctccttcagttttctcaattctcggtaagcatgtaagcgtggaaccatgtgaaggcaatcctgattttaaaaaacttaacagtctacttttgcctaggccaccacctcctcctcccttggcttctattcatattcatgatgaggatgttgatctattaagaaggtatattccgcctccagtttatagatgtttatcaagtggctataacgttttcttgaatgaagtgagacgtttgacttgcatatttgtttcagttaaaggtttagatatttcgactcactatggttctaaaaccgcacatcaattaatgcagttggtccagaaggcagcatatacaatggaaggtagtgtaaacaaattcttggtagacgataagggcgtattattgttaatcatatttggcctccccccagtatatcatttggatgatcccttgagagcagtttttgcagggttaaggattttagatagtattcgatttatgggattaagttcaagtattggaataggtactggtagagtttggattggaacagttggatgcgaaattcgtaaagagtacacagcactaggcgatactgttaacttgtcagccagattaatggcaagagctggagagaatgaaattttatgtgatttaaatacatatgaagcatgtaaccacgcaatgcagttcatacaaaaagagtcattttatcctaaaggaaaagatgtatcaattgatacattttctccaactggtatattaactagaagccgtttacaaggtagtaccggtggaaaggccgaaacaggtaatcctgaagattcaaatttatcaaacaataaagataattctaatattaaagatgggctttccacagataatttattatcaacagagaattcaaataatcaaaatactgatataaacctaaatatcgaaaatcttcagagtatcagaacttggcgaggctggaagccattaaagaaactaaaaaaattctttaagccaagatatagctatggcctaccagatatgaacggcccaaattttagagtaattcctgactatgttatggagagcatgccagaaagtaaattccttggacctctaatgccctgggagtactatgaaccttgggatccaatattgcgcccaacattggatttaggaggtgttatggccatttatggtaaggaaaactgtggaatagatgaaattattcaaaatattgttcatcttggagaaaagttagagagaaaagttttcttatgtagtaatatgccagatacgccatttatcaatattggaaacgtgcctttattaccttggaagactctttgtacggatattgtagagtcatggcgactaactaaatcaagagagaagaaaggattttcgaatatcgatcgagataattcaatttatggattagcaaaagaacttacacatccttcttttcattggactttgcataaactaaagccagttttgcagggcttagttctcccatcagaactatcggaaaataaagccttcttaagaatgggaaaatataagaataaagaaagtaagaagatgaaggacatttttagaaatcccctattatttgtaaagaatttaaatgggcaaccagaatcattggataaagaattagatggggctgagttagaaaatgacgaaaatttaaataaagaagtttttaaggatgaagctgatgatgacataacaagctcagatgaagatttatcagatgaagatgaaaaaggtttgggcccaattattacatctctagttaatggcttttccatgtatgaaaacagcatcatttgcctacatgtaaaaagtggaacatgtttctatgctggaatggaacaggaaagttggaaaattgctaagatgatcgcgagaatcgctatgatccgaagaaagaggaaagttgagcatgacttcaaagagttaaaaaaatggcgcagaaaacactctagaatatgccttttttgcaaaggatttaagagaccaatacaacatatttccaaagatactttatatttatataaaacaacaaagtgcactcctcctgcttttaaatcttccccgccgttattgtttattttgatatgtagtagtaacactgactcaatagaagagcaaaaggaaatcattcaatgggcaaaggaatgtaatgcatttattgaagttccaaaattaactttgaatgaaacttccaaatttattgggcaccaattaggtgtcaatactcaagttccgttccagctagttgagtatgtacacagagcatctgggggtattcctgaacatataaaaaggacccttttgcaacttctttcgcataaagccatttctataagcacacaagatgatcaacagatggaagatcctgaaaagaagggttccttaatattggattctgataaatctttaaataatccagattctctgtcaaacaatatcagtaggaatgcaagcgtatgttctaatgctctttcaggcatcgactctattggaaataattttgattttggagcgattacgagcatcgtgccaggatacaatttgaagaatatacaaggtgatttgggatttatctcatcagtttattcttctagtgatgaatcttcatcatctggttcttcttcaagcgatgactcaaaagaatggtctgatgactcaataaaaaggaggattagggttcctagatttagaactcccggaccgcgtgagctattaagtagcgatggagtgccaattgttggaaataagcaatcaaatcgattttcaagcaatgatttatcaggatccagacatagatcatcgtttacaaagtttggtcaatcttcatacctaagtaggagttctgaagataatagaagatacattaaagttacaggacaactaagaaaaataccatttgcacatgagattgtagcagagtgtatgtctaagttggaactacttgaaccagatgaacaaatggctgcaaaaattgccagtgcatttacatttgcatttactgcttcagaattacatgaggtttatccgcaaaagaaatctcctctcgagtttctaaaaatgattaaggctatggtcaataaagatgtttttgaagtttgcgataaaataaattttggagtcgatagatctagacggggatcaataaatagcgaccacaactcgaaacacattactctatatgaaaatgatcaagaaaaaaatataaatggatatgaagacgatatttacaaagatatttccagctcaactcctattatgaaggatatctctgactacttgtcaaatgtgaatttatcagacttttccaagaataataaagactctatagatgtaacttatccatgctcaagtgagaattctgaaataaaaaatgaaagaaatgaaataaacaacgaccagtctgtaaatattaatataattattgctgaggataaccaatcagcatccgaatatgaattcccaaaacctcaaaattgtgatattttgccctattatattgagtactaccgtttccaaaatgtagcttttcagagagttgtttcagaatctcttctctcagatgaaagaaaaaggcttgccagaatttccaggaaaacactttcaagaaggctttccaagcttagtccatcagttagaagcgcatcgccacaactcccttcatcccctacagattcctctagcagcaagtttcctgacaatagtgaagctaataaagcatcagccaggtatctttcaacaatacctaacaatgtcagtgttaataatacaatttcaacaaatttggatgtactccccgaagatgaaaagtga

SEQ ID NO: 1653 - DNA, 2214 bp, Cryptosporidium hominis
atgatttcaaacaactcaaagattaataattcatctgaagaaaagagtcttaaggtggaagcaaaacttaaaaatccttcattcgagatagaaagcgacttaaatagagatttggaacaaggaatacttgacaataaatgcgataacttagttaatattggaaaagatggcaaggaaattgttaatccaaaaaagaacaaaatatttagcagaattagactctctaacaacaataacatatttctaacattatatacaatagtcgggtatttttttacatcaattgcgattatttactataatcattggctctttgacaaagttgcgccctttcctgtatttgcaacatgggttcaacaaattgtaggagtattttgctttggaattttatcactttctagaagaactccaaacatgtcaaaaatgaataaggattcttctgaaaattccggagacagtacaaacctaaggaaagaaaatgaaacaagaaaggtaaatgcaacaagtacaaattgtacgtccaacgaaaatatatcagctaaagaactggaagcaggttctaatagaagtattcccattgaaatttcgttccaagaaaattccgtaatagaagaaactcaactgaaagatagctctgtagcaaactcttcacaaaacattagaattgaagaaactacagttaatgaaaaggcaaaacagaaaaggaatagcattaagttcagtactgaaatgaagaagttactaaaaatattacctatgtcaatttgctttgtcgggctcgttgcatttggaaatatttgtttaaaatatgtacaggtttcaacttatcaactcgcaagatcggggtctttgatcttcactgttattgtatcatattttatgctcgggcaaaaacaaacttggcaatctattcttgcatgtatagttgtttgtgcaggttttctgataggctctctagacaggtctactctttcagctatgggaattgttacaggattagcatcatcattctgccaagtattttataatgtatttatgaaaaaatgtatgaattatttcaatggagatgcaatacaactaatgaaatataaccaatgtatttctaccattctgttaataccatgcatatttcttgcccgtgaattagaattgataatgggttcagctgcttttaatacaaattcacctgagttctttagactttggactttgttgatattatgcggattactttcaatgcttctgaattactttacatttttggtcgtagggtatacctccccagttacatttaatgtgttaggcatgttcaagagttgcgcccaaacagcaggtggattcataatattccatgaccacgcaagtgttcacactattactggtatttgtttaactcttgcaggatcggtatggtatggttttgcaaagtctctgaattgcaattccggaggtaaatcaagctctcaatctgaagtaggctctgaaaatggcatagttatttccaagccagaatttgaacaaaaggtatcaattcttacaaaagagttatcagaagtcgaggaactttgctatagctcagatgttattcataataaaaaatataattatgaaatttttggagatctagtagatcatactaatactttttctggagcagaattaacaatgatttctccagaaatcaaaaaatgtgtatgccagttagaaaaagagggctcagagatagagattaaatgtggatgtaaaaacgatcaaagagaaatttgttccaataaaaatagaaataacggttcagatgagaagattaatggaactgtttccttaagtagctgtatttcaaatggaaggcaagaaagccaatatactggcaatacattaacgacaaaatcttcagagcaaaaagatttagaaaatttgtttgaaaaattctccaacatttcgagagaaagctccactgatttaaagagcagtatgtctaaaatttcggtttcaatgcctgctagtgtatatgcctcacccgtagttgagagcagacaaatttcagctgatgaaatcccaaataacagaacagttgaagcatcgaatgataacatatctctggacgttagcataattgttgaatctgaaagagaagcggcaggtaatgacatccaggggctttctggaccacattttgagggaagtgatacggaagaatcaacaacaataacttaa

SEQ ID NO: 1654 - DNA, 1590 bp, Cryptosporidium hominis
atgctaaaggtaattttggcagtattaataggaatccttctaaggatgcttattggatattctgaatattctggccaatcagacccaccaatgtttggagactttgaggcacaacgacactggattgaaattactacaaatttgccagttaatatgtggtacattgataataaacacaataatttgagttattggccattggattatccaccattaactgcatatcacagtatgctgtgtggcaaggttgcgcattttttaggatttagcaaattttttgaactggaaaaatcaaagggaatagagagtgagactctaaaatggtttatgagaggtaccgttttggttagcgatattctgattttcttttctgcttttgtattttactggaatgtatccaatcctattagagataagagtgaatcaaacaaatatttgttggtgactcttgtatcagcaccttatattttcgtggaccattctcatttccaatataattgtgttgcaatcggtttggtagtttggtcggtaaatttcctttattgcggctaccacgctttatcaatattttccatagtttgtgcagtattctttaaacaaaccatgctttactttatacctgcgtttgcattcatttatgtttcaataataattaatattaaaggattcgtagtgaaagtcaaacgagtaatttatttcgggttaacaggaatgcttgcaacgctgtcaattttgtatccgtttatttttgataatataaagaatccattaaactataaagatgtcttttataatacaagatttgatagtttactagccaaatataaaatgaattttcttattccaataataaaaagagttatacctatatggagaggtgcttgggaaaatcatgtcgcatctttttggtttgcaaatatatttattgttaacttgaagaaatgggcaatgaaaagtgaagataacttaaacactgcgcttcaaatctgtacaacttgtactttattggggttcttgccagcatgcttaaatttattaaataatccttcaagaaaaaaattcgagattgctttgcttgcatcctctctttcattttttttattttcttggcaggtacatgaaaaaagtattattttaccacttacgccagcattactattaatggatactttcccattgatatctctaagcttcattatagtttcatcattttcgcttgtgacactatcaatcttggataaaacaacttcatatctaataatttttggattattctcaattatcatttcattttatgctttgcatgataaaattgaaaggtctaatggaattattgggttaatgtatgataatatgccgataattctgtcaatattgttttcacttatgcttgcttgccagtatttagttcccccacctataagatacccatggttacacgaatttttaaatgcactagtttgcgcatggactctattttcactacttattatatgtacattgaagggaatttcttctggaggaaaaaaagaacaaaaaaaaaggtctcaaattaaagatattaacctaatttataatgataagaattaa

SEQ ID NO: 1655 - DNA, 759 bp, Cryptosporidium hominis
atggcgttaagagttgcatatgaaagttcttccgaaatcggagtttttgcgaaccttactaatagatattgtttactagctcatggctcctctgcagcatttacatctgtctttgaagcagaattgatggaccatatccctattattaataccttaataggaggtacaaggctagtaggaagatgcacagttgggaatcgcaatggacttttggtttcaaatatggcaactgatcaagagcttcaacacttgaggaatagtttaccagataatgtaaaagttcaaagaatagaggagcgtctaagtgctttgggcaactgtattgcatgcaacgattacgttgctcttattcatacagatatggacaaagagtccgaggagataattcaagatgtgctcggagttgaagtatttaggacgacaatagctggtcatgtgttggtagggagttacgcaaagttcacaaatcaaggtggaattgtgcatacattagcatctgaagatgagatgaatgaattgtcggcattactccaaatcccaattacctcaggtacagttaatagaggaagtgatgttgttagtgcaggttgtgtagtgaatgactgggtgggtttcgtaggcatggaaactactgctgcggaaatggcagtaattgaaagaattttcaaacttggaacctatagtaatgtgaataaccaagaagaaatgcgtgagaaagatattaaacttaaatcttcaataatagatacgcttgcataa

SEQ ID NO: 1656 - DNA, 942 bp, Cryptosporidium hominis
atggaacacaaatatggcgatttaaacagttcttcgagagtgtacgagcttacaggaattaatggagaatgtttaggtacatgctttacaagtgatggaaggtctattttggtttgtggaaatgacccacagattctcctctttcagagctatgaaagtagtaaacatggaatatctatacaagggcatactaaggctgttctagaagtttctgtaaataaacagcatggctttcagttttcctcttgttctgcagacaaaacagtgcgctactgggatattgagacattaaaatgtatctcaaagttcaaagggcacacaaagatagtaaattcgtgtaaatgtagcaatactttgattatttcagggtctgatgatgggcaagtgcgtgcatgggatactagaataaaacaaaataaagcgtgcgtttataaatatgacaataaatatccgataacagcagtgtcatgtgagggagaatggtttcgagtttttgcaggaggaattgacaatagcatctatatgatcgatatgagaatatctaccgctttcaccctttctacgcttaacgatacaattacggggttggatgttagccccgacaattcttttctagtgtcaaactctatggacaaccaagtagtcatatgggatattcgacctcattcagatttacaagacaggaaaatgggaactctgattggtgcaaaacataattttgaggcaaatttgcatagggtgagatggaattttgatggagatctattggctgcagcttcttcagatgcaatcatatatatttggtcatttaaacacaggaaattaattaataagctggttggtcacaaaggagctactttagatattagcttccatcctagccttcccattattgcctcggccggttccgatggccgtgtgattgttggagaatttatttag

SEQ ID NO: 1657 - DNA, 2481 bp, Cryptosporidium hominis
atgtcggaatcactcagaagagaatgcacagattcggataaaaacattgggtttgaggagggatgggcccaaattaaaagagaagctatcgagcctttggaaacatatttgctaaataggacccagattaatgatacagtgaagaacttatttactgccaaagaatattcaaaaatctatactttaatttataatatgtgcacccaaaatcctagaaattggagtaggcagttatttaccaaatattctgaaactattgagaattttttgaaagaaaacgttgttagtaaattgaaaaattctacaggatctgggttactgtttgaattccgactttcgtggagtaaccacttaatttatacacactggatggaacgcttttttggttacttgaacaaatatcacattaagattgcgggagaaggaagtctaatgctaaaaggaatcactatattttatgaaactatatatttggaattcaaagaaagtatttcactttcattcagtaattctattcaggagtacaggcttggaaccaaagatattgacagtgaacttatgaaaggagttgtgaatgtgtgtttggaaatgagcgagaagagcaaaatcccagaaatatacgaaaatgagatagaaaatgtcgttattaatcacttaaactcttactatgggagtcttgcacccaaatgggttaggaatgacaaattattagaatacttatctcgtgtggatggcattgttaattttgagaataagctatgcgaattgtgtctatttaattctacgaggaaaaaaatacaaaaatcattaactcaaatattacttgcagatgaaatgaaagaaattctttcaaattctagctctattaagaagatgtttttagacaatgaattcgagcaactaaaattattgtttagacacttttctacaattcatcatggaatgcatgcattaaatactcaatttaagcgctacctaacggagtgtggccaattggtaattaataaattctcggagtcaattcattttgctgaagatattgagattgataatgaagaaacttttgatcaaatccaatctacgcataatttagccgaaaattggccttggatgcttggaaaatcaattactgttccttttatgaatataaaatacgaaactttattcgtgcaaacaattatttctcttttcgatcattcaatatacttattggaaaactgttttgataatgatactgcagttcaaaagacaattcgtgagtcttttgaagtaattgttaatttagaagtgggttgccaaaaccaggcaaaacttgtttgtttttattgcgacttattattaaaaaacagctactctgagattgggaacgatttcaatgttttccagtctaacaatcaatttgctgtattagctggaaaacttgtggaaattttttcctatatccactttcaagattactttcttcaaatttacaagtttctacttgcaaaaaggctacttcaatatcacttatccttagaaaaaaatgagctgtatattatatctttacttaaaagcaaatgtggagctgggttcacatccaagttagaaggaatgattatggatattcgaatgactcaaaatttgaataataaattcaaagagtacctaaaagacattaaaaaaggtgaaatagaaaataaagagtttgaaataaaagacaacaaaatatctgatttgagtttacaaattgttaaggctccgattccgacgaaagttgactttgccgttaatattttgacaagttcaaattggcctacattagactcctcaaacataaacctgccaactagcctaaaaaactgtataagcgattttgaaacattttatttcttagaaactagccacagaaagctcacttggatatattggtatggggaatgtgttttagactataagctcccaacgcccaatggaacatttaaattctttgaaatacattgtaatacgtaccaagcatgtattctgctacaattcaatgattttatcagcttatctttacttgagcttcaaagtttactaaatacagaaaagtctattatattaaaacatataaaacctttatattctgacgtaggaattttgaaatttgtcaataacacccaaatttccacagacaatccagtatttgaagtgaatttcgagtttgcttcaaccgatgtcatatctccaataattattaaattaccacatcaaacagaaacaactcaaaagaatcgtactgaatacgacaaaagccatgccatagaagcagcaattgttaaaattatgaaaattaaaggacaaatgacaagaagtgatatcattgcccatgtctcatcccaactatgcgactataaaccctctgaaagaatgataatcgacaaaattaaatatttaatagaaagagagtatcttgaaaataatcaagacgacccagaaaagctcttatacttagcatag

SEQ ID NO: 1658 - DNA, 789 bp, Cryptosporidium hominis
atggcaattggtaagaataagcgaatttctaagggtagaaagggaggacgtaagaaagttgttgatcctttgtcacgtaaagagttctacgacttacgtgctccaagtacctttaaagtacgtaacttcggtaccactattgcttccaaaaatcaaggtacaaagttagcagttgatgctcttagacacagagtatatgaagtgagcttggctgacttaaacaacgatgaggatcaggcattcagaaagattaagttacaatgcgaggatattcaaggaagaacttgccttactgagttccatggaatggatatgactagggacaagctctgctccttaattagaaagtaccagacacttattgaagctcactgcaacgttaaaacttctgatggttatgtattgagattgttctgtatcgcattcacaagaagaatggcagaccaagtaaaatcgacttgctatgctcagacttctcaaattagacaaattagaaagaagatggtggagattatcacagcagaggcagaaggtacaactctacgtgatttggtaaagaaattcatcccagaatcaataggtaaagagattgaaaaggcatgtagacacattttcccattacaacatgtatttattcgtaaggttaaggtattatcaaagccatcgtttgatgtgtctcgtcttatggaaagccatgttggtgctgatggtgttgaagagaaaggtaccaaggttgtttccgaatcaaaccaagcaaccaatttattgactgctgagatgaaggcataa

SEQ ID NO: 1659 - DNA, 237 bp, Cryptosporidium hominis
atgggagagccttctgagaataaaccccaaagcttaccaaataatttatttctaaatgataacttaaagtttgacaaattggatttggatgtcacaaaatttaaaagaaagcaagatttatactttaactcttatgacaggctttggggggaaaaggtaacttatagtgtgggtctatcttatgggacaggtatgctttctccctgtttttttcttaaacaaataattatgatttaa

SEQ ID NO: 1660 - DNA, 1326 bp, Cryptosporidium hominis
atgaagaataaaagtacagagtttttagaaagtcatgcttcaaaaatagcggaaaatgttgaagaagaaagttcggaaagcgtaacatttgcttccctaggagtctgtaaagagctttgtattgcatgtgaatccttaggctggaaaactccaacagaaatacagaaaaagactatcccagtagctcttgaaggaagggatattattggacttgcagagacaggttctggcaaaactggatcgtttattatcccaatattgcaaagattgcttgatgatcaggttccaatgtatgctgttatattagctccaacaagagaactttgcgttcagatttctgaacaattttctgcattcggttctttaatctctttgaaaattgcaacattggttggagggcttgatatggttatgcaatccctttcattagcaaaaaaacctcatattattgttgcatcccctggaagattagttgaccatttagaaaacactaagggttttaatattggggggatcaagttcttagttatggatgaggctgatagattgttatctatggattttgaaattgcattgaataaaattgtagaatcgtccccaaaaaatagaactacttatttattttcagcaacaatgacaacaaaggtcgctaaacttcagaagatttcattatcaaatccaattaaaatttgtgtaaacacaaaatatgatactgctgctaatttaatgcaatattatatgtttataccatttaagtataaatggagttattttattggattactccaaaatctgggccaatatactggaattatattctgtaatacttgtatcaattgtagaagaggagatttgcttgcaaaggaacttggatttaacagcattagtttgcatggtagaatgtcgcagtctcaacgtctatcagcattgaatctcttcaaaggaaaacaaaagaggttattgtttactacggaagtaggaagcagaggtttggatattccacacgttgacttcgttattaacttcgatatcccgacatcaagtaaggattatgtacatcgtgttgggcgtactgcaagagcaggtaggagcggtagagctatttctatggttactcaatatgacgttgaaactttccagaggattgaatttgcgctcaataaaaaacttgatgagtatacctccttacaaagagaagaagcaatggcaattcatgcaaaggtcgttgactctctaagaactgttgatgcagaacttaatgattctaatgaaaaaacagcactagttggtcatagaaaactaaaaaatcgtaacaaaaagaaataa

SEQ ID NO: 1661 - DNA, 321 bp, Cryptosporidium hominis
atgactgaagattccaatattgaatctcaaactacaaagaaagataaccccagcgaagggcctctaagcctattaacagaatgtgtaaaaacaaatacacaaattcttgttaattgtagaaataatagaaagattttagggagagttaaagcatttgaccgacattgtaatttacttcttacagatgcaagagaaatatggacggagtccatgaagtccggtaaaaagggatctgctaaatatatcaacaaagataggtttatttctaaattattcgtgaggggagactctgttattttgattttgaagagtccgaactga

SEQ ID NO: 1662 - DNA, 297 bp, Cryptosporidium hominis
atgctgaacccaaacacaacatttgcaggttatgcaattccacatccatctatctccacaatgaatttgagaatagaaactatatctaatgttgaagttgatgataagaactataatctggatttaaaggctgcgctcagtccaagtctagacaaaaaaagcagctcaaaaaagcaaagtagcaaggtaggagctactcaaatccttttaaaagcatgcgatgatctgaacttaatatgtaataaaattgaagataaattcgataaggcagtgcaagttcatctctcgagtaactaa

SEQ ID NO: 1663 - DNA, 678 bp, Cryptosporidium hominis
atgaatagattagtaaatcaaataacagcaactagcattccagaaacaattgaatgtgacttatcaaagaagaaagacggcaaattttttatattagagtcaaaaaatgatatttcaagtgccaaggagctatataaaggatttagaaatggcttgagatccaactgcaatattcaaaatcatttacattttgaaaatagactaaaagatcttgttcttcggatatcttctgatcaagatttcactttgaatgatgatcaagatcttgacgatgatgtaacctgtttaagcgttcaatcaaaagaagatattatgcaaatactagaaaaatccagaaagttaaacaaagaaaacattcaagttatagatggggtggaaattcttctttcagggcagggcggaagaccgtttgccaagcttgataaggattttaatactcagaaagtcgaaactagagaatttgaacctgaacaaagagctcaaatgcttcgaaaacttgacagcttactgatttcaactctcaaatgtacagcagaagttgaccgtcttagccaaattaacgctaactccaatatcaaccactatccaaactcctccataagcaggaacatcaatgagatgcggagcttaatcacggaactctacttaaactcattcaagggaacacacgacctatga

SEQ ID NO: 1664 - DNA, 408 bp, Cryptosporidium hominis
atggctagaactaagcaaactgcacgtaaatcaactggtggtaaggcaccacgtaagcaattggcatcaaagggtgcaagaaagtcagcaccagtaactggtggcgtaaagaagccacgtagatacagaccaggaactgttgcccttcgtgaaattagaagataccagagatctactgagcttttgattagaaagttaccattccagagattggttcgtgaaattgcccaagatttcaagaccgatttaagattccaatcatcagctgttatggctttacaggaagctgctgaggcttacctcgttggtctctttgaagatactaacttgtgtgccattcatgctcaccgtgttaccattatgccaaaagacgtccaattggctcgtcgtatccgtggtgagaggtaa

SEQ ID NO: 1665 - DNA, 2079 bp, Cryptosporidium hominis
atgaatttgaggctagtctattttctgtttttattctgcagtattgtgctaggatctgatctaaatgaaaccttccaagaagaaataaaaaaaaatttgaaaaggcagcaggtggttaagagacaggttgcatttgagagattaaaattgatccacgagattgatctagcgatttgtaaaagcgaacaatttaatttcattaagtgcaaatatgatgactctggcgtgcttaaaagctttggaggaatgttcggagttggggtagctgcaactttatacccaatgaattcaaattttaggatttataagaattgtagcttaaatccagatttaacataccaatgctatgaaaaagatctaattaaagatgtggatgctattaatgtctttattaaacgtgaaaatagcaagctaagtacccaatataagtatgcatatttagatagacttcctatacttcttccaaataagagcagttctgaattcaacattggttttttaatggagaagtatatgaccacatatatatctggtagaaaagttttaaacaactttattagtccaaatgtttacacagttacaagcaaatggggtactccaattcatgaatttgatcgttatatatttatgcaatatttagaaggtgtgactttaagcgaagttctgaagaggctcagacaaagtgaaatttttcatatgaaaaacagctttagaaaagttttaagagcatatagtaatttagttgcagctcgaaatagccaatataaaaacaatgaagctataaagagaagagaaatgttgttaagaattagtattaataattctgctggcgaaattctcggaagatttagatataggctttctttgttagatcataccttgaacttcttacaaagaatttgggagcaaaatatataccattgcgatttgtgtcatccaaatattatgattttggaagaatatttgtcagatcctctcgaaattacgaaaattattaaagatgggcaaggattcttaatcgatgatgatgaatatattaatttgatggaagttaatagtcttccccttgaaattactaaaagactgaacgaaaaaatggaacaatcaaaccacataaacaaaataaatatgtcaaattccaattatgaaagctctgataataaattacaagggagcactcatgaatgtaatacaaataaagcatcaacttcttttgatgactctttttacgataacaaatttccatgtaaacaaattttgaattcagatacatcaaccagcgcctctagtgatggaatcaatatcgatgcttctaagaattctggttatggtgctgaacaagctacctccaagaataaacaaggtctaagagtgattcgatttaagcttgaaaactttcgtatgatagatttctctttcagcttagatatgaccaaagaaattaatagtagaaaaggggtagataagtatctgatcgacactccttgtcgtatttatagaccagatagaagagaagatatcattgaactaagaagattggttgatgaggctgcctattttgcctcaaaaagcgaaatgaatgtcttagctgatacgtggagcactgtaatagaggaattaattaatgaaaacagtagtatatctgaccatgttgataattttcttacatttgataaatctgttgcaacacaagcaaaacaattcttgacagcaattcaggtacttcaaagatttttcaaagagttaagaaacaatatatatggtcctgagtggagcagttgttgggataatttgaatgaatggaaaagattaaagcttgtgcataaatacaatcaaatggaaagggagcatcttaaactacaatcttcatgcacaattaaagatatgactattgctattcataaagccagagaacaacttcatcatcacgttgcgagatttaaacaaggactttttggtagtactttacttgatgcaacttctacaatggctcaatattattcagtttctgttgctccacaatatattgaatctaagttgaaagaaatgatcgatttgggtttatataaattaagttaa

SEQ ID NO: 1666 - DNA, 1179 bp, Cryptosporidium hominis
atggttacattcaaatataggatgaaaaggcttcgtacatttgcaaatgaggaaattcaggaagagctaccactaaaatcaaagctaaacgagagactcatagccgaaaggaaagaagataatactctagaagaaaaagatttaaattctcttggcagagatttctctcaaaattctcagagtactatcgaaagcgaaaatatggaagctagtgctctagaaatgagtctgttaaaaagatttgatgattttatggagattatgagacatcttaaattaaatattaagcctgggtcttttagagatgacgaaaaccttttgaactattgttttttgatttctaaaccttttaaaaacaatagtattggatttacattccacgtggcaatggaaaatattgtaagcggaagaccaagagttttatctcagtcaatgtcaatggctattgagtatatttgttgcacaaagtttccatctaaattattaaatggtgaatcgccaactattaatagtccattcaaagttaatgatatacaaaataataagtctccattgaaaacaggtaatcttccattgttgaaaacaatcaaggagcaagaagtcagttcgggtttatttattgtattggatatggatgagaccttagttcactgtacaaacgaaatgcttaaaggagttaagcctgatttattagtcaaaattgctacatattctacaccctggtttgtatactataggccatttcttaaatttttccttcaaaatgcttcaaagttgggaagcatttgcgtttttactgcaagtactagagaatatgcggagcaagtaattaactcaatcgacccaactcaagatctcattaaatataagttatttagagaacattgtactgtatataataaaggttacatgaaggatttgagaataattcaaggcgcaaatctaaaaagaacagttctagtagacaattctttgataagcaatacgctacaattagacaatgcaattcctgtcgatagctggtatggatgctgcaaagataatgagttgcttagattgcttgtactattaaatagaatacaattgctaaatgatgttaggccatatttggcaagtaggtatggaatcagagaatggataaatatgaatagaactaaagataacttaatgcctatatga

SEQ ID NO: 1667 - DNA, 543 bp, Cryptosporidium hominis
atgttaagtgagtgcaaaagaatagaagaattttctattagtaattgcaaccaattggatagtaatactgagaatgtaaatattgattattgtacattggatggaataacaatgaataaaaaaattaagggtttgttaactgcaataaaggatgagcttaaagattgtgtattgcattatcatattccttctctttgtaactttctaggtattgaaatgatcaggccactgctgtttcactctgcgctcaggcatttgggatataaatcctcccactttcacagggatccactttcccttaaaacgaatgccccaaacaaggttgtaatggatatcttgagatcttgggcaactttaaacccatcaaaaaataaaaaaaataataattttttggatgttcaagtaactactgaaaacattaaatttgacatccatcctgatgtattgttggaatctaaagcaaactatgggcctagatggcttcccaaccctgaggcaaattggggtccaatatcaaggccaaaaaactctgggcagcattaa

SEQ ID NO: 1668 - DNA, 2421 bp, Cryptosporidium hominis
atgtcagttataggtcttgacataggaactataaatgcagtggttgcaacaattaatagaggggctgtaaccattgtgagaaatgaactctcagaaagaacgactccaatattggttggttatactgacactgaacgtttaattggcgagccggctttgacaaaaatgaaatcaaactacagaaacacttgtaggtatatgaaacccttgattggtatgctcccaaataacgtggtagagacggagaaactgtattcattggcggaaatcacaacatgcgaaaacggtaacattgggttcagggtaaactataagggcaatcaacaagtggtttccttgactagtgtttatgcatcttttctcaagcgtctaaaggaaaacactgaaaagagtacaggccaatctgttagagatttggttattagtattccaggatattatgataacgttgctagacaaaatgtattagatgctttacatattgcagggatcaattgtttgagacttatgaacgaggaaagtgcagttgctcttgattatggcatattcagatctaacaattttgcagaaaatgaaaatgttgttgtagccttcataagttgtggggcgggatactttttcgtttccattgtgagatttactaaaggcaagttcgacattcttgcaacagtttatgagaacagaattagtgggcgtttaatggactacgctattatggaatttgctgctagagactttaaccagaagtataagactgacctattaaaagacccaaaagctaggttaaaattagaggattctgcgacaaaatgcaagaagattctaagtgctaaccaggaggcagccttcgtaacagaatgtgtcgacggtgaaaacgatattagcatgatgattgagagaaaaacattcgaagagctttgctctaatataagcggatatattaacaacatggttgattctgcactaaagcaagctggaattaagattgaagatatctcttcaattgagataatcggtggttgtagtagaatcccatgggttcaacgcgcaattggggcagcctttaatgataaggagctttgtaagactttaaatgctgatgaaacggttgcaagaggctgtgctcttcaagctgctatgttatctccagttatcaaagtacgagaattcaatatgactgaaagattcgcttatgaagttcttttgttctggcaaaactctgctggatcctcagatttcaaatcagcaactctcttttcacttggaagcgacttgaatgttttaaagaattccacattttccaaaactgaaccatttgagattgcacttagatatgcaccaaattcacacacaaataatcttgatcttggaagataccttgttgatctccctcctcaacaagattcgaaagtcaagctttacattagactagataagaatggaattgtctgtctggaaaaagttgaacagattaaagaggaagtagtaatggagagtgctcccacaccaactccagcatcaggaaatcctgaagactccaactctaatgacgcgcaatcaaatgagtctaaacctgaagaacagccagctgttccccagcctacaatgaagacaaggattaaaaggactaatgtaccattcaaacagattggtgaattacaaggatatttgagcgaggagtcaaaggctaagttcaaggatggagaagcccgtatgagtacagaagacttattgattcatttaacacgtgaaaaactgaatgaattagagtcatatgtatttgatatgcgctctaaaatctcacctggaggcaatttaaatcaatatgcagagaagcaatcaattgagaacttcttagggttcttggcacaggcagagaactggatctatgataactatgaaagcacaaaagagatctttgaaaagaaactagaggaacttaaagtatatggagacccaattgagatgagataccaagagtctcttcaattagaggagattcaatcctatatgaattcaatgtttgagcatttccagaaggtatgcacaaatgtggacatggaatttactccagaaagcaaacagcaagtaatggatggtttgaatcaaagatatcaggaatttagtgaagctatcagaaagaattttgaagatagaaacaagtttgaaaacctgattgtttctttagactctctaaggcaaatgtgcgatgaagccaagaaatattgcaacgataatttaattccaatcccgaaggtaactgaaccgacaaacaatggaggtgaaaagatggacgattctaagccatgtgcagaaccaggaaacaatggtgatgtacagatggagggagataacaacggagctcagggggctggagaaacctcagaaatctcgcaagagtcagagatgaaagataattag

SEQ ID NO: 1669 - DNA, 1683 bp, Cryptosporidium hominis
atgtcattcagcacaaatctaatatccaaagagccaattcccgagatgagtaatgtcaaagcttcagatttggcgcaagatcctatgctgatctactcaacaactggcaagctggcatctcagaatgttcctgatagtcctcctactatgtttattagtgcgaattcgtcaccaggatgcaatatagtaaatgaaagagatgacgcatattcaaacttgagtaacttttattcaatattttcaagaattactgagatgaagaataaagaaatggcttcaaatagttatttcccaaatggaggatcaacttctaataatacaggattaggagctggattttcttcatgtagcccagcaacaggtgctcaactgcttcctccaagcttagttaataactctcagagtaataactcgaatagttttaattcactcagtgtagatgaagggagtttaaaatcgaaagtagattcttcaaatagcttatttccttatcctggatctcagatagagtggaataacactatgaatgcttactatcaacagttagcattatacaatcaaatggccatggctatgtattctccaattttagccggtggatacggaatagcaggtacaacaacaggatgttttaatccattacttagacaaatgtatcttggttggcaaggtaataatagtgcattaactggacagggatctaggccgggatctggaactggaattggaattggaattggaattggaactggaattggaactgggactggaactggatctgggactggaactggaactctaactggatctggaactggaactggatccacacttatgccttttaacctgtttgagttacaaaatggaggatctcaggctccaaatatggtatcattggcatcactatctcaaattccgtgtaatgggggggctttaggtgctaatttgactcctacagccaatattattggaggctcagaaagccgattaaatataccatctgtcaatcttacgggtggagtgagcagtagtagtatttcagtgaatagctccccaattcactcttcccagacaattccttcaattctttcgcctattagtaaatcacaatcttcaaattctagaaagtcactcaataattttgatggaggattcgagatctccaacacactaggggattgggtatctaaaataggtctcagacaagaaagtagaaaggctgaaaagtctagaaaatccattaaatcaaatattggaggaagaagaaaaattgacaagagctctgctatttgtattgtttgtggaactactcaaacttcacagtggagattccttaatttgggagaactatattcaagcaataaagacgaacattcgatatctctaaagcaggaatctaaccatgcgttcaacgctcagtcagatcagatctcgtctacacctgaaacaagcccatcaagtaatattcaacccactacatatgttgaaaaacaaatttgctgtaatgcatgttatatgaagtatgatagaaaccgcccaagatatagaaatggtaagaaggttcctccgcctctacctccgtacttatattcccagaatcaatgtataactgcctccaagcccaaagtggctgataatcactctaaatataaacaagaggcatcatatacacagtctgaatga

SEQ ID NO: 1670 - DNA, 1548 bp, Cryptosporidium hominis
atgagtaatagtgagcgttcaggtcagacctcgggacgtgagcaccatgctcgctttgctgaagatgaagttcaggagcagcgatatgtggttccatcgctccaaatcccggaagaaagctcgacaagtggcgtagctgagggaggaatacctttagttaagttggtagaaactgtagtaccagatgttgaagttaaggaagtagtgagaacagttccacgtatagttcctgaatatagagagaaagttgtggaggttccagtaattaagacagtggaaaaaattattgaggatcccgttgtgaggtataacgttaaatacgttccaaaagaggagattgttgagaaggttgtaaccaaacctgttgtggagtataaaacagttgagaagattgtagaaaaggtgacatatgtagaggaaccagaaaaaccttttattaacgcccctgaatcactcccaattttcccaccaaaccctattgaaattgatgagaacactgttgttagcatcacaagagttgcagtaggagacgctgttccatctttgattgaacttcccgtgccatacatggtcccaaagccctttgttgttccagtccatgttccagttttggaattccgtgatcattttgttccaattccagtaagaaagcgagtagttccaaagtttaagatgactgaggaagtatacgaggtggaatgtgtaagagaagttccctattttgtgtatgaagatattatcaaaccagtacctgttgatgttgaatttggaaagagagagagagagatggatgttcacttgatgaatcccgcagaattatcacaggctgacttccatgctatgtggatgagggttaatgcagatttattagaagaaagaagagttttagttggcgagatggaaattgataggatgattacaccataccgtgaggcaatggatggtattgactccaaccaggaaccaagcctagaacgtatgcagagctttgaaagacaaatgaacttgcaaagacaattgtgggatcctttaccaatgtctccaggaaatccattaatgatgacatatttacaaaaccaatggattcttacacctactattcaaactcaagaaatgtatactcaagaattctttatgctacaacaacaggctgtatataatttggtaaccggtgcacctcagcaggttaacttagcaccacaccaaatctcattatgtggatgtgaagctgctgctggagttgttgatattgattcacttccttctggagctcagaatctaattagaggacttgaatctaaagaagttgtcaatgttgacacattaggtccaatggatcaaacacctattgtcacttatccagttcaacaatgtattccaatggcagtcttaggcgctgctcctctaagcatgccaaaggatattattccaataaagcctgaggctattgaagcatcgcatcacgatggtttctcaataacttcaatgtgctgcaatgcaagtgagaatccaaaggaagaggtaaattctgaaagtttggaacaataa

SEQ ID NO: 1671 - DNA, 795 bp, Cryptosporidium hominis
atgccagcaaagaagaataatggtggacaaaccgatagagattcagaatcaggattaactgatcgtcaatctaataaagttgaaagtaacatagttgaagtgccagaattgcatttccatgaaaaatattcagctgtgaatatccctgtagtacaagagaagatcagatatgaaacaaaggaggtgattcaagaaagagaggtacatgtagtgaagccagtcgttaaggagaaaattgttgaagttccaaaatataaagttgttgagaaagttgttgaagttccccaagttgttgtacaggaaaagctgatcgaggttgagagagtggaggtcacttcaagaagcagaaaccaatcaagaccaataagtccggtggaaaagaaacaattagatattgttacgcaatatcgtcaagtcccaaaaccagtagaagttcctattgcattttactctgctattcctgttcctattctgatagatagagcagttcctgttccaatggaattgcaaattattcaagatatactatgtccaaagattgaggcgatctataaagacattccaattccaattccagttaagagaacaattgaaaaacctgtgccaattggtctatatgatcagccagaacttctccaaaaataccttcacgaccctaatgagccattaccaaatccagtcgcagctttagagcaaatggctcagcaagcatccatggctgctgcattaaaccaacaaaatatgatgcaaatgatgcaacagcagggcagtgtacaacaagagcctcaagagtaa

SEQ ID NO: 1672 - DNA, 1932 bp, Cryptosporidium hominis
atgagcaaatttgaagaaagagtgacaaaagtcctaatagaaaaatgtggaaagttacaaagtttaaggccattaatatatggaacagctggattcagaatgaattatgaggagaacccacatagagtagaacaagtggccatgatttgcacaataattgcttgcctaagaagtattctggaacaaaaatgggtaggggttgtaataacagcatcgcataatccaattcaagataatggagtgaagattgtggatgttacaggaagtatgctgaacaaagattttgagcaaatttgctttaatgtggtaaaccatgattatgcgagcaatccagtgagagtattgatgcgttatttcaaggagaagttggcattaggagatgatgacctaaacaaaatagaactttcaaaagcaaaactaatagtaggtttcgatactaggccatcatcaaaatatattctagagtctattgagagatttacatcagaattcggaatctcgagatttttaaactttggatttacgactactccgcagttacatttcatggtagcatttgcaaatggattgatcatcgacagagttccaattgttattaaaaaaactataatgttcgaaaatctcattaaagacttggagaaatgtagcaacctaaataagagtgaaatagtctcatcgttctttgaggtttactttgcctatcatgaatattactttaaacagttagtgaatttgatacaaaatgatgatcactcattcctttttactcaaaatagccatcttttttttaaggcaaaacccaacaaaattgaaaagtacaagataaatgaaaatgggatcttgttggtagatgtggcgaatggtgtaggaaaataccacgctgatagggtttcaaagatactatcttatgctggtttgaatctaaaaatgattaactgcgataatcctgaaaaacttaatgatggctgcggagcagaacatattcaaaaaaataccctccctcctgttggattctattcttaccaagattatgattcagataaagttgactatgttgcggcttttgatggggatgctgacagattgatatactttgtacctaatcattttcataaaaatgataattctgaaatttttttgattgatggagatagaatttcagcatgttatgttcttgtggttgttaccctattaagtcaatccataagagagataacagttgaaacagacacaattcccactttgagtttaggtgtaatccaaacagcatatgctaatggagctagtaccaagtacctaaatgatttacttagtgcattaaatccaaaatatttcagattttctattaactgtgtcccaactggagttaagcatctccacagaaaagcagaagaatatgacattgcagtatatttcgaggcaaatggccatgggactgtaattcacagagaagacaagttaaaatcatgggttgaagagatgtcaaaatttgggataaataataattcatgcagattattaacttatttcctgaatttgttcaatcctgtaattggagatgcaatctcggatatgcttgcatttgaagttgcaagaaaatttgtacaagccagatttggctgcaaattttctatgcgcctttatgacgatcttaatgtcattcaagataaagtctatttaaatagatgcgacctcgagactctaatatgtgataaagaaacagagaaatttctggttgaaccaaaagcaatacaggaaagcattgataattatatctcaaatttgaacgataattattccagagcatttataagaccatcaggcactgaggaagttgcaagggtatatgtagaatcactaacattagaaagagcaaaagatattatgggatttatcaaggatctactcatcaagtacttttctagagattaa

SEQ ID NO: 1673 - DNA, 279 bp, Cryptosporidium hominis
atggaagatcaaccaatacagcaagaaataaatgaggagctcgaggatgaaaccagtgaattcaatggtatgcaagaagttagtaatttagaactgaatgaaaacaatgaagagagcattgagtattttcagaatgagcgaaagtcaaatgaactattagactccaaaccttcaattcaggaaagcaaaatttcaaatataattgaagcaaatacaagcaatgaaaaattatatgttaaaatcagaaatgaaaatgtaagtttaaaaatattattctag

SEQ ID NO: 1674 - DNA, 2088 bp, Cryptosporidium hominis
atggaaattgaagaaaagtacgaaagagcaagaagagccactcagtttgcaaaatggtcggataatgcggatactctaacaggattacctattttagataacaagagaaaagggtggcatattcctgcaaacaatgtaaataagaaggcaaaacaggatctggaaggaaataatacggggaaaagtcaagaaaatatgcaaattctttcaaaaactgagttgagacgtttaaaagatctaaaaaaaaaggaagctgctaagttaaagaaaattaaacagaataaagttaatgacaatgacgataactttaataatgaaattgtttcaataaaaagaccaaaagatgttgcaaaaatttgtgatttggtaatggctgacccagaaaataatattgaattgctcacagtacttttagagtattgcgaaaaaaattggaattcaagtaatttaaataagagtacggtgaatttcccgattgagctttgcattatttctcttgtgatagttgtgaaagatcttgttcctggatataagatttcaagtcaaataattggtttagaaggtgcaggttctgatgcttcaaatgataaagtaagtctcagaaaagaaactcaaaaaatacactcttttgagaggaaaattctcaatatttataagagaacatgccttctactaaggaaaatacttggatttggtggtaaaaatagtacaatcatcactagaaacaaatctgccattttaaggtcaacgatggatttacttgatgcgacgtatcacttcaatcaccataccatattacttagaatgattatattatttttaatgtcaggaaatgaagaggatcttcaaacaagatcttgcctttcttactgttgtgaaggattaacaaacatattaacaaacgatgcatctcttgaaacaggagttgaagcagtgaatatgatacatgagactttatttaacagaaagagtaagaagaatgccacaaatatgttcacactttcaaaatggattcttatacctttcactaaatatgctccttggcatagaatagaggagtcaaggagtgaatttaggaggatttttggtccaaacaccaacaccattagcaaggaaattattgatgagatccaacagacaagtacaactagagtaaaggttgagatacttatagaaagagaggaacaaattttaaagcaccttttcacgttttactcgaaagttttacttttggatctggatgaacttgaacatgtttatctaggaatatctcagtatagtaataggataagcttgaagataagatctgagttaattgaaattataaaaggaaaactctataagagtgataatctaaaatggaaaagtttcgtaatggtacttaaatgttgcttttctttacttcaaagaggaaaccaacttaatgagcaacaacttgaagataattcttggattttgagatatcttgttttaagacttgagaaagaacatttaaaaataaagaatattctcaattctcctaaggaagctgattctaattacttgaaagagatgagtatttcccttcaggataaagagctaccaacagtcattcttaatacaagcattttttcgagttctaattcgagttatctttaccgtcttataattgttatcgcagaaatttcactcgtattgtgcaaatctggtgaagttgattcgagtattttcttaattaagctttgtggtcaaataattatcaaatttccgaagcttagagttcttttagatccagaaggcattccatgtaatgacttcccaattgatgcaaattgtatattatctgcatggcaataccaagaagtctctttatattatatttttaacgaaataatagagaataataattcaaacgcaacacttaaattgggttgcaatatgcttctatctgaatctgctgataatactgttcgaaaaaatgcggttatttcaataaagagatattttggtagaaaagaaaccttccctgctggcgatgatgagccctcaaaaagcgctattgaagagctcaagccattatattatattttgaaactagttaatatgtaa

SEQ ID NO: 1675 - DNA, 1869 bp, Cryptosporidium hominis
atgagtagtgaatatactgacgacggatttgcggaaaatgaatacgataaatatatagactacgcaaatgtagagcagttggaagactcaaaccaagagcagtactatgattatggcgcggatgaccaggatcagtaccaagagcaggagcaaagtaatttagaggcaatccggactcgtttggcaatggctttgtcaagtaagagttcttttcttcaaagtgcaaaatcttcattttctcagtttgacgaagagaaaaggggtaaattaaattatacggaaactaaacgcttgcttgagaggttggcaataaacttggagcttcctccaatagatgataaaatgcttaaagtaatatttgcaaaatatgatgttggaaaaacaggctttttaaattttgagcaatttgcaaaattcttttggcacttattgaatagtataagagaaaagtactacccagaaaagtcgattttggttacccgcgaccaatttgttcgtagaacttctttaaagaaagctgatgatattgaaagcatatttagttttgataagaaaattggagagggttcattcggaaaggttttcttagtcagagagagatgtagtggattaacaagagtatgcaagataattgatagatctttgtctaatatgagtttagaacaaatagaagcagaagttgcagttttgaaaagtttagaccatccaaacattattaaaatcttcgaggtatacgaagacaaagaacacatgtacattattatggaaaattgtggaggaggggaactcttcgaacgtatacatgaggcagtatctaaaggtttcagactaagtgaaagatatgtagcacacataatgagacaaataatggcagcattagcctattttcactctagaaatatagtacacaaagacttaaagccagaaaatatcttgatgcaagagaaatcacaccactcttcaataaaaattattgattttggattagcagaaatctttaaatctgtggatgaccatagtaatcatgcggctggtactgttttatatatggcgccagaagtatttttacgtgatattacgacggaatgtgatgtttggagtgcaggagttgtaatgtactttcttttagcggggacacttccattcacaggaaggagtataaaggaagtacgaaacagtgttttgaataccgagccaaagtatgaagaggattgcgtacatattactccagaaggaatagatttactacaattaatgcttcaaaaagatccagcttgtaggccaacagctagagaggtactttcacatccttggttcaggtattcaaaatctaacaatgaaccgatttgtatcaataataggctgcttcataatttgaagaattatatgaagcaaaatcagctcaaacatgcgttagtaaatatgatggcacaccaattaaacgtaactggaccccagattaagcagataaccaaggcatttaagtcactagatcaggatggaaatggtgttcttactccagaggagcttatttcagggctacaatcagctggagttccacaatgggatattaatcgaattgttcagtcaatggacgtcgatgatacaggatttattagctataccgaatttttggcagcatgctatgaatggagggacagcgaacttggtgttataagggcagctttcaataaaatggacattgacggcgatggaaagctatcagtgaatgagtttgaaaaggtactttgtagtggtgaccaaaagcttcttgttcacaaagattgggatagtattattaaggctgctgatacaaatggcgatggagttgtggactggaacgaatttttggattacatgattaactaa

SEQ ID NO: 1676 - DNA, 2226 bp, Cryptosporidium hominis
atgggcgacttaagtcattcgtcaaatttaaagacggattatctggagagatcggcttcaatggttcaggaattaattgagcatgaatacgtttctggatatcttaagaaatggagtccagtaataggtagaggttggcagagtaggtattttgctcttctagaacaggacagaacattggtatattgggcaaaaaaacccagttttagagatgagcaacctcgtggatcaattaatcttaagatagtagaaaatgtatttgctgatggcccgcttggaataaccctaagcacgccgcatagagactatcaacttagagcatcgaccccaactgaaaaggacaagtggatggatgccatcattctttggaccttaaagagcagaaaataccggtcgaaagctgaagactcaaaaaatttccgatttagcaatatgttaatagaagcaactcagtcatgtctgcattatatagtggagagttttctgaagccattcaaaaaatctgcgacaagagccatagaggttggtcctgaaacactatctaactcgaataaaaaaaggtttctaaaggatcgtggattatacaatgtgatatgtaaggcttggatggtttctagagaattaaagggaaatagagccagttcaaagagaaaaggaaacttgaattatcttagagacggacttgaaacgagagctgtctctgctctgtcaattgataaggagtatcaatttaatgagatattaatgcaaaaggagctcgatgattgtcgttgtcgcgaatccaatcagattcagcagttgtgtgaggatactccttttgggaatatgactcagagccaccccaggtttggggtgacctctcccactttgagcatggagagctcggaaaatagtcaagattccgaggtattttgttctcttactgagattgaagacgtttcaatgggatgtgaagctgatgaaattttgataccttttgatagtgctttgtgtatatatgatcataactgtcctcctacgatagaggaagatgaggagtatgttagacttaagcagcataaatatagcctgcaattatcagaactcatgctcaaccagctttcaaatctttcgaatgaggcatttctggataattgtatctttggacttgtttatattaaaagaagtaatccaataataccctctttacaaagtaataatatattttgggcattaatgatcagttctagatcactctctgattctcatcaaatttatccatctccactattgagtgagaagactattttaggtgattgccttagtttatatagggaggtcagaatttcctcttctaaaaatagcgttacatccagctccaagtacagctataatcatagtcgaactcaaagccaaagtaatagagattctatccctgtgcttggggttattaaaaaatctcatatatcaaagtcctcgatggatggaattatgaatgcgaatgaatctggactcaagactgaagtcaaatacgttgatcataagacccaaattgataataccttattctctccattgggaaataatttcctgaacaacttaaatgtcgacattggtaatggtagcgtgcatattggaattaataaccagactatagacccatatggattccttcttgatacattatatctctattatccaaggaatgaatcaaagaaccctgtccatatgcttgatcctggacttattatttctgttggaagcatctctgagagtgttaatggttttagcttttcagtctcatatcttggctcatctgtcattgaggattatatcgcttctgatttagagttcaatgatgactcaccgtccaatataccatcctcaactggcacaaattttgctccatctatcgaaaaagagccaattactcttgagttttgtactagatcttggagagatgccaaagcctggagatattcacttttagttgctagaaaatccaagatggccgataactcttatgaagaagccgccacaaaaaattgtcagtatgaaaatagaaattcatgtgtaagaggaaaatgcgtgcatgcagatgaccactgtgccaagggccaaaattaccattgttttgattcctgtcaaacattaacaactacagctagtagcagtgctagaaccagtcatggttattatttgaccaattataggaggaatatatcaaactttgctctacatagatga

SEQ ID NO: 1677 - DNA, 585 bp, Cryptosporidium hominis
atgcttaataacttgttggagtgtaatgaacttaaacctttggaagagttagctaatcatattatggaagaaggcctgaattttggacaaaattcggttatccttgcgaatagaatccaagaaaaggattctaatcaagaatgccaaaagactcaagtaaattcagttctagttaaagccgatattagttcccctgatactcatatcccttcaaccaacagtttaactgctgattcacccatttctgaagatagaattgaaatttcacacactattcctaactctggagaagattctactattacaaaatccatcaaagccaatatttcatcttatccacaagatatttctaagactcaaaatgtaggaagagttcagtccacatgcagcgatagtatgttaattactacaagcaaatctcgtgctgataagaaagataattctattcattctagaaagatcaaaacttatccctggacagagttggcaaaaaagttgattctatgtacaaagagaaagaagaaagatggcaaattgtttagtagtggcttcttaactccaaaagctacttcagaaaacctttaa

SEQ ID NO: 1678 - DNA, 240 bp, Cryptosporidium hominis
atggatctgttcaaagacgctcagatggcatggggatttgttagcaatgtctgccattgcccacttatgagagctcatttcatggtatttaaatggcaagaagatccaaagaaggctgcactgcctttacctgcaactgtttacatcaagtctctgtttttatgggtggattcccagatttcagataccagaatctttcctttaaagcctggtaagtttaagttaaattttggaaattaa

SEQ ID NO: 1679 - DNA, 219 bp, Cryptosporidium hominis
atggctacgaataataaacaaccaatggatacagtaatgaaagcaccaatttcttgtgatgttctaagccaaacttttgatacatccatactttatgaagcagttaagaatccagaaggcataaatagagatgaatgggcagcacataaaggtgagtttgaaaaaaatgaagcaaagaaagataaaacaaaagagaaatattccccactctttttataa

SEQ ID NO: 1680 - DNA, 1431 bp, Cryptosporidium hominis
atgtatgagaaacaagaagcaatgatgaatgtcgagggagaatttgcagaagagatggacgatgaaatagaaagcgaagaagaagtaatcagggaagaaattgaagatgggtctgaaattgttgagggagctgatgaggatgttgaaattgaagaacattattggcttccaggtcagggtgacgaaaatcaagaattagtatatgagccaaaagcatataaaatgtactataaatgcctggttgaatggagttgcctaacactggatattttaccagacaagcttggagacaacagaacccagtttccgcatacatgttatgttgttgcaggaacacaagcaaatatggaggataataaccatatacttttaatgaaatggtcaagaatgcacaaaaccaaaagagacagagacgaaaatgataacagtgattctgatttaagtgattctgatgactctgatgatgacaactttgctgatgaagaccctattgtaaatgtgggagcaattcctcataaaggaactattaatcgtattcgggtttgccctcaacttccaaatttggtatcaacatggtcagagcttggaaaagtttgtatgtgggatataacagaatcgattaataacttaaatactgacaatttgaactcaaaaacactgaaaccatcaaaccttgcaaagaaatctacaattaagccaaagttttcatataatggacacctggatgaagggttttcaatggattggaatcccaaccaaattgctcaatttgcttctggagatagaaaaggaaatatatgtttttggcagcctattcaaggagggtcttggagtgtaaatccagtccatggaaacttccaatccagtgttgaagctatacaatggaagcgtgatagcaatagtagtagtatctttgcagctggtcttgttaattctaatatttgcattgtagatattagaagtgagtcagaccaactgactattgaaaactctcataatggcgatgtcaattgcatttcatggaatccattttccgaaaaccttttgcttagtggaagcgatgatgcaactattaaattatgggatattcgttcaactaaagatccccttgaaacattcattttccacagagaacccatcctatctgttgactggcatcaccaagatcaagatgttttccttgcagcctctttagataactccattagtttctgggatattgcaattgatgatgaagttattgatgaagacaattctgactcaaagactgatgccactctaagtggcactacaaacatcccaaagaagcttttattcttacatatgggccaggaacatattgctgaggctaaatggcacaagcaaatcccaagtttaaccatttcaactgctcaagattcattcaacgtatttattccaaacaatttataa

SEQ ID NO: 1681 - DNA, 600 bp, Cryptosporidium hominis
atggtttcagatggttcgtcatattattctgaggattcagagagaagtttgacatctgaggaggagaatttctcagaaggtagttgggaagatgaagaagacgcagagtatatatttaattcaagagaagtttttggcttaaaactaatagcagatgacaaaaaaacaattaaatctttagacaatgtagaatttcatgttgatggatctgacggagtatcacgatggataagggtcatgattgacagtagtattcaaactgagcataaaaaagtaatcgaagaaatttttaacaatgtatttcaaggatttggagtttctgaagattcatccagaatagaattccctgcaaaaatcaaaattaaaaacaaaaagactggtattgaggaatgtttaattcttgacttccaacttccaagaggagatgaaattttattggcagaaactccttcggaaagtaaaccagtagtaaactcactaatgtctcacttgtatatctacaagtataatgaggatggactcaaattcaaaaattatcataaagaccaaaaggttgataatggatttggtttcaaaacttggcataagtacagccattaa

SEQ ID NO: 1682 - DNA, 246 bp, Cryptosporidium hominis
atgtcatgcggtaatagaaagtgcatccgtatttctcatatagtttataaagaaggaattaaaggatattcgatctcggaaagagttaatccatacccagactatgttgatatagatgaggcattgaaaccaagtttggaagcaatcgatgtaaatggattgaatgaaagctattctcaaaacaatcagaatacgtatcaaggaagtcctcctcaagaaagtgtagtagctcaacttcattattga

SEQ ID NO: 1683 - DNA, 3981 bp, Cryptosporidium hominis
atggcactaaaaggagtgaggcagttttcgcatttaacattggaagagaatgaggagtatgttgctgacgtatcatgtatctgtaaagctacaggaattcaaataaaaacatttggtagtgtattaaaaggaagaatcaggattgggagtaaaagcataatcatagaacctgatgactcaacaattactatgatcaagattctctttagtcaaattacagatatgaagctggatttttctaattcgaaaatgattatatttacaaaagtcgttcgacttgtagatgtgcaggtaattgatggtaaatcaagaagtgttactcccaaccaagtcttatcttctaaagattgtcgaggccttgaatctaatcgagactcttttgagcttgaaatcactattacaagtgaaatagcgcagcacctaatgaatctttctagtgaactttggatggaacactctaaaaagcacggttcttctaataaactcgaagatttagtgggaaaatggattagttttctatacaataaagaaatattgaatgttgaatacgagtttcttttggaccacagagatcaatttcttatttcaaagcctctaattgtgaatcgaatcaaaccctttacaaagcatagagggattctacatattgtttcttcaggaatatgctttaagcctcttccaaacttctcaaataagccttacaaaagaattccgttgaaaaatatttggtttatatttaaaagaatttactcaatgaagcctaactctgtagaaataatatatggaaaagaacttaagcctcatattatgacatgtaaagggcgaacaaactggagaagcctttttctagaatttcagtccacccaagatagagagcatattgtggctttccttcagtcctacttaatgagcttgaatagcaaaggatttcaatggagcagtcatgtacctcagtatgcatcatgcttatgctcatctcataatacctcatcttgtttgcctatgctttttgtagatccattatatgctagtcaaagcccatgctttaagaatcatatccaaaatctttggatacatggctcaatatctacatatcattatttagattacttaaatagcattagtggaagatcaaaaggagatttaacacaatatcccatttttccatggactatcgtaagctttaattcagtattgaattcaaggcacgatctttctcagtctttcaattacagagatttatctaagcctttgggttctattaatataaataacctagagatgcttaaaagcaggatgaaggacctcccagcctcggaacaatttctatatgggtctcattattctaccccaggatatatttcttattatcttgttagacagttcccagagtaccaactcaagttacacggaggagattttgatgtatggaacagaatgttccactctatgaatgacacttggagaaccattcttgaaggcaaaactacttatatggaattaatacctcaattctatgagcaaaatcccgatttcttattaaacaataaacttaatatccgaaccaactctgggtctttacttaatgttcaaatcccaaactgggagcttgaaactggccaaaaccagtttaacgcaaatacactgaatacggctaatctgagccaggctgagaagtttctaaggacaatgagatatgcacttgagggacaagtggtgagtcaacatattcacgaatggattgatttaatttttgggttcaaacaaagagggcctcaagcttatagttctgataacctttttcatccaattacatatattaactcttcaatagctatgatgaatgataaatcacctgtatacgcagttcaggaatataataatgagggaattagcaatatccaacaggaaatatatacaaggagaacaattgatgagaatgaggatattgccttgaaagctcaagttgaagagtttggacaagtgcctataatgcttttcaatgaaccacatcctaaaagaggtataacgtcatttgaagaatcaaccatcatgcaacacttaaatcacgaatatgctaatatgccttggttcgtcctatttaaaagtaatccccaacttttggaagcaaaatatgattttaatcaaaaattagaccagcaaaaacacgaagagagctacttagagaagggtattgtttctagttcactgcttgatttacaaagtcaccttaagccagttaaggctttgaatagcgaattttctaataatacaaatagaatggatggatttaagagagacatagtttctcaggagaatatattaagatcaaactacaaactaggaaaggatgaatttgataatagcaaggaaaagtttactttggatgagaataatgggtttatgttgttatttacagaagactactgtaatttcaagggtggctttcaaaaactggatctatcaaagatcattcaattacaagagagtgctaagagtaagactcaattctcttttctgacatcaatttatgagagacctggggagttcgtacttttggcactactagatcagtttgaggagaggttgttgttttacatttcagtgtatggctttgaagaacttggattcaagtgcatatattcaagcaaacaagatcttttcgagaacaaggcaatatgtattgatttgttggtatgcaacgaaggatcagcctatgtaacaattggaactttgtcaggagatttgatttaccttaggtttaaactatctaacaaggcttcaacatataacttgacaaactcagaacataactttaataacatttttgtaatggctcagaaagaaaaagtcctaaaacaattcaatatgggaaatgtaagtctattattcagtattgaattccatcaaagtgattgctatattgtggcagtttcccaaggaggtattatgttggtaagtaaacattcaattgataaccgacaggatttccgtaaatcgatttggtttcccattgtggatattccacttaggtatgaaaaagtttcttccatcattcaaatggatctagtaaatcctgaattacaaagtttgtacatggatagtccagagaaccacaagaatcatagaagcccggatagaggtacttccagatttggaaaaattacaaaagatattgactcaagtggtttttgcttctcatgcatattatccgacttaggtggcaagaagcaaagactttggagcttcggtggacaagataagctactttctttggacttaattggaatgttgaatagtgttttcttagttcaagggaattgtcggaaagaaaatggaggaaatgtaaataacaaccttagcaatgatgtcattactattgagagtggctctggaaatcctcaaagctttggattgaaagatatcgaagaatcccaaaaagtggagtggatatttcttaaagaaaagagcctcgttctttacgttggaattaatagtcctggtaatctgacaatattagtcttttgggacattcaaaaaaaagaagacgccaaagttcacaaggtcatcttcattcctagtttatttacagagtcagtttgctgggataagtacagaaaaggacttttaattctagggcgtcaaatatcgaatgcagacacaaagtctcaattgcaaacagaggataaaactgggtcaagtcaaagtatcaataacgaggatggaaacatatactttctccaagaaagacattggacctccaagaacaataatactttgcaaatactaacacttaaaagttcatttgagctactgttaaatatgaacataaggagaacattctctcttgaccacaattcgccagattttaaacgttctactataacatgcacggaaaaactcataatactgagttcatatttagcattccttgtttttaaagtctccaaaaaaaaccaaacaaccgagaacctcggatga

SEQ ID NO: 1684 - DNA, 1086 bp, Cryptosporidium hominis
atgaagattctaagattagcattgttagtatttgcgtttatgatgtcgataaacttgataggaagtatgaagagtaaatactatcttggaagatggaagaatgcaatccattccgtggcagttgaaggcactgatgatcatccattaatgagtgcaatttacagacatagagaacacaaggctgaattgatcgccaactttgaagaatcaatatcaaatttgatagatttaataaaacgtgggatggtaacaagtatggatggatatatgtatggtagaagacaagtgaaaaagacattggactatgacccaatttcgaaattggcagagagtgatgatgcaaagatagcaaaaaaaaagaagaaaaagggaattcccttaatggaatggtttagatactcgtcggttttgaaattggctgctgaatttggttcagggttgttatcattaaaggattcagctccttttgtggaccattcaccagatattaagaaaccaataagaacagtatctattttgtctaagaacagactggaatggagtttaacagaaattgcttgttctacttacggaatagtattaagtccaatgtatgatgctttaggcccagatggagtagcacatagtattaatttggtaggctcttcaacagtggtagtttcaatggaagctttgagcactattttgaatgtactttcaaggctcccaggaatcagatatattgttttactaaggccagaagatggaggcgatgtagaatatccgttagataaagtggaattatcaaaggataccctcaaagcttatggtgtccaggtttcactttcaaagtatgagattccgagtcacgtgaattttgtaacatttgaagcagtgatgaggcttggtgaattgaatttgaaggaaccaactccctcaggttatgatgatgttaattcaatttatttcacatcaggtacaacaggagttccaaagggtgcaattcatacaaacgggaattggattgcaggagcatctgcttcccttagatcatttttgaatagatcagactgcactgcactcttggaccaagagacaggtatctaa

SEQ ID NO: 1685 - DNA, 2712 bp, Cryptosporidium hominis
atggaatacaaattaagtccggatagtgaatctggggttaggccagaattagagaatttaacagttaaggaaattaatctagaacgccaaggggaggaggaggaagatgacgacgaggaagatgatgaggaagcatccaagcatattaatgagcagaggtctgaggggccaatgtgtctaagcggacttaagtctcaggtagctcgtaactttgtctcggaaaggcaagatcagatgaaagagaaaaataatggtggttctaagagtaatagtaaatcaactagaaataagcctagtagaaataaagctaataatcatagaaatgaagatagctaccaatgtcatattgaagaagatagaaagagcaagaagaatgacttaaatgacgattgttcatattacaataggtcatcactcggttcggcgaatgatgacttagagctgcctaaatctgcctgcaactctaacaaaaccgttagtcaggctaattatcaattcgaatttcatcatcaagatctccgccactaccatgtttcagaaggctttgagagggaagaccaaaggcacaaattctttgaaaatgcaaagaaccagggagatgagccatcatcactactaaagggaagtgctgacagctcagtattggttgaccacagatccttaaatagcccaaaaatttctcatgagggatcagtacgcaatatcattcatgacaataactcaaatacgatcaaaggaattacccgagtatccgagtctgatcgacttgaccaccgcttctgcagtgatggaggcgctacatcccacactggaagtaattctaatgttgatccaatccttttttgtactccacataattttggagcaggttactttactgttcctaacgcttatcctgcccctaatgtcgagataaagttgtttgtgggtagggttccaaggaatattgaagaagatgatctccgtgatttatttaagttgtatggtcgagttgtgaatgtgtccgtgatccgggaaaagagtactggaatccatagaggagcagctttggttaccatggaatctgttgcgcaagcagattttgctcttagagagctaaattctatcaaggtattggacgaacttagagggcctcttaaggtccaatactctacgggggagcctgaaagactgggttttgagagtgaatcttgcattccaggagttgatcaagtcaagctttttgttggagctctccctagaaatatcacagaagacgagattagggagttattttctccatatgggcaaatcaatgaaatattcattatgagggagcctcattctggagtgggtaaaggttgtgcttttgttaaatatgcttttaaagaacaaggacttttcgctatcaagtctttacatggagctttgacccttgcagatgtcaacaggccaattgaagtccgcttcgcatccaagaaccaccagtcatctactagcagctccttaatagctcaaggagcgcatttaacttttggaacggctgcagctcttaactttaatgggcacttcaactttggccatcactcaattcaaaaactccattcccccagaattgttggagccagtaataacgttaacaatattttgtgtaatgctagcacattaacttcttcgacctcgtcaatgtctcaacaagcccctggcagctcaaagtcttcagttggaattggaggaacagcttaccaattccacaaccatcaatcaggacaacattttattggatgcaattctaaaggtttatcgcaaagttcaaaccatcattctttaaccgaacagctgcaaattggtccatttactggagttagtgcaactggagccaatgctgtacaagctggtcatcatcccccatgtggaagagctatcacgctatttgatcacaatggaatggctgtagccacaaccacttccacggctgcgatgttctctcgttctcgtgcagttggtcttcccattccagcatccacgagtgctacagctgcagctgcaattactgctaatttgatgccaaggtgtattggtatgtggaaggaatactttacttctgatggtaagccatattaccataatgaattaacacaggtaacacaatgggaggttcctccagaatttttaagtttccgtccaaacttttcaagagaagttgttggtccacctggagcaaatattttcattttcaacgttccgtatgaatgggataagaaaagtcttgttggactcttttgtcgttttggaaatatcttatctgctcatcttatggttgataagactagtggccgaaataagggagtagcctttgtctcatatgataatatccactctgcagctgaggccgttaaccatatgaatgggttcatcacggagcaaggaagaaaacttaaggtttccatcaagcaaggtcaagaacacttcgtccagcatttattgaagaataatttgcctcagggaggatgcagccaaacgggctatatggagaactctcaaaataatattcagaatgattcgatttctatcgccatttcccagaattctaataatgttaatggtaataatgaaagtaatactgatgataatagtaataatgatgtaaatgttaatattaataataacaataatagtaataatagttgcaataataacaaccacaacttcagttctggaccgtcctcataa

SEQ ID NO: 1686 - DNA, 2868 bp, Cryptosporidium hominis
atgaaggttttgcaaatgtgcgaacaagcgagcgaaactggtgatgaagaacgcatttttgcgctatttggaaacaagttagataagttagaatctgaagattttactttggatggctacatcaatgagagttttcctaatgaacagagtttgtcctgtttacctgaaaaaattgaagaaactactaagatcttagaagaaatagatttagaaattggtaaggaattaagaaatatagcctcaagtaatttaattgatgggtttgaggagaacttgaaaatatttgaaaatgaacttattccaaggattaaagagaaagaagtacagcatgaacaatttaagaaagatgttgagtttattttgggaaatatttgtgaattagatcaagtccacaataatttaactaatattgtgaatttattggaaagtttgagtattggtaatattatcagagctgagattaaaagtcatatgagctccagagcatatagtgaattggttccaatacttattttggcctatgacttatcaacttttttgagaagccagaaagaaaataacaaagctatgatagaaatttttaatcaaaacaaacaggataaagtttatcaagaaattcaaaatagcttatctgaaatggaaaagctctttgggttacttaaacagcaaattaccgaagatttcctagccctaatagatccatatattttattcctaggaggaatagatcatcaagacagtatgaattctcaaatcactccccctcagcacttggaagcaccagaagagttcagaaaacaaatgaaatcatgttgttattgcgtggaattaattggggatgatttccgtaccgaaatagtggacatgttcactacaaaattgcttgaaccttattgtaggttatttagttatagtcaaacagaaaatttctttggtactcaaaacaaaatgattggacaaaacaaagaaaaagtcacgttatcagctactggagtagaattcattgaaagaaggtttgggtggtatagaaggtgtatgaaagaatatgaacaacaatttggggagatttttctcacaaaatgggaactccaaacaatattaactgaaaaattcttcacatatactaggaaagatttactacaaacattgggagatattggatatctattggataatcaaaccatttttgaatacagcttgaaatgtaatcaattcgaggaatatatatcttcaaaatttgcccagctatatgatcaaaaaatactatttgcagaactagagaaggaaaatcttcaagaagttctaaatactaaaatcaataataaagccatcagagagttttgtaagaaatttaaaacagaatacggaaatatctcacatttaaatacttctaaaaactccaatttgggatcctctaaacataaacttaaacaagaaatgctcgaatataccttctcacttgattctgggaaaataagatatccccaaactaaaaggttgctgactgaatgttttgtcccatacttagcatcatttttggaacttgagaaggaatctctactaaagaaagtaaccaaagaactggctcctgatgaaaaaatgacggaaaatatacaaataagacgtgagacagacatccttgggcagtacgaaactattcctcttatatggacctcctctaaaaatctttctcagcttattaatacagtattccaacaaattgaacatctaattgattatgacgatatatatctacaattcaatgctttaatcttacaaatagtacaaacatatatagaccaaaaaattatttcatgtaacatacaaagagcactagacaaaattacaaataataacatctattcaggagggtcttcatttgaaaatattgtcgaagctgtggttacaacagtctccactcaaaccagtaaagttgctgcaactacaggaggaattcttttcgcttcagtttcccatgatcacataaactctgagttaaaatacaatgctcgaaggctagctgcaactcttggctctatagattaccttgaatggatacatgcaagattggagtatatgactaaaggaagccgaatcaacgataccttagaatttattgaggttaatgcggatgctagaagtcgagatttaaggcctagaggccaaaacgtcatgtttagtaattacatgtgggtctcgaaacgaaaaattttaggctgtgtagtcaaagaactatcacgaccattaacactgagcatgtcagaatggtacacaaaaaaaacacaaaagctcaacgagacgatgatggtgaaaggtattttggagtctgagttgccgactttagataatagctttacgggcggcactttgagtttggctcaggttttgggcgaatctttggtaaaacaatatgtccaatactctcagtacatgccaaccatttacaaatacagtataataagccaggtcatgatgcaaagtctgagaaataactggaaatttgtggtatctctcaaaggtccactacactatggcacactagaggtggtggtcaatgagcaacagaagctatcctctctctttctggaacttccgtcatactttccagcgatgtacgttcctagggcttatgttaataatataaaagtcattatgagcaaaagtatcgtctttcttcgtattgcacaaaaaaaagctcaaatgaatgattctcagcttgaccagacttccatacagcattttacgacacagctgtacagaaatcttgaaatcgagactgaaaaagatgaactctcagccttccatataaacctggctctaagacttggaaataacaccggccaacaccaacaacttcgaccaacataa

SEQ ID NO: 1687 - DNA, 1359 bp, Cryptosporidium hominis
atgcttcttgtttcaacagaacaaatggtgaacgacagtatttttggagattaccaaaatgcttggaagggcaggcagggacaaaaggataaggaagaaatcatatttgatatggatgataacgttaagaaatcaaaaaaatcgagtcctactgtgaatgaaggtgaaaaaacacaagagcgtaaagttattgattttgatattccaaaagatgcagaaaaaataaatacaaattctttttctcgttacccacaaaataatgtggttgatattgaggtgattaaacctccaagtcataatggagaggaatattattcaggaaaatttccagtttatgagattccaaattctgttacctcagaaatatgtcaagaagttggaacaaaagagattccaggccaatctaagtataagcaatttccaatgtcaagttcaaaaaattatggattttcctcatttattgttcctccaaatagaattgtggaaaggccagaatatacagcaatacaaccagatgatagagtaaatatcaatttgcatgagtataggaatttttggaaaaggccaaactatgtgaataaatatagaaatattgattctctttatgattatttggttgaaaaagcaaatttaaattggccggaaacttcaaatgattatttgaaatttgaaaatgaaaatttagttaagccttatattataaagtctgaatatttcaaagttgattcagatccacaacttatgatttatccaagacaaggaagaaatttggaaagccggtatattggaggagaagaaccattaattcagccgtttcagagcctagaacttgcagattcatatgagtatggatcatctgaaaatgatccagagattcagaggcttgcatattttgataacaatgagttacctgaatatgagaggactatgatagatgatattccagataaattctttccatttcctgttcaaaaacaaggagctactctactgaattataaggatcctctattaaaagtagatttccaaggaatgacaggaaggaaagtcaataaacagccatttttaaattttgaagaagatgaatcatttcaagaaagagatatttctcaggaagatgatgattcaattccatattctaaatttagagacactgcaaggaatgcaattgtcaaatggtatattgatgatgataatgaaggagatacccgtttaacaggcaaagatagaaggataataaaaaagttattttcacttattgaacatgtcgatccagatcattataatgagttaatgaataggggagatgattatattgttagacaaataataaggattggtggatcttacggtgattga

SEQ ID NO: 1688 - DNA, 576 bp, Cryptosporidium hominis
atgactattccaataaagaatgttgagatcttgaaatcttctgtaaaaaatgaacaaaagaatagggatcaattagaaaaggaatataagaaaaatctggaagaacatgcaaaaatactcgatcttctcaagaagaatcaagaaaagctacgtgaaaaaatggaggaagagcataagaaaaagcaggaggagttaaagaaagagatgaaagattcagtcaatcagcttgaagcagcattagatactgcatcaggaactataggagaaattgaaaaggaaaaaagatttttagatgaaagattgaaaaatttagaaggagataatcaacatattcgaacattaatcagtatgaaagataattatataaaaaagatggaaaaaagtagaattgagttggagacaaaacaggaaattgaattgaaggaaatgaagaagaattatgagaaacaattgaatgagttaaggaaaaatttgagtaaagatgatacaatttctggattgagtagtatggcgagtaatttagaatttgaagctgaagagaatttagaaaagattgaagaaaatgcacttaactga

SEQ ID NO: 1689 - DNA, 1008 bp, Cryptosporidium hominis
atgaatgtagaatataatcggggaatgcttattattccattaatcgacttagctctatgtataaagggagctcttcagctaaataatacagttacaagcaaatcaaaaaggacaaagttaggaacttgtattgttggtggagttagaagccattttgcagctcagaagatctatagggtagcattaaaatatttggagatgagcccagacttatctctagcaaaattcttaatcattccattaagaataggaaaagagaacttaaatgagcagcttaaactctcagaatctggaaatgttgataagaattttgatactcaaataccagaagatgcaatttcgccagcagtttctgatttagaatttagcaaactccagttcgaaatgaaattcgaaaattctaaacaagtcaaggaaagatataataataaattatctaatttaagcgaagctattttcaaactttatttaatgaattctagagagctggatattagatcccttaaagcaaatggtccaaggtctgttgtaatccctatgtcattccctcagttgtacattaaaggttactcaagagctcaaaaacttgttaaaaagattcaaaacaaatataaaccatctttaaagaataggtcatatagaaacaaacttaagccaggatttattctactaattaacgatagtacggttaattctggtgcaaatgctaaattatttttgaatgaacaaattaagagaatccaaactttctttaccaacccttacagttttaaaaatttcaagtctcgaaaatatgaagggccagttttagaaattaaaggtgttaactccctccaaactagaaaattcctacttgatgcaatagctagagcatctagacaaccatctgttgtccctatgattatccttccaatatttgttgacaataacttaaagactagcaaatctgacagaaaagccatgaataaggctttaaaaaagaatattaagcactctaataatatttaa

SEQ ID NO: 1690 - DNA, 92 bp, Cryptosporidium hominis
ggagtctatagaccaaataattcttactcaggattgaacctttcaccagaaagcctttcaaagattacatatttgatgaaccagggccctca

SEQ ID NO: 1691 - DNA, 2241 bp, Cryptosporidium hominis
atgatgctgagatacgggagttctttgattttagtcaatttattgacactaatgttattacaaggccattttggacaaattggctgcaaatcttcagacaaaggaattgctaaggatgaaattaattttgaagaagatgctgccagctcatttaaattagcttcacagtatactcctgctaatgaaggtaaaattgaagtaattagtttgaatgaattactcaagggagtgtcaagaaacaaaaataattcaagcaatgagtcaatagattttacagataatgattattctattccgactgaatcaaatagtgatggtagactaacaggaatgagtagagggagaagcagaaataggcgctttaagtttagatttggagaagtacctatagattcatctatagaaacaagtagcagctctgctaattcagaacctgaaggagaggacaaagaaaaggaaatagagaaaattcaaaatgtgaaagagaagccttttgaatctgatacaagttcattttctgttgttggaggagaaaaatcgacaagtatagaaatgattgataaatccgaaccctccgcaaatagtgatgctgaaacagagcctgaaaaaataaagtctcctattccaataattccggttgaagaagaggtaaaaccaaataattcagtagatcaggtgattgagctattgcatcaacaatcgaatttggatgcattgagagagcagaaaagaaagaaggaattcaagaaggagaaattagaaaatcaagagaaggttatggataagttaatatctgtaatagattctatgcaaaagaggtcacccttgaaaaaagaatacgcttatggtgcagtaatgaatcataacattagtgatctgagaaatcaagaattattttatgaggggtatatggattctaaaaatgatggaaatgaggactctttaagaagattaagagattacgaagaaaagaaaatcagaaatgagttaaagaatgcatcattgacaaggacattctactcaaaacctagcagcgcacttgcttctgaactgaatgcttattcggccgcacttaattccagtccaaaaaagaatggttctggctccggttctagttcaatttttggctctggttctgattctggttcaacttccagttctatttttgattccgtttctggttctgattctaagtctggctccaaaaaagaagaagcggctatatcaaagagtatagatttaaataatcccaaaactagatctgtaagtgtggggttctcggatagttctattgaagactactctagtggtcaaagccatatttctgaatctggtagaagttctcctgcagataacaatgttgagtctagagcaaataccgatgaatatgaaagttcaacagaagaaaatcttcgcattaaaactccaacactgtctcaaactcataagagttattcaacaagttcacctaaaatattggataatctagctgaagaagaggaagaaccgggcattccaggtacaaatcccgaaaaaagaccctctgaaagccccataaaaatgcttgaatcagagttaatgaaactacaagatttagtagagcttgacttaaaaaagagcacagcctcaaatagttttggaagggtcaaaccaaagacttcctatactcaagatgaatatttagttcgaacttcaagtccagaagaaaacatcttaaatacgggaaaagtaggaattggaagaattagaaggaccagagaaagcatagaaaataaaacatattccccagaaaacaaatcagtttctaagccctttgttacggttggaaggctcaaatctccaactagagcaacatcaattgataaaatgagacctattaaggaagatgatgatgactcaaattttgaccataatacagcaacaggagttttcaatattagatcaaccaaagtagccatggatagtcagaatgcaaggttgaaaatggaggagcaactgagaaacccctacagtgctccattgttttctccttctgacatcttagaagcaagggagactcattttataggagataaacctcaggcaagaagtcagcctaatgctttcagaagaggcatgatggcttccatgtctcagaatatggcgggaaacccatttcctgcaggcctcggcccccctcttgtaagagtgcaaaaggttaaaggagagatgaaaaagaaacttattagaagaaaaatgtga

SEQ ID NO: 1692 - DNA, 1320 bp, Cryptosporidium hominis
atgagactgtattcgtactttttattggttatcttttattttgtatgctatgatctacaaaaattggatactgtagattgtattaagcttcacaaagatgctaatgacaatgttcaaacgaaggatgaatcaaaagaaggtagtaaggatatgagcaaggaagagcaatcaacccaagaaacaagtagtgatggtagtaacaatgataatgatatttcttcagggactgaagagaaatcagattcagaaactgaaaaaggagaggataataaaagtggcatttctgaagcaattgatgaaaaaaatgatgagaatgcaaacactgacacaaaagacgagcagagtaatgccactaatggtcaggatggatctctcttaaaaggagataaaatggaagatgagtctatcggtaatcaaattaaggatacagtgaaagaagaagatgagaagaatgaactgaagaagctagaagagtttaaaaaaagtgaaacattagataaggagcctgaaatagaaaaggagccatcagaaaatcgtgtggagaatgaaaagaagtatgagatagaaagtgagttcatttcaaagactagtacaattatttctgaagtaagaatgacagatgaaaatgaatttacaatagatcatccagtagtgaatcaggtaattaataaggttattcagccttcaactgaagaaaaacagcttcaaatagagataaaggatgactttgaaccagaaagtggtattgatgagagtaaacagactaaatctgtaatattaacttttgatttatcttctgaagatcttttcagtaagatttctctcatctctgattcgaaactaacattaacaaggtatattggtatgaatccccaaaaagtaaaaattaccttggtagatccaacaataagatttggctcccaacagacaagactttctgagctagccaaatacgaatcaatgcaatttgagttgaatcaaaaagttcctggaaaagctgatgtgatttctttaagtgaaatttcaaaccaaatccctataatacttcaacaacacaatacaacaactcttagatttctattagaagctgtagactctcagacccaatttggtatactttcaaatatggatggagtagggcctaccatagtgcttgagttaaagcctacagttgaatcaaattcgacctggatgtataccattacgggagttgctgtaattgttgtcattattggagtttctattgctttatacttccaaaataagaataaggaatctcagaggattgagaatatgcctctgttaaataacaaggtttaa

SEQ ID NO: 1693 - DNA, 1104 bp, Cryptosporidium hominis
atggtcaaaaatcattcaattgtgttgattttcttgactttaatattattattgactttagataatgggattataggggtttttggcaagaaaaaatcaaagtataagattgacaatccagaattgggaccagaatcgaatttagatcgatcaaaaagattgagagaggagatttttgaaccaagtgagtttggaattattaaaagtgatcgattgcagataatagagtcagaatatggctcgatagcacaacttccaattcgtgggcaccaatcttttgatacttcaaagattagatcccagtcaattttgagtgatcataataatggaattgagttgattaaaccttatgaaggtgtttatgttgattataatttgaccagcttttctaattttatatccagaattgtcgagatggatttagaaatgcatttaacttttaaagaggtaactgatagaaagttatctattagaagagaaagagaagttttaagtcatttgaatacacaatccaacataaaaaattttcgtgaacaaagatatgaaaagcttaattctattgagttccataacattagctttctatttttagcaggttactttaagaatgagaataaatcatcaggttatggtaattcattacaagattttgtattggtatttaaagatagtattacattgtctagacaaaatgcaaatcaatattatgctaaatatggtataacaaccttcaaggataggttaacagcagtcatgaattcagaagaaagtatgtcagttaagcatagagaccttttttcagatggtaaaatcaatgtggatcatcataagttatcttttctatatttaccgcataatgaaacgcaattatacttttcaatggatgggacccagcgattaatacttccaaagttgcatattaaagcaattcaaactcatcaagaggcagatgacacgccagaattaccttctaaagatgaagattcgaattcaaagaaggttgtaattattacatttttaatatttacaatgtttacatcttttattatattattttacattataataacctggtattttagaggaattcaaaaacactcctga

SEQ ID NO: 1694 - DNA, 246 bp, Cryptosporidium hominis
atgatggaacagagcccaatacaaggaatagcacaattacttgtatttgataacgttgactcaatcgaaaagaatgtctacttcttgagaataaatcaacttgagatctcaaaaatgcctcccttgaatagtaacccaaagatagctaaacataaatttgatcttagtcttattaaagaagcagacccaatgtcaccaatctacattgaaagaattgaagaatcaaacgaaaatcaatatttataa

SEQ ID NO: 1695 - DNA, 609 bp, Cryptosporidium hominis
atgaatggaaatattaaagagagatatagcccatttaaaggtaaagtaattgaatttttaaatggaagaatgattttaaatatatccgataatattaactcaaaattggatttaaacaaaaaattctttgttagaaaaggagaagttatacttagaatacttgaaaactattaccctcccatatttgaaagtaatttaattgcaattcctttatttatgccttgtaatggaagagcagcttggggaaaagaacatggaaaagtatttgtaaaaggagaacaaattgttgagtttatttgtattgaacaagagaaaattatcataaaacatttaatttcaccttctagaggttatacagaatctcttcaacaaaacaaatctgataataagacaactatcaactttttagatcaaagttttaattcatctattattcaaatagcagacccaattggtattatgtggcttgaactgaatgggattaatttaggtgaggaaagatttccaagttcttcaaaagaaatcttaataaagatgccttgtaatgggaggatcgaatatcctatttcagaaagtagttttgtacttaaaaatgaggttagtcattaa

SEQ ID NO: 1696 - DNA, 417 bp, Cryptosporidium hominis
atgtatatgttattaaaaaaagtattatcgttaattttttttttaaattggtttttaataataaaaagaattgaagggattgatttgaatgatgataaggaaatattaataagagaattgggtattcctttaaaaatgaaaccatttggagaaaatagagttcctagtttaagaaattttaattataaaactcaaggagaaaataataattatagagtggaaattaataatttatatattaataataaatttcaattatcttactatttgaaaataaatgataaagatactaagtttttgtcttgtggtttcaagtataggtttaataatacaactttaccaatgcttgtaaatagaggagaggtaagttttaataaattaaagaaaaaacaaaattattttagtttaattaattaa

SEQ ID NO: 1697 - DNA, 624 bp, Cryptosporidium hominis
atgagctctaaaaaagagctgccaatattatcttattgttatggacaggttcagctggcttatccatttctaccacttccaataattcttttaaaagaagaagatacgtttttggttcaattatgtgcaaaaaagtttccagattataaaggaattccttataaatttccaataattccccaagatcagaagatttcatttaataatacattatttgaaacaaattacttaaaacttgaaaataaaagttcaaagataatttataaagttaatgagaaacaatccaatataattgaatgtgtaataaatcgattatttgatggtaaaatctttcaagtattggaatattccattataggaataattgcatgtaaattaaagatgaaagatcaaaaaatacaaatagaaagaaaagttattagagctttttgtagtggtagttcaagttttcaatctgggaataacactgattttatttatggtacttttaaagtgaataaaaaatctctatttaattggatagaatgtatttcaaatcctgaagatttgttagaaaagaaattaatgaatccagatcaagccataaaagatgctttatatgaaatggatgaagaagaattttag

SEQ ID NO: 1698 - DNA, 3045 bp, Cryptosporidium hominis
atgatgaaattaatattaataaattttttgttaaaatggattatattctcttatatagtaataaataatataaatgggattaaatcaataaatactagtaattcagtttttccatattcagaacaaagaaacatatttacagatagtttaatgttatttgttgtggatcatcttgaatgtatagaaaaggcaaaaaaagatataatagaaaaatttaataatgatacaaaattacaaagtataggattatatagaagaataagagtagaattaagaaagaaggaagatgtaaagtttattaaagaagttagtaaaatgcgtccatttagtggtttatttccagttttagttggtgaagtaattgataattcaataaattattgtatatataaatatgttgatataaatatgtggtcaggttttaaatatggaaaaaaacttccaaaagagttaataaaggatttggataaagatttgttagaaaataatacaataagtattcttttatttaaaggggtttggtatatatatgaaggaaaaggatattattcaccaattagaataggtgagaatatgcaacatattggtatattttcatattctggtataataagtagtttacattatatatttataagagaagaatatagagaaaagtcaataatagataatttaggattacatagaaagaagaagattgatatagatcaaaataagatggaattattaagacaagagtttatatttagaagatcattaatgaatacaatgaataaagaacaagatgaaagaatggatatggatgctagacagatggttattcttagagataagattaataatgatttgaaaatggaagcagttaggaatggtggaaaatcatctgtagattcacaagaaaattgtttaaattgtaatgatatatttaaatgcccaaattgtgatttggagatttttccttcggaaaatgaaatagaatttaattctttagcaattttaaaaaatagaggattttggtatgaggatacagtgagtagtagtaatacaagatttcaaattaatttaccattttatgataagatggatcttgaaaagtataatatttattgtaatagtaattctttttctactaatgataaaattgggagagataatggattaaaaaaagaagtcatatctctatcaactgaggatatttcaccaatttttgattcagatattgatgttgaggatcattattataacaatgaaaatgatttatcttatggattgacttctttgaaagattcaggaataaatcaaagtaatttttcttcttcaaagtcatcatcattgggtattgctaattctcaagattcacatcaagaattattttctttggcatctcaaaattctccaaattctaaagattctcattctaatagtttttcaaaattaaattctcagatatcttcttccacttttattttagaaccatcaaagccaattataaataataaatttgatatttctaatccagactcaaaagatagtaaaaaatctttaaagcgtcttccaagacctcttggaggatctcaattgacttcagtagataattcatttgttgatttgagtctttctcagaaagcagcttctccagttatagctcatgtagaaccttcaagggatttgagtttttcacagacagtggtttccccaatttcagttccagcctcggctccagctccagctccagctccagcttcggctcctggtttatatatatctcaagtagaaccttcaagggatccgagtctttcacagacagtggtttcttcaacttcggttccagcttcggttccagcttcagcttcagtttcggctcctggtttatatatacctcaagtagaaccttcaagggatccgagtctttcacaaatagtggtttccccaacttcagttccagcttcggttccaacctcagctcctggttcatatatatctcaagtagaaccttcaagggatccgagtctttcacagacagtggtttccccaacttcagttccaacttcggctctagcttcagcttcggctccagttccagctccagttccagctccagctccagttccagccccaactccaagcttaactacatatccaactccagttccttatccagttccaggcccaaccttagctccaactacattgacttatccagcacatccaatgacacctccatatccaattccaacccctttcgcttatccagctccagctccatatccatatctatatccttacccataccatttaactccttttccatattctccagttccttttccatatccagctcaaaattcttctttaactccaattccaaatcaaacacagtattcaacaaacaatacaaccaatggaattactttagaaccaaattccaataaaaaagccacagaaagatcaaagtcacaaaatccagatcaaagttcagaaatgagtcattcaaagaaacaagatttctctccaagttatagagaattatctattatatcttcaagaaaagaaaaaaaaaggccaaaatcaggatcaaagtcaagatcaaagtcaagatcaagatcaagatctcaaaacagcaaggaaaaacaaaaattccaaaataagaagaatgtcaaaaaaaaaagtcaaaattcaccaaattcaaaacaatctttcttggaaaagagagatcagaaaagaaaaagaagatctgaaagtgaatatagccaatataattcaaaacttagatcaaaatctgagacagtacaaattacttccgaaaagcatggccataatcttgaaattcaagtcccaacaattaaagttaaattcatgattgatgaagaaagaatgattcaagacttgattaaaaccaaacaaaaagaaaattttgattcaatttatcaatctatttcctttaatcaacaaattcaagaattcatagaatttgaatctttttggagcaatagaaagcgcagtataattaatttaacaaataatacatatatatataacctttaa

SEQ ID NO: 1699 - DNA, 483 bp, Cryptosporidium hominis
atgaaggcaatttttgctagcagagccaagttggcatggctttgtatctttttagtactcttattcttgactattaatcaaactttgggatcaagccaaaaaaaggctgtagatcaatccacacaaacaggttctggtaataatgaaagtagtatgactgaggaggcagattctagtgagagagaaaatgagcaatctccagatatttctattgctttgatggattcaagtggaaactttccagcaccaaaggaatattctcaagctgatcaaggaacgagcactgaaagccataaagtggttattccaaaagcaccaaagttccaaggtgaaattgaggaagtttcagagggagaaggtgttatttctccatttgataaacaaacaagtactgatgatttggaatttgttcaatttgagaaaattaaggaagaaccatacatttacactatgccaattgattctgaaaaagccaaggcttag

SEQ ID NO: 1700 - DNA, 723 bp, Cryptosporidium hominis
atggtttcattaagattgttattcattatagctctaacaactttaattcaaaatgtcagatcatcaaatattattttgaatgagaactacacgaatatttctgaaaaagagtctatcattgaaagtttggagattattaaaagagagtatgatcaaggcaagaatttgactgatttaatcaaagatcttgaacattctgaagaaaatagggagcttttcgagaatatggatactaatacaactgaaattattccagattcctgggataagcttgaagcttctatgaaaaatactactgtcgtaactccagttgctccttttaacagctcctcaattggaggttgtgtgaaacttgcttcagatgtgaatattatctttggttctcacagagatgaattccaaaatgctgttgcaaaatgctccaggaaagctcttgggagctataagaatacatttaggtgtatttcaaagcttagctttgatggtttaaaattatcagctcaatgtaatgattgctgggcaaaaactgctcattgtggagttaagcattgtgcctcccagtgcttgtttaacacatgtgttgctaagtgtcagaaatgttcaattagagaatgttccaaacagcttaacgaatgtgcagggactacatggatgcctttaccttgtgctctagatcctcacaaaccaatccctgatcattttaaagcaaatgaccccaagtaa

SEQ ID NO: 1701 - DNA, 3900 bp, Cryptosporidium hominis
atggagagaattgttttttctaacttaatttttgccattttggctgggtatctcattagtttgtcagcatgtgctgaaaaattcaagtataattatactttaggtaatattactgttaacagcacaactccagtatatattttcccaactagttcttcaaaaaaaaccactactactactgcagaagtaacaggagttggtgagagtattcctccattaggtccatttgacagaattagaggtccagattgcaaaactccattcgttacttttgatttaaagctaatttgtggttctgatggaaaaacatatgataatgtttctatcttcagaaatgctcagtgcgataatgaaaaccttgagttccaacattggggaagatgcaagggaactctaagttcagttaagggccgtgaacaactcatctccaaacgtccatatttgccacaaggtattgtcccatctccaatttccactaccactactaccaccgctaccactactactactactaccactactaccactgtagtggcaatagttgacttccaggaaggttctccattaggtccattcgacagaattagaggtccagattgcaaaactccattcgttacagcagattatagaccaatatgtggttctgatggaaaaacttactcgaatgtcgcacttttcagaaacgcccaatgcgatgatgagaatttggacttcgtccactggggagaatgtcccacagaagttaagccagaagaatcaacagaaaggcctccattaggtccatttgatagagtcagaggtccaaattgtaaaactccatttgttactttggatcttgacccaatttgtggttctgacggaaaaacctatgacaatacttcaatattcagaaacgctcaatgcgatgatgagaatttgaactttgcttactggggagaatgtaccacagaagttaagccagaagaatcaacagaaagacctccattgggtccatttgacagagtcagaggtccaaattgtaaaactccatttgttactttggatcttgacccaatttgtggttctgacggaaaaacctatgacaatacttcaatattcagaaatgctcagtgtgatgataagaatttgaaatttgcttactggggagaatgtaccacagaagttaagccagaagaaccaatagaaagacctccattaggtccatttaatagaattagaggtccagactgtgtcactccttatgtaacttatgaattaaacttgatttgtggctcagatggaaagacttattcaaatatctcgagcttcagaaatggtcaatgtgaagatgaaaatcttgaattcaaacgttggggagaatgtacttcagaagaatctcaacctaataaaaagaagagagaagatttgggaaccttggatagaccaagaggtccaaaatgtaaacaagattgtccaaagttctatgatccaatctgttcaagtactggtaccatttatgcaaatgaatgctacttcagaaatgctcagtgtgatgatgaaaagcttggattcctccattggggggtttgtaatagtaatgatgctgataagattaatggaatcatctttatcgaagaatctggtccttttgaattggaaccattgggtccatttgacagagttagaggtcccgactgtaagacagtttttgttgatttcaaatactatccaatttgtggtactaacggaaagacttacgaaaatgtttcccatttcagaaatgctcagtgcgatgatgaaaatcttgaattcagatactggggagtctgttttgaaggttatgaggaatactttgggaatatgattccattaggtccttttgacagagttagaggcccaggttgtaagacaccttgtactaaagaatataacccagtttgtggaacaaatagagtgacatattcaaatccatgcgaattcaggaacgcacaatgtgatgatgtgaatcttgaattcctccattggggaaaatgcagcaagagtatatgtaacaagccagctcaaccatcagctcaaccatcccaggctccagttgtagttgagagacgtacgtttaatgcagaagaagcacgtgaacctttgggtccttttgatagagttagaggtccagagtgcagaactccatgtactagagagtttgacccagtttgtgggacagacggtattacttatccaaatccatgtgaattcagaaatgctcagtgtgataattcaaatctcgaattcgcttatttcggagaatgtagtgatgagtctgaacaacataaggatttaagtccagttggtgagttaaactctgagttttataaatacaactatgatctctatagaatcagagggcctaattgtaagaagccatgcagtagtttagattcaccagtttacggtagtgatggaaaggagtacaaaaatatttgttatttattaaatgcgatgtgtgatgattctaccttggagcattatatggccagagtttacaatagtgaagaagataagaagaatcctccaaaagtaattaaggcagatttaggtccatttgataggaaaagaggtccaaattgtaaacaagaatgttctaaatattacaatccagtttgctcaagtactggtaccgtttatgcaaacgattgctacttcagaaatgctcaatgcgatgacgagaaacttaaattcctccactggggagtttgtgacagtaatgatgctgataaaatcactgcaatcatatttaccaaggattctggtccatttgagacacttccattgggtccatttgacagagtcagaggcccagattgtgtcactccatttgtgacaatggattatagaccaatatgtggttctgatggaaaaacttacacaaatatctcgcactttagaaattctcaatgtgaagattcaaacctcgaatttgttcattggggtaaatgtctcaccactgaagaaaatgttgaatctcccgatgttactgttggtggtagaggcctcccaggtcctttagatcgtgaaagaggtccaaattgcaagactccatgtacaagagaataccatccaatttgtggaaatgatggtgtgacttacgccaatccatgtacatttaagaatgctcaatgcgataatgagggattgactgccttacattttggaaggtgtaatgatggtgatgttcatttaattacaaccacaaaaacaaaaactccaggaacagcttgttcaacaaaaccaacaacaagtgaaatggccaggggacacttaagaagcgtaaaaggaacaaatgaagaagaagatggttctttaccaacaagtactactactaagaccatctcagaaagctatccaaaatcagatgaaaaagatgaaaaagaagagcactttatgagtttaatggaagttctttccaaaacctcatttaatactccagaaccaacaataacaagagaaagtactggtaactgtttaaatccaacagatttggaaattttgtttggtgaaactagcgtatttttccagaatttggtgatcgtttgtggaagatcatctcttggaaatggaggtaagacagccaagtgtatacaaagcagatcttttggtccaaacgaacttaggatctcagatcaatgtgtttcgtgctacaaggaatcagcaacctgtggtggtaagaaatgtaaatcagcctgtctcacttctacttgtaatacaaaatgccagaaatgctttgagaagaactgtgctagcagtcttaaagtgtgtgttggtaccagttggttaccaagaccatgcggacttgatccgtttggtgaaattccagaaggatggaaagttccagatccaaaacaaagtgatgttgctccagccaaataa

SEQ ID NO: 1702 - DNA, 1590 bp, Cryptosporidium hominis
atgaattcagaatcttttgataatggagatttgacagtctcaaatatgtcagaaataagttgtggaaggagtctatgtttatctactaaagaacaatataaagttataaatagaaatcaactaactaaattagattttccattatttagagcaggaacaacaagtattgagtgtggaatgtcattaatggaggagatttctgatattgaagatgaatgtgaaaatccatttgaaaatgaatccaaaagaaaaaagattaaagaattaatggtgaaaataaaggataaatctaaacaaggatattttaatttaacaaagtcaatttcaaaaattggaacaaaaatcaaaacaaagatatcttcagtaaaagagtctagaaatagtgatgataataaaagtatctctaggcttacttcgaactgtagcagtattggaaaatcaaaaccatctttaagtttatcaaaactaaaatcatttggtaaaactcgaataatctctacatctagaaaagctaaaattcaaagaaaagttagtcaagtttcaaacaaagcatcctataaactaaatacaaaatgctcatatgtatcaaaaagatttatttctgcttcaagtactattaaatcaaagattgtatataattattacaaattacgaaatattgttggaaataaattcccaagaaaaagttctaaatttgttttatcatttaagaaaagttccgatgatattgtgagaaaaaccatgaattgtaattatattcctagtaatgaattgatttatgattctgttgaatacatcagtagaaatgctgatgatgatgaagaaattcaaaatattactcatgagtttgaatcaaatcatatagcagttaatagcgaacaatatgatactgagaaacaaatgagtgatgaacagtttttagaaaatgatattaatattaaatcattaaatagtaactcagttgaaattgatttaacaaaagatgaactctcacaatttgaaaacaatgctgaagttgatgatactacccctactacaactattgactcttttttgagactaagctcaatggattcaacaatatgtacaaccattcaaaatgatacaaactcaaatactccatttcctataatgttaagtgtaggaaaaattatggaacagatggaactattgcatcaagaacttattcaattaaaaaatgataataataataatgcaaataccatacttacatttggaaaagatgatatggaaatattctcttcaatgaaggaacttgttaatactttaaacgcagacaagttgaaagaagaagaagaagacaaaatttacaaaaagaatgatagtgatgaagaaatcatggataatagtttaaataacaatattatttttaaacaaagccagttccgacatgatctagtttttacgcttttgagacaaactctacaatattatgagaatgtcaaaaactcatacttagattctgaatttaaagcaaaatctaatgataatgaacaaattaaaaacctcatcattagtgcaattcagaaattaaaatccggcgggaatttgcatgcattagaagtttaa

SEQ ID NO: 1703 - DNA, 933 bp, Cryptosporidium hominis
  misc_feature (634)..(663): n is a, c, g, or t
  misc_feature (665)..(696): n is a, c, g, or t
  misc_feature (698)..(708): n is a, c, g, or t
  misc_feature (710)..(711): n is a, c, g, or t
  misc_feature (713)..(717): n is a, c, g, or t
  misc_feature (733)..(733): n is a, c, g, or t
  misc_feature (848)..(848): n is a, c, g, or t
  misc_feature (878)..(878): n is a, c, g, or t
atggaagatgagacagtatttgaagttaatgaaccaggaaatacacgaattattctctgggatgatgttcaaaataagcatattgaattaaaatggaaggtattaagtggaaaatatggttcagtgacttttgcaacagtattaagaccaaaaataaataatgattatttagttaaatctcaaataatggcaaattcttgtaatatgccattaagaattaagaatataagaacttggttccatggaaatttatatattaaatcaggatggattccagaaaatatgaaactattcttggcaataaaaagtccatttaaaggagtacattcaattgaaaaagaaatttgggaaagagaaaatcttataagtttgttattgactcgcgaagtattttcaatggttttaaaagatggagaattagaccaatatcaattatcaccaagtattgtaacttttcatcataatgtgaaagatttcaataaaagcccatcacatttctttataacaaattcaaaaaagagcttaataaaattaaatgatccatataggccattattttccaattatttatttatggaatatattaatggtgttcctttggataatttattatattatttaagaagtgaggatnnnnnnnnnnnnnnnnnnnnnnnnnnnnnncnnnnnnnnnnnnnnnnnnnnnnnnnnnnnnnngnnnnnnnnnnngnngnnnnngggggtctttcttggngttcgccccgccggtttgcgggcgctcgcccgcgcgcgtgtgttgtttcgcgccgctcgcgtgtcgggtgcgtctggctgggctcgggcgcggccgctcgtctcgccggggttcnctcgcgtggcgcggcttgtcgtcatcgtcngcgattcccatctactgctccttcatcttttcgccccagcatttcggccccgtaa

SEQ ID NO: 1704 - DNA, 2664 bp, Cryptosporidium hominis
atgaagttatcccagttggtgtttttactactgggtatttttttggagtttgtggatagaaatgatgcaataaaagttaaggaaggcatcacacaagaaagagggaggatgttgagtaggggtagaagagctgtttcacaaggaagtataaatagaggaactttaccatcaagaaaggcttatcaacaacatttattagaggattcaatgttaggaagcgatggatctgactttataagtgatagtacaataggaggaatcattcatgataaaggaataatatccgaagctccatctaggctgaaaactaagccagtttttgcacgggttcagccagaaggtgctacagcaaaattacaagtgactcaaaatatttctcagagacgtggaggaaagatatcttcagttgtgcgttcaatttctccaaggagaattagcgtgatagatttaaatatgggaccacaagaaatggtaaatgctttatcacaagaagcaagaaaattggaggaggataagactggtgttaacaagggttctgctgaattagcatgcggaagatataattttatgtttcattgtgaagtagttgagatttcaaaggaaatgtttgaaaagaagaaagataaatacttatatacagtttctggttcaaaagataagagatatgcttggaatactgctcaaggaacatatggaagggtagtttttggatatattgaggttccgactgtagatcaaagatttaaaacaggtaattcacatttttctcaattttataaattgccagagactttaactggagttaaggtattatttcatggcggaggaaaatatcctgcaaaatatcttctaccaggaatgaaggttagtgtagctattaagtcatattttagaggcgtattcaaaattggaaggattgtttggaatagggaaagagagattctttattcattatccaaagaattttggacagatgggcatggtggtccactaactcatactccaacagtatttagtgttcattatcaagacccaatgactaataaacaacgagtattatttgaagatcaggaaaataaaagagcgttggtttcagaattgttaattatggaaaggattactgggcaaacattttttgaagttttagtatatcttcaagattttaagatttttgaatggctagagaaaacaaatgcctgggaactttggaataaagcaatatataagctacaatggactttaaatcacttattacaaagttttatggcaactggatatatattatatatgcattgcgatttaaatagaagtaatattttactttcaattccgcctttgactatggatcataggcgaaatttattgaatatcatttcaatggaaccatgggatgctagacttattgatctttcttttgtatgggtaccaagtgcattaaaatcaagaaatactcatagtatttgcagtcaagtaaataaagcagccatattttctgatgctaattatctatatgtatgtattattgaacttttaaaaactcctcaaagagatcttccaatttctaagccaactccactatataaggctgtgagagctaaagcacttgaattatgggaaaaaattgattcaattaatgaatggtggtctgttggtgttaattttattggtcgtaattcttcaacacatacaagatataaaattagaaagcctgaattgggtggaaatacattcaatgaatgtattgaaggtattatgatgatgtcagatgtttttgatactgaagctaaaaaattgggaattaagttgccattccattcattttcacctgaagcttatctaagaggttatttgcatctttcatttaggatttcaagacttggattatgtttaagaacaaaaattacagaaaattgggactctctaaagagtgtattacttcctactagttactttgacttttctgttatggtactttctttagatgaaagcatatcatctaataaggattctaatatatgtaaaatcaaaattccaacatcggaaagacaaatgattgaaactcgttcttcaaataatcaatcaggaagccattatatggaaattactctccctaataaagtttgccaagaaattaaatcatgtatggcagaagttgaagcaatgaaatcaattccaggagatgtagttatcaaaccagcaatttctgttgtaacagctgaaaatcatgaatctgaacgtttgttacaggagttgcgtattgaaaaaagattcccagaatcaatacaagtattaggaatccgtttatttggaagattccaaggaattaatactaatgttgatttaaataaagaacaaattttaagttttctaacacagttgagtttaagtgcacaaactgggagattaagatcgaaaaatccttctgaaagttctttattgagtgtatgtaatgaacttgaaagtaatggtactttgaagtctatatttggagcccaaaaatatgcatctattgtatcttatgcaagtaattacagattaaataaattttgtcaacttttgtttaaacagttacgtaatactttgctattttcaaaccacttggatcctaattttagatcaggatcatcaactctaacatcaaaaacagcaattgtacgtaaataa

SEQ ID NO: 1705 - DNA, 2502 bp, Cryptosporidium hominis
atgaaactttgccaagaattaatgcttctatctcagaaatatttgaaacaaaaattgaacataaaaatcgttatacttctctatttgcctttactctttggaaaaacgagattcaatcttattgaagagacaatccaaaatgaattaaagctttataattacttgaaagcatttccaataagaataaaagattttgaaaaatatattcagctttacacaatttgttcgtatctctcaccattattatcatgtgaaattaaagaggttcccaacatgaaaaaagatttgtttaatgtaacatcttcagctacatcgaatttattttcattcaataatatatccaatttcagttccgtaaatcttgagaaatataatcaaacgattattaattttccttgggtttcttcaaaatattcttataaatggaatgttattagtggtacatatggtgatgttatttgtggaaaaatcttcggtggaaataaacctttatttcctcatattaaagaatcatcctcatttttctttaatacatatagaaactttaaatctaaagaatatgttgcatatatatttgattcggaagcttatgagacaaatattgtttataagcaattggaaactggaaaagatacccacgtttgtattaaatcattcagatcaatgaatcatcctgcgtattttacgatttggaaagatgagaactataatttaaagtggctagagagggaaaattggctttcgggactttccaataatgaaaaatatatcaagttcaccccaaatcaagttctcatagttccaagaataccaaaaaaccccaatcatcaaaagggaaatcctttaatcatgcagttaaatgagaaatctttacatacttgcacagatgtctgtgaaaactccattttctatccatcagtttacgaatctcactatccttggagtattgtctcagggaagttttggtcctcttatttaattatggaacaatttgcaggtccaagtttttctgatatttccaattttcttactttggactctgtaattaattggataaaactttcaaaagataatttttacatttggagtgcttgcttaattcatatagtctatttattcttttctgctttgatttccttcacttttactggaagcctgatgtatcaacactgtgatttacatgcaagtaatttaattttaataagcaataattgggagattaacgaagataactccttttccaaaccaaaattccaagtttcgttccgagaagcactttctgaaattatttcatctaccattaagactgtgaaaattattgaccttacatacattacttattttaatgctaaaaggcgttctttaacccaagtatgcgagacttttggtgaagtttcaatttcagatgttgaaaattggcagatatttacctataatctgaaagatcatgtagataatgccttttccaaagataaaaacctctcaaattacattaacccaatttctactttgattaaactctttgaaagcgatatggactttaatttaacaaaaccaaagtatgtaggaggttccgaactttggtggaaaaattgggtctttgaccaaaacaaatttgatgacttgtatgattctgtattgggaatcggaaatttctttagcaaggctattaatttggtagaattatcaatatatcagaatgaaagcattccactacttagtccattaaaaataccttattccaaagttcttactaacccaatttttttcgaagtttactttaaagaattattttacgttccatattctatcttgtcttttgggacttgtattaatcagcacgaatcgttatacaataaccaaatctactttttaacagctgcagaaactttaagtcattttttcttaatgtcttctcaagctgaacttgataaactccctacttgggtgcacaaagatcaagttggatcaaaacttttttggaatgagtgtataaaatctaatcgattattttcgaattcaatttctgaaaattttcctagtgcattttattttgaaccatgtattaaagaattttgtgtttctaaaaaatctttttccaagaaaataaaactttggattcaagaagatattcaagacagagacttttttattaatacttttaagaaacttatcttactttcttcaaacaaaatcagttttaccttgtcagttcttgttttgaatcaaattaaatttacagttaaagaacatattattattaatccagagaagctcttacaaatctctattgctttttcaaactccctttcaaattatttgattcaccaaattcacgaagaggaacccattcaagaccctcgtttatttttatcattgtgtgttacgcaatattacaagcatttacatttatatattaatctttcccattttaattttggtgagaagctttgctccaaaatttacaaggctgtatttaccaaatttacgaccactttgtga

SEQ ID NO: 1706 - DNA, 336 bp, Cryptosporidium hominis
atgttttacagggcttattatgagatcgcaattcaaaagtatataaatagtgagaacaaggaatactgcagaaaagttcaggaggagatagcattagatcgagattataggcgttttaaatccaatattaaatttaataaatatcttgaagaaattaagagctcttttttcgagtataatggacaacagaaattaaacataattaatccagaatatatttgtaaaaacaactttctaaatgtaaatagtaaaactactccgaacaatgagattataagacaaggcttttgtgaaattcttattaaaccactaaattacattaatatcaaagtttag

SEQ ID NO: 1707 - DNA, 1746 bp, Cryptosporidium hominis
atgaagatttgttttaatattattggggtattatttttaatattaagttgggtgggtttggtggtaccaaaattggaaatccgtataagtagataccagtttgacaactttaagaatatgataaataagttgagtttggatcccaatatattttctaggaataagaaaattaaaaatgtgatagcagatagaatgattgacattagttcgagatatagtgctttgttggactctattttatcatttgagaactggattaagaggttttcaaaggaatatcatgagaatacatttaaaaataggaagattcttgctttaataatatcaataaattcagagtttgatgttattaaattaaagttcaacaagtttagtaatgatattgatacatttatagaatcaatgttttcaaaaagttcttcgacatgtatttcaagtgaaaaattttctaaaggaaagtacaagaagacacttgagaacttatatagacagctatttattttaaatcaggatataaagaggttggtaggttatcaacacaagatgattaattcaagttcattatatatagtaaagttggatgaacgaactgatcagacaaaaacaacacaagtacaagatattgttgatatatcaaatgaaaacagtttgtatgatttgtggatatattatgagcatcatagactacctaatttgaaggagaagttagttttcatttcgaggtctatttctattttaatatatcaaaacaaaataatactagaattcttattagatagatataaagttttaacagaacagtatctagagttttttaatagctcaaatcagacaaaatcagtgaatttgagagcaagctctcatgaatcaaacctatcaaaatatttggatgagcatgaaacaaatttagaggcttctattcaacaacaacgacagttctttaaaaagtgtctggatgctgaagagtcggggttaataactcctttagattctgttgggaatattggcgatgatagttttaatatggaattatttaatgtaaatcatatggttgagttcatgatgagggagcttgagacaaaatgtacagaatttcagagaaataacgaaattctttcagaatttaacactttcatcgcaaatgaactaaaggtcaatactacaaatattaatgatttctttttttcaggggatccacaaataaaaaaaaacgtttttagccatttaacttatcaagtaaatcaacttaatactatttcagagtttgttaatatacttgaacaaagtttaaaggcatatcactactttaatattccttgctattatgggatcgtaaattactacctaaaacaatcctttaatacatttttcaacatttactacgaaatagaaaataatctcatgcagaaaactaatattaccgccatacttgagccaaatgttggcgcccttgaaccaaaacataacagtaattctgaattaaataaagttaatattactgttactgatgaaatgataaaatttatgtttaactgttctgaaatcgcaaattctgagaggagttgtaaagaatttaaaaattttccacattttgatacgaaatataattttgcgactttcactaatataagaaatcttccacccgatcttaatttaggcgagcttaatgaaaatttagaaacacttatggatcgatttctaaagggtattatagtacatgagaaaaaactaaatgatgatgagtga

SEQ ID NO: 1708 - DNA, 336 bp, Cryptosporidium hominis
atgggttgttcatcatcaaagccagaaactaaagttgctgaaaataaatctgcagcagatgctaacaaacaaagagaattagctgaaaagaaggctcaattagccaaggctgtaaagaatccagctccaattagcaaccaagcccaacaaaagccagaagaaccaaagaagtccgagcctgcttccaataatcctccagctgctgatgcgccagcagcccaagctcctcctgcccctgctgaacctgctccacaggataagccagctgaggctccagctgctgaagctccagctgctgaacctgctgctcaacaagacaagccagctgatgcctaa

SEQ ID NO: 1709 - DNA, 3129 bp, Cryptosporidium hominis
atgggtttaaataatctcggatgtttatttttgttatcattgtggttatttttatatgatttacacaattttcaagattcctcatgcttgagaatatcaattttgagtttaaagagcgaagtatgcgaaagtagtgatactggaagtggttcttcggatttggagtcatcaaagaatagcgataatgatacggagagcgatgctgcatctcaaggcagtcatgaaagtaatacaagttctggcggagaatctagcactagcagccaacgaagtacgtggggcccaccttcccgacttcaaccttatgatgttggagatggtggatctcaggcttcttcacctgtagatcaattagatgcagcacttcgattagttagtggtctggattttgatgtcggtgctacaggagaatcttttgtttttggttctggatcagataacaatcagaagcaagatcagaatgatggaaacactgaaaggggcgcatcagaagcagccttacagtggtgggtagactatggtaacgggggaaaaaagccaaagcctgtgttaagttcatctagatccagctcttcttgtaattctagcagttcaagaaaaggtaaagcggatgttgattctggatccaagaaaactggaaaaggtagcactggaccaggtggagcatgcggaacttctagagggccgaataaagcagataaaacaaggaaacttggtacaacaggtaaaggaagagacactgcaagcggtccaagcggcactggaggcagactaggtagaactccaaacggatcaggaggaagaggaaacgctccaagcagcacttcaagaggtccaggcaacgcttcaagaggcccaagcagtgcttcaagaggtccaagtggcgctccaagtagcgctccaagtagcactccaagtagcactccaagtagcactccaagcggattaggagggaaaggaggcgctccaagcagcgctccaagcagcgctccaagcagcgctccaagcagcgctccaagcagcgctccaagtggcctgagtagcactccaagtggcctgagcaacactccaagtggcccgagcagcactccaagtagtacaggcagtgccccgacgggagcaggcaaagtttccactacaggcggatccagcagtagcccaagcgctccaagtggtacaggctcattagggggaataggtggaagtgccacttcaagcggagcaggaggaagcggtagtggagcgggaggtagtagtggcggaagaggaggaggaggaagaagaggaggaggaggaggaggaggaggaggaggaggaagaagaagaagaggcaggggagatggcaaagaggaaggaagtgaagataaagatacagatgatgatgagtcaggcaatggtgaagattctgatacttcatccagctcaagtggatctagaaaagaggaaatcttgaaaaaacttaaaagtattaaagagactgcggaaaaaatgaataaaaaaatcaaagaatctagagaaagaagaaatcaatcccataggtcacgaggcttttccagtagcagctctttatcatcatcatcagggtcattattcagcggcgacttatcagactcaagctacagtttatttggttcatcttcaactgtctcaagtcattcgccaagtagagaaacattaacagttcaagggccttttggaacatcaggaagtggagcaggaggcggcgcagtagctattgatggaggagcaagtgcgggagcaagtgggagagcaggtgggagagcaggtgggagagcaagtggaggaggaagtggaggaggaaatggaggaggaagtggaggaggaagtggaggaggaagtggaggaggaagtgggagagcaagtggaggaggaagtgcgggaggaagtggaggaggaagtggaggagtaggagctctaggcggaggtaaaagaggagctggaggagtaagtagaggagcgagtaaaggaacagtaagaggaacaagtggaggaggaagtggaggaacagtaaaaggaacaagtggaggaacaagtggaggagcaagtggaggagcaggtggaggagctagttcaggagctagggctcgctctcctttgggagccaagtctacgcaaagatcaaggtcaagatcaaggtcaagatcgaggtcgaggtcatcaagatcgaggacatcaagatcgagatcaagatcaagatcaagagccggggaaggatcaaattgtccaacatcttcatctagatcttcacttcttttatctcgtcagtcttctgtaagtgcaagttctgtgttttcacctacttccgctccagttaatttggtagtttcagtaagtggctcaagttcagatctaattgtactgaaattttcggattctgtagtaggaatcgttgattcatccaaagctagaacaactggtaaaggaggaagtgaaggaggagaaagaggagaaagaggaggaagaggaggaagaagtggagaaggtggaagtggaggaagaggaggaagaggaggaagaggaggaagaggaggaagaggtggaagcggaagtggtgatggaggaagtggtgatgaaggaagaaaagcgcctaaaagttatctagaaatgtcattcgaatctatatcccaattgagaagcgatttcggttctgttttcagcgctttattagactcttttggcctgctagttgattctagtttctctgagtcgtgcttatcattgattgattctctggctgatatctgcaacagaagggattttaaaaatacaacattatgtacagagattttaacccttattgataagttaaaacaacttgaatcaagatatttgaagttattatcagaagtttccagaattggaccccaactaatgagggtagatgaagaattatctaaactacaagagtctttaataaattatggtggaatatttttgaaatcaacatatctaagtagtattcagattctgatggaaagtgcaaagaatttgactaaaaagataaaaaaactccatgaaagtttagaagaggcaaacttacagtattgtctaggtgggcatttgggtttacttaaaactcaaattttgactttcaaaatattaaaatga

SEQ ID NO: 1710 - DNA, 279 bp, Cryptosporidium hominis
atgaataaaatggttagaaacataactagatatttacaatctacatttaataaatattgccaagaaagaagtttaagaacccttgaagaatcaattcttgggcttaaatctcaactttccaagaaacaaaggactaaaagtcaaagttcaactcattcttctattacttcaacatctacatctacatctactcctaggagtcgtcctactagaccaaagtcttatatgactcaaactttaagttctaagaaaaaaagaagagaaaaatactcaaaatag

SEQ ID NO: 1711 - DNA, 501 bp, Cryptosporidium hominis
atgaaactttgtagcttatttgtattgatttattctatagctttaattaagcagaatattattgacttatttggaggtcaaaacaagattatatctccattattatattcattacttcagttaactgcaggtgttcaaggtactgctagttcaaaagaaggtcttaattcagaatttggcaggttgggtcttatcgaaagtaacattgatagtgaggttgaagtttctggcagactaactgtatcatattcacgtatcgaattggttaacttaaaagactctacaaagaagccttttgaacaaattgaggaatcgtatcgaaagttagttaaacatccaatagataagaaatgtgttgccgcaatttttttaattcttcaagcttgtatttctgaacttggtaaatcagatgctacttgtaaaatgttaagaagaaatcacaatattgttaagaaacaagtaaagaattataaggtggttactgaaaaatactcattttaa

SEQ ID NO: 1712 - DNA, 957 bp, Cryptosporidium hominis
atgaatttgaaatgggcctgctttgacagtgtttctattctgcatttaaaagctaattatttaaaccttgagggtggtaatgaattggaaggtactgaattacaagagccattgagtttttctgaagagtatttgagactaagtaaaattcaattcgatcatagtgaggaggaggaggagaaggaggaggaagagaaaacagaaagaatgagctgtagatcaattaatgaactttttgcttatattgatgaagctaaacgtactttttcgtatagagtttattactatgataatttaaagttgggacaaaattgtgaaagctttcttgatgagttggttgcaatgtgtaagcaaaaaaaatatttaagattccctctttgcgaaaaaattatcaagtctcataaatatgtgaaacaaatgaagataaactatgataactattcaaaggaattgcatagattacatgatttatttctgactatttactctaaaatttattcttacaaaacgtcttgtaatatttcaatattaattgaatcaaaaatcaaagagcaagccttagaattcatacgtgaaattaaacaagaatcaaatttaaataaaaaactcaataagttttttgattttagttataaaaattgtcatcctttaataatttttaagtataaagacaaactactaagttatagacctcgggttcattttaaaaaaggaacaaggttttttactcaagattactcatacaataaaaggtatagtacgatatctaatgaagcttatcctttgaaagctaaatcacgcaataacctagagacttcagactctggtcaatcttcgcatgattcaagttcttcctcaaaatcgtctagaggttacatgagtcctacaattagttatattaacaagatgaaaagcaaaaaggctcgagcatcaagtttacataaaaaaggagattga

SEQ ID NO: 1713 - DNA, 375 bp, Cryptosporidium hominis
atgatttctagtctgatctttgattgtactgcgagcgctaatcaggctattttactttcttacttacaatatttaagattgacaagcacttatggtgaacttgacgctagaatcgaagatgttaattcaattaattcacatttagaggctgtcaatgcaaacttttgcgatgaaacattcatatctaatgtgaaatatttaattgccaatatgaaaaagaaagtaagatttagagatgaatcttcatcaagttcaaaagttaaaaaacaaacttctaaaaagcgttccagtcgatcaactgcaagaagatcttatatggaacatacgttaagttcaagtgctaaagttagaaaaaaatacaatggagaccattaa

SEQ ID NO: 1714 - DNA, 861 bp, Cryptosporidium hominis
atgaatttcaataagtactttctgttagtagttacaataatagtatatattaataatttgaatttcaacaataatgaaagattatatacaagtattgctcacagcgattctattttcgttggaataaaaaacaattctcgtaactatttgctctcttcacaaagttttttgactatatcccttaaaagcaatgcacctagtaagaaatcaggtaaaaagtcttctaaaaatgatggtagtaatagaggacagggacaaaatacacgaacttttgaagagaatatggatgatctagctcaaaaacttgaaaagtttagtattagcagtttaagcaagaaagttattgaagttacatgtcttgatttcatttctttgcttaatgtacttattcaagggattcaatttttacaaacattgattactatgattggcgactttagtttacttgaacgttgtttacaaatgttaatttcaaggagtgttggaaagggatcaactttgtcaaagttgctttcttcgattaaaaaggtttctaaagcacttgaatcacagaaatcaatgtttaaaagtttattaaaactgctaaatgaatctgaatcaaaaatagctagtatttccagtttaattaaaaaatgcacaatgacagtttctcagtcattgttgttaggttctccaaggtttgaagattactttggcttacctgaaaaaattaatagctctcaaaaaaaagttacttcttttgatagtttcgttaataaaatcgttgctgagtattgcaacgatggcttcttagctaatattgataatgaaattttgaagttacaaagtaaagatactgtagaagatatggaagttagttga

SEQ ID NO: 1715 - DNA, 2790 bp, Cryptosporidium hominis
atgcagctaataaatataatagtaaaaataattgtggtatttatgattaatatagagtattttccgagagaagacaaaaaattaggcttggttataaactctttattacatttaactttgaaaaataacgttggttcaaatcctatatcaacgacaaataatttggttactagtacatctacaaatgatcaaagtataacgagcgaattccaaagaatgaatttgattgacattaatgatgaggtcaataatattgaatctatgactgtaagtataagttgcaattcattagaaagtttgattcgtgaattggaattacgaagtcaaattctttcaatacagggaccagcactattatattctctaataagcaatgaatgcttggctcatttggaagaaatggctttaatatgtatgaataagaagcatagtagatatcttggctgtagtattattagaaaaaatctagctaaggttaggaaacaaattaaaaagaataacagatatttattaaaaatagcaagatttgaagaagcatttattacaataattccaactcttaaaggatattataggagttgtggtaatgatgtgaatattccggagactgaattaaatgaatttaagagttttgtttcaagttttggttttatttcttttttggcaaatttgagaaatgaaaatgaaaggattttttcagaaatatgcgatttttcaatattgaatgagatgaaaaggaaattattatcttttaagccacgagttactttcaaaaaaggaacatattttaaaccaagagggagagatattaaaacactaagcctttctcaatatttagatagaaatgataggttttataattctgagttacaaagtggtgattttggatctaaattgggacagaaagtggtcactgagccagaatcacgcttaagttcaagtaggattacttactttggtggaaaatctaggacgggttcagattcagaccccgattctgattcagattcggacacaagctcagattcagattcggattcagattcagactctgactcagattcggactcaaattcggattcagatccaagttcaggatcaggaggattaggaggaacaggaggtagagaagcgggaacaggaggattaggaggaggagaaggaggaggaacaagaggaggaggaggaggaggaagaggaagaggaggaagaggaggaggaggaggaggaagaggaagaggaggagaagcaggagtagggactgcgatgggaagaggagcgggaagagtaaggagagtattacactcagcatttttctctggtaaaagctctgttttttgctctagcattaaagtagaatctagggcatttttaaaagaggagcaagagactgaaaatgttaaggaaaagtgtttagcaagcattccagaatctgaatcggatactgactcggattcagactctgattccgactctgaaagttcaggaggctcaattgaaaagccaagcgttgagggaaatttaagaaaagagagggaattatcaggttcaaaaacgaatacaggagaagaaagcgttaaggcaccaaagcgagtttcatgcacgggaggaacagattctggtacaactggagactttgatagcaggtcgaggagaatactggattttacaataaaaggttcaggtttgggaggatcgagttcaatagaagctgcattagggagttcaggtttagatgtattgagctcaagaggaagagactcaggcagagtaggctcaggtagagtaggctcaagcagagtaggagcgagctcaggagcaattggaacaattggaggctcaggtataggaggctcaagtagaggaagaggagcgagctcaggaggaaatagcatgggaagactcacaggtaggggaggattaggtttaggaacagctggaagcttaagcagaggaagaggctcagacaggagaggtttaagttcaggagcagttggaaccattggaagctcaggtagaggaggctcaaacagaggaagaggctcatacaggggagggttaagttcaggagcacttggaacaattggaggctcaggtagaggaggctcaagcagaggaagagggtcagacaggggaggtttaaattcaggaacagttggaacaattgaaggttcgggtagaggagggttaggttcaggaacaactggaagctcaagtagaggaaggggcttagccaggggagggttaggcttaggagcagttggagcaattggaggcttattaagagggagaagctcaggtagaggaggaggttcaggtagaggaggttcaagcagaggaggttcaagcagaggaggaagtggcataggaagactcacaggtaggggagagttaggttcaggaacaacaaaccattcaaattgttctttaggtacaactgaacagaatactacttccgatcttctgagctcaagatcaaggtcgagttcaagatcaataacaaggacaagatcaagatcaagaacaaggtcaagaacaagaacaagaacaagaacaagatcaagatcaagatcaagatcaagatcaagatcaagatcaagatcaagatcaagatcaaggacaagaacagatccagaatctaattctagatctagtccaaaatcaggaataagctcaaatataggtatttcgtcgctaaaagcaaaagatatttctggccctaatagcaaattaccttcatatatgaaaccaacaataagttccagaaacaaatcagtatcgagaagttaa

SEQ ID NO: 1716 - DNA, 768 bp, Cryptosporidium hominis
  misc_feature (740)..(740): n is a, c, g, or t
atgattactaatattaaaggtaacaatgcagaactctgtgatttctataatgatccaaaaagaagagaaagggaaaacgattacattaataaagaagcatttccaacccttgatctttcaatagaaggtatccaagaaagtatatctaaagtttggaatgaatgccaacaaggacaagaattattagaagaaattgatcgtattctttccactttatactcaaaaatctcagcattttcatcttcaaataatgcttgcttttcattacaatcagtttctgagttagattctctcgttaaagaatatgagattaaaagatctcttatttatgaaactttgaatagaaaaatcaatctaaagagtgagctggaactattatatcttgattttataaaaaaacaactccaagaaactcgtattccattggaagatgttcaagagactaccaacataaatcaatcttttttctccaataatataactcaaatgtcttcaaattcctgttctgattggagtatgatcaatgaaatagaccaaaatgcttattccagtggtttagatagctttgacgatgatgatgatcaagataatgaatctatgatactcgatatgagcatttcaggtagccattcaacaaatttcgaatatattcatcaaacccaggaagataggcttgaacaaaatgagcaagagattctttatgtcttagagatggaccaagaacgtagagatgatggttntattccttctttcatctttcacttttaa

SEQ ID NO: 1717 - DNA, 3237 bp, Cryptosporidium hominis
atgatggattggacgagtgttattgagagagacttgcgtcgactctctgaattatcaaagggagatataacaagtatattgggatttttacatcatgatgcctgtgatggaaagttgtacagattagtaagaagttcatttccatttaatttgtcatcaggacctccaaattggggtttatgcaggccaagcgaggtcccttcaactatttcattgagcttatcttatgtttatcgtaatgcagtagaggcagctaatgcaaaactgccaataaagtggacagaagagcatgtggagttatatttggaagcaaccatagtaagttgttggagttctctgtcggagaatgagagtgagaactcagatccagatcttggagagctggaaataggtacagatttattaaatgagatttccttacaaccagttggtcagaaagattcaagaatatggggcttgtgggcagttttggactttcttaacaactccagaaaacaaagtgagactttttcgaatggtagtttaatatataatgcagctaaggaaggaatgaaaaggattgagcaaggaagattctataagtctgaacctgaagctttattaacggctgttactacacaatttacatcgattatgcaaaaaagtaaatcaggagggtctattaagtcacctagagacataaatttggaacaaattgtaacattgactcagaatcaaaatataggtcataatcatcatcatcaaaatagtggaaactcttcttctggagtagaaacaacatcaactattgaggattcatcatccagtagtagtacttcagctaaaccggttgaatctcaccgcgctgcaataagatatgttccatcgaagaggttaggagggagggcacatgtattttctttaagttctacaacatcctcaacaatggcgactacaccagctgtaaataagatcaacgattctactcaatatggtggttattcgtcttctaatattggcaactctcagttgaatgttactggctcgaatgataatatatatggttcaatgaattgcgatccaaaaacgccaatacctattagaaggcaaagggttgatgaacctcatataaagttaaatgataacacaaattcaatgcgtgatcatatgaatattgatagtaataatattaaccagcaagtaaacagacaaagagagtatggaagaaggatcggttttaacattgaagaaagtggtaagaatataataaatagtaatactagcagtaacattaatactaataatactaatattaatggtggtaattgcactaacgttaataattcagctgtcagaatggatacggacaatgaagtttatatgactaatggtgcagaaaaaaatgatttgagccaaaatccatttgtttgtaaatattcattagagcctgctgtgaaatacccaggatataagttggaagtgaatggaaagtattatgaaattatatcatccatacaaaaaggtggatcttctcaggtttacaaagtaaaagagtcaaaaacgggagaactatatgctcttaaatgcgttcgagtatttacaaaaaaccacgatcacagtaatgctcacaaagaccaagaagagaagaactcggaaaaagatttatgtcctccaagtggaggtagatccaggaaaagtattcgcaagagtattgttaataaaaatgataatggggtctatgaagaagaagatgacgaggatgaggacgatgataacgaagagcagcagttactattaatgtttacagaggaagtgaatctgctaaagaagcttagaggttgtcctcatgtaatacaacttatagattcggaaattgcactcagttgtggtgcgattgacataattatggagttgggagtcaaggacttaaatggaatcttgcaaggaagcactccattacccagtataagtgtattaagatctatttggacagaaatggtacttgcactaaagaatgtacatgatttaagaatagttcatggagatataaagccagcaaactttgtttttgtagaaaagaaaggaattggaatgtctaacatgagagatagtttggtaaatcttgatattgagaatgtttatcacccaaatagtggttcatctgttgctccttcagagcttttaggtgataattcttcatcgtcttcaaatagtactagtaatagtacaagtatagaaaagtccaaattgcataataaaactgtcaagattatagattttggtatttctagacctattgctgatgatacaacgcatatatttagagacaaggccgttggatctttaccatttatggctccagagactgttcgtccagtaacaataccagaaagtaaatttgctgctgctgcagttgcttcaaagttaaggatgccacatcaagtcatgtctagaactgcagatatttggtctttaggtgccatattgtatagaataacttacaaaaggcatttattccaacaaccaatatcaaatacaagtaaaagttcatctagtacaactgctggaggcaaaaaaggtggatcatctggaaagtcgaatatagctcctcatgaaatattgatgtttttacagaatgaccagagcaagatttcatttccaagagaaatgggaatcgcattttcagagaaaactgagaatgaatcattgtggtttgatgcattaaggcatttattaaaatggacactgcaatgggatccatcaaataggcctaacgtgaatcagcttttaacacatccttttatagatacttgcatagtttcaagatatgtaatgcaacaaataccaaagagtatatcaaataagcatccatcaatatctgatgattatttgatatctaatttgaaacataacactcaaactgatgaggatagagcagctttactggagttattgtttaaatctacaataccaataagtggcttatataactcaaaaccaaagaatatatatctttcatcaatgaggtggaacattgtgacaaatggaaatttcctcttttatagcttatttgaggcactaaaggtgaacttaaatgttgatcaaaatcagtcatctcagcaacaaggatcttgtgatcaaagcatgataaataatttggcaatatcacagtatatttcactagtaaaggaagtttcaatcccatcaccaccttctgtaaatacattgaataccacatacagaaaaggagatatttag

SEQ ID NO: 1718 - DNA, 1362 bp, Cryptosporidium hominis
atgtctttaaatgataatttggaagcaaaccaatcaaaatactggaagccaatgagtgaagtttcagaagattgtcgtgatttggagaatctgaataaagaaaaagaataccaagaaaagatgaaatattatcaatggatttcgaataactcttcagcaaagcacatcttaaataaaaagttatctgaaagattaactttttttaattgtgatgtaaggcaaatattaccaaaaactgcaaatattggtccaaatacaagtaatattcaatattactttgttgaggaaaaggttagattatttactggattgaattttgaccatgatggtctaagcgaaggaataattccactttggggaactgcatttagtaatggattagtaagaaaatataataataataaggttccaaatattccagtaccaaatagaatttcattttatggatttgttgcgagaattggtccaaatttatgtgatgaacataatattgatataagtttttgggatacttatagattcgaaggaaactcacaatggattcctattaaaaataataataagtataacatatctgaaatgagcaaaattttccatattttaacattggatttgaattctgaagaatttttaaagctttctgattggaagaaggagataaactcaaaaataattaagcaaggaagagctaattcggttgtagttttctttgatctttggattgatgatggaaatgtgcttacaacaagcccattatttgttgataatactgaaaggattaactcatttaattatttggaagaaaatactccaacaacaacttcttcatcaaattctgtgaattctgctataaatgagttatctgaaaacaccataccaatggaaagtattcaaaatgatcttaataaaaagatttgttatcataaaacaacattttggaagccagtattacatatgataccacaaaaaatgtttgaaattcaagatagtattgaatttgagtttagagtcgaggataattttaccaaattaaaatttaaaataaatgcgataaattcaaataatggcgaaaatactccttctacaatcacttctgatgatgcagaaaatagtccttcaattcttcctccattgggagatatttcatatttacagcttagagaaagatataattcaattgttaaagaaatcagtccaacaatttattcgaataattcagttatttctgttcaagcttttaatgcatctctaagtattgctctcaatccaagtcattaccaaggtgaaaatgcaattcttgaggatgatattccatatgatattgattctttgaattggctttgtcagtcatttttattataa

SEQ ID NO: 1719 - DNA, 111 bp, Cryptosporidium hominis
ttttgtggaattataaacttacaccaagatctacataatgtcttaattcatgtaaattcgaatttttctttcttaatggatcaaaacacttcttttgaaattccaacataa

SEQ ID NO: 1720 - DNA, 417 bp, Cryptosporidium hominis
atgattgaggaagctctgggaagtttagaggaaaaaggagtgcgatatattgataagaaagttaaatatgcaggtgaaacgtacactattaaagaaaaagtcgacccggagacattttcaaggaaaaaagcacgaacatcttccacaggaatgcaagctcttgatgaaattgttgctaatctcaataaggaaattaacattaactcaatacaaaaatcacactctgattggactgaatttagacagatggcgggcctcgaatctcagcttgagcgccaaagaaagcatggctatatttcaaagacggcatttctgcaaaaagcagattggaaattacatgaaaaagaacttgagattaagagaagaagcggtggtaataacaatattggcagtagtagcaatgcaagcggtaactaa

SEQ ID NO: 1721 - DNA, 765 bp, Cryptosporidium hominis
atgatagacctatcattcacaaagaagagtgattgggaaaatgtttatgaaccctcagaagattcttttttgatggaggatgcattaattttagaaaagaatgagattttgaaggtaaaaccaagacttatttgtgaaataggatgcggaagcggatatttgacggcatgtttattgaaaataattaaagaatctgatgcagaatttcctttgcctatttcatatttggtggatgtgaatactaaagcattggaaatgtcggaaaaagtgatttccaacaataaaataaacagtccaatagaattaataaaaatgagtctttttacttgtctgaataggaatcgagggctatttgaaataattattttcaaccctccttatgttccgagttcaaataaagaccttaatcagtcaattttgaattgtggtattgattcagcatggtctggtggggtcaatggtctatttttcgtgagttattttctatttggtgacgatagactgattttatcagaaacaatccaccaatttcaagaagaagaaatcattcgaattgaagatcaatttaatagttttccatctttggtagatgttttagctccaaaaggagtttgttatttacttttagaaaaaaataactgtcctaaattcacacttgagcaaattttgaaagaaccaagatattctggttggaatgttcagttcattattgatcgaaaagttcagctagaacatctgtacattcttaagctaactccaaaataa

SEQ ID NO: 1722 - DNA, 1500 bp, Cryptosporidium hominis
atgatattttggaatccaagtttaaactttggagttgatatctcatctaaaggagcattagaacgaggatttcttgatatgcttggtttaggagacaagcaaatttggagtggatctaattatggtggtaaacttataagagctacagactctgagaatagaatacaagagtctgtatcaaaattgattagtcttactgaattatatagatatctaatggtatataactatcttcatattattggttccatttatagacatgcaaaaaattttgaaagaactgtcagatcaagacttaggttatttaaaaaaatgagagataggctggtaaacacaagagattctttagctttgatattaaatgcagatttaccagatgacgttaatttaccacaccctatttctcctccttgttatctgaatatgggagagaattgtaatgaagaaatgtataatcaaatcttgagtgaaatagcttttttcaaagcagttcaagatgagaatagagagctttcaattagaattcgtgatgggtcatgtggaaaccatgaagttacaggatgtacattctgtgaaatcaagaaagcgaggatatctttgattgaatgggcatttaatgatattcaatcagatttaactagactagatagggatttgaagctttgccaggaaacgattaaacggaataatgggaatgatccatccatttccaaatttaatagaggcggaggaggttctgaaccaaacttggattataacatttctgatccttcagaaactatgctcggatatggatctagcgagctaagcaatgatcaagatgaagctaattcatatggtaatttttcaagtgattttggaaataatgcaaggccaacaggaaacatgaatagaagatcacgaacttgctcaagcacggagattaagagatataaaagaagatcctttcatcataaaacgtcaaaaaagacttcgaagcgtagatatcttaaatcaaggaggacaaagacaattaggaaatctaaaggtcacgatgttgattcttttttagcggataacaataatgacggtatatcaaatgcaagtagttcccacaaaaatcaaattcattccacagattctaaaagtggtagttcaccttcaggttttaagagtgattataataacagaagaagatctatatcaggaggaggcaaacaaacaaccgaaaataatgatctgggtatatcttccccctttcttagtacctctgaagctagtaatcattcttcagattgcgaatatgagtcagaaatggacacatcctcaccttttaatggtgaaacaaattctattacgaatacacccgagattcatagctctgtaagtccgaaaagtaccgtatcaccggaaaccaaaaggggctcctcttcagctccaaatgagtccatccaatcacttaaaactgaagttccacaatctctctccaacacacaaaacaaaaaaagaaataggaggtaa

SEQ ID NO: 1723 - DNA, 3129 bp, Cryptosporidium hominis
atgcagggtaaattttgggcagaaggctcagagtcttcttcaatagactcctccaatagtgaaagtgagagctcgtcagactccgagatggagatgcaggcagctcgtcgtcgtcaaagagagatgaataattcgagatgggcaattgattccgactctgacagcagcgaagacgaccgtagagttgtacgaggagctaaagagaaatttcatgatgaattgaggatgattatcagaagggttaataaccatgtgaaggtgtctgatttcagctctctaagtgatgaatacgataaattgttaaagtgtatgcaaaaatctcaaaatgctgttaagaattatggaattccaaagtttttcatttcagttttagttgaactggaagcatttcttgatgagaaatttagagacaaggaggctattaagaaactttcaaaggcaaaggctacaagtttcaatactttaagggctaaatttaggaagtcagtagaagaatatcgtgatcagatggatgattgcaggaataatcctcttgcctatcaggatgataatttaagtgacgatgattcagattctaactcgtattcagattcttcagattctgattcagattcagattctgattcatctagctcatcatcatcaggttcagattcaagatcagtatcaggatctggctcagatggtaatggcagcagctcagacgaatcgtcatcagactccgattcatcatcatcatcttcttcttcagaatggtcatcttatgaagatgaatatgaagatcgccacgcatctgcattagctaaatggggaaccagaacaaagagtgtgaaaaagaaggaaagtggaaagaaagctaatcgtcaaaaacaagttaagaaagacttgcaagatactacagtaagtggtggagctaataataatattccttctggagatcttttgtcatttgaaggtgaagtaactgtagatatgattgtggaaaaagttggtgaaattgttgcagctcgaggaaagaaaggaactgatagacaagaacagattcgtctgttgaaaaaggctgcagaaatctccaggccactttcactccaggcttatgcagatgttcttactcacttaatatcagctcaatttgacacaattactggagctttccattgtataacatccggaatatggtcagaaatatgtgataacattaacatattactagatctagtccttcttaataacaaagacaagagagtgtacatttcaggcttccaaagctttatttcatctaaagataagaaaaaaaagtcttcaggtgacagctctggcgccggcgccaattctggaatggatgcacatggaaatagcttggatggtgaaaatgctaatactgatgaaaacttttctttaagtgatattgtagatctaaaggagcaagacaaaagtactgttactttccttgtttcatttattgagagactcgatggagagtctctcaaggcacttcaacttactgacgtgcactcaagtgaatacaaagatagacttgttcagtcactccatcttttggcgctcttatggagatgctataagatctgtgaagaaagaggctattatgatcttgtttccagtctctcagtacacttaatcaatcaacttcattttaaaaatgattcccttgctataaaagtttgggaatttgtcagacaaatacttgaaaaaacagttaattcatccctcaattctgaggaattgagcgccaactctgattcatccaatactgattgtgcaggaaaaatccctgatataccggtacctaagaaatttaaaccaagtgagcttattacggaattggtggggaatgtttacaaatatggggattctaaagacaaactgagggttttgattcaacatgtttataatatggcacttcatgataattataatgaggcagtgactttattccaatctataggagtatatgacatggcattaggatctgatgtaaatattcagatcctctataacaggtctttagttcagcttggtctttctgcatttagacttggacagatttctgaagcccagcaacttctaagtgaaatttgtatgccaaatagaaatagagagttgcttgctcagggcatgagtaatatgaaatcacaagaaagaacaccagaacaagagcgggctgagaagagaagacttttaccatatcatatgcatctttcacttgaagttattgattgtatttatcttatttgctctatgctactagaagtaccttatttggcttatcacaaatctttaattatgcaaaatgaagcatctaatagccatattaaattaagacctatttctaaacagtttaggagattactagaacaatatgagcgccaagctattactggccctcctgagagtcttagggatacaatcattgctgctacaagatctcttcaacttggtaaatggagagaatgcaaagactacgtattttctctatctatttgggattataatcaagaagatttacaacaaacacaagaaagattggaattaaatattaagcaagaagcactcagaacgtatttatttacttatggacacctttacagctcatactcggttaataatctaattgagatgttccaacttcctagagaaaagattcattcacttctctctaagatgatgcttaagaatgaattacaagctttatgggatcaaaccggagagtttgttttattaaatcataagcaagcaagtaagattcaaaatgattctttaattgttgctgataagctcttacaatttgttgattgtaacgaatctatgatttcttctaaaggcaatgcaagcggaggtaaaaatcctaatgttattaataatagaaactctgcaggagtagggaatcccaataatcaaggaggaataggcccaggctctgtacaaggaggcggaccaaataatacaaacaacactaattcgtccggtactggtaaccaatcattcaattctaattactattcaagaaaaactacttctggacagtataataagcataaaaatacttcatcttcatcatcgtcagtaccttcttcatcatctatgaatcttagaccaatccgtgtgtga

SEQ ID NO: 1724 - DNA, 369 bp, Cryptosporidium hominis
atggaggtttgtgaatggattaaaaatttagaaatgggagttttggctgcaattgaaatcacaaggaatagtatattggaaaatagtagcaataaagagtttaatattatgaatgagtatgacaaactatataataagatagagactctatgtaaagatcagaaagagttttacgaatatattctagagaattcagttggagatgaaagcgatttagagggaattaaagaattccaggataaaataaagttggaaaaaattactcaaaaacttgaaaatagtaaagaatacttaaaagaatgtataaaatgtgaattacagaatatcaactatatagatacattaagtataatgtggaagcattcatag

SEQ ID NO: 1725 - DNA, 333 bp, Cryptosporidium hominis
atgaatatgtcacctcattgggaattatctacaaagaaaattgcacattctgatagctttaaagcaaaatgtccttgctacaagttctctaaattggaagaatccagaaaattctggggaatttctgaatcacgttacatatctactattaaatcaaatcctcaaattttcgggtctttaattaatttgagtgacttttcaaattgtgacctttttaaacatgtacaaaataatttaaaacataacgaaatcatctccaatgaatcttcttcatccatttcaaatattgatttaccctcctcatctataagtaaaaaaagaagagttacctag

SEQ ID NO: 1726 - DNA, 1110 bp, Cryptosporidium hominis
atgttgagtattagaagtaaaagtcgaaagtcaataaaaggaaaggaactttatagtgttaaaagtattggaattaagaaacaaaatggtttagaagttactaatcgatccagtaataaccatacaaataattatggaaataacaaaatcattggtaataaaattaagaatactataattaaaacttataatcaatcaactaaaaattctggtccgttagaaattgaagatagtggaaacaatatagtttcaaccagacttcaaggaagtttatttagaaagataaatgaatttctttatactagtgatagtgaaaaagcatttaaagagtatattaaggatggtaatatgtttgaaaactaccataaaggttatgaaatccaaaagagatcttggcctattgaccctttggataatataattaattatatttcaaaaaataaacatcttaaagttattggagattttggatgtggaacagccaaaataggtcaaacttttggccatattaaaggatataaagtttattcttttgatttaaactgttccaaagaaatttctgaaaaatataatattactatttgtaatatgaaaaatatacctttaaatcataaagtcttagatttagcagtattttgtctaagccttatgggtactgactggcctttatttattaaagaagcatgtagaactctgaaagataatggaattttagttatcgcagaagtatcatccagaattgaagattcaaaatcctttatatcaaatctacaaagtcaactcaatcttgaactggttcaagatcctaccaatcttactaactattttactttatttatatttagaaagaaacagtcaaattctagtcaacttaaaaatttgcccacttatatacaaaacctatctttcaataatttctcaagaaaaaatagacattgtttttcaagcttcaaatataaatatgggtttaagctttattggattcgtaaagtctccaaaaccctcaagtttcttaaacttaccaatcaatcactttctgattctcatcatgaaaaaaaattttatattgatcacaaattacttaaaccttgcatgtataagaagagataa

SEQ ID NO: 1727 - DNA, 1512 bp, Cryptosporidium hominis
atgaataagcaagactcgcatccaagcagaaatagctacaatacccaaaaatttccctataatccagaaaattttaaaacttttgtgcagatccttctaagactatttcatgattctccagcaattattgttggagattgtttaatcagagagcaaaagtcattcacagatagagatcttgctactaaattaaacttatctgataggcaggttagagaggctttaagacaattagaagaagacttgattgttgttaaggatcagaaatcgaacgatggatctcaaagcaatagctcaaactctgatcagttttcaaataaaaataacggtactttaaacttctctactgatcttgaaagtaaatattcttcaaaccaaggaggatctggatcaaattctgcatattatatcaataatagcaccggactaccttctaataggattggtccatcttctttcaggatcaatccatatttacctgctgttgttgaatggcaatataacacaattattcgtgaaattgaccaagaaattaaagatgctgtgaaccttgatgaattaatgtgcaatagatgcaatgcaaagtattcttcgcttgaggctctttcactagatttaaatccagatgatgggttattcttatgtaggttttgcaacgaaaaacttaaatctgttgattctgcttcttttagaaatgctgctaaagataaagctgaaagagtcagatcgcaacttcaaattctgtcaaactctttagaacttgtaaaaagtatgcatattcctgtatttcctccgtatcaaagcaagaatgacatcaattttaataaaacgaaactcccgaatagtttagagaatgatggcaatattgatagcaaaatctcagatgatcaaattactaaaaactctttatctaatgaaacttcaactcctatttcaatagataataattcttcccctattagtaaccaaagtaatttcaataaaaacactaatcacccatcatctggtatcaggaactcaaactcaacttcatcaatttcatcatcttcttctccccaagtacttcctcaaaatacaatttccaaagtcaagtttggaataaagctttctgccaagtcaacaagctctattatcggaacttctaatagccattattccaagctttctggtaataatgctattaaacaagagaattccaatactatttcttcttctaacctttctaataactttacaaatagtagtaatataaaaattactggtattattactgataatattaaaagtattgaccaggaatccaatcgccatacacctaccacagctagctcctctacaaagtctcctgctaaaattgaagaaccaactttttctgtctctgctattaaggataaagtctttaagattactgaaattgatgatgatattattaatcaaatgactgatactgaatacttaaagtacgatgaactacttcagcagtatcaaactcttggattgattaatacataa

SEQ ID NO: 1728 - DNA, 1035 bp, Cryptosporidium hominis
atgcaaatgtcaaacggtatttatactttgttagatatcaaatatggtattaaggggggacaaagtaaggagattttatgcgatatgttaagaaataacaaagtttattatgataaaaacaaagatactggagattttaataatattgaaaatcttaattataatagaaaatacttttatactgatgaaaatcaaaatcaagtattggaaaaaaagatgataaaaaagagaaaatctaataatgattctgaaaatgctagtaagattcaaaggttggatcacgaaaagttagatttacaaaaaagtaagattgagtggtggaagaagccaagaggatggaaggtaacttattttaaacaaggtcaaaagctttctcaaatctttagggtttcattgaattctacaaatatagaaagagaatctcagtataaacaagcttatagtttttacttatcaactcaggaagaaaataaaaaaggaatacaaacaaataacgaaaatgataacactattaatactttaagttttgaggtcaaaaatatcaatgatagtaatcatattgaaaatgttaccgaagatttagcatcttctaatttcatttatggtattccaaacatatttcacgggcccaattggatacaaatgtttaatacaaatttaaattcaagaaatattgcttcaaataatgctcctatttttggaaatattttacctttgaatttctgtatacctcctttatttggtagttgtaatcctccattttatggtattggaatgaataatagttctaatatacaaagtgatcaaggatataatcaattaagcatggaaaatcatgcaagagtatattcttctacacaattatcatatcaagcctattcaccatttattccatccataaatccatttatgatgccaatatttccttctttaatacaaaataatacaaatataaatgcagaatggagtaattacactggaaattctaaagatttaacatcaaatgttaatatagtcaacaatacaaatatataa

SEQ ID NO: 1729 - DNA, 2424 bp, Cryptosporidium hominis
atggatagagctaacagtgataattctcttaaatcttttgatcattcagttgaaggttctttaattggttatcaacaatataaaaccactaaccccttatataattcttccaaggatgataaatcgtcatgttctcttgattctttattagaagaaaacaaaaattcattaaaaagaaagaaatgccagaactttcatgccaatgataattcaaatgtccatagtactgttaataccagtaatagctgtaaaagcgaaagagtgaatagtaataatcgcaatttctccagatataatgatataagtgatactgagcaaagcaatgtccaaattcgaaactcaatagtgaagagaaaagaattgtttatattggctccttttaagttcatattgaactggatcttgtcaaaatatgttctttttatgatagggttttcatcatttttgagtacaaaaaaacagatttctccaacattcttacttgctaataaccttccaataaaatcaaaatcatatttaagagcattaatttttggactgaaatgtactcttgttggttatgatgcttttgaagatattttctttagaatcagaaggctctttaattgcaaagacacagagattcagagaaaaaccaatacctttattttttttggattaattcgtctagttattttattcatatcaatgtattggattattttatgcaagagtattgatttaatgattgtttcagtttacctttctttactatcagcaatttcaaacgcttctttatctcttgcaactatttcaattcgcgagagagatcgattgttccatctttttgttccatcaagtgttgatcttttaagcttattaagtccagataatgaacttcaaggcgaaggattggaacttaatgaaacaaattctgagaatatgataagcttttcgtcatcattaaatgccaatcaggattcatcaaatgtttcaccaatgtataatgataagattgtacatattttggataaatattcagactctctactaactccagcttcccggttaattcattctcagatgaacaactcttctttacaatccaatagcccgatgaaccaatataacgagattgaacctagccaaaataatattgaattaataaatgaaaagttctggtacaaaaaacttccatctcataagtattggactttgaaggatgttttttacgaatattactcaatttggatgtgtactaaacattctggattgcttcaatcccagaacattgctcaaagtaataatcttaatatgatttacgatatagaccttgtttcaagcagtaactctccaaatagcaatacaatgttttctcaaaatccatttgaggcaatgaattcttgtatgactctctcagatgagcactttctttttaatataaataatggagggattgcatcaaacagtaatttatgtgcaagtatgggaataagcaataagaacaatagtaacaattcagtctcacagataaccaactcaaataatagccctataagttaccagaataatgtaagcccaggggaatattctccaattttgagtaatgttccgagccaaattcagagtttttatttgcagaattccagaattgaacgccatattcttgcaatttgtcaagctgagttcataagaccaaatgattgtagaatttggtatataattcaatggttaatctgtatgttgattactctctccttttacacgctttcttacattgataagaagaatctatactttaactttcttcgatacccggaaaaatggattagattttcagaatcaacaataattacagtattctttgaggtaatattggcttcacattttgctcttctcgtatggtcatttctcaatcctcttggatttttatgggtattaattatacaaaggtttcgtatttttttatatataattaataatctcttaaaacgtagaaagaagcgtaagcttacaaatataaatgagactttgatattaagagagcttacattctttataacaatttggaattatattatttcaagaaacaatggctttcttcagctcactctttacaataaatactttaaatcagcttatttcttcttcttggttttctttgctcttcacttctttattgtaaaagggcagatacaattaatttttcgatcccagctattctttactttatttacatttgttatatcgcttttggcattgatttctttaatattaataattattctacttacaaacttgattaccaaaagtatttcttcctcaatcaactcaattcttcacacatattatcataacaaacttttccacttatttctcagaagagaagttgctattttatcagcaaaaaggcatgatgcttttctacactttgattattattaa

SEQ ID NO: 1730 - DNA, 384 bp, Cryptosporidium hominis
  misc_feature (336)..(336): n is a, c, g, or t
atggattttggcttggtttttatgctaaatatcccatttccttcaaaaaataatattaagttaggacttttaaattccattaaagcttgttttttaattaataaagtttcagaattcccagtgagaaagtatagaagtaatcacgaaaatctctatgagtcattccaatattcacttatttcacttattatcaaattctcaaaagcctttaattttataaagctaatttcaattcttacattctttatatggattgtaatttctcaaatttacgaagaaatcgtatgctttgtattactaacttgtatagcaatcatcatttatacttttcatggnattagaattgatgagaatatgtatgacccattgaaattcttgttttaa

SEQ ID NO: 1731 - DNA, 507 bp, Cryptosporidium hominis
atgatgaacttccatggcacaatttaccgagaattaaatgaaaatcctcaaattctcgtttgtataaaacttcaaacttcaaaacaaaaggtagtccagatatttatgatcaacatgctgatgaatctgatgggtatttctcaaattcaggagtctcaagagatctttttaatgaaccatttgaaggaagatcatatttgcatgaaaatccacaattttttagatattcaacttctaatccaaaccaacaacaatgtgacccatcttcctcctcaaacttacaaccagactcaaatccttcaggattcaattccggttcttctccttcttcattaccaacttcttcttatgctcaccctagtattatccctagccatttcttatatccatttggagaagctagtactgatgcaatttattcgattgttaagctcagacccgatactatcggagaaatccttaccagagttagttataaatctccatcagatgcaattcatgttctag

SEQ ID NO: 1732 - DNA, 1674 bp, Cryptosporidium hominis
atgatgccaaatcaagttttggttgtacaacaaccttctcaaagagatcaaggaagaaaagcccagttaagaaatatccaagctggaaaaactgttgcagatgttgttagaacaactttgggtccaaaagcaatgttaaaaatgcttttagatcctttgggtggaatagttcttacaaatgatggaaacagtattttgagagaggttgatgttgctcatccaggagcaaagtctataattgaactctcaagaactatagatgaagaggtaggagatggaacaacaagtgttgtagttctagcaggagagttcttggcttgtgcagagccactcttacagaaaaacatacatccaacaattatagcaaagggttatttaagagcactagatgactctataaagttcatggaggaaatgagcgtcaaattggatgtaaataacaaagaatctttggttagtgtagttgattcctgtttaaaaactaaattttctggaagatggggtagtttaattagttctatggcattgaaagcagctgagactgtctcaattgctaattcaggttcaccaaaagaaattgatattaagagatatgtaagaattgaaaagattccaggaggtgagattgaggatagctatgttttggatggtgtagttgttaacaaggatgtagtccacccacgaatgaagagattgatcattaatcctaaggttttgttattggactgtactcttgaatacaagaaaggcgaaagtcagacaaatgtagaaattactaaggaggcagactgggaggctctattaagacaggaggaggaagaagttgaagctatgtgtaaggatattattgcaactggttgcaatgttgtattcacagaaaaaggtgtttctgatcttgctcaacacttccttgttaaggcaggaatttctgtaattagaagggtcaggaagagcgataataatagaattgctagagtcactggagctactattgctagcagaacagaagagcttacaccaaatgatttaggtacttgctgcggaagattcgaggtcaagaagattggagatgaatacttttgcttcctgaccgaatcaaaaactccaaaggcatgctccattcttttacggggaggatccaaggacgtcttaaatgagctcgagagaaatctccatgacgctcttgctgttgcaagaaatatccttcttgatccagctctacttcctggcggaggtggtacagaaatggccatttcttgttacttgaatgaaaagtcattttccattgatgatacccaagtatgggcctacaaagctttcgcccaagctctggaaattataccaaagactctagctcaaaattgtggagctaatgtaatgaagactttgactttattgaaatctcattatctaccttcatctgcaaccaggggacagaaacctgttcatggaattaatggatgcactggtgctattacaaatgttacggaactcggcatctgggatacacttgctgtcaagcaacaagtctataagactgctgtagaagccactcttatgctcctcagaatagacgatgttcttagctctgtatctaagaaaaaagatcctgttcagaacaatattgagcaaaatccaaatatggagtctttcggtgactctagagacggttaa

SEQ ID NO: 1733 - DNA, 1674 bp, Cryptosporidium hominis
atgttgagagctccaataattcttttgaaagaaggatcagatacatcccaaggcaaaggccaaatcttgagtaatatcacagcatgccaagcaattgttgatattgtcaagacgactttgggtccatatggcatggataaacttattcatagcggtaactctccagatgatgtaacaattaccaatgatggagcaacagtcttgaatttacttggaattgtgcatcctgcagcaaaactattagtagagatagcaaaggcacaagatgatgaggttggagatggtactacaagtgtagtaatcttagcaggcgaattcttaaaagaagcaaagggttttattgaagatggaatgtctccacaagtaataatatcaggttttagaaaagcaagtcaaatagcaatagacaaggtaaatagtatgaagatcagcctttccgaggagactccagaaaagagacgaagtatgttaataaaatgtgctgagacaactttgaactcaaagttattagctcattataagacccattttgcagaagttgtagttgatgctgtttcatacttggataatgaaatggataaagacctcattgggattaagaagattaatggagggtcagtcatggatagttttctagtaaagggagtagcatttaagaagacattttcttacgcaggttttgaacaacagccaaaacattttgtgaatcctagaatcctcttattaaatcttgaactggaacttaaggcagagaaggataatgctgaagttagaatctctgaccccactgcctaccaaagtattgtagatgcagagtggaagattatctttgagaaattggatctcattgccaattcaggagtaaatgtggttttaagcagacttgcaattggagatttggctactcagtactttgctgatagaaatatcttttgtgctggaagagttgaggaacaggaccttaagagaacctctttggcaactggagccattgtgcaaacaacagtttatggcttaaacaaagatagtggagtatttggtacttgttctgaatttgaagaggttcaaattggagctgagagatataatatcttcagagactgtgcaaagacaaagtcatccacaatgatcttgcgtggtggtgctcagcaatttattgatgaagctgagaggtccttaaatgatgcaattatgattgtaagaagagcaatgaaatcatcatatattgttcctggaggaggagctattgaaatggctgtttctaagactattagagatcatgctagaacaattcttggtaaggagcagttagtcatgaattcttatgcaagagctcttgaagcaattcctagatccttagcaacaaactctggatttgactccattgatgtcttaaacagacttagacaaaagcactcacaaaacaccgaagattgtagtaattatggtgtagattgcagcaatggagggatttgcgatacttttaactcattcatttgggagccagctgtgaataagcttagtgcttattccagcgcaacagaagctgcatgttctattctttctattgatgagactgttaaaaacaagtccagtgaggaggatagaatgcagggtcctctacctggaatgggtggtatccctccaggtatgatgggcggagcaaggagataa

SEQ ID NO: 1734 - DNA, 942 bp, Cryptosporidium hominis
atgaatagaagaatttttaaagaaacaaagttattttggattttaattccaataataatatgtataatatcactttcaataaatatttttgatattaattcaattgaaaagaataacaaaatattgaaactatggaatggaatattagagagtggtgataaatttttaacaataagaaagctggtaggattatcaagaaataaagaatacagtcataagaaatatccaatattacgcccaaaatataatattagagaaaaaaacaaggtaaaaaattggaatgatttaggggtagtattgcaaagtaaatggccacaagtaccattagaggcttcattgatagaatttctaacagagttttacctaggaataggaagtacatttgaagacttagtgagagatttaattaatttaaataaccatgaagatggaaataaaattattacagcaaggttagcaagtgaattggttgataataatctagggatcaaattgatggagactatggtaattaatagatactattctcctagaattgagtcaattcgaacattggaaagaaatcaaagaagtgtttttggaataatatgcaaaaaggctagttggtttattgttatatatcaagaagagactgttgatacattttgtaattccaatgatctttacaatagtgtaataaaagggagatctaaaggatttgagaatgtagaaaaatatgatttaagcttctcaaaatttgatttagcaaaagaacatataattgaaaatacttatatcaatatagaagaaaacaataaaatgaaaaaaattgatatttacgcatatatcgatttttcagaagataattctatagaaattttgaataacttatggaatatttgggatatattaaaagatcaaagttatgtaagaataaaaattagacattgtgataatgaataa

SEQ ID NO: 1735 - DNA, 1026 bp, Cryptosporidium hominis
  misc_feature (1017)..(1017): n is a, c, g, or t
atgtgcgataaagctgtgaatatggaaaatgtattaaattctgatggagatttatctattgaatgtatgaaagatattggagcatttttagtatcattatccaaaagatttgaggaccaattaggtgcaatggtacattatttagagaattttgggacttatcaagtagcattgtgtaatggattaagagaaaacactactttatcgggctataatcaactgcatgatcgtgtttcagaaggatccacattctttactcttaatggaaggttattttccccaactgaaacaaatttttttaatttggttactttattaaagagtttaattttctcaaaaatcagattaatgaagaataagattgatgatgaagttgttatagattctttatcaataaccggagtaaatgagaaggaagaactaaatctatttatggaaagtattaatggccaattgaatgattcaagaattaataacaagtataataatgtaataaaagataaggggttaaaaaacctaatagagaaaggagaagttcttgattttagctcaatacttgaatttgagaaggatttagaagaagatccaactttaatggacgatacagattggctagggaaaagagaatatgtattatcaagctcatctccatggctgaagaattctccaagaactgattggagagtatcaaatattcttcctttgaaatcacgtcatttttacaaggatattactaatattggtgattctcaatggggtgttactcctagtatttttgaaaaggtatggtttcatagaaacattactgaaaataacgaagatcaagaggatattattaatgatcttgaagaaaataactccactgaagcaaagattttaaaagaaattgaatattcaccatggataatgtacaggatatatttttcaaatcaggttaaaaattcgagattaattcaagattatccaatatatgatattatgaaggagccagaaaatacactggggtcagtatttatnatccattag

SEQ ID NO: 1736 - DNA, 273 bp, Cryptosporidium hominis
atgacatttattaaaaaaaatgataaaagtggatcaataagtacaaaaatgggattaattttggtgaataattacaagaaaattgggagttatttaaaaagagcttattttgagatgtattatgattttgaagttagtaagaaattaaaacaaaatgaagaaaataatcaaagtatgatggatttatttatttcttatttgagaagtaataaagaactcaagattgaagatgatatatatgaaaaagatcaaaacaaaatttcaattacttaa

SEQ ID NO: 1737 - DNA, 1200 bp, Cryptosporidium hominis
atggcgattctagtaaagtactcaaaaactagtaatataggaaaagttgtatctttacttgtaaactatttacttaaacaaaatactgagctaaaaattgaagagtcaataattgatgaaaattcaacaaatgaaaaaaatattaaccaagttgttttaattaaagataaagagaattgcaatgatcaattagaaaacattgttgatatattaatttatcttggatcttttggtaaaaatcttttgggaaaagattctagtttaattaatgaatccaaagaaatcattgagaaacttatcaaaattaactttaacttctctaaaggaactgaaatgtctgaatttaatgaaatgattaagggtaaaagtttctttctaggaagaagtttaaccattgtagatcttgttatttatatatcattgtactcttattttgaatccctcaaagatcaaaatcaagaatatattccagaatatccaaatctttcaacattctttgaacaaatacaaattgttactctaataagacaatcttgtcctgaaggtattaattatttagatttaccattctttaagaagaaacttgtaaagaaagaaaaaaagaatactggcgaacatggaaataatagtaatcataataaacaagaaagaccacttgacgatccaactagaattgctcttagagttggtagaattctttctgttgagagacatcccactgctgataaactttatcttgaaaaaattgatgttggagaagatgaaccacgtactattttatcaggacttgttggagtttatgatctaactcagaaaattaatgaacttgttgtcattgtttcaaacttaaaaccaagagcaatgagaggtattacatctaatggaatgcttttatgtgccagtagtgctccttctggagataataataatagtcaaaatcaatcatccaaagaatattgtgagcctgtttctgttccaaaagatgctaaagttggagaacttattttttataatgactttaaaggagaacctgatgttgttttaaatacaaaaacaggaaaagatccatttgctgccgttcaaccaaattataatgttagtagtgatttactttgtagatttaaagaatctactatgatgacttctgcaggtcctgtttttgttgaaaacaagaatcttattcatggtaagcttagctaa

SEQ ID NO: 1738 - DNA, 708 bp, Cryptosporidium hominis
atgtcttcatttattccaggtataagaaaagaacatttggaagaaagtttggaagattcagttgaaaattcaatagaagatgacttattgagtgaatattttcaagaattatcatctttgattgaagaattaaaacaaggaaaagaaatatttcaacaaaataaagcaaaatatacagaacaagagaaagcaaagtatcaagcattaatactttcatcccaaaaattactggaaattatttactttgaaattcattttagtgaatcaaatacaagaaattatcaagattttcagaattatatcaaatataaagagagtctttcaaaattatatcaagatttctccaaatttgtagtttttgttgaatctgataataaaaatgaagaaattttaatttcaaattcatcatcgaaagaagatactaattttgattcatccttaaacaataatgatttattaatagaaaaaaataaatatatctttgaagaaaatatcaaagaaaaaacttcaaaagattattatttacttcaaagtaaaagattattagaagaaacaaatcaatatagtcaacaaatacttttaaatctaaatacacaaaaagaacaattaataagtaccgataataaaatgggtcatatatcaaaaagtttacaagattcatcattattaatagacaaaatgacaaaatggtggcatcaacttatctaa

SEQ ID NO: 1739 - DNA, 972 bp, Cryptosporidium hominis
atgttaaataatcacgatgaaatattaagagatatatccagaacttttcctaaattaaaagaatttcaaataaatgaaaatcaaaataaaatgattgaaatacttttcaagatttcttatgcattacctaatgttggttactgtcaaggaatgaattatttggttggaatttttttatatgctttagattttaatgttgaacaagtttattcatcagtaatgtcaatattaataaattgggaatatcaagaaatatataataaaggtttaattaaacttagagaaatgtgttttgtatttaatgaactaattaaagaatatctaccagaaatatatgataatatttttaacaataaagaaaatgaaatagaaataacttcagaactttttgcaatacaatggtttcttacattatttacttatgatattgctgatacagaatatgcaataaattcaatactaattttagataatataataattcatgatccaagcaagaattttaacattacagtttataaaattgctttatctttattatgtataatttttaaagattataaatttgagaaatttaatttaaatactcatattcttgaatttgttagaaacagatcaaaagaaattttaatgaatattaatgaaatcgataccttattaaatatgtctcgtgatctaaaggtatcggaatatataatacaaaaaatttatataaaatataagaatttagaattgaataaaaattttaatacaagaaataatggatttaaagatgaagatgcagatcaggatcaagatgaaattaatatagagaaagaaatacaaagaagtagtataataaataatatttttaataattcaaaatttcaagagttttcttcttctcatttattaaagagatatatagtaatcagtagatttgaggatatggatgaatttccttcttcatttcatccttattttaatatttaa

SEQ ID NO: 1740 - DNA, 213 bp, Cryptosporidium hominis
atgattagaaaaagaaaaaaagacaaaaattctgaaaatgttgacaagttatgtttggcagaattagaattgaaaatcaaagaaaatgaatcaaatgaaaaaacaaatctagtgaatattgaaaaaggtaaaaataatggatataacaatatgaacaatcaattaaaagatggatttataaggaatttattaatgaatcacaataacaggtaa

SEQ ID NO: 1741 - DNA, 1014 bp, Cryptosporidium hominis
atgattgatccagcatctgctttttgtgttggtgtatattttttaggggttggtgtggttggatctgttttatatattcctattagtttaatgagagctattgaatattatcatttggatggagatggaagaaagaataaaagaaacaccttattggatggtgattcatttcttcaaaattttggaaatattctaaataataataatggtgctattactattaatggaaacaatagtagaaatagtaatagtcaatcaatatgtgatgataactcaagtctattctttgagagacctgaacttttattaatacataaaaagaaagtgctaagagatatgttaaatggcaataattatctcaataatttggttgattttgatgataagagtgattacagctttggtgcatatgagagatttacaacttatcagaattctactttaaataataacaatacttgtaatattggtagaagtaaaagtgatcttgggaattcacgtaaatatatttcaaaatattgtaattctattatacatggccatgaatctgttagagatattttatcaacaacaactccttcagataaggatgaaaatgataatcaattagaaattgttattgatgatgaaagcgcgattttttctcttgaatattttaaacaaattggatctaagaaggattatgaaaaccatactactaattataatagtatgtatgtgtgttcctcaactaattctacttcttcaatcatttcttatgaagtaggaaatagtaatcacaacattaattttcctgatagaagaggagaatttatcaatgattgtaaaatagtacaagtatctcaagaacattattcttatgtaaatactggattaaaaaatgatgatcgtggtcattatttgaagcaaaaaagatccttatcagtatctttaaatgatgcttattttaataaaatcaaagaatctgctattattgaggagatttctgctgtacatgatattttagccttataa

SEQ ID NO: 1742 - DNA, 333 bp, Cryptosporidium hominis
atgaaagatttaatagtttctgctacatgtggattatatgggaaacaagtactttatgacttaacccaatctgaaatggaaagtcttaaaggtacattattaatggcaattcatagtactgataatgatattgatacagatactgaaaatgttggtaatggtaatgttgatatatctcctgttacaattgatttaaatacaaaacttaaacctgaaatgattgaatttttaatgaatgagactttttctgcttgtaaacaattttctgttataattcgagattttcttaaaaattatacttgtaataaataccaaagtatttattcaaaatga

SEQ ID NO: 1743 - DNA, 381 bp, Cryptosporidium hominis
atgagtcaaacaatatataaaacaaatactttaactattttaaaggtagaagataatgacaaattgaacaattcttccgataacactaataatactaataataatagtaaaattgaagataacgaagaaattattcaagattcgaatattaataatgatttagactataagaaaatacatcgtaaatctacaaataatgtaacatgggacgaatcagctatagataatgaaatgatgaacaagaaaaagtcaaaaaaatgctgtattttccataaaaagagaaattttggtgaatcttcaagtagtgaaagtgattctgatagtgaaagcgattctgatagcgattgtaatagtaactgtaataataaatgtggaaagtaa

SEQ ID NO: 1744 - DNA, 3228 bp, Cryptosporidium hominis
atgacacaagtaatgactgactcagtctcatcaaatggtatgggaagactaagttcagtatcgggttatgcactattacttgatgatgattctgtagagttaaaagaatatgctttaagagagctgaatacagtagttgatggacattggtatgagatggcagaatatttaggttcaatagaaagttgttttgaagatgaaatgttcccaaatagagaacaagcagcacttttagcttctaagatatactttcatatggaagattatgacgaagctttaaggtatttattaagtagttacagattatttgatccattagaaaatagctcattctcagaatcaatggtagttaaatgtattgatgaatttattaaagtatgtaagactcattataataatatcaataataattcagattctgatacttatactgatacaaatattaatgaactagatccaagattagaagaaatagtatctgatttaatttctagaagtacttccaatgggaaatttttgaatgcaatgggaattgtattagaagcaagaagaagtgatttactgataaaaatcttaaaacaagtattagaaataatcaatatcgagaatttgggtcaattttgtgatcaatgtctaaacttaattcgttacttagattcaaatgattttcgtgtgaaaagctataaaatacttattaagttgattgaagataaagctgagtgtattgaagatagtccatgcttaagaacttattgtgaatgtctgtgtgaaattgaagatagtgagaaactttctaatattctgataaatcttgccaataattcaaataataatttttccaaagcatattcaatcgcatttatcatcaaagattacgaaaatatttctttattgaaggaagtagtaaataagattgatctttatttgattggtatgatcacaaattcttctaaagaaggagaagaagaatgcaaagatatgaaaactgagaatcagaatccaaataataatgataataaacttgtaaaagtgaagagtattcttacaggagaaatagtttctgaattgaatttacgattccttcatttaaataaccaacctgatcttggaatattggaacacatcaaaaataactgtgatcaaagatcaacaatttcacatacagctcttgtaatgtctcatggtttaatgcaagctggcactacttgcgatgtatttcttagaaataacttagaatggcttggaaaagctactcattggtcaagattctcaactgctgcatcattaggagttattcatatggggcatatcaaagaagcattaaaagtgctttctacttgcttgccaagtagtggaaataccatcagtacaaattcgaataatagcggaaatactttagggggtcaatatagtgaaggtggttcattctttgcccttggattaataaatgcaggttacatggatcaaaagtctagagaataccttttggaaaaactgaagagtcctcaaagaaatgaagttcttcaacatggagcaagcttgggattaggattaatgggttttggatcatgtgacgcagaactttatgatgaattacgtaatgtattatatatggataatgctgttgctggggaagctgcagcctatagtattggattagttatgtttggatctggatgcaaaaaaacaataggagatttactttcatatgcaaaagatacccaacacgagaagattgtaagagcttgctctgttgctttaggtttcgtaatgtactctcgaggtggagaggaagcagacgagctttttcaacaactaaactctgacagtgagcattttattagatatggagcaatgcatgttcttggacttgcttactgtggaactggaagccaatttgcaatggagaagctattacaaataattgtttcagagctttctgatgataataaaagagctgcagtatttgcactgggtctggttatgtgtagaaatactcaacaaattcctcaagttttttctttattatgcgacagttataatccacatgtcagatatgctgctgccctcactttaggcattacctgctgtggaatggaatcacccaaagtcacagcaattctcaaatccatgactactgattcatctgatattgtcagacaagctgcatatatagggctcggactccttttaatgcaacaaaacgaatcctctaatgacaaactctcatgcacacgtcagcaaatgattaaggcggcaactgacaagcatgagcatatagccaccagatttggcgccatactgggtttaggtttgatggattcgggaggaagaaatgttaaagcttctttgttttcaagaaatggggagagtttacgtccacaatcggcggcaggtttttctttatttttccagttttggttttggtttcctctggtacactgtatttctctatcatatatcccaacttgcattgtggggttggatgatcagtttagggttccaaagagctttagtatgaaatgtaactcgtctaaagagaaatttgattatccaaagtccttctctcttgataagattgaggataagaaggttgttgtcactgccgtactttctactgcttctaagaagaaattaaaaaagcaaaaggccactggcgccgacacaacaagtgataataaagatagcaatagctcctcttctccattatctacttcaaaacaggtagttgagggagagaaaagtggtaatgaaactggaaataatttgaaagatggagcagataccaagatgaatattgatgaaaagatggaaaaagaagaggttgagatggccttagatacagatgattcaagaaataagagtggttttgataaagaatcgagctcttttgtactaaacaatccatttagagtaataaaaccacaagaacaatttttggaattgattcccaactctaggtactcacctgttcttcctttacaaaagtctggatttatcatactaaatgatagtacgccattggaacaagaagagtatgtctttactgttggacaagataccaataaagataatagtgctacttccgaagtgaagaatgaaactacaaaagaggaagaagaatccaaagaaaagaaggaaaataatgaggatgagagaatgtccgacaatgataatggaaaatcggaagaaatggttccccctgaaacatttgaatggcagggataa

SEQ ID NO: 1745 - DNA, 474 bp, Cryptosporidium hominis
atggataaattggaaatgtcaaatgaatgcaagaattgtgagagttacaaaaatgaaattaacaaactgaggaaagaaatttacaatatcagcaaatcaaatataaatagccaaagacttcttgaagaaaaatatacaatacaggttcaacaatttcaagaggaaaattacaaactaaaaaaaactgttcaagaatatgaagaatataagcataagtctgaaatatattacgaagaggttaacaataccttaattgttgctaaatcaaagcttaaagagctacacgaaagaattacatttctggaaaagagtaattccgaattagaatataaatataatgaggctaagtctctattgtctattctagttgaacataataattacaattcagaattctccagtaataaaatacctataaaggaaaatcaatctaattatatttatcaaatcgattccaattccatttccatttaa

SEQ ID NO: 1746 - DNA, 2571 bp, Cryptosporidium hominis
atgagggttgggaaaataggtaaatcactattaatattagtattatcattgtatttcctgatattgagtttggatttatcatttattaatggagataattatggaatcggtataaaattagtaaaatgtgattcagaatttgaaaaaaataaaagtgaaggctcagaaagtcttgaacttggattggaattgttaaaaaatacaataggacaaacaaaagtcgaatcagaaaatggatttggtgaaaaaaataaagagttgtcaaagatagatgaactatcagtaaagagcacattaactgaatcagaaaattttgatgattcagaaaaaagtattaatggtagttttggtgaggagaattttgaaaaagatgattcatttgtatcagaagattcagtcaataaacaaggatttttatctcaaagtttaggaccttcttttggccgtgatgaaaatagtagtgattctgaagtagattcagcaacagcagataaagttattaaagataagatgaagggaataaaagaatttgattattccagtagagaaagtgaagaagaagaagatgatgatgatgacgattttaatataaaaaagaataatttaaatcaagagaaaaagaatatgtcaacaaagaataatttgaatcaaaaaatggttaataatggtccaaaattaatatttaataatttaaatgaaccaaagactggattaaataattattctaatactaaaataaatgttaatcataaagacaacttacctactttttattatcctggaggtactgggatatctcaacctgatgtctataatttaccttttggtacaaattcagcattttctgtaaatcagaatgtaattcatccaaaaccaacaatgaaaatgaataatattcaacaatctggtggagttgctattaataatgttggttttgttaatcaaagatcactttctacaaatcaaattcaaaatcaaaatcaaaatattatacaatcagtgcctaagtcacaaccaaaaacagttatattacaaacagtacctatagcacaaccaaagccaaaaccaaaacaaaatgttatacaatcagtgcctaagccacaaccaaaaacagttatattacaaacagtacctatgacacaacctaaaccaaaaccaaaaccaaaaccagtagtagctcaaacagcacctaaaccaaaaacaattctaatacaaacagcacctataacacaacctaaaccaaaaccaaaacaaaatgttatacaattagttcctaagccacaaccaaaaacagttatattacaaacagtacctatagcacaaccaaagccgaaaccaaaaccaaaaccagtagtagctcaaacagcacctaaaccaaaaacaattctaatacaaacagtacctataacacaacctaaaccaaaacctaaaccgaaacaaactgtaactcaaatagcacctaaacctaaaccaaaaacaattttaatacaaacagtccctataacacagcctaaaccaaaaccacttatgactcaagttgtgccagtaccacagccaaaaccagctatggttcaacctgtacctgtacctgtacccgtacctgtacctatgccagtaccacagccaaaaccaactatggttcaacctgtacctgtatcacaaccaagacaaactatacctataacacaaccaaacactcttatgctatatgcagtacctgtaagacaaacaagactagttaaaacgcaaacagtacctaaaccacagccaaaaacaattatattacaagcattaacaaaagcaaaacctgaacgaacttcttcacatcaagctaatgcagcaaacatcatttcaaacaatacaaaattaagaagaaatgaacctttcttattaattaaagatccatcattaagatatggaccaaatgttaagagaaaaactccaggaaaaaggataattcctattttcattaagaatagaactccaaaaaaagattcaaataatatactagaatctgatattattacaaaaaagaaatcaaaggtatataaccgtaaaggcgaagaatctgaaatagaggaaagcgataatgatgatagtgacgatagtagtgatgacgatgacaatgatgattatattaagttaattcgtgttcataaaaaatctaaacaaaacaataataagagaaatgtcaaatatatatataaagatattattcataaacccaagtatataaattcaaaccaattacaaaatgggcgcgtaaactcccacatgcaaggccaatatttatcgcatgcaaataataatatgtcaggccagaaaccacaatatggtataccaatgttccctatggcgccaaatcctggtcaattacagaatggccaaagaatgataaatcaaggtatgagagaaaatgacgatgatatgggaagttttcaaagtaattcaattaatgcctataaagacactcagccttggtatcttcagtcgacatttattttctcatttgttggtataatatttttattaattgttggcgcaattgcaatattttatattgcagcttaa

SEQ ID NO: 1747 - DNA, 664 bp, Cryptosporidium hominis
atgcaaaagtttattcattccaattataaaaagctcaagtttatttcaaatattcttgataaaaatattctttgtagtaatcataccaattgtaatgacctatcagatttaaattcaaataaaattattaattatgttgaaaataacaaaaatcttgtgaatgaaaaatttcaagaaattaaaaataatattttcaccaatgaaaataataaaaaccttgaaaagtatttgacccagtaccaactatttacaatagtttctgaactaaggaatttccatttaattcttgaagattatttctctatgcaagattatgaatcattaattaaaatgtataataaatggaaaaaaccacttgaaatactttctaacgatgatgattttaaaatagaattccaagaaatattaagaaatagcaatgaaatttttgaaaaaacgataaatactttaaaaaaacaaatacttgtgaatattaataagaattcaatattaccaagtattaatattattattaaatcatatatttcattaaatagtgaacaaattgattttaccaatgatttgatttcaaatattaataatttatttcgagatattgttaatgaaattgttattaaacaacttgaaaatttagaaggttccaaagttaatgataaagttaaaa

SEQ ID NO: 1748 - DNA, 2394 bp, Cryptosporidium hominis
atgggaggtgcaagacttaattgtagctcaatactaaattcatggactgatgatatctcacaagtacgtgatgtcttagtagtatttagagaagaaggtttgttttgttatcatccagttaatggtaactgttctgctcttccaactaatcatggaaatcctatcatactctcaactttcaagaattatctggtcttagttagttctcctcttaacatctcatcagaatattattcaaataattccagagaacaaattgaaactgttaatacaacattatgtgatgttactatatgtaattacctcccagaattaagatgtatatgttatactggtgaatttaaaaatgtttcacatattgttaaaggacttaatatgttatttgtcctctgttctggaaataatgtactttcaggttctacttctattactaatacaaatatgattaataagttggatcatacaattttagaaagaaaacaaggaattcaaagtaatattcttttacctaattcttcttctaatactaatcatactgttagtactaataatagtactaataattcatatattactaatacaaatattactatgccaaatctattatttcatttggaggaacttaacctatttgaaagaatccaaatcttaatcagtaaaaacctttatgattgggctctaattctagctaagaatggaaatgtctccaattctatatattctcagatccaaagagcatatggtgattggctttgtaatattagaaaagattattcgggagctttaaacagttatcttaattgtctagatagcttttctggagataccagtcatgtaatacataattttctacaagctaatagatttgatgaagcaatcacatatttaaaggaatgtgtattaatttttagaagaaaagaatctactaagagtgttattaatcttacaaatagtgaagattccagatttcctattgcaaaagatcatataacattactttacagattgtttgcacaattggatagattagaagatattatggattttcttcaaaataggaatttaaacgaagaaattgataattatgaagtagaaacagcgattgatatgtgtagaaattataataaatttgaaatggctggaaagattgcagaaagatttcaatttcatgataaatacatgcaaattcaattggaagatagaagatctccatctgaagcattagagtatttggaagatattaatttggatgagccgcaaaaactatcattaatattaaaatatggaccaattttgattaataagattcaaaaacaaacaactaaatttattaaaaatttggtaatagaaaataatatgccaattgatgtatttttaccaatatttgtaaatcacgatcatttactattagaaatggcttgggatgtattaaataatgaagggaagaaattacaaatagaattagaagatattgaaaagatatcagtagaattatgtattcatatacttcaagtatctttaagacaagaaccaaaatctgagatatgggctaaattaatattagaaagattaataagaatagataattcagagaattggcattcaattttgtgtatttgtatatattataaatatatttcaggtgtattttatatttcacagcattgtaatttacatcaatttgcaattactgagttaataaaaaaaggtgaaattaaagatctgatagaattctgtagtttatttggtaataaggacccatttatatggcaagaatcattatgtttggttataaagaaattatcagagaatacaaatatgaaagaaaatattgaattaatagaatatcttaaggcgattttagaaaacgttcattcactaaaattaatatctccattatcaattttggagattttgtcaaagtatttggtaaatgataatatttcatcagatgaaagatttaattcattaacttttgagataattaaaccaatattagcattatactctgattataataatgagaatctttcagaaaataataggaattcattaagtgatataaatgaaattaataggatgaagaaagaaatcaaggatttgaagatgatgcctaaaatattaaatacttcaagatgtaaccaatgtcatttacctttggagttaccaataattcatttcttatgtgatcattcatttcatagatattgtttattacaacaagatcagtgtccaatatgttcttctgatcaaaaaacaaagatcagacttttaaaacagagagaaaatcaacagatcaataaagatcaattttttaagtttattaagggagatacggataattcactaggttttgatcatatttcaaaatcactaagtgttttattcaagtag

SEQ ID NO: 1749 - DNA, 531 bp, Cryptosporidium hominis
atgaaaattatgccagttcagaaacagacacgtgcaggtcaaagaactcgttacaaggcttttgttgctgttggagacttcaatggacacattggacttggagtaaaatgtgcaaaagaagttgctactgctattagaggtggaattattgccgctaagctatcattagtaccagtacgtagaggctactggggtaacaagatcggtgaaccacatacagttccaatgaaggttagtggaaaatgtggttcagtacttgtacgtttagtaccagccccaagaggtactgccattgttggtgctccaactacaaagaaaatgctccaatttgcaggtgttaaggattgctttacttcatccagaggatgtactaagaccagaggtaactttatgttggccatttttgccgcattaaagagcacttatgcttaccttacacctgatttatggaaggaatattctttcactccttctccatacaagcaattttctgatttccttgctgtaactaacagcaaagttactgtctaa

SEQ ID NO: 1750 - DNA, 309 bp, Cryptosporidium hominis
atggagatgttttcaggttctggaaattcacttggtcaaacaagaagttcagcattacaagttaatattgaatcagaagctcaaataactgttgataaaaataaaccaactactaacatacagttaagatttcataatggccaaaagaaagtggttacattaaatcatgatcacactattgctgatttacattgtatttttatggaatgcgctcctgttgatggcgaataccaactcgtctctggattccctccaaaagaaattaaatttgacccaagtactacattaaagaatgctggattactccaa

SEQ ID NO: 1751 - DNA, 1242 bp, Cryptosporidium hominis
atgttgaatgaaatgaatgatttaaaggaaagaattaaacaggaaagagaagagaagaagaagctaattaaagaaatgaaagggaataaatctatgatggatgttaatgaaacccagaattcaaatgtatctaaattaccaactaatttatctgattttgtagaaagtgcacttaaccgtcaaaatgcatttgaggcatcaaagtctgaattggaagagcttaatatgaagactttgggagatccaacatcatcagattcatctagaaaggcttttcttcgtgatttaaggaagttaattgaggagtctgatgtggtcttggaaattttggatgcaagagatccactaggttttagaaatgttgaattagaaagatctattgttgcccaaggaaaaaaattggttttaattttaagtaaaattgatttggttccaggtgatgttgttaaagaatggttaacttatttaagaagagaacatccaactttagcatttaaatccgcattaaatagttcaacagaatttggagtaaatcattcaaaaagtagtggattaaatgcatcacatgattttattaaagcaagttctgtagcatttggtgtttcaccattaatgtccttaattaaaaattattcaagatataataaaaattcaaagaaatctattacaataggtgttatgggttatcctaatgtaggtaaatcatctttaattaattctttaaaaagaggttattgtgttaaagttggagctgttgctggagtaactagacatctacaaagaattgatttggattctaccacaaaattaattgatagcccaggagttgtatttactggtaattctcaagatccatcacaagttttgagaaatactgtacaattaacaaatgttaaagattgttttgaaccaatttcattattattacagaaaattgatcatgaaattctacttaaactatataaaatacctatatttaataatgtttctgaatttttaacaaacgtatcaatatctagaggcaaacttaacaaaggcggaattcctgatattaactctgctgcaatgattgttttaactgattggtttaatggtaaaattccttattataatttccctcctcaagataactctcatcaaaatcaattagaaaaagagtctattactattgtttctaattggtcacaagaatttaatatagatagtatatatgatgaacttgattcacaaatcaaaaattaa

SEQ ID NO: 1752 - DNA, 645 bp, Cryptosporidium hominis
atgatgaagattgtagaaagtaataatgagtatggctcacaacttgtagcaagatggatgctattagtgtgtataagcttagttactatgggtattatgtacagtaatgacacattgccagcaattgcaccttttatttttgatgcatttgaagacttatataataaagaagaatttgaatactattataatacactatgttcattggtatctgttccaaatctaatatttccgctattagcaggagtactcattgatacggtttcattatattatttatcaatagtacttatttcatttctagttttgggacaatttgttctaactcttggatttggaatgaaaagcctaactacaatgttaattggaagatgtatttttggtttgggatcagaatcatcattaattgctttcaattcccttttaatcagatactttccagattgggaagttgctttggctctttcaatatgtttagcaattggaagaattggatcagtattaagtgatatggtatctcctattatagcgacactattcccagtctattggacttttctattgggattagtattattggtttttggaggaattagtgttattgcaaatcttaaaaagtattatttggaagacttattcaaatga

SEQ ID NO: 1753 - DNA, 1057 bp, Cryptosporidium hominis
atgtcgattaaaagacaacttcttactgaacttctgcttattgagtggatggaagcattttttgctcatctaagattagctcttttaccttcagattttcttgtatattcgcacaggcatgatttggtatgcagtcacttttttggcgggaaatcaaatatcgttgttagtaatgaagttttacctagttggattttagaaaagttttttgtggatggtgggtttaatgtcatatcaagattgggagaagccgatgatttattgagtactttgaaagagaaccaagacgaattagaagataaggaaagtggagatagtaaacaaaataatgagaacattgattccatcaatgcattaaagaataaactcgagaaagtgaatgaagttaataaagaaaaaactgtcagcactgatgaaactaaaaaattaaataaaaatgctgtagctaaatgggaagattttgatattggtgaagttagtaataaaaatatttgcagtttgagcgggaaaaacttgcccatagaacaaaaattattaacgtcagaagaatataatgcatgcaaattaccgtcattaggaataaaacagcacaataaagaggaggatcttaatcatgattcatgtacaagatatccagagttaagaaagactaaattaatgccacaaatgaaagatctagttgagaaattgaatccaagatcaagaaatctacatgaatattattattcaaaatatgatgtcgatgatttagttgagaatatagtatcatgtatgaagaaaaaaatggaaggaactacaaaaacagataaagatgatgaaattatttggatgaatgtaaataataatgaaaataatattcatactactgttgataatatattattacctagagataataaaacaacaattaatatatgggatccaagtgtagatagaccttctgatttagcaaaagaatattggaggtttttggttggttataattatgagttattaatatctttacttcattcagcaccatctttaaagaggaaaagtctaattcaagatatttttg

SEQ ID NO: 1754 - DNA, 1077 bp, Cryptosporidium hominis
atggatgagaaatatgatgtattaatatgtggaacaggattaactgaatgtataataagtggtttattatcaacgtcaggaaaaaaagttttacatattgatagaaatagttactatggtggagaagcagcatctttaaatctaacaacattgtatcaaaaatttagacctggtacttctcctccagcaaattatggagctaatagagattggaatgttgatctaataccaaagtttgtaatggcaagcggcgatcttgtaaagatactattaaaaacaaaagtaacaagatatttagaatggcaagtaatagaaggaacttatgtatatcaatttcaaaaaggaggactattatttaatccaaaatttatacataaggtaccagcaacagaaatggaagctttaaagagtccattactgggtattatggaaaaaaatagatgtagatcattcttttcatttgtagctaattggtcagatgatgatgtttcaaagcaaatgggattcaatagagataaaaacacaatgaaagatatttatgatcattttggtttgtcttcaactacaatagattttgttgggcatgctttagctctatatacaaatgatgattatattaataaaccatgtggcgaaactttagataagatcagattatatatgatgagcctaagtagatatggtaaatcaccttttatatatcctgtttatggtcttggaggtttaccagaaggtttttcaagattatgtgcaattcatggtggtacctttatgttgaatacaaatattgaaaaatttctatatgatgaacagggcaaagtatctggtgttgttacatcacaaggaaaagctgaatgtaaaatggtaatttgtgatccatcatacgttctaaatgaaaatgatagtaaacctaaagttaaatgtattggtaaagttttacgttgtatatgtattttaaattctccaattaatgatactaatgatgtatcttcatgccaaattattattcctcaaaatgagcttggaagaaaaaatgatatttatgttatgatggtttcatgtactcatggagtagct

SEQ ID NO: 1755 - DNA, 966 bp, Cryptosporidium hominis
atggaagatattgactttcattcagatggtaacttgaagagtagacaattcaaatcttcaattcgtgttgcacgaaaacgagcggatattcaaacatctttaaaagagctcgagcaagaaattaaagaaccagctggtatggtatgggcatgttgttttgcaaatgaaatagacttcccaatgattcttgaagcttggaaacaaggagatttatcttctaaacaaatacatattgaaatgacatttagtgaggtagtatgcttaagatggctgcaaaacagaatttgttatgtttttaaatttggctgtgttgttggatgggacttaacaagagccgagagggttgcaatagtcaatatattaaaaacatttattaaacaaccattacatataagaactgatgaatctcaggatgatgatatgacttatgtttggggagaaagaccatccattaagcaagataacattcatttagtttctgattcattattagaaagattaagttatagctatgcattaagtcaaagtgtaaaactttctgtttttgaaagtgttgttgatcaaaatattgatagtaccagatcactcccagaaagcttggctaaaagtggtacaatcaaagataatagagaagatattagtaaaagaattggtgaactttttattaatcgtttttatattaatttgcaaactgatattttagatacaccagatatattttgggatttgcaagattatgagccacattacattacttgcagaaattatttagatatacctaaaagagttgaaatccttaatcaaagattggatatcattaaagatttatatgatatgctaaataatgagctatcccttcaacacggttataagcttgaatggattgttatttatttgatttgtgctgaaattgttattgaggttgtttggaatatattaattagagatattttcaaccttgtataa

SEQ ID NO: 1756 - DNA, 1623 bp, Cryptosporidium hominis
  misc_feature (1620)..(1620): n is a, c, g, or t
atgaatgggcatatccctaagaaaaaagcagtcattattggaattaattatgtggaaacagaaggaattagtttaagaggttgtgcaaatgatgcaaagttaatggctttgacattaatgtctcactttgatttcaatgcatcagatataatctttctaactgatagtgaaccagatagaggttatgatactttggtggattctcaagaaccaatttcattctatgataactggccaagagatgaaattccaccaacaaaacatcatgattccagaatatatccaaataaaagaaatattttaacagcaataaattggttaactagagatgcagaagctggtgatattcttgtattttattttgcaggacatggagtacaagtagatgttttaacatcatatgaaggagaaggatatgatgaagcactacttccagcagattctacattatatttagcttcaaatggttcagatttagatgaatataatgtattactttgcagtgaacttaaggaattattattatgtgttcctcctgaaactcaattgaatgtaattttagattgtaatggaggtcagactattttagatccagctggtaatttgaatggtatgtggtatattaaaggtatagtgacaaaaggaatttggccatttctttcagctactaataaagttaaaagagcacaatataattcatcagtatttaaagaagaacaaatggttcatagacttgtaagaccaagatatgttccttgtgttcaaattggcaatacacaaaacttaaaagatccaagtcttcaatctacacaatatgtatctttatcatgtaaaggatattgtttttctgctgctccatggagtcaaatagctgctgaagcttcattacctttgttatcagttactagaaagactcaagtgacagattcttcaatgggtttatcaaatggcccaatttctactcctaattctcaatcatttaatagttctggattactttcatctaaaacagaatctaaattaggtgtaatagagattccaatatctagaggtggagcttataatataattcatggagtttttacctggtcattttgtaaagctattagtgatattgctactggaatattacaacaaggaagaccaaggaatgaactttcgtataagacaattctagcaagagtgagagagtacatctcatgcctgaaaacttcaattcttgctcacttagatcaaaatccagaattaactattcattcaggaggagctgggactgtttctgaatatttttgttccccatttggaggagacaaaagtatagattttgattttgatcattattttagaataactgataattgtataagacatttaagaaagaaccagaactttttaatacctcaagaagcttacaattctatgttacaagccaacaagaatgataatttagttttccattctgtgaatttaagtatattaagtaagcccattaattcatctgaaaaccaggtttcacaaagagattcccctccaacatttagagaaaacaatgatcaggaaggtgagaataagaaagatgaatccaatcaattagaagataggaaaacagtggatactagntag

SEQ ID NO: 1757 - DNA, 390 bp, Cryptosporidium hominis
atggtaagaagactctcaagtgaatttggagattttatcgaatcttaccctttaaaaagaactactataccttatttagatggaatatggacttggattgattgtaatccaaaaaatgtggaaaaaattagtaaaatagtttctcaagaaagtattacagatattgaagatattactgaagattactattcaagaaaaactgttaaacaattatctattaaagatcaagataagcttagtaaattaaatagtgcttcattacaatataataataatgatgaaaaatacgaatctaatgaatttgatacaattgttatacttcatggtttatcaggcactgctggtgaatactttatgtttatgaagaatatgttaaaatgcggattatag

SEQ ID NO: 1758 - DNA, 1770 bp, Cryptosporidium hominis
atgacatccttaggtgaactttattattatggacatgaagctggtggtattgcaagagatgtgaatagagctgcacaattatgggaagaatctgcaagaagaggagatccacaaggtgctttagctagagcttttttaaatttagatggtacaatgggtacagaaagagattctggtccttatttaagacaagttgtaagaaatggagaaccaccagctgcagctttagctaactattatatatataaacttggattagatgttgataagaattctacaatagctggtgaatatttaaaattagcagcagatcttggtgatggtaatgctcaactaatactagcacatgcttatgctggaggaaagatgggagtcattcctccaggaggtcagaatgatactttagctttaaaatattataaactttcggctgaaggagggagaactgttgcttattttaattcagcagtattaacattaaaagggtcagatacaaagtataagactgaagaaagtagatgtattgcttcaattgattacttaactcatgttgtaaagaagaataatcatgtcaaattcttaagcttattaagtaaaagatcatatgaaaatggtgatattgtaggatctcttcttcgagaaatgacattaagtgaattaggttttattgagggacatattaattcacaagatttatggaaagaaagatccattttgtattataataatgaaataaagaaattgatttttgagaataaaaatgataatggtatcgttgttaaaaatgagatggtatcgagaaaagaattatatagtaatgttatagaagaagagagttttttgaatataatgtgtaatattataatgaatgataaattgaggagtatatgtaaagtcgaattattagatgagagtaatgaaaagtattcaacattgtatccaagtgaatttgatatgagaatgagtggaatttcttcttcaacattatgtttggttaaggcaagtagaaaggaggtattttttaatgtaccaataaactttgataatacaataattcatttaaattcaagttatttcaagtattatgatatatttgattcacaaaatgcaacattaagaggaagattggatttaaattactctgaaaatatgtcagagaaggagaagaatagggtatctgagtttcttagttgttggatgaggccaagatcttattatgatagatttgagaaaatgacaagaagattgagaataaaagaatttaaagatgagagggaattggaagaggatgatgatgatgatgaagaagaagaggaatctaatatatttgatagattattagaactttggcaaaagcctaaaagtggaagttatcaaaggtacccaaaaccatggtataaagcattgaagaaaatatataatggttttaattatgtatatagatcatttattcttaaattagtgattaagttaaataattatttcttaagttttatagatgggaatgatcttcaagatgtaaaagaagaaggaaaaagtatattttcaagaatgaatttgggtttggatttggatttagatcttgaaattgatgaagagaaggtaccggaaataataagattaaaaagaaattcatcactttggtgtagtcattattattcaagaagatcatcatcaaatggagatatttattcaactcaaaatttggttcaacaatttttagaaggaagttttggagttaataaagacccagtttccgcttttaaattt

SEQ ID NO: 1759 - DNA, 213 bp, Cryptosporidium hominis
atgcttgaagcatatcaagataaatctgcatatgctatgactttaataggatattacgatgaaacaaaaatgtctgatccaataatttttaaaggaaagaatgatggtgaaattgttaaaccaagaggtgaaaaaggtttcagttgggatcctattttcaaccctatggtcattctttgtaagtttaaaaagttcatattattaatattataa

SEQ ID NO: 1760 - DNA, 664 bp, Cryptosporidium hominis
atgataacagaaatacaaaatagagaagatttatatcaatttaatgaagatagaaaaatagaattacttggtaaatattatataattttaagataccttaagaataacttaatttcaatatcattaggaaaagttcatattgataattatattaaaaattctcttggaatgaatatcaaagaatttcaaacatataaaaatagcaatatcaatttaatggaagattttaatagtaatatgaataataataataataataataataataataatattcaagaaaaaaataataatatttatcaagaaccattaataattgctttaaaagaacaactaaaatcttggtggtataataattcaaaagattatatagattttagattagttttggtattttgtggattacttatgataatatttgcaataatattattattaataaaaatgatgagatattataattgggtacctttaaaatctttaaaattagaattaaagaaaagatttcgaactaattcaaaaatattcataatagatatttcaagtgatgaaaattctgatataagtcaagataaggaaaagaaaagaaaaagaagagttaaatcaagaaagatatatgattcacaagagattagttatactcctagaagtgaatatttatcaa

SEQ ID NO: 1761 - DNA, 1080 bp, Cryptosporidium hominis
atgggaggagctattagtgaacaaaacaggaatgctaacttggatcaagataagataatggatttaaaagaaattaaaaatctgtcttataaggagctttataaccagtttgaaaaatataaagcactaaattatgttgaacttgtaatattattaggaacaacactcattttagattataacagaaaattaggagaaagaaaatgggatgtaatggaaagtattgcattagcaacatttcatttcagagttaaatatgaaaatgatggacataaaaataagatttcaaaatggcaaaaatactgtatggatgaactgaataaaaaacatggtagtacatttagatataaaaaacttgttggtatgcttttagaaagcagaggagaaattgaaaaagctttagatatatataaacaacttttaaaatttgatcctgaagatcttgaaattagaagaagagtcatttcagtactttttgataataatgtatcattaatagatgaacatctgagagaatgtattatggatattaatgcttggaaaatgaaagcttattatcttcttacttatacgcttgaatatgaatctgctctcttttgtatggaagaaattctacttcatgaacctcaaaatattgatactattaatattatagctgacttacatttagctcttggaaattattctagatctagacagtacttttgtttggctttaaatattcaaaagtccaatttaagagctctttggggaattctacaatgtaatcttttaaaaaatgatgcttacaatcaaaatcataacaacaaatctaaagttgataattcaattatttctaataatgatcacaaactaactcaacttgctgttaaacaaataattaacatttattcagaaaatgattcaaattctaatattaataaaaaagatattgattacgatatcaattacaataacgataccgataacaataaccataaaggtaaccataattttaatcaaaataaaattgaaattacaacatcaatgatagttagtgagcttttggattattatacaagtagaataaagggtttatag

SEQ ID NO: 1762 - DNA, 2352 bp, Cryptosporidium hominis
atgacgtgttttacaagcaggtgtacacagatattggttttttcgtgttttttatgtttttttgctgcagtagaatcatctgtaaataaaatagatacatcagagttggattctatttggaataatgatttgatacttggtaatgctccaaatggtaaattaaaatcgatttcgagtatgctagatagctttgctttggagcagaagccagttataagtaagaatattgagaaacctaaagaagttaagactaagaatattattaagaatgaatcagttaaaccagtaactaaagtagaaaagcctttgaaagaaattgtcgatataattgtagaaaaagaaattaatgaaagaacttactttcctgaaaatgttaaaagattggatgatcttccaaaaccatcatatttggaaagatctaaagtattatctcttttgtctaaagatatgagtttagatttatttactaatgaaaatttaccaccagaatatagttttttggagagtatagtttctattaataataaaacgttggaaatgtcaggcttagatttattgcaaggttttgtatctgatattgattcaatttgtagactttcagttaaatggtttgaaaattatccaaaatttgtaaaagttttaaggaaagttgatagtcgaatttcaggtcattatattccagaaagtaaggaaaatcattcaaattctggtcaaaaaactaggcttagtagaagatttactaatgattggattaacttccttaatttattgaaaaccattgaaattgattctaaaacttacagacaaaatagaagagtgcttagaaagtataaggaaattaaccacaaagatctcaaacagtatcgtagaaacatttataatgaactgcaactatataacaatttacttttgagtatacttttaaagttaagcttttatattcaatatattgtttactttccaaatactggaaagctttttggtggaaatgaagattatagctataatagtcaatttaaaaaaaaatatcaaaaacaactttctgatgaaaatgatgaattaatcaaacttaatagaattgatatttatgtaaaccgaattccaagcgatattcttagagaggtgcgaacttcaatatcttcttgttctggagttgttaaaattttacatggatatggaatccatctagactctactccaaatgatattatttcattatatctccaatataaacgcattacaagaatacttttgaatatttataatagtgaaacaagtcatctatttgaaaaacatagtagtaataataatctttcatcaataaattttaaatccaactatgacaattatggtaaacgttctaaacacatttttgaccaaaattttgttccaaataaaattggcttcaaaccatttcaaattcaagaagaaaaacaaaagtttcaagaaaaaagaaaacctcaaaaatcaaaacatatagaaaacttttctaatgttaataaagatcctactgaacttaaatttaactatctttcaaaagaatcagttgagaaatttgtcaatgaaaatgaaagaaatcttttccaactaattaatcaagatcttactactaataaatttaataaagaaacgggacttagtatttctaaaaaaagaccatctggtgcttccgggcttattattttcagccagaaatataatgttgaatccgaatatgactgtaccgccaaagtcttacataatggaaatgttgaaattaactttaataaaaacatcctttctggatttagtggtaagattagtacatggtttaaaaataactacctaaaacacttttataacaacaaaaaaaacaatcttatcccgcttcaatttaaactcatgattgcttgtccatatgctatttcaaatcactgcatgcaaaataattgtggcggcctgaatgacgtgtttatgttaatatatttagtaggaagattaaaaggttattatgatgactggaagattgttactgagtttaattcaattactgcagatacaaatatgcaatggaagattgtttcaatcttgattccagatattcagtcacatttaggaaaaatgtgtcctgtacaatcaaactcattaaaatctcaagttctaaaaacatcaagacaagtagtttttaaaagtcccgtacaatttgaaaatctttctgaagagtttaagtatgagaatgctaatattaaagagtcaattataagaaattgtcttaattacgtacaagaagaaacagttattgagtttttaacaaaagatggaagagatgatggaatggctatatgtagaaataatcatttatatataagttag

SEQ ID NO: 1763 - DNA, 759 bp, Cryptosporidium hominis
atgaatgaggaggaattatttttagttttaaagaaattgaactatttaccttttgaagatcagataaaattaaatatggagtttgaagtaatgaagaacttactaatgttagttttaagttatattttggaaagaagtattaataaaattatcttaaaagttgaagaaattgttaaaattttgtgttgtgtgttatttacaaataactacagttctaataaaggaagtatctttgatatggcttttaaagttttatttgagattttttctatagataaagatttggagaatttacaaagctcatattttactgaagaattatgtgggatttcattagaatggagtgaattaaaatcattaatgaaatcaaaagattcagttaattacgaattatttgataacgaagaaatacaaaaaaaaagagttgtgttaattaagtatgatttatacatattgagtatactaaagagtttaaataatgagaataattcaataaaaaatatatctttgaatgagttagacttggaaaacttgtcaaaacttattagtgaagaacaaggatttgaggacttttcaaaacgaaattcaatttcgttcaattttatattaaataccaataatagtaattccaatttagtttggctttataataaattaacaaatttggctagtcagaatataagccaatgtttaaatttaaaagccaagaaattggtacaattaattaaaaaacaatatttgaataagaaggacggataa

SEQ ID NO: 1764 - DNA, 669 bp, Cryptosporidium hominis
  misc_feature (648)..(648): n is a, c, g, or t
atgacaaagtttggagatcatgttggcttaatcgaaacctataacacttggatttctttgcaaaaaagttctggaaaaaccaataatatacaaggaaatatcatctcttctagtaacaattatgaacaaatcaatttttgtaattctattggaatctcacataacagtcttttaagagcaaaatctattagagaacagcttattgatgtcaccacaaagatatttaatttaaaaactattaacagttgtactatgtttacttctcttaaacatagtcatcctgaaccctttgaatctgaacttaatcaggaacaacagaaacaacagaagcaagaacaagaacaagaacaagaaaataaatggattcccttttacaaatgccttacaaaaagtttctggcaaaatgttgccaaactagatcctagtagtaataaacaatacctaactgaggtcaacaggcaacttgtgaatatacatcccactagtagtgtttcacatttaaaggagaaacctaaatggatcattttcacagatattattcaaactaaaaagacttatatacgaattatctcagccattaatcatttatggctcaatgactactgctccagatggttcatttccactgaaacagactccaaacattanagtcaaaaaataaaaacataa

SEQ ID NO: 1765 - DNA, 1575 bp, Cryptosporidium hominis
  misc_feature (1517)..(1517): n is a, c, g, or t
  misc_feature (1564)..(1564): n is a, c, g, or t
atggttcgagattgtcgtttagctatatgtaaatatcatgatacacaaatttctatttctgaaaatgttaatgtttggtataaagctagaaatgataagaaacatccatattttaaaggaatattaagactaagttcagctttcaattctttcaaatttattactatgatattgagctatattttagtgatttcaatgaataatactttaaatttacctttaattcaagatgcaaagcttacatttagtccaagaaatagtcccgaacaactttcaaatgttccaagcttagatttacatataagtggttatagttcaagtttatatattattattaagaccatcctttcatcattcaattcagaagaagttattacagagacagttttaaatgactcattattcatttataaaggattattaatgaaaaaaaaagaaacaatgacttcagagcttaaagcaagagaactttcttggagaataattgctccaaattatccaacattgggtcggcaatacttaggtttaagtcaaataacttatcaagaattatataatgaatttaagaaatttaaggagaatttatgtattgatggattatttataggtaacttggatagagcggaattagagaaattattaaaggaattttcgactagagttggtattaaagctaaaaaagagcaatgtcttaaattatttaagagtagatctttcccaattaaggattttcgtggtacagctaataaagtattttatcattataatcgtccagattattttgagttgtcaaagaattatattaattcaaatttagatgaaaaagcaatgaagaaacttgatacaaagttttcaattgagaatctatttaagttattaaatgaggaatgtggtcagattaattgtacaaatgaggtaatgaggagtggttacttggattttaaattaagttcggatgaatttggtccaaatattgctttattggatatcatcatctataagaatattcaggatttttatactgacaatgttgatatcggaattttatatttaaatgatgcctattacaatacatactggcttaatgagtctttaaaaatgacaagtgaaagtttgagtttaaagacattcattgaggcatttgatagttattataaatggagtgttcaattagagtcttgggattactcagctaatgatttggggttatatatatctaaatttacagataaatatagtaattacctcaagaatggttttggagaggattataaggcgataaagaatttaactatttcaaagctcaagaataagttgttaaaatcggatattgatgaagagtttaatagtcataagtttaatcttgggtattcggaatcagtaatagaaagtcttaaggagcttgattttttcgactttaaatccaaaatgaatcatattttaaacgattatgcttcattccttcttgttcaagttcaatctactgaaaagaaagatttaattttagcttgtaaatnctcaaatttgtattcagaaagtagaaatccgagaagaaatagatttnacagaatatga

SEQ ID NO: 1766 - DNA, 558 bp, Cryptosporidium hominis
atgctatatttaaaagatgaaaagcttgatgaaagaactcaaatttgggggtttgcagctctgagatttcttattagatcaagtttaaacgcatgtaacgagtttttgaaattaggagtttttgaattaattacaaaaaagttagggaagaatcaagatatatttctcattgaaaatatattggcaatatatgtttccatactattcacttctcaagactttaaacttaacaaccctgatatcataagggaaatattggaaattatcgatattaatgttaataatcatcaaatagttcaacagggtttaattatcctaattaaatcatgtcagagaactgaggtttactctcatatcattgcagcatatggagctaaaaggattattcaatcaattctccaagtttacaagaaggatcctgaattcagtcaaattattaaactttccaaatatttgatgagatgtctatgctcattttgttcaaaaactaccttaatcaagctcgtcaataatcaacttgttttttcacatcaatttgatccaggtaggtttttatag

SEQ ID NO: 1767 - DNA, 621 bp, Cryptosporidium hominis
atgggatgttgtgtttcaaaagatgagggtgcagtaaagaatataaaattaaagaaaaaaaacaatggattggaattatctcagaaatttattattggaaatcattatggtaatcgattattgtctttctgggacataataacttatgaaggaataaattttgcgaataaagcccatactttatctacagagtttattcaacctcaaataaaagaattacatgctatttggattatttcgatattaaggcagctacgttctgaagttgacacaatttttttattatcgcgactaattgaaataacagagttattggacccacttgatgggaattcgataataagaaatcatatgtgtgaatctggagctgtggaaatattgttaaataccataaaatatcataagaaatcacctgaaatagtgctaatatgtatttttttgctaactcatttattttttaatgatggtgtttccgaaagaatggttccaatagtaagtttaagaaatctaaaattaagaatgagctttaaaaaacttgtaaattcaaattataatagattattcctgaaatattggagctacttacatatttggagaagaatattccgaattcttcagtaa

SEQ ID NO: 1768 - DNA, 516 bp, Cryptosporidium hominis
  misc_feature (417)..(417): n is a, c, g, or t
atgaagttaattaatgtattatctcatattgtccttctatttgtaatattctgcgattttacagaaagaagctttttgccaacaatttcacttgtaagaacaaaaataatccacaaggaaaataatgcgaacaatgggagaattattccagatttatctgaaattcccaaaaacgaagaaccactgtatttagttgaaggtttaattgatttatctgaggaagatgaagatgattattacgaggatgaaataatcttcatagatgatatggaaagaagcaatttagatgaacccacttctaatgacgatgataaattaagttctggggatgaaacacgaaatattaatgattctcaaaacaatggtgaattagagattgataataagagtgaaattccagaatttaataaagaattntatttcaatagtcacaaatgtttcctaatgttaggtttcgaagttgagttcttagaaaatccaattttgaataactctggagtactgaagtatatcaaa

SEQ ID NO: 1769 - DNA, 936 bp, Cryptosporidium hominis
atgatacacgatattttactttctcttacagggtttgttggggataagattgaagtagaccctgtggaatttacaagtaactcaatttctttgtatagttataaatatagattgagactcaaatctaatgttgaggaatatttatcagaaactgaaaaattattagtggacaagattttgcatatttctagtaacttctattctgttaatgaatttgttaaaagagttctaggctctgtgtataacaaacatagtaattataattcaaatacaaactcgaatccagcttttggttcaaaatttaaccacgaaaagagccatcaacttcaaattagagcagatcttaagaaaagattactcagaattaaccctgttggactatatatacatgcagtagtaaaatgcatgcaagagtatattgttcgatttcttcagaaaattaatcagttagaaagagaagtttttgaaaatccaagtttgcctcttacttttgtactaacttcaataacaaaaccttccagagttttagataattttatgacattcattgatgagtggtataatcttgctcttaattcaagagtagattctacatgtaaattctcgttttcaaatatgtttattacaatggaaaaatttgaaaatttgtgtgaaatatatataagtattccatgtggatatatattggattatttctatttgggagtgtctgctggagatttacttcaggaatcagtgagtaaaaactttctattggtatgtagtcgaatcttttgctatcaaatgataaattggatcattttaggaaagttggttgacccttttgaagagtttattgttggaaggttttccatttcagctcctactaatccattaaactcccaaaaggatgctaacttttcaaactcattttcaatctcttcaaatgataggtaa

SEQ ID NO: 1770 - DNA, 1692 bp, Cryptosporidium hominis
atggagttctgtattaagctgtattggcatacaaaacacttgagatctctgttaaatactgaaaaggagtattcactattaaaaaccaatttacttgaaattcccaatccctttatcaatttaatggaaggcgatttattcgcatatagacttaggattttgttcaaacaatcaaatatttcaatatatatggagccactgaaaaatacctttcctggctcaaattcactctttggaagaccaactcaggtactgagtattcaacatattaatattgatatttgtttacctttgcatacttcgtcatgttttattcatctactaagacataatgatcacaaaagattcaaaaaggagaaagaatttaaggtttttaaatggtgtcatataagctcctctaataattcagatgtaatttctcagctagcaaactcttgcagcataggaacctcttcaagtacaaactataactttaatttattaaaaaacgtctcgttaaattcttatctaagtggaataagctttgatcaccatatatttagattaagaattatccagaaatttgattggccgttaccacttttattcaccaaaaagaatatggaacattattataatctgtttgatttttattggctatttttcagaacatataatgggcttgaaaggatttggagagaagctttcaatctaagatatggaaatagaagaggagcattcacttcattttctattgaacatccagtgaaccatttttggaattatatcttttactgtagatgggttctacaagtaacaattggtgaatattactcttttcttcaacactttgtagttgaacaaagcttcagagactttctcgataaggttaaggaagagcaagattttgagaatattatccaaaaacataatgaccttgttcaaacacttattcttaaatcagggttccttttaccctctattttaaacccattaacatcaattctagttttaacaggtgaatggatttactctatttttagagaaatatctagatggaatgattccagcgaatttattgaagcaagttacacattctcaaatgctgaagagattaaattcccatgggatggtgatgaatggcaatctattatcaatagtacaataaatttcatgaataactttattctactctgggataatctttgctctgaaatttcaatagtttcaagtaatattcaatatcaacactttagccttttgttatctatttttaataatcacaaatggaatattgatatacctgaccttaataatgctaataacagaaaagctttcccttatggctcttttggtccatcacactcggactataattatgaggatgacgaatacagagaggaaactgtaacacactctgtagtagaccgttcggaggactttgaaagcgataactactcagattcaagagaagaggacaatagcgataactatttcaatagtcaagatgatcttgaagatgattacaatgaatttgatttattcagaggtgaatttaatgaatacaataatagtaacggaaatgatgaaaataatgacgagaataaacaaagtcagtactcaccacatatgcttgatggaacaaataacagttatatcgaactcataaactccaaacttagtgccacttatctaaaaacaaacaaaatctaa

SEQ ID NO: 1771 - DNA, 1797 bp, Cryptosporidium hominis
atggaagaacaaggattcttttccttgttaaaggacatgctcaaggatcaaagtgcaatggttgtagctaatactgttgcaagcttattagaaatttatgaaactagtataagtaagggtcatcgacttgagtctttacaatctgtaaaagacgaaaaacaagaccaaggaatgactgaagatcagaaattctacaaattggcttttaatgaggtagaaaaacaccaaatcctacaagccttgaatgaatgtacagaatgggggcagatttatatactaaatgtagtagcagagtggaaggtatcaactgaaaaagaaagtgaacaaatcattgatagattaacttctagattatctcatgcaaatcctgcagtagttctttcaactgttagagctgtcttgaatctactgaaaaatttggaaaatgatgattatattacaggtaccctacgtaaattaagaccaccaattgttacattacttacaacttcacctcctgaagtgcaatatgttgttttgaggaatgttcagttaattgtacaatcatatcctgccttttttgaaacagaaatgaagcttttttattgtaaatataatgatcctgcttacattaagattgaaaagcttaatttattatatagaatggcatctattgatactgcaaataatttattaaaagaactaaaagagtatagtaccgatacgaatatagaattctcaagaaattctattaaaattattgcattaatatctataaaattcaaagaaactgcttctaattgttttcaaatcctagcagaacttatcacaaattctcatcaggatcatataattcaagaaggaattatctctttaagagatattttgagatcctatccacaattatcgtcaaatgtaattcccatattaatggaagtatcagaatctattgttgagcctgaatcaagatctgcttttgtttggattattggagaagtttatgagtttgttcaaggaacaaaaccaagtacaaaaaatgaaactttgaatgattttctccgttattttgttgatatatttattgaagaatcggtttctgttcaacttcagatacttacaaccatagtaaaatgctttcttaaagctccaattcataatcaacaacttgttactgatatttttagacttgcaactactaatgcagaaaatcctgatgttagagacagagccttgatatactggagacttctctcaaccaatcctgaggaaactagaaaagttgttctttctcaaaagactgtattatcttcaaaaagctttgatattgaaccaaaacttcttgaaaagcttatgggagatcttggaatgatttcttcagtatatcataaacctccaagttgttttattgatattagtaagaataatatagttcaaaatcaacttcaagcttcttctgaatctcaaaatcattcagctttaatttcatcgtcagattccaatatcgatacacttccttataatattgattctggtttttctgttagttattcaaatactaacgagctaataaatattgatgatcttatttcttattctactcctgtatcaaatattaacagtaataaaatatcaagttctcaagatatgagttcgtcaaatcaagttcaaagctctgagcttttagattttggtctccccgcctctaatataagcttattcaaaagtaatactcagggagacaataatcaaacaggagatgtgaactcacagccatctggtagtaatgttgttacatctgttgatctgttatctctctaa

SEQ ID NO: 1772 - DNA, 1392 bp, Cryptosporidium hominis
atggagtctaatttatatgtttctagacagagaggagatgagacaaatcatatattagttcgagaatatcaaacatgcctatctagttatcctgatacgagacaacatggaagttttgagaatttatcaaggccatatgctccattgagggatataacaggcagtatatttggaggattggtacgtgaatcaagagtaagatcagtgaatgaatctaacgattttaatagaattaggaactctatggtagaaagattaaatagagagagtataagaggtccagaaagtcgattttttggatttgaatcaaatagtagaaatacagcttattataatagtcatgaaaatgacataagggcatttaataggtcaatgtctatgagcagtccaaatttagatgttggttttgcttcattatctagaaatagttcaaatgaagcaattgagaataatagtagttttttgaatagaagtagaagttttgctgatagaattatggagcagtttgatattgtagaaagggaacataatcaattagctgaaagaattcatagaagtcaatcaatttatgagcagattcagaggaatggagctgaaattgatcaactttttgataatttatcatatagaatgcaaagaagacatactcaaagagaaaattctactggtaataattttcaatctagaaatacaagatatggtggatctgtaatagattgtagtagaaatggccacattaatcatagatttagtaacagaccaagattcgtatctatgcaagatgttcataatcattttcgtgatcatctattggctactgaagaagaacatgaagaagaggaagattatgatgatcaagataatgatgtcattgaaattattcaggttgatgatgatgaaatttccgatattatatccagaagaaatgccgacattagaaatagatcactaattattactcaagaggaaatcattatggaagaaagtaatgaccctgaacattctgagaatgaacatgaacaaaatcatggccatgaatatgatcaagatcttgaagatgaaggaatgcatgataatgatggtaatataacaagagtattaaataggcttagagatagaatttctcaaaatcaacaagaagatgtttctggggtgcccatcaatattcaaaatgcattaccagtatcaaaatttgatttatcaagatctcagaatttggatgatgataagaaaatgtgtttaatttgtttggatgagtttaaggaccagcaagaaattctatggcttccatgtactcattgtttctgcagaaattgtattacttcttggtttgaaagaggaacagtatgtcctatttgcaaggatgatttattggctcattttaattattag

SEQ ID NO: 1773 - DNA, 1095 bp, Cryptosporidium hominis
atggtttggcaaacagataattattcaaagtattccaatggaaaaaaaagaaaagttgaaaaagatatggaaatatttgaaataaagaataagagaggacgtaaagggaagaatgtcaaattaaagagttttgaaatttcaaatcatttggacaaatttgaaggaaatactgaaatgatgaaatctccaatagtaacttcccaaggatatcacttatatacacatcttataatagaaagcaaagaagaaaaagatgtgtttactattggagaccacgtaatggtttgtttatcaaatggagatgaaagaccagcacaaattacggcttttctatatgatcctgaagaagatttacaaggggtggagttaagatggttttactctgaacacgacttgcttgatttaggtaaaattattgataaatctaaattgccagataatttgttcacatttgaggaagagttccttgaaagcgataaatgtgaagttttagaagctagtgtaattaaaaggatgattcgtatttggaatatcaaaaaagattatttgaaatggactaaagattgtttggaaatatattctggtcctcagaaatgtgatccaaaaactcttcccaaaggagaagaaagtttcgtctcttgtaaacatcatgatgagagattaattgagtacataaaggagtttaatgacgatcttccttcttattctgtagaagtttctgataattatttagcattgtatcttgttttaactgatactggtacaatagtcccaattagtgaaagaagaaatttatcatatttactttcaagatgtagtagttactatggatattatacaaattatatggctttaaagcaactctcaatgagttctggatcaaatagaacacaattaagtggtgatcctcttgatggaatacaaggagctactggaagcaaagaaatatcagatttacattggtcaaaacgtccaaaaaaagtcctaccttgtagagaaaaggagcatgaagaaattacacatgtacttaaaacttccattttaaatgaaggaggtgggggttttatttattgcaggtttgccaggtactggtaa

SEQ ID NO: 1774 - DNA, 1743 bp, Cryptosporidium hominis
atgggaacaaaaattaagaatccacaaaagactttgaaatgttgcttcgagtggtttaagacatttaaaataatggaaagtgatggtgttgtttgtgatgatgtttttgatatattaatcccaagcaatttaatattatttattcaggaattatctccaatgttttttgccgactattctttaacagaagaacataataaagaaattgcgaaagggctacatttcttaatggacagtatcaatgactatatggacggtagattttgtgatgaaattgacgctttagattatgatttgattgcttctgcgattgaaaaaaaaggtaaagtgcaagatgatattttatgtgaaatatgcagagtatgtggatttgttatagtatttgcagtagaaagtgagtataatgaggatgttattagtaatatgatgatcttaagtgaagatgcccaaatagagttacaacatatgattcaagttactggagaatttgctgaggaagaagaagaggaagaaccagaggaagaggctggtgatcgatccgttttgggaggaggacaagtaggaataagtttggctcatgctgatgaattggaaagaagaatagaaactttggaaagacaacttaaatctgagcaaaaagctagacaaacagcagaggatgcattaaaaaaagcctcagcaaaaccaaagtctgcaattgaagagactgaaaagcttgaaaatgaagtttggaatctgcaaaatgaaaaaacacaactaataaaagaaaaaaaagaattagagactaaattaaaaggagatattaaggaccttcagtctgaaattgatttatataagacagaagctggaaaagttgaaggattagaacaacaaattaaaaagctcaaagaaaaagtagatagccttttggacttaaaaagacagaatgagaagctaatcaagcaattggaggaattagaagaaaatggtggtggtgatggaggagatggaggagattctgaaggaaataagaaatcatcacagttacttaaagaccgaatttctgatttagaagaagaacttgagaaaaatgaaaatgaaaaggatgaattaaatgaacaattaactaaagttaaacaacaacatgaaaagcttcagaaagagcttaaaattaagcaagaccaagttaaagttttagttaagcttttagatgaaaatggagtgtctattgcagggaaggttgacattaacttaggagaagttgaatcatttcctacacctggaacagaaagcttttatattactcaactttcaattttgacagaacaattaaatatgcaaaagcaactacttttaagcgaacaaaaacgcatacaattattagaatcacaagggttgaaaacaaacagtggagatgactcaactcatgctgatggagcttcaggaagtgattttgctacaatcaataccttaaagcagcaaatcatgattagagaacaagaagctgaacttcacctttctgctaaaaaagagattgagaaaagaactcaaatggaacttaaattattgtctacatgcttgcatgatatggcacttagatatcatcaatgtaaatctattatcaagcaacttgatgaggagctttcatctttgaagcaaaaatgccaaatatctattaatactgttgatcaagaatctgctgcttttaataaagataatgttggtaatttgaatcaagttccaaataatgaatatattaattaa

SEQ ID NO: 1775 - DNA, 1077 bp, Cryptosporidium hominis
atggattacacagaatttagacaactaattagcgattggattaatgcagacataattgaacacgatatttggtcagttaaggctgtagtggatagctatggttgtttttataaagttgattcttattctagaaagaaaaaagttgttaataagcagggtagagcaaatgcaagacaaagtaatcatgaattctctagaggtattgatagaggatccaacactattgctactgaattgacttttagaatgtccaactacttcagtgtaggagtagaatcaagaattggtataggatttgacagatatcgaaccaagaacgcagtcctgaacaaaatgagatatgcgcttgaaggagttaagaatacattccgtcatacaactcctgtatacgatataattgataaatgcacagtaaatacaacttgtaacaaggaagattctgatttaattgtttcatcagaaaaagtgttatttgtgactgatcagaatgctaaatttaagagtaattcatgcacatgctctaaaggtggttatgagtttgttgatactcaaaattcgatttccgagcataaccgccagtctaccggacattatcagaactccgtagaaaatccgtcaccaactctaatgccttgtgcttctttaatattcattaacattccttcatttgcttctgggaatgatatttggaggtattgcaaagggaattgtggaattaagtttaaatcaagacgtgattccattgaaaatatgcttttcgaacaacagaaaatgggcgatgagattattgaatgcgtatcgtttccttcagctgtggcaattggactcgagatcgctattaagggtatggggagaagagtttttcaaaacaaagggcctgttagacttcattttaagcagaagaactcccttgccactggtagaaaggtttacttccaagtagatggagagtttctaatcgcctaccatcctttatactttgacgtttctcattctcgtaagattaaagttttacaaggaaaaactgacagaaccttacactctgcaactctttttaacaatttcaaatccaattag

SEQ ID NO: 1776 - DNA, 396 bp, Cryptosporidium hominis
atgaagctttttcgtaaagcatttggattcctttcttttttggatgaatctagaagaaaattgaatgaaaagcataatgtaaatgacatttttaatgaaaatttaattaatggaactggaatagattcagaaaagttttatgtaatatctgaatatattgaggtctctgaaggtgagaaaaatgaaaataatattcaaaaaaaatctcaaagtcttcagactaaagaagttgtacaaacaaatgaagaaaaagtagataaggatcatgttcttaattttaaaacttttaagatttcagttcctaatcctggaaataattgttttattccaaaaaatattgaaaattttaatttggatggtaatttaatggcgataacaagctgtaatagtccttaa

SEQ ID NO: 1777 - DNA, 1977 bp, Cryptosporidium hominis
atgaataacgacaatattttactagataatgaatatataaataggatttccaaaaatagcattaaaaaagtactgaaaaaagtcagtgttagtcattcaaatactcatccagggtttattggtattctaaataattcttctaactgcaatcccagcaatagttgcagtgctagtagttccagtagcagcagtgttagtaattacaatacaattaagaataatacaaaaaccctttatgaaggtgaacttagaagtagaaataatggtagcaacagtaatagcaatataatgattggtggaagcatttattcaggtattcactcaaatgaatcatctcaaggtagggaattttttgaatctacttacagagacaatagcttagggatagctaaggataattcccatcttgcagaggagctgagagaggattgtaatgaaaaagaagatattaatgttattaaaagactgataaagaaagaaggaaacgagaaagaaaactcacaagaagttaaaaagctaagaattccagattgttcaatatgtagagaatatttaactagaaacctaacggtaataacagtatgtggacatgtgttccacaaacaatgtattgatgcttggctatcaaagtgtgattcgaacaagaattcaaatatagctcaaggtagattgaactatttattgagtgataacggagagccaacatgcccattatgtagagttccatgttcagtatttacactttgtgatttagtaaacattacaatagatgagactttggttttagaagattcagaggagaaattccaatactctcaaaaagaagatacagttagttctaaaagtacaggagagtgtatacagattacttgcaggttaaaacaaaaaacattgacagatgaatctgaagcaaaaacaaaagaaaatgaagaattacgtaagcagcttaatgatgagaaaacgaaggtattggtaaagatggacttgattgagagcttggaaagaaagaacgaaattttacgtgaagatttgaacaggataacccatgagcttggagaaatgaaccaaaaatattcggatttacatcgaaaatatacttttctacaatcaaataatgctattaataactttatgggagaaaggtttcaagatgatttaacaataaacagtcaaataaaggatgaccaaaccaatattgaagttctagaagatgaaacaaatcagatatctaacttgataggatttaatccatttgaaggaggtgatagtttagaaaaaagagaagacgcttttcaagcattaaaaatactttccaatgcattcatcaagctatcaagtaggtatgatcagcttaaagagaaatctagcaaatggaaagctaaatgctatcaacttaatgatttaaatacaacttcgataaatgaatgtaattatttaaaagaaaaacttagaagcctgagccaagtattaaatacttcagatacaggaaaaaaacctgactcatcaacgccaaattcttctaatattgcaaaccctactatcactcttagcgatacagaaaacaacgaggagtccttctcctatatttcaaagcttattcaagacaaaaaaactgcaagatcgcttaatgaaggtgatacaaaatctcaaagtaaccaggaaaacagagcgcacagcaactcctctataacctcgaattcaaaaacaaataccagacggccatcttctaggatcccccatagaaacgaattcgggaatatgaatattgaaggcaaacatggcccaaacacaataaaagagaaagtaaaagaatctgaagaacaaaattccaaaatggaagagtctccaaatccaaactactcaaatctaattaaaagtaggaaaaatcaagttatgaaaagaaatataccaagagattcccagtctatttctagttttttttatacaagaagcccaaaaattaaattaattgactaa

SEQ ID NO: 1778 - DNA, 1233 bp, Cryptosporidium hominis
atggatgcaactttgagcctgaatgatgaatatattccaataattcccaacaatattccaaataatcaaataatctttggagaaatgttaaatattggaattggaaaactttcttttaaagcgaaaagttcaaacaatcaatcttctttaaactactcaatgaaattcactcttattgaaacaatatgctgctttgcaaagaaacatccaatgattactcaaattgaaaatggagattcaataacagaaggagaagactctatgtctaactttattaagaaaattggagatccatatgcgagctttacttctggagctctggagttttttggaaagctcccaaattctgtttcaatatcctgtaatgtcattcttccgtggcaaaaagtgactttagaatcaaatgatgagaatgatcaagaagtaatttatattcaaccttacatttctgttaaagataatatttcatgtactaaattaaatgatgaattatttgattcaaaccaaaaaacttttactcctattaggcataattccgagatttatatgccttcaaatgaatcatctactcctatatccagattcaaattgagttggaatagctctcaaagcaattcttcaaaaatctttacttattggtatccatatgaattggatatcccaattaaaggctattttactatttctccagaatctaaagaacctatcaaacaaattacccagtctcaaggtcacttcaggcctattttaactcattcattccaaatggaatattgtctttgttttgaccctgcaattgtaaaaggaatgcaagtttgtcaagtctcgatcccactcttaccaggaacccttgaaagtatcaacaatagtggaaacaacagcagctttagtaaacaaaatataccaagcgtaatgatatttagtcatacccttaagtccagtatgggccaaataatcatctcaaatgacaagaaacacattatttggaccatcaacaaccccaaagaagttcttggaaaaaacggactcaataagaaattttcattcatccaattaagaatgtatggtagtattaagcttagaataatatataaggaaaataaatataataggactgggaacaacttttcatcatttcaagggcaagctcttaattctccagcaattaactcatatttgctaaatattggccctgaaacaggaattccaaagctattcacaaaagtcccttga

SEQ ID NO: 1779 - DNA, 693 bp, Cryptosporidium hominis
atgaaaatatcaattcgaattatttcatttttaagctcaatccttttgttaaatggaatagaatcacttaaatttaacgaagaatatatcagaaagaatacaaaatctaacattaagcttgataatatccaagaatctccacttttagaatgtacggatgctttaaatagttggtcttattttgcaaaaatgactgtaaaaaaattattggatgatgaattcaaaaaggatgagtatattttcttccttgaaactttaattcctcaaatttccacaattgatgagagctttaatcaatgtagaacagaactattaaaatacaatatatcaacaaaaaatgaaactagccaatttaaattagaaatgaaatccaagggtgagaaagaaatggtattcaatacaaaaaaatcagtaaaggaagttttaaaaagaatagaagaacttaaaaaaagaaatggtgatataaatgatgctaaaaaattaatattgaactttgattcaagagatatttgtactgaatgtaatatattttcatctcaaatggctcttattagtgttattaaaagattgagattaatttacaattcttatattgcagagcttgaaagtaatattgaccctaatatacttgaagagatagaaaaatctgaaaataagaccatgaaagaaaacttatcttcaatattatgttag

SEQ ID NO: 1780 - DNA, 819 bp, Cryptosporidium hominis
atgagtaataattcaagactttcatgtaaagggcttcttagagaatcactttccagtaaaaaaaatattccatcattagtaactatctgcgtgaacaaactaagaacaatcagaaactctattacatgtttggaagaaaagaatttatcaaagaacttaatctttttaatattcaaaggatctacttgttatgaacttcttacagcagaaaagaataatttaggaatacagagcatgtttggtaacgatgctggccagacttgggatacactttgggaaactgcagttaaagtaagatatagcaataatgaacaaattctttgtaagaagaaaagtaatgagaactatagagacttcttcataaggaatcaagaagatgcagaaaagaagtttaaaactcatatattgaagagatcaaaatctattggagtttctaaagttaaaagagccactaatactgaattgaataaagcaaatagaagaactttatcacttcatagcggttcatattctagcaaaaacaatacctcttcaaagcgtagtattaatattttagaaagtactccgatatttaatacgcataatccactattcaaaccaaagaatgtaaagattactagttttaataatagatcaaacaaatctaataatccaattctaagagaatattttgagcaaaaatccaaagataatagtattcatagactttattcttcagcaaattctagaatatcttcagtttcttcatcgtctgccaaagctgctacttcaagtgttaagtttaatggaaagcctgaagttacatatatatttgattag

SEQ ID NO: 1781 - DNA, 108 bp, Cryptosporidium hominis
atgaatgaagaagaattacaaactgaaattcaaaatgcgcttctttctaataatgaagctgtcagaaatgcttttactaaggatatactccatttatcttcaaaatga

SEQ ID NO: 1782 - DNA, 2802 bp, Cryptosporidium hominis
atggtaatgatggatgactttgatgtgattgacgatgttttactgaattcaaatgaaatagagagtctttttgaatatgatgttaacaatgaagacattgaaaggaatagtatacatagtgatgagaaccagaatgaaaatataaatattagtcaatctattttaatgtctcctgaaaacatttctggaaagactcactcttctttaagaagagttgtatacaactgtaggcaaaatagtgccttaaggagtgaaaattatggcttagaaaccccaaaaggtttaagttcaaaaagagcaagtataaatatagatgatagagaaagtattaatcaaactaagtctgaaactcctatagaaaataatttatcagaagccaataccattgagtgtgcaatatgtttaatgacccttcaagatttgttgaattgtaaaaataaaggagaggagcaagaaagtactggtgaatcaaacaacaatgatattaaaaccttgaattatgaaaagaagcttgaaaataatacttgttctcttttaaatgtagaaactgctaatgaaactctctgcaaagaaaaaaaggaagagttattaataggaggattgagtgtatgcaaacacattttctgttttgtctgtattaaacaatggtctgatgttgctactcagtgccccttatgtaaaagagaatttgatcacattaatgcttttaatgttattccaggtgaattgtctataccagtaatggttattcctgtagaaatgaagaaattgaactgcaacgagatggacgaagatccatttgctgattttgcatgtgaagtttgcagattaaatgatcatgaagaagtattattgctttgtgacaggtgtgataggggctaccatacatattgtttggatcctcctttagatagtgttccaagtggagagtggttttgtccaaggtgcataagaggtagaagaaggagaacaaacaatagaaggaacaatacaagcagagcaaacaacagcaatctagatacagattttattgtagatgatgaccacgatttcgttttagatttaggttcagaagttaattttgaacatagaatgacaacaagatcttctagaactggtcgttcaaccagatcatcaggtacaaacacaagatctacaaggagtaatagttctttaagacccaatagagagagaaggccatcaagtcataataccgagccaaacttaacaacaagaaatttgtcgataagtacaactacaattcgagtagtttcagtagatagcgactcttcaacatcatcattgaatgataacattgttctctcagaaagaagaaggatattagcttctaatagaaatagtaatcggagaggaggcaggtcaaatttgaacgtaatatttgaagaagctgagtcgagtgaagggagcagtccaaatagaaatagaggcagaattaattcaaatgcacaatcaaataggacaagtagatccagcagaagtagaagaacaaggactgatagacgcactcgaagtggagtctccagaagagaccattcaaggagtgaaagatcagccacaggaactagtatattagaaatgcttgagggtgctattaatatatcttcagcattttcttctgaatatgttgatttgactagatatacttttcacgaagattcagcctctaattcaatttttggcacctctagaagtaggagcagttcggaaattataagatcgagcagtaataacaataataaccaaaggagaggtagaaatagtaatttaaatgaaaatactagaattaataacaccagcagacaaagtatccaaaccaatttaaatatttcaaattatagaatcccaagagaaaccattgttcaaagaaataacctagaccataataatagcatgagctctgtatttagcggcccacaatacagtcaatcatcagatgacgaaaatagtatcattgaaatactggagaatgaagaacaaagctttcctaataatgaattaagctcaaacataaacaatagtaattctcagaatgttaattataaaggtactattgattacaataattcggtcaatttaattaaagagtcagatttattaattcaatcttctccactttttgactctgatgaaaatgttccagactcaaatttacccaaaaattctcaaagtgcccccaatactggaaaactgcatatatatggtgatgcacaaaatgcaactaacattgaatctgtgcataatttatgttcttcaagaagtctcaacggggcaggctttaactcttcgtctgatgttacatcaaaaattgggatcgtaagtgggaatagtaataatagcaggagcagcagtagtattcttatcaacagaaaagattctcaagaatctcaaaataaaaacgaatcaaacaaaagtaatggaccaatcatttcacttagagcttattatcctgaaaggtttgcaagctcaaagccgaaatatataccagggaatgactcatttaaattccgagatgaaagtaagttattaaaaggttcttcatcatcttcctcttcttcctcatcctcatcatcttcatcgtctcttgcaaatataattactttagtaagaaaccaaatcagcactccaacacaagtttgttccacagattctaatggagcaaaaaaaattcacattttagggaaagaaaacgaaaacagctatgaagaaggaagtgtaaatagaagatcccaagagcttgaaactgataaaaatgttggtcagaaaaaggttaagaggctttag

SEQ ID NO: 1783 - DNA, 465 bp, Cryptosporidium hominis
atggactcagactctcaggaaagtaagccaagcagaagaaaggttctacagaggcaaaatcaggaagttaaggctttaaaagaggaatggaagaaagcccttgctagctgtaataagaagggatctaaaaaggggcttgataaagaataccaatcaaagatggaggcactacaactatctcataagatggaactaatgaaactatctggtgaaagcaatttagaaaatgaagaagactctgtggggcaatcttctgaaaataataggaatattgacgactccaatacaaataaactcagtttagtggaaaaacttcaaactatggatgaagtaccatcattatattccaatgcaacctttcaagtgactaagagtgaaaagcgaaaaaagaaaaagcaaaaagaacttgaacagaaatatatgaaaagtctggaagaatgtgcactaaatagtaagtttatttga

SEQ ID NO: 1784 - DNA, 164 bp, Cryptosporidium hominis
atggaaccttttgttctagcctcagttgagaatacagatataacatttgaagaatactgtgacaatattagaaataccaatgaatggggaggtgaggttgaattagttgctctttctaactctctggaagttcccattacagttattagagcattaaatcacag

SEQ ID NO: 1785 - DNA, 1140 bp, Cryptosporidium hominis
  misc_feature (1114)..(1114): n is a, c, g, or t
atgaaacaaaattgtaattgttttcatgaatattctttcttttcatggattaatgattatattaaaggcactaaggggtataaagcaatactagaaagaaataataatatctttgaaccaagcttctcatcatcattctcaaaaaactctaatttaaatgaagttgtttcggattttcagaaaaatttactatttcaatataaatacaaattaggtgaaaatgaaaaaagtttcaatataggccaagggcttataaaaacattttggaatgaattcattttttgtttggctctcaaagtattaatggtagttttgacaacctgcttaaacattaccttgaaaagttttatggaggtagttaatccatcgagcaaactaatacaatgtttgattttaatttgtttacaaacttttaagatatttctagactctcatttcaactttttaatagcaaaaatgtcattaaatattcaaacatttataattagagctgcatatgaagatctatctagaactaattttactcgtactttggccaagcaaacacaaaatgaattaaaaaacacaccaaacattcacaacttaatatttggtgatttaaattctttggaatctttgatgcaagcatttattgagcttattatatcaccaattaaaattatcggggtttgggtattgcttcaaaggaatatgggtttttctgcaaatttatcagtattgacctatatattattatacttgataagtctaactctacaagtagttggctcattatacaaaataaagtttatgaaattcagagatataagaattcttaaatgccatgaatatctttcttctttgccaatcattcgcaatctcttttgggaagaagttgtgtacgaagatttaatgtctgtaaggaaattggaggtaaaggctaacttaactaggtttctatatttaatgacagggacatttttggagtataatgctctttccatagcaaaatacattttatttttttcaattatttacaaatcttatactcaattctcaaattctatttcttttggagctacagttacttcaagaattgctaccctgcatgcattaaacatgcttacaagtccanctaggaggacgcttcgagtattgtag

SEQ ID NO: 1786 - DNA, 891 bp, Cryptosporidium hominis
atgtgttcactagaaagagtaatagaatactcaaataatacaactaatgaaaataaacttatagaagatttgaaggaggaagaagccattttagatgagaaagttaatagtgattctaatttaaaactgaaatttacaaacgtagagttatcatatcaagtttcagattatactagtaattacaattacttggaatttaaagcaattaaagactttaatcttgagctgagcccaaatgaacatattggaattattggtagaacaggatgtggaaagtcaactttaattaaaggtattttagggtcattaattccttcttctggcaccataaaatttggggaaattgaaatttacaacttatcaaggaataaaaggagagaaatgattggtatagtaactcaaacgcctctaaaggtaaataattggtcaattagaaaatatttggatccattttttgaacataatcaagatacaattttacaagtattaaaatttactggattctacaaaataattgctaatagaatgcaatttgacgaaaatctggatctggttaaattatcagactataaccaagaaaattgcatctctctgacagattttcatttaaaatatttgaactttgtcaggctattattgaataggaagaaatacagaatcattttattagacgagcctacaatagaagcacagattgaattgggaaatgaagctccgagttattgctatgagaactcaaagcttgttcctattgaagagcttatcagagattacttccagcattgctgtgttgtaatcgtttcgcataattttaatgctttaaaatattgcaatagaattattaatcttagctataaatgcaggttagatatagaaaaaaaaagtaattaa

SEQ ID NO: 1787 - DNA, 1683 bp, Cryptosporidium hominis
atgcatatagaactaaaaaatagaaatagtaaaaatgagggtgatttagagagtaatacaaatgaaacgaaagaagactcgtccatttttgactcacaaaaatgcggctcttacaagtcatcttcattgaattcagcaataataatttcaagcaattcagataatcaaaactatggtgaaaaacgagtagttgaagttccacttaaagaatcagaaatatggatacaaatgcttatcggatttgtaacagtagtaaaggcaactgttggtacaggaatactctttgctccttttgcaattgttaattcaggctatgtcttaagtattgtactcattttgatttattggttattaaatgttatttgcaccattttaatgtttaaatgcgctgatgaagttaacgacacgtattcaggtattgcatctgcagcaatggggaagtctggacgaattctggctgatgtttcaattacatttacgcagttatcattttgcgcagtatttgttacttttgtaaccaaagctatacagaatgtaatatctggcattcatgattgtgcgcctgcatatatagaatatggtacagcactaattacctttattcagctcattttatacattcctatgtcctgttttggtagaattcagtcattgggcccagcgatgattatggcgaatattgcacttctcattggtttggtaacagtattcgcctattctgctttagaacttgcatcaaatatttcaaataatactatggctaaactctcagattttacagatttagaatcaattgcaggtttggttggcactgctgcttttttgtgggtatctggtcctgttgtagtatcttattatgtctcaattgcagattacaatgccagaagaagatttacttgggtatatgttgtggcaataacttttgtttttatgcttgccacatcatttgcttttgtttcagcatttggctatggtgaaaatactttttctacgattactttgaaccttccgattacagcaggtgcaatgtcaggtcagatattctttgctatttcgattttactttcatttccactaatgatctttcctgtaaaagagattttcacaaaatatattgacaactattggaagaaacataacaaaaataaaattctggaatttattacaccagctgaacaagttagacaactcagcattcaaaaaacttcgagtaaattaaacactccaataatttctcaaaccaattctcctggaaaagaaaatttgagtccaaattccatcaattcaaaattaggctcaaaaatccttcttaggcaaccaagtggatcaatttcgtttacaattgataattcaaataacaaactatcaaattactttgtgaaagcagcaccttcagccattgtaataatattgagcataatttgctgtatgattggtttctttcttattaattcacttggaaactttgtaaatcttgttggaggtttattttgcgtcccaatcagtattattcttcctgcattatttcatctaacactatttaagcagcagatttcacttcctgcattcattctggatattttcctcattatttctggaataattacgtcaattgtcgtcatttggtacacattcgtttcatggagcgttacaaacgagtccatatgtaatattaagcattag

SEQ ID NO: 1788 - DNA, 1566 bp, Cryptosporidium hominis
atgagtgaaaagaacgtttcaattgttgtggcagcttctgttttgagcagtgggataggaattaacggacaattaccttggtctatatctgaggatttgaaatttttttcaaagataactaataataaatgtgactcgaataagaagaatgcactaattatgggaagaaaaacatgggattcaattggaagaagacctcttaaaaatagaataattgtcgttatttcctccagcttaccacaagatgaagccgatcctaatgttgttgtatttagaaaccttgaagactcaatagagaatcttatgaatgatgactcaattgagaatattttcgtctgtggtggtgaatccatatacagggatgctttaaaggataactttgtagatagaatatacttaacaagggtggcactagaagatatagaatttgacacttatttcccagaaatacctgagacattcttaccagtatatatgtctcagacattctgtactaagaatatctcttatgattttatgatttttgaaaaacaagaaaaaaaaactttacaaaattgtgaccctgccagaggtcaattaaagtccattgatgatacagttgatcttcttggtgaaatatttgggattagaaaaatgggaaatagacacaagtttccaaaagaagaaatctacaacactccaagtattcgattcggaagagaacattatgagtttcagtacctggaccttctttctagggtcttagagaatggagcttatagggaaaataggacaggcattagtacatattcaatatttggtcagatgatgagatttgatatgagagaatcttttccacttttgactacaaaaaaagttgcaatcagatccatttttgaggagttaatatggtttattaagggagatactaatggaaatcatttgattgagaaaaaagtttatatttggtcaggaaatggctcgaaagaatatttggaaagaattggtttagggcatagagaggagaatgatttgggcccgatctatggttttcagtggagacattacaatggagagtacaaaacgatgcatgacgattataccggagttggagttgatcagcttgcaaaacttattgagaccctaaagaataacccaaaggatagaaggcatatactaacagcctggaatccatctgccctatctcaaatggctcttccgccttgccatgtgctttctcagtattatgttaccaatgataattgtcttagttgcaacctttatcaaaggagttgtgacttgggattaggatctccatttaacattgcatcttatgctatacttaccatgatgcttgctcaagtttgtggttatgaaccaggtgagcttgctatttttattggagatgcccatatctatgaaaatcacctaacacaattaaaagaacaattaagccgcactccacgtccatttccacaactcaaattcaaaagaaaagttgaaaatattgaagactttaaatgggaagacatcgaattaatcggatattatccatatcccactattaaaatggacatggcggtataa

SEQ ID NO: 1789 - DNA, 1065 bp, Cryptosporidium hominis
atgaataatagatttgctttaatattagccgaaattgaagtacagttgtttggctcaataaacttggcactttcagattattggcttgtaaaaaatcgactcgattcagaaaaggaattagttcaaactttagttagtgtatttcctaatggtgaaagttatttagagaaggaaactgagatacaatttgttcaaacttattttatgattgctaaaaaagtaaaatccatcttggttccaggctatgatggtactaaaagaagcatttttcaacaaatgcagatatttaaattaaactataaaaaaattaaatgtaataaaattcaaataagttttatcatgatttatttgatttttgaatttaacgaatactttatttttaatggatttttactttacatattgctttgctcatttaatgagctagaagatatagaatttaaccagtcattaattatggtattgaaaaatcagcatagtttgggatctaaaatttcagctattggaggaaaagatttaacaaaatttcttaatgatataaaaaatatttttacagaaaattcaaagtatgaaattcaagtaatgagtagattccaaaatataagatttcccataaattttaattccttgaatgttgaagagtttgggcttaatttttgtcttatattacttgaattgcatatactaaatgaaaatagacttactgaattgcagatttttctattctttggatcaagatttagttcttcttctttagtcctattggctaatgatatttacaagttagcaaagcaaaattcaattactagtacagatatcatagcatctattctatatgacattaatacatttaatagaattaagaaaagagttttagcattgcataatcttgatcttaaaaattttaagaaacaatttgatcagtgtcttcaagctaaagaaggatataatgaacttcttggaatacgtaggaatacagatattcaagaaaaaagcttaaggaaatcgacgggtcaagagcgaataaatttaaacttgaaatatccatttttaaatttattttaa

SEQ ID NO: 1790 - DNA, 1032 bp, Cryptosporidium hominis
atggatttctttgatctgcaattgaaaaatttgcttggtactgagttctggtttgatttacataaaatggcttcctacaaagatataattaatgctattttagaatattggaaacattttagtaatccaactcaccaaatacataaacaaaacatagtaagattttatgtaagtaaccaacaagaaatgagaaaagacttactgagtgattatagtggttatcatgagtcttcagcagctatggtcacaaaatttgtaaaaaatgtaactaaatacaattgttatagaatgaagaacacattagcattattctatttaatatttggtaatgacccagaatatttggtttcagcatttcttctttatttgttaatatgttcatttagagagttagcgttcggttcattttcaactagttttgtaagagtaatgaaaaatgaagatcaactaggatcaaaaatgattgttttaggtggatcacttgtttcaaggttaatatttagcatccaaagagtatgttttcaatattataaagtacaatatactatttctgccgaaaatcaaatgattagaaacccaatcaatactcaaacatttgttcttgaagaatttggatttcaattttgtttatcattattggaactcgcagcaaatgaaacaattaatattgattttaaatatctattactattttttggatcaagaatggggcttgctgcagaggtgttactcgcattcgacattttaaaggaggctattagattagcaacttacctaatagaagctatttcattgttattgaatgatgataatgcatttcaaactatagtagcaaagataatggatttatatgggattaatatttggaatgtaaagaaaagattcaatgaatgcattctggtcaaagagaaatatcctatattaaatggaattgtgagtaccacggattatcaaaagaaagcaaggaaaagatcaagaagccgtacggaaaaatcaaagattagcttgagatctaaatattcatttttttaa

SEQ ID NO: 1791 - DNA, 1395 bp, Cryptosporidium hominis
atgagcttggaaagcacatcaataacagcagttttaaatattaaaaaagaaaattctttagaaaaactagttagaatttctcaaaaagttgataatattaaaactgtgaaagctaaagaacaggaagatagtaagagaaagtcttccaaacaaaagaaagaatctagatatccaatatttactgaagaacgagctagacttttaaagttagataaaacaccagaaaataaagagtcaaataaagaagccaatcaaaaatcgaagacaagtaaatctaaatctgaaaagaaaaaagaacaaattcttaaattacaaaaagaagccgaaaagtcatcggtaaaagaagaaattaaacacgtattgatgagtaccagacttgaaaatactactggtggaaagaggaaacaggcgaaaaaaaataaaaataataaaaagaaagaggaagaaaagcatcaaagagaattaagaatgaaggaagaaacagacgataaagagtctgaggatgaaaataagaatcaaaattattcatcattaaccttgttggctgagttaagaactgaatttgaggtttcatcaaataaggaggaaagtttgaatttggttgctatgattaattctatatttgattacattcaggaaaatatgaaacaaatgacaccgagtcatggatgtacttcaaaaacacttggtgaaaactctgcagttgatggatctacaaaatcacattcaccttcgagtaaagaatcaaatagtctatttgatgcaactcgctcatcttctaaatcagaagataaagtgccagttatattagggaatgaagcaagcaatgtaattgaaactgaaacttcaacagcccaggagggacatatatcaagatcaaaatcaagagcaagatcaaaatcaagatcaaaatcaagagcaagatcaaaatcaagatcaaaatcaagagtaagatcaagagcaagaacaagatcaagaacaagatcaagaaaaagatcaagaacaagatcaagatcaaacatagattctgaactcgattcaagaactagtaaaacagagtgtacagaaggtagttctgtacttgttgaaccttttaaatcaaaatttttgaagatgtttgtgaaaaagcccttagaagattctactccttcagtaatgaaatttttcagtgtttcatatccaaatgagtcaactgttacagtaatgtcacaggctaaagaaatttttaatgaagttcaaaattgctttttggaaacggccagattacataatgaagtttgtaaacttttgactggtacagatttaatattaattaaatctgtggaagaaaagtatatcgaacattgtctgtatcttttgcagctttacgctaaaaagaagagtattcaagaatga

SEQ ID NO: 1792 - DNA, 891 bp, Cryptosporidium hominis
atgcaacaccctacactctctaaaacaatgcctgaaagacatcgaagtgccattttaagatcagcatatgggtccaacttaaaaggctcgtctttccaatcgtcttctgttttgtcaaattcaaaaagttcttctaagcgtcaagcaccacctccgcccacaaatccaccatgttctgttaaaacagagtcagaaaaacctcaaaagcgtcgagcaccacctccacccacaacttcaccatattctgttaaaacagagacaaaaaatcttcaaaaatatcgagcatcacctccacccacaagtccactatgttctgttaaagcaaagaaaaaaaatcttcaaaaacgtcgagcgccatctccgcctacaaattcaccatgttctgttagagcagtgacaaaatctcgtaagcgtcgagcaccacttccacccacgcactcaaaatcttccgttaaggcgagtacaagaagttctaataagcgccgagctccatcaccaccatcagcgcaaccttactctctagaacgttcactgccaccttcatatcaagaattaacattactaccgcctattcaacgtagttcacaatcatcacgagcaattgaaaaaagtttgcaggcagtaacatcaaatcttcgaagacgttcttcatcatcaccaccatcaatacatccatctctttggaagcattcttcatcatcgtcatcgtcgcaacaaccaattaggcaacgttcatcatctctaccgcctagaatatcacaacgacatgaacatgcacctactacatctacctctgaatcgtttaaatcatcacaaattaaacaaaaacctccacgcccgcctcttccaactattcaatctattcatattcaaagaatttttaatgcgtaa

SEQ ID NO: 1793 - DNA, 8211 bp, Cryptosporidium hominis
atgaatagtagtaaacccgagtatgatgcaatcatcagccaaatcgagttattctcaaacacaatacctgatagtaatgcatttgtttggttgaatgataatgggaatgaagagtcaacaattacttataaaaatctttggaaatcaattagaataatctctcattttttgttaaatgaattgtcattaaaaaaaggtgataggattattttgtgctacacaccaggaattgatttcatatattctttttatggttgtcttgcaagtggaattgttgcaattcctgtttaccctgcagatccaaataattcatctcaagtggataggcttcgtaagattgttgacacaagccaagctaatgcttgtcttactaattcatcctacaataaaattatttcactattcaaatttaaatttttcaatgaacctctttggaatgtaattagttggtactcgacagataaaatattaagagactataatgaatttgaattagtaacagataatggtttttacaaatcgaaaaatgattcattgaatccgtttaaaacagttgtgaagaatgaaattattcattttaaaaagccaaaatgtgagcctcatgatagcgcattcatacaatttacatccggatcaacaggtgatcctaaaggagtaattgttactcatggatcattatattataattcactattgtgtatgaaatgttttaacttctctctagaacctaaatatgaatctcccgaaacaaaaataactgaaaatgatatcgaaacgagtgatgaagctaataagatactaaaagaaattattgaaattaaaaatcaattcatgaagacttttgggcataacattagaggattttcttggctcccaatgtatcatgatatgggtttagtaggatttattgtaagcacaataattatcggatctgaaacgtttttactatcaccattttcatttattaagaacccccacatatggcttaaagttatttcaaaatacagaattgctgcaaccgctgcaccaaattttgcatttgattatatttgtagaaaaataacaaatgatgaattagaagaaataaataacttgggtggattaggttgtttgaaacatggtggtattttaagtggttctgaaccaattagagctgcaacacttgttaggtttgcaaaaaaattttcttcagtgggtttttgttcatctgccttccttcctgcatatgggatggctgaaaatacacttattatttccggatttaaaaaaaaaagcaaactatttcctaaggtattaacattaaaaagtgataaaataatcccaggaaaaaaggttgaaatagtcaattatggatatatttcttgttattgtaactattgtaaacacgaaaatagcattgaattcaacgacaaagattccatgaaaagaaatttagtatgttgtggagaaaagaactcagtaaacgataaaattatcattgtttgcccagaaaaaaatacggttcttccagaaaattatgttggtgagatttgggtttcttctagaagtaaaggtgcaggatattggctcttaaatgatctaactgacaaaattttctttgggaaagtaaaagaatgtgattctgacttgtctgatatcaaatttttgaaaactggagatttgggtttcataaataacgatcagttatatatagtaggaaggcaaaaagatgtaattatcattagaggtaaaaactattatccgcaggatattgaagaagtaattgatacttgtcacgaagtagttcgtccgggttgttgtgtagcattttcaattgatattgatggtgaagaaaagcttgcaattgcaacagaagtaagaagtgagtttattgaatcttcggatattccgggaattaaatcatatattaaaggtttaattaataaaaaagaaagatttcaagctaaagatattattgataagctgtcaattaatattcagaaatacttaggaattgaggtttatagaataatattaataaaagaaaaaaaaatgccaaaaacctctagtggtaaagttcaaaggtcaaaagttaaacaaatgattatgaatggagattttggttcaagcattgtaattgattttattaacaataatttcgaaaatatacaattagttgaagcgtttaacaaagatgaaagaaatattgactccgattacttttcagtttacagtgaaaatgaattgcctgataaaatatatgagagggtaaagcatatatttgagtcagtagtaggaaataaatattttccggagttagatgacccacttctttcatgcggaattgaatcaatgaaagctgtggaaatttgtaatgcgctttcaaaagaatttaatattgatttccctgcaactctaatatttgattttccaaccctgagacttttaatagaacatattgaccttctcaaaaatggaaataaggaatacttacccaatgaaatcaccagtgtacctggaaaaactactagtgagtttgttatttctggaataaatgctcacttacctggttttagctcgaacaacccctttgtaaagctttgggaagtaatgatgaatagtgcaaatgtattttctcctgttccacatgaaagatggaatgcatattgttttaatgaaaagaagtctatttctgccattcaaaaaattaaaaattactatactgatacaggtgcttatattattggatccgaatttttcgatttagaaaaattcaaaatacttccaatagaagttgagcatatggatccacaacagagattgctattaagaggaaccgaaaagattttaaaacatgttgaactcccaacaaataattcaattggtgtttatattggatgttgttctaatgattggagtcaaatcatttctaattctactcatctttctgtttactctggaacaggcgcatctccttcaatactagcaaatagaatctcattttataatggcttcgcaggaccatctattacaattgatactgcatgttcttcaagtttagttgcattggatatcgcccttcatcatcttcaacaaaacacaacaaatactgcttttgtagcaggagtcaactcaatactaaacccaaacatatttgtttccttgtgtaaagcaaaaatgctttctgatacaggaaaatgctcaccttttgatgaaagtgcaaacggttttgttaggggtgaaggatgtataattgtatgtattcaacatatatcaatagcaaagaaaaaaattgcaacaattcttggtacatatgttaatcaggatggaaaaacaacaactctaactgctccaaaaggaccatcacaagtatctgcaataaggaattgtctaggaatttcaggaatgcatccatcagagattaattacatcgaatgccacggtacaggcacccctttgggtgacccgatagaggcaggagcaataatatctgtttttaaaactcataatgaataccaatataatgtaactcacatgaattctaatatcgtaataggcgcattcaaatcaaatattggtcatttagaaggtgcagcaggtttagctggtcttttaaaagtattactagttatgtcaagaagatttttcccaggaatagggaatttaataaacataaatactcatattaaaaaattgttaaatgatgaaataaatcataatcgaattatttttcctaatatgaatgaaggaaaatatttttcagaaataggaattgaagaaacacaagtattgcgatccggaatatcatcttttggatttggtggtactaattctcatataattattgaagaagggccaaatattaacttaatctgggatattgaaactgaggagaactctgacttacaagaaggcaattacttcccatggactgcaagatttcatcccttcatttcaacaattaacaacaaagacgaaatttattcttacgctatttcgaaattgaagtgtaaaaaatatgttattgagcacattattaatggattaagcatatttcctgcatcaggatatattgaacttgctattataacttgtaggcttgcagcattagatatttctagtggtgaacaaattgtttatattcaaaaaaaaaattctagagatgaaattataagcgagttcaaaaagagcaactttgatatactaactagagaatcaaatatatacttattgaaaacttcccccgttctaataaagaacctagaaattatttctgttttcaatttagataatctggaaaatgaggaattaaatgcagatataaatattaacgaaggaaaagtttctatttattcaaaaaatagggattatttcagttgtaatgtaaatttaattttagacgttgaatcaaacaacaaaatggaaattctggataattccttcacagttgatgaatttaaaaaattatgcatacttagaacaattgttcatgatgaattatatgatttgttaaataattcaggatataattatataggtagatatcgttcattggaatatgtttcaattggagattcaattgggtatggaaagattaaaacagatgaatatgactctagtcctttttgcatcgcaccctggatattagattcagcgtttcaagttttaggaggattcttaattactaatgagaatattaatggacaatacattccagttagaattgaagaaatgctaatcaattccgatatatcgtattcagaactttattctttagtaaaaatcacaaatattgaagaaaaacaaataatttgtaacatttgtttgataaatgaaaaaggttctaaattgattgaaattgtaaaaatgaatttcataaaaaatgaaattccaaaccaaaaaacagcagtaaatttggatcataaaaaaaaaatagatcatttaaattccgaagtagattacgaaaataattattttggtataaaattagattggagaccagttgcagcgtcggaattatttgaaaataacgataatgtaaatagttatagtattattacatctgataagcaattttctaggataaattcaagcttagaaaaaacaggaaataaaataattaaatttaataaaaatcttattaattttaatgggaatattgttttctttaattgcaaattagaagaaataaaaatttttattaaacaagcaaaaagtggagcaaggttctacatattaacgaaaaacgcaataccaattgaaaaaataattagaactgatggtttttcatttgataatttatattgggattcaattaatcaatttattttagaaaacaatattattatttccgttattgatatagaatcatttgacgaattgaatagccaaattaaatttggaattaactatcttggtaaaaacaatattaaaaataagatagcaaatattttgtttgatcacttagtaattagaaatgctcaaatggcaagggagagaaatttaaccttgattggttattccgctactccaattcgaattggaaattgcatcggtatggataattttaaatatgaactaacctcaagaggagaacttaaaaacttcaaaataaaatattctgagaaatttaaaatagaagaattaggggatgatgaggttaaggttcaagttaaagcagttgggttgaattttagggatatattaaatataatgaatttatatcctggagaccctggcgaacctggtagtgacttttctggaattataataggtattgggaatagtgttaaatccttcaaaataggtgatcatgtttggggatttgcaagaggttgcttcaaatctcagttggtaacaacatctacattaatctctaaaaagccaagaaatttatcatttgaagaagctgcagctttacccgtaatcttttgcacagtagaagcttcattcaatgatttatataaagtaaaaaaaggagattttgtactgatccatgctgcaactggtggagttggtattgcaggtgttcagtattgtattaataaaggcgcaatagtatttgcaacatgttcttctaactcaaaaaaaaaatggctttgtggattgggagttcattatgtctcaagttcgagagatcacaaaatattcaacaaagaaatgaatgtcttcttaaatattgcatcaaaaagatacagaggtggaaaaaatgcaaagtttgatttagtactcaattgtctttctggtgaatttattcatgaatcctttgggaaaatacgttcaggaggaacatttattgaattaggaaaaagagaaactttggactattctcaagcaaaatcaaattatccagagataaattatttgaaactagcaatcgatgaattggttgtgggtaatcctaaatatattcaatcattactttcaaggtatgagactaataatttaattaatacaaatcctactttgcctgttaaggttttcaaaatggaatcttgtactctagaagcattaaggtttatgcaaaaggcttctcacatcggtaaaatagtattaacattgccacctcctcaaacactaatgtttgaggcttttaattataagacattgaacatagctaatcttgacaaattttctattgaattattcaaaagatatgaatgtagtgggttagtagatttactggaccaagaatcaagaaattttgagttagataaagattgcgaatcaaagtttattagtgaaatgattactaaaggaaatattatcgggccattcgagatattctccaaatacaagattatgttggaatctttgttttcagttagtcaatcaatacctttaaaggtaattaactatattattaatcatgaaatttttgaagaattacgtattcttattatttctccaatatttccagaaatattattggataaaattttatcattaaaatcaggcaaggtggtatttttaacaatttatgatgaaaacaacaaggagaaatgttataaagtaggcaataatatggtaaattatgttagcagtattattaaccttaattctgaacaatttgactttgcaattatcacctcaacgttctttggaaaacttacatttatctcattaatggaaaatgtaaaattgatgcttaaaaaaggagggccactttttattatcaacccatttggagaaggtttaacatcaagtattatcaaacagcaatattgtagttatatatcaaaaataattgttccaattaaatttaaagttgattttaatgttgaaaacgttattgatgagtttaagttgataaattgtgacaaaaataaaacagttaaattctactctttcgaaacaaattattgggattcagaatttgtaaagcaaaataatactgatgatgatggattcaaaaacaattttcatataattttatcccataaagaagacgaaatatctttatttgctgctactaagttgttaagcgaagcaggtgcaaacaattttgtgtatatatcaatggaaaaaattacaattaattacccattcaagtacaaatttgagattaagaaagaaaactttgttcaaaatctcaaaagaatattaattggaaatggaatttacaaaatttcgggaataatatgtttgcccttaaatcatttgaaatgcagggaaatttcaaatattctttgggatattcattcaatttcatttatttcgactacatctattcaatatttcttactttgctcttgcaatgacaaaaataatttaatattagaaacattttgtagatacagacgcaacattggtcttcctgggcaagttgctttttggaattataattcagaacaagtttccaatcttaatcatggctcatttgtacaagctgcaattaaacttgcaattgtaagtaattctgcttgtatttacaaaccaatgaaaaatcaagttaaaaatagcgaggcttgggaaactaacagtaaaattatcttcgataaacaacatataacgaacacaatagtaaacacaataaatgatattgtaggaattgaaaaaattgactttaatactccactaattgaaataggactcgactctttatccgcagttgaagttagaaatgcaatttctaacgaattaaatatcgttttaccaattaccacattatttgattacccaaccataaattcgttatcagattttatactaaagatttcaaatacatcaaca

SEQ ID NO: 1794 - DNA, 663 bp, Cryptosporidium hominis
atgataacagaaatacaaaatagagaagatttatatcaatttaatgaagatagaaaaatagaattacttggtaaatattatataattttaagataccttaagaataacttaatttcaatatcattaggaaaagttcatattgataattatattaaaaattctcttggaatgaatatcaaagaatttcaaacatataaaaatagcaatatcaatttaatggaagattttaatagtaatatgaataataataataataataataataataataatattcaagaaaaaaataataatatttatcaagaaccattaataattgctttaaaagaacaactaaaatcttggtggtataataattcaaaagattatatagattttagattagttttggtattttgtggattacttatgataatatttgcaataatattattattaataaaaatgatgagatattataattgggtacctttaaaatctttaaaattagaattaaagaaaagatttcgaactaattcaaaaatattcataatagatatttcaagtgatgaaaattctgatataagtcaagataaggaaaagaaaagaaaaagaagagttaaatcaagaaagatatatgattcacaagagattagttatactcctagaagtgaatatttatca

SEQ ID NO: 1795 - DNA, 273 bp, Cryptosporidium hominis
atgaaatttggagttgattatatattataccataaaagtccatctctagtccatggaaagcattgtatattaatttgtaaattcacatatgaagaaaaagaaaagaaaaaagaaaatgataatgatgattattgttataataaaaatgatctatcaaaatatgatggatatgaagaaattatttacaataataaaaaatatatggtaaaatttcctattattaattataaaaaaattattaatttatcgagattatgtgagtccgtttcaaaa

SEQ ID NO: 1796 - DNA, 99 bp, Cryptosporidium hominis
atgttggaatttcaaaagaagtgttttgatccattaagaaagaaaaattcgaatttacatgaattaagacattatgtagatcttggtgtaagtttataa

SEQ ID NO: 1797 - DNA, 49 bp, Cryptosporidium hominis
atgacaaagaagaaaagcataagaaattacaatgggacaaacaaaaggg

SEQ ID NO: 1798 - DNA, 58 bp, Cryptosporidium hominis
agttaatacgaaagtaatgaggaactcttttttagatctggcaccaaaatcagattaa

SEQ ID NO: 1799 - DNA, 345 bp, Cryptosporidium hominis
cttgaaatgattttatttattaataatcctggaaaaaagaggagcaaaagggggagggggagggggagggggagggggaggatgaaaaggaggaagatgaggaggaggagaattggaagaacgagaggcaaatatgatagtggcagcagtggtagcagtggtgtggtagcagtggtagcagtggtagcaatggtaacggtggcagtagtggtagaagtagttgctgtcgttgtagtagttgctgtcgttgtagtagttgctgttgttgtagttaaagtggtagtagtagttgtagtaacagtagtattagtatcagtataagtatgtgaggaacggaaaagaaga

SEQ ID NO: 1800 - DNA, 344 bp, Cryptosporidium hominis
tgatttttataaagaccataatgaagaatttcaatttcaaaaaattaaagcaatttcaagacagagaatatatgaaatgataacagaaatacaaaatagagaagatttatatcaatttaatgaagatagaaaaatagaattacttggtaaatattatataattttaagataccttaagaataacttaatttcaatatcattaggaaaagttcatattgataattatattaaaaattctcttggaatgaatatcaaagaatttcaaacatataaaaatagcaatatcaatttaatggaagattttaatagtaatatgaataataataataataataataataata

SEQ ID NO: 1801 - DNA, 43 bp, Cryptosporidium hominis
ttgcatgtgttgaagctattgagaaaagctttaatgcgtttaa

SEQ ID NO: 1802 - DNA, 2082 bp, Cryptosporidium hominis
atggattttagtaattcagtattttttttaacagatgatttttctggtgtagaggattgcccaaataatccaggaaatagtcatacatattatcttgattttagaggcataaaacatgttccgtgttacgaatgtgagaactttcttaaaagtatttctattattgaatataataaaaaaaaacagattgaaccttgtcatagaagtgaaaaaggatttcatttagtggaaagtggaggaaaaaataataagtttatatattgtacatcgtgtagcgatttttacaataataaaaaaattacatcgaaaccaaaattgatacactttaaagataaaaatatctttaaattagagagctgtcccaataaaaatgggctaacacatcaagttcattatgcaaatgatggattcaaacatacttcatgttttgaatgcattgcagagccaaagggattgccttatggtgcgtttattgaaaggaaaaaatatgagcgttgcccaaatagacttagaggaaaacatttctttgaaagcggaggagatggatttaaattggtttattgtacattatgttacgaaagttgtaattcaaaagcattttgtcaaggcggaaaaaataaaaaacctgccagttctgatcttcacattgcatcatcatcacgaacaccttcagaatcatcatcatcaatacctccatcatcaccacgactaacacgtttggcatcaccatcacgaacaccttcagcatcaccaacatcaccattatcaccactatgtacaccttcagaatcatcaccatcatcaccaataccttcagaatcatcattaccaacatcaccaccaccaatacccccagaatcaccactaccaatacctccatcattatcacgaacacgttcagcatcatcattgctaatacctccaacatcaccaccaccaccaatacctccagcatcaccacaacgaacacctccagcatcactaccaccaatacctccatcatcatcaagaacacgttcagcatcaccaatacctttagtatcatctttacaactaatactacaaccaaggccgccaaaaccattaccaccacaacgacgagtactacgactacgatcacgaacaccaacatcgttaccagtatcatcatcaccatcaccaatgccatcatcagaagcaccaacatccagatttccaagctcaggctgtgtggaaaaaactggaggtaggtatacttcagcagggtatttcaaaactcattgcccaagaagtcaatcagcggatttcaaattgaaagtttctgctggtaactcaattgtttgtgcattttgtgataactcattaaaacatggagtttatgatccaccaaggagttcatcatcacttgcggatgctatttcagttatagggcattctcgttcacgttcacgttcccgttcccgttcccgttcccgttcccgttcccgttcccgttcccgttcccgttcccgttcccgttcccgttcccgttcccgttcccgttcccgttcccgttcccgttccagttcccgttcccgttccagttcccgttcccgttcccgttcccgttccaattctcgttcacgttcgtcactaacagcaccagtatccaggcactcaagctcaggctatttggaaaaaactggaggcaggtatacttcagtaggatatttcaaaactcgttgcccaagaagtcaatcagcggatttcaaattgaaagtttctgctggtaactcaattgtttgtgcattttgtgataactcattaaaacatggagtttatgatccaccaaggagttcatcattacctgaggacactatttcagcttcaggacattctcgttcccgttcaaatattgaaaatcaacaacaccaacattcgagcccaattgatacagagaaaagtgaatgtggcattatttctaaaggatattttaattctcgttgcccaaggagtcaatcgatggatttcaaattaaaagtttctgctgacaactcagttatttgtgcgtcttgtgataacacattaaagcatggatactttgatccaccaggaagtcaataa

SEQ ID NO: 1803 - DNA, 1470 bp, Cryptosporidium hominis
atggttaggaaacgtggcattttctgcacattattatctgtagtagctctttttaatgatttaaatactgatttactgccaaaagatcgaaatttaagtttttatttttctttttatctagataattggtcattagttaaactaaaggctattggcagaaacaaaaattcgatcttaacttcatcaggatcgcagagtaatgttgatagtggtccattaaacgatggaatccaatatcaaagtagtgaagagaagttgtcggacctaacttctcgttcaggaagtgctgtcaattttggtcaatatcaagataataagaagttcatctttccaggtttttctgactttcatccagagccttgcttggccgatccttcaaggactcatccagtttatgttaacaaacttggagaaagggctattaattgtttaaaatgtgaacataaatttaatcaacaaactcattcagactacagtagcagttgtaagttcgagacttgcaaatattcaaaaccggacattcatttgacgagatcgtgtagtaatgggtgtaaattaattttttgttcaagttgtcatgaaaatagcgattcaaaattatcttcaggaaacagttctggctttgagtgtcccaaggatgaacctggctcaaattcacgattagcacgaccagcaataaaaactggaggtgcaagctcaagaggtggtgaaaacactgattttgtgcatactccaaaaggatatttcactacttgttgtccaaaaagtagttctgtggatttccgattgaaggtatcaaaagataactctgttgtttgtgcttcttgtaacaacttgttaagacatggaatttatgatccaccaatgagttcatcatcatctggaagtactagttcatcattaagaaaatgttttaattcttgttcagtatcaacaccagtatcagcatcactgacggtactaaggccaatagtactaaaaccaccagttccagcattacctccaagacgacaagtaacacgactaaaactgagaacatcacaaacaccatcaacagtacctttacccaagtgtccaggcttaagaggtggtgaaaacgctggttttgtgcctactccaaaaggatatttcactacttgttgtccaaaaagtagttctgtggatttccgattgaaggtatcaaaagataactctgttgtttgtgcttcttgtgacaacttgttaagacatggaatttatgatccaccaatgagttcatcatcatctggaagtactaattctttaataagacagcgttctcgttctcgttctcgttctcgttctcgttctagttctcgttctagttctcgttctcgttcccgttctcgttctcgttctcgttctcgttcccgttcccattcccattcccattcccattcccattcaaatattgaaagtcgacagcaccaacattcaggcccaaggaattaa

SEQ ID NO: 1804 - DNA, 1164 bp, Cryptosporidium hominis
atgaaaatttctatcaaaatatgcatagcactaatctcttgttttactattttaattctatttcttcaattcaatacagtatattctgaatctgtagaaccgatagatgaagaattagcccctagaaaaagtcctaatctaggtattgaatctagtgaaattgaaaataaaatcttagttaccacaagaagaagtagctttgatttgatggtagcaaaaagtttccgtgaaagaagagaatcatcttattcatctgaaaccagtttgagctccaaagaagaagagattactaaaatagagaaagagatagaaacaaatctattcagggaaattattactgtagttataatggaattcgaaacttttgtctttaaatcaggatatctttttttgactaatttttggctagatatgaggtcaaatttcgataatattgatattgttaaaggcttagttgacttttggggaggtgaagaatcagaagacttatacccaagtttggtttcttttttttataaggaaaatatgaaaagattaaagatgtatttatatccatcatttgataaaaaaccaaagccaaagaaaaaattattaaaagactttttgtacaatgcttatcggttgtcatgtcaagattcaaagaaaagtttggcaattttaatattaatgtttcaaagagaagtcaatcttgtttacacatcatatttgttatttctaatatcttgttctcataaggacttttatcagatggaatttgttgaaattttccaattaattttacacaacacagattttgctgaaaacaagatcctttcaatagctgataaaaatgttgatacttttataacatttttcaagaagaaactaaagattgaaaatagtaacttacctagtaataatgaaataaaaactctaaatccattaaatatgcatagaattgactttgaaatttttgggttaagcttttgtgagtcattgttggaaatatctattttgaaaaatgtgatttttctttataattatcttattttcctttttggttcaagattttcaaagcctgaagaagtacttatagcaacagatatatttaaatttgtttcttcttcagcaacaactacaacagaaattattgccatgctactatttaatgagagtacatttacc

SEQ ID NO: 1805 - DNA, 843 bp, Cryptosporidium hominis
atgaatgaaatgtttaaatttgcattaaataaatttgctttatacttcttaattatttcatttttaagatgcttaacaagctaccttgtaaatgtttttatattttactggaggcaagcgcttacagaatattacttaaaaagctggaacttaattagtagtgttgagggagcatcccagagggtacaagaagatacagcaagatgggcaaaacaattacgtcttaccatttttgaaattgtaagtgcaggaatgacgttcattaaaatcattccagaacttattgcagtttcatctgcaattcctgaaatttttattctcggaaagattaagaatggaattatttttccaccatttattatatttggaattcaagtaataattttggcattttcaagttataagttaccttatcttcactttgaaaaccagaaacttgaagccaaatatagaaagatccttgctttgaatgaagattcggaacataacattgactcaaaagagttggaatcaatttatgaacacttgactaggaattactactctacctttaagtgcaccttcttcttccaatatttgtatgtttctgcaaatgaaattgctttcttcgctggtaatattttcttatggccatcatttttctatggctctatgactgtaaaaatctattatacagtccaaaaatttatgggagatatgttatttgttttcatgatcattcaggaaagatggagaggattcactgagttgatgtcagtctatagaagattgagaacattcgaggatgaaattagcaaagctgccaaggaaggtgttcaacttaaagggattgatctagactaa

SEQ ID NO: 1806 - DNA, 1023 bp, Cryptosporidium hominis
atgattttacaattttttggggacaaaaaatatgccatatgggcatatttagggtctgttctgatcttaagcttggctatttttgagtgcttctttgacacacactcaagttatcttgttgagtactatgcaaattgtatgcaaagtcttttaaatccaacacctggaggatacaaagctacagttgatgatttcatccaatttatttatggctttatatggattgaaattgcaggagtttcactaagcaatgcttgtagagcaatattaggtaactttattgcatttaaatggagaacagctctgaataattactatttaaaaaaatgggaacatctaaagaccattgaaggtgcttctcaaagaattcaagaagattgtcaaaagtttgctgtaattttggaaactatagcaattgagatgctatactggtcatgcaaaactatagcattttaccgactagttgtaaattatggtagaatgatgtcttatgtaccattctttggatctcactctcactctttgttatttgcagctttaagtttcgatttattatgctttgttccactagttatttcaggaattaagcttccaagcatcgagtacgacaaccaagtacttgaagcgtcttatagaaagaaacttatctattcagaagaagttaatgtacgagatgaagatctaacaacaataagaaaactttttattgaagtcagaaataatagtttccaaatgtataagcatatgatgtttgttgactcagcatctactgcaactattttcttcagaaaatactttgttgtattcttcatcattccttcttacttaaaaggcgacatagattttggtacatatactgcttctgttgctgttgtaaataatatgctcagaattctttcatatattagacaagaatggagtaatctcattgaattactatcaattaaacagagacttgatggatttgaagtctatctaaatgaacatagcgaggcccaaacattggttggtaatcaagaataa

SEQ ID NO: 1807 - DNA, 4473 bp, Cryptosporidium hominis
atgaaatttttcctgctttttttaatacttgcaacattattggaaaaaattgtttctcaaactgctccatcaacatacccaacatttacttatgatcaatttgcttctcattttaggcagccatattctacaaaagtagtcacaggagatcaaggtcctgattatttcagttcattatattcatatcctcaatttccacaactacttacaccatgcaatcatatgtatccaatgaacataataattggaaatacaaatagccaaagtggattttccattgagtttggttgtaactacaaaaatctcaaagatacgatagtagtaagtagtagttattcacaccttaatattaactcaacggctattttagaaggagcgtgtacatactttgcatcttatttaaatatggcaagcttttcagtatttcaaacaaattcctatactaatatcacatatttggttcctggaaatatagtttctcatactctttctttgatcccaacatcgagcgcaatcttaggaactcactcaaaatttgaatggattaattctcacttctttagtagaaaagccaaatatgatcttcctacatttttaaactttgttggagattttagtggaacattttctcttccactcacttataagatatttcttcctgatgacgtactaccatctgtaactgtagtaggatctcaatctgaaaggtattacatggatcagtttaatgttacccttacatatggaaatttcacaagcccaagtaactctggctcaagctctcaattaaataataattggcttcctaaaaaaggacttgcaggaataattcctatagtgtatcccactgttgccattatgccaattcaattatatcaagactggagaaaggacgaaaataaagttgttccttcatggggagcgagcaatatccctttaggattttcaccattaagagttcttcctccttcaaattttccaaaaacaggttatagagggtgtggaagtaactttgatttttattatccagaaagctcggaatttttaaatggaaatattgttgataaaaacaaaactcttagcttactaaaaaatgtatcagaatcaaatacatattatatgaatactcttcaagggactttcttctttaataaggttccatattcaatgagtggagatactaatggacagttgaaggatattcttccaggatatgcatttctggatacgaactatattggaggttgtttctttaatggaacgtatccattagctgtaagtgagcttggagcaggattcaaagctggttctctgtgttttacagattctatggatagttatccaacttctaatagccaattttatcctcctccactaaaacattcagggtttcttactcaacctggccatttggtgggcgtaataactacaatgagtcagtttgttagatactcagtttcaggtggcatttctcaaaacgaacctcaaaatttacgtccatttagtcataaatacccgggattgggaatttcacagtcaataatttatgatgtatttaaccatgggccaagaataatggttaagtcccctcttaacgtttatgaaaaatcttcaattgaaattccttttgattattttgctttgggagagccatacacacttaggatgtttggtcaattcggctctcctggtactgctatgagttgcagatctccaagatatattccatccaatgaagaaatgagagatataaatgtagaatggctttgcttcaagccaaagacatcaataacccagattcaagcagcaactgaacttaagaaaatggtctctgaagactgcaccatttcccaaaatttggagccttgcgttactagccaaggggctttggggaaaaattcttggtcacttaatgttccttctggatcttatgacaaaagtaaagttgcattaatagttcagaacttgaccgatacaaacttcccaaaaattttcggaacttataaaaatgcaggctcttggtttagaattacggttttggaagacaatccgtatgaagaaacttggtaccctcatagcttttgtaatgtacttccagtactaccagttattccaatttcatttcctcaaatattaaggttgaattctatgactcagccatgggatcactttagggattctatttattcattatatatttcaacattagataatacacatgtaagtgttgaattatctttgggatcagaaacctcattaccagcttctacagcaatatattcgacagcatatctactttgtcaaaatttgcagcctttgcaaatacaagtggtaccagaaaagctctctttatcaagcttacttactcatggtactgtgccactaacagccgaagttcctcctattgcagcagggttaagaggaagcttagattgttttttgaacttctatacaagctttagtcaaccgttttcaggaagagtgggtacttttagtagtttcagtggagcagcccctgcaactcctccatcaggagtagcaatgtattcctactttttgttggctgaatcacctccatttgttggctctttaagcctttttgctccagattcagaaggctcagttcttactgatgctattttcctgcttgtagagaaaatactctatggctcagattctcaatctggagttttcccgtctgtaggtgttttggcatctaatactccaattattaacgaaaattcaacagtgattttacttggagattctttgcttactcttccacaaacaataagattgccagcaatcacagatacgtggtatatatacttcagggctcaaacatcttcaaatagtggttgtagcattccatgtttatctaaaatcaaaaataaattcttctcgcattggtgttcttctccagattcagaaattcaaatttgtccaaaacagatagtaaagatgaagaaaaaagactccgatgaaaatattttagacgctatcgcaacatctttaaattcaatatcttattattcccttaatgatgctttccagctacttactagtcttgtactacagccagtatcacaaaaacttgtttgggaggactattttgaattattatatgaaaagattttggacccgaaccaaattccaagagcattggattttgctgcatctagacatcaacttttattcatattaagacaagtattagaagtggcaattaaaaatccaaaactaaaaatagatactttggcaccacttcaaatctttccaaacttgactctaaatgccgaatgtgctaataatccaggcacaaagtatctaattttggataatttagaccttctcctagctaataatagacaaattggaacaactcttgaaccaagtgctggtagaatggatttaattcttagaggtgttgaagctgttgcaaacaggttctctttctggagtggcccttctcaaactttaaattatacgggtaaatattctgatattaacgtcgatatttatactacatccttttttatggcttattctggagttcaaattggttcattcaagtttaaatatcttacaaaaatggattttagagaacttcatctaattgaatcctattatctaagactaaatgaaagactttataatcctcaagaagtgcaaactaattgttcaagctctattttcacgattttatcaacgtctattagctctggaaggatttataacagtctggtcgatattggacaaagaaacaaaactgagatgaaagatcctggagtttacataggatctacttcacttttctggtgctccgtggattatcaagcaataagtatgcttcaacaagtggaattcagtgtaagtattaaaactgaagatgaattagacctatccaatatgctttgtgctgcaaagattaaggatcaatggcttacatctccatgtagaactatattaaccgtttctggatcaaaaggaaaagaaatatctaagttcgaatgctcatgtaacgctatatcagattatgcccttgtaggattcccaatattacgcaaatttgatcctactgatggaagttatgatccattttcgccttcaattaacaaaccatggggaggatttgatgattctctcaacagttttacaaacaatgaaactttaatttcccaaataattaattcatcattctctggatttatttccacatttgaaacattgaatggagttcctttcttaaaatcaaatctatcaagcttaggatcaaggcctggaattaaaggtagttacaagcaagaaggtagagaggaaaaaaagacattcggaatagaatggggaatcaatgagactcagtcattatataatgtctcaaataatatactaacatcttctaatatgaataattacattctatggggtcctacaaacaattatactaataaagtaaatgcaacaattacctaa

SEQ ID NO: 1808 - DNA, 2235 bp, Cryptosporidium hominis
atgtccaacaaaggttatagtgaccttgtaaaggagagtaaattgtttgaaaagtactataaagagcaaaatatagttccagtagaagaatgggaactttttatggaatacctcaagcaagatttaccgtccactttcagggtagtcggtgttagtccatattcatcatcaataaaggaatttgcaaaagaaactgagtctgttacagtttatttgaatgaaaatagtgaagaaatggacaatttaattaaagaaattaaatggtatccgaaaggattagcttttcagataacaaaatcaagagacaagctgagaagatcatctggtgtttcaaaagagtttcattcgaagcttgttatgatgagtgatgggggaagcattatgagacaagaggctgtgagtatgctacctgttttatttttggatgttaaaccaaatcattatgtattggacttgtgttctgctccaggcagcaagacttctcaaattattgagattcttcaatcagaacaggctgttacaggagagtaccctaaaggatttgttattgctaatgatttagatacaagaagagctcatatgttaattcatcatacaagacatttaaactctccctcactaattgtaacaactcactctgcggatcattttccagatatttacttgagcaatcccagctctgagtcactaaaggagaaattttattttgacagaatattatgtgatgtaccgtgcagtagtgatggcacattgagaaaaaatccaaatttgtttgcaaaatggtccataagtttttctctaggtctacacaggctccagagaaacattcttttgagggcattatctattcttaagcctaaagaaggcttgctagtatatagtacatgctcatttaatccattagagaatgaagcagttgtttcctcggtaattagttctttagcaaatagagggatacaggtagaaattgttgatcctttgactatttctgaaatatcgaaggatgttatttcaaaaaccaaatttggaagagggatcagcacatggagagtcccaattccgagaaaacaactgaaaaaaaataagaataagaaaaataaatgcgaagaaacaaatgttgaattgctgcctcaagaacctaaagagttcttcgataactacgaagaagttccattccaatcaagggaatccattttcccatcaatgtttccacctgaagatccaaaaataaaggaaagcctatccaagtgtatccgtatttctcctcaccaagaaaacactggaggattttttgttagtgttttaaggatagccagctctgaaaaggaggataataaggcggataacttccagctagaaattcaagatgattatttaactttagctgataatcctaacaaaaaaaatattatcaaaatgctttttaacccatatggaatttccaattttaacgaagaaaagatattgaatactttaatttatagaaatccaaaaggagatttcaatagggcttgtaacaataaaaaaagcttagaagagcttaacaaaaaggaaaaggaaaataaggaaggtagtacagacaaaattgaagatgattttgatagtattaataacacaactgatgatctttctaatcaggaattggaggattctaagttccctagaaaaatgtggcaagtatctgagagcgtttctaagttcttgttctcagctaagtctaaaaatcctttgagagtgattcatgcagggtttcctggtgttgagctatctagatatagaaaaggtccaatatcaattgaagataatcaggttatagacgtaaactttccaccgatttacagattcaattgtggattcaatagttacttacattatagtcatggcctctctcttgacgatactccaagatgtagagagttttctattaaatatatcttaaaactacttcagacaatagaaaagccaacagaaaatactgaagaagttaaagaattccatccttacagaatccccagacatcatcttaaagaagaagaatatcctgaatttaaaggaatttttgatcttccaggatcaataattattaagcttgatttgggaaaatttggcggtaataagcctatttttttgccggctcatgtaggccgtcatcatatcgaacttttgttggataaattcttaagattttgtgttaaatttcacattgaatggctatataaacatcagaatcactaa

SEQ ID NO: 1809 - DNA, 738 bp, Cryptosporidium hominis
atgaatggactagagatttgtaatagtcagagagaacttgtgcaaaatagtaaacgaatttttcatactaaagattctcatttaaaaagttatccaaatttagagtgcataaccactgcatttagaaattctgtgatttactctgaaaaggtgaataacccaccagttccgctttttgaacaattttgtaaagctgcagttttatattcggatttttatcaatttgccttgggtgaaaactttgtttgtaatttgcttagaaatgatataaaaaacaactcttcccaagcaatggaggcttggaaaagagaatcatccgatgcaaagtcagttgaggagtttttaaactctcaaataaagattcatactctggacaaaattagatccaatccgagtagtgcaataattaaatttttatggactgttagaactacaaactttattcaatattttatagaaaacctaatatcaacgacaggagaagatcttcattgctctgcaagagatgcttacaataaatctttaagaccttatcatggatatgtaaaggttggaatagcaataatggcatttaaactcgtcccttcaaaaactaatttaattctctctctaggctatctagatattgactctggtataacagctctcagaaaactttcatccgcatctaggccttgtattgaccaaattaatgcattaatagaaaaatatggttgcaattttcaaaataaagtttaa

SEQ ID NO: 1810 - DNA, 1941 bp, Cryptosporidium hominis
atgggtcctagaatttgccctcaatgttctagcgctagtattgaagtacacgaaggaagaggagagacaatatgtacgaactgtggcactgttttggaggagaataccatggttgaaggtcttcagtttagtgaatgttccaatggatcgatgcaaatggtgggacattttgtgccttcatcgggtgttagaggatttgcaatggtatatggaaatagagaaagcagggagcacgttctacagagaggttatcataatttacagagaattgctgatcaactacgtctttctagtagtcatatagaatctgctcaaagagtatttctgatggcagttcaaagaagttttacaataggtaggaacaatatgcacgttgcatctgcttgcttgtatgcgatatgtaggagagagaagacgcctcatatgcttattgattttagtgacgttcttcagactccagtaaaagttttaggacaagtttttatgaaacttttgcgtctacttagattacatgttccaaacattgatccctcaatgtttatggagagatttgcagctcaaatgaagttaggcgaaaaaactcatgctgttgcagccacgggtgtcagaattgttcaagctctaacaagaaattggattactactggaagaagaccaactgggttatgtggagcagctttacttatttctgcaagatatcacggaattcctgttagttcttcagaaattgctcagattgtaaggatttcttcacccactttattgaagagacttgcagagtttaaacatacctctacagctcagttgacagcagatgaatttgaaaatacagatctgctctctcttccaattgttagaggaccaccctgttttgagaagaaccgcctaaaggatgaagcaaataaagctttggcaatttctaatggtgaagataaattggccattgagggaataaatcctaatataagtttggaatcgaattatgacaaggaaaatgaaccattaggtaatgatgaagatagaagaaaggattatccagaagatgctcaggaagaagagcaaggcgatgaagaggaagaagagtctgaaaccattgatgttgaagctgatgattttgaggggcataagaggagccttagtttccctaaatttttaggaggaatagaattagatataaatcaagataaactttgtaatgatgaacctacatcacaggatatcacaactattgcttccaaactaattaatgcatttgataaggctaaatgcacctcagagaattctcaatcaggaacttcgacatgtgcagatttaacttcagcagaagacctagtaatggatcctctacacttcttgtttaaagattttggagatccccaagttgaaactgaagacaagcaaacagcaaaaaaaagtattcaggaagaaactagcattgacaacctaattgaacctgttagtggaaacaaattaaatattgcgaattcggatctctccactacaattggcagttcagggcttgaagaccgtgatgatatctcaagttctgacgatctgagcgacattagtgattcagaaattaatgatttactacttgacgaggatgaaagagaagcaaagaggctcctttgggatgaaattacaaaggatacgcttcctccatcgtggcttagaaagataaacaaggagccaatgaattcgaataattttcaacaaagtgaaatttttggactttcgaataatacagccaaagataataccagcgctggtcagcctaagaaaagaaagacagaacaatcggaaaaggaaagttctaaggctcagaaggttcaaccagaaaatgctattgaaagcgtgttaatggcgcttcaaaaggctggtccaggagcggccaaacatgttaactctgatactttagccaaactgtttactgtctgctag

SEQ ID NO: 1811 - DNA, 531 bp, Cryptosporidium hominis
atgccaggaagcacatatattgaaaagatcaaaacacattatgatacattggaattaaagaaagattgctctaaagaggatatatgtagggcgtatatgaggcttgcattggaatggtatcccgatggaaatagatcggatacagaactaaagggtacaatgtttaaaaatatctcaaatgcataccaaatactctcgaatgacgaattgagacgcaaatatgattctagcattgatgagctcatcaaaaaaaacagctctgaaatgaatcagaatttaaattttgatccatatgaagtttttgagaaatttatgacagaagtactggcagataaagaaaagtattatcagtattcttccccatgtaatggtggattttacattcattcaaattcagattttaactctgattctgatattgaatttggattggatggagacgaaaaagacgccaatattaatgatgatcttttcacggaagatgaagacattgaatattgtgatgattatcattatagaaataccttttaa

SEQ ID NO: 1812 - DNA, 342 bp, Cryptosporidium hominis
atgatgtggccatttttaatgataactgcaggagctagtcttgtaattgcaagaggaacgcctatattagctaggagagctggattcttttctcggaatatgatcaggcctttagcgggatcaacggggaagtttcctttaaaactcaagggatttgagaacccaatgagtattagggaagcttacaagatattgaatgtacctccgattgcatcgaaagcgagagttagagaagcccacagacagctaatgctaaggaaccacccagataatggaggctctaactatgttgcctccaaggttaatgaggcaaaagaattaatttgtggggataaagattaa

SEQ ID NO: 1813 - DNA, 705 bp, Cryptosporidium hominis
atgctgccttttctcaccctagcaaggaatttgggagctggatcagtaagggtgggtttggtgagtaatttctctaagggtcaactattttttgttggaaaaaatctgttgaaaaatttgggtacaagggctatatcaagcaagtcaaagccgacatcagtttgcgaagaagaggaaagagcaattttggaggcagaggttgcgaagattggagttctgcaggaaagaattaagacccttgaaaaggatgcaagtggttacattcataaaatagaagaatttaaggagaaactgttacgttcactagcagaaaatgagaatttaagacaaaggcataggaaagacttagaagcagcaagagaatactcaatttcaggctttgctaaaagtcttttggatgtctctgatagcctttccagagccttattgtcagtagatattgaaaatgtagataaaaattcaatcaaaagtttatataatggaattagcatgacatattcgtcattagaaaaggtttttgaagcacacggtattaagagattccaatctttaggaaaacaatttaatccaaaagaacatgaagctgtatttgaagttaaggatacatctaagccaaaaggccaagtttgcgaggaactcttacctgggtacaagatccatgatagagtcctcagagctgcaaaggttgctactattaagaattga

SEQ ID NO: 1814 - DNA, 1443 bp, Cryptosporidium hominis
atgggaaaatcgaagaattcaaaaataattagtgaagcagagcctttagttatggctaaaaataaaagcagtggctttaatgcctattttttagtttccttagcatttcttcaaatgcttgtcagttcaggtattattcttggttggcagtctttagctaacattatcaaggatactggaacttataggtttctctgtgaagatccatcccttccttgtgtagaagaagaagtatatttggcaaatttaatgtctatctctcagtcggttcaaatgttctctgtcttattcttaagtattttgatggacgttattgggccaaaatttatggcagtttgccaatttattaccgcattaggtacatttatgattgctgttggtaatccaagaggaagtattgattacatttggtatggcgcaattctacaaaatttatgcggttgtatttacatcccatcgttcattcatttatcaaatcttttccccaagggtagggcagttattgcatctacattttcaacactttatggcttttcatctcttactttccttgttgtacagttaattcattctcattttcaaactacattaaaagtatcacttcttccccttgcttttattcagggattttttgttttgttcagtttattactcccaaacaaaattattcatttgggagatagctgtggtttctcactaaaaaaatgtggtttctattctattaaaggtaatacaaatgaaggtaactcagaaaatcaggtaaatgttcgttccgacagagaaaataactctggatttgttcagtctaaaatcaaacctctatttaggtccatcttttccaagatatttgtggttcaattcctcttggaagtacttgttgttgtttcagtcaacttttatgtatcaaccctatcactacaaatagaagaacttagtggtttaagctcaattgaagagagaaagaaaattggttattactggtcgactattttcacaactgtttcaccatttggttctatcgttggggtattggagggttatttagttgataaatatggattatggaaatctgcccttgttccaactatacttttggttgtttgcgcaatatttaaattggttccaaatgtttcattccaattacttacctttattgcatatacaacaagtcaagaggctgtgtttagttctgcatattctctatttactttggcaatacctacagatgttatttgtacttttgctggggtaaatctattactacagtcattccctgtaggatatcttcctcaatatttgatttcattatttagtcaaaatggatggacattccaggaaattaactttatgttaattccacctactataattgtaggagttatatatgtcaaattcttatatactcttgagaaaaagtcaaaacttcagagtattaacgaataa

SEQ ID NO: 1815 - DNA, 894 bp, Cryptosporidium hominis
atgagattttgcgttactttgatatccgttattgcagctttgctctgtgcctctacatcagttctctctatggaacaaaagtccttaagacaatctaaaactgaattatttacaaaagttggtctattcgtagaaggattcacacttgattcagttgcaagaacaaagatggcaatagaaaaaggattacaacaagttgaaattgttgatttgacattggaggatcttaaggcattgccaacttcacatggtattcaattatttgttgccccatctgaaatgtacactggattagaatcagttgctaaggaaggtgtggctatcatttcaggatttgtacacaagggtgctttcttcttctctcagttggattcatcctcaacattatgtaaggaattcgactacgaaggtgttaagacttccaactttccattcatttatgatggagtatgtgctggtccaatcacaaagagtggtccaatggaaactgaatgcagagctattacagcccatgtagacagtagaactaaaatggttacttacaacaacttgtttgttcacaagggtttctactttgttgatgctgagtcaaagaagaactgcaaaatcctcgcaagtgctactccacgtgataactctgagactttgatcgagttcagaagcaatgctgatgctaaggccattattgttgcatgtaagtacggaagtggagctgcaattctctcaggagtccaattagaccagaatgcagcattcttgaaaggctatatcgccagacatccagaaaatactcatgttaagaatgttgctgaatctctctctgatgtatcagaattcacaaaatctctattacatttcgtggtcatgatgaaggtcactgctgctttagaatag

SEQ ID NO: 1816 - DNA, 627 bp, Cryptosporidium hominis
atggaaaaacaagcaacagaacacaaacttcatcatcaaagtatcccaagtactgtttctacatccacagactcgattgatattgactctttaagtcctaaacaggttgagtctgacacttggttggacaaaatcttaaatgaaaaaggtattttggatattactaagaatattttgtctctagtaaatgatgaaaataaattgataaatacttttaacaaaaactcttgtattatttccacaaagatttatttaagtaaacaggctgagaaactcccatccattatctctgttattgagcttggaaagaatattgaaagccactctaatgtagttcacggtgggttttctgctacactagtcgataattgccttggaatccttgctgctcagctatataaattccctgtaactaaaacgcttaatttggcttataagaagccaattctccctggccagacaatagttattatttcaagagttaaggattctgaacaagaaaataatgaatcgatgattcagtctgacagatgtactcttatttctgagatctttaacatgaatcaggatgttcttctttcatccgaggctgtttttgttgatatttcaggcagagttaaaaagtga

SEQ ID NO: 1817 - DNA, 972 bp, Cryptosporidium hominis
atgggtccaaccaaatcagaagataatgaggtggagatcctaaaggaaaggatcaattctctagatttggaggatttgaatccaagggagaaatactcgagagtagtacaaagaagatttgaaagatcgatgagggaattggtagaaagggaaaagcagggtcatccttttgttaagtgcaggctatgttttttggttaagaaagaccattgtatatgtatggatctttcaaggcttgcagggaagattagagaagctcaagtctatccagaaataaggtttattatttttatgaatgatcgtgagtacttcaggtcatcaaatacaggaaagcttgtgaatcaattaattcctggatcggaaattttgattcacggaattccaggtagttgtgaaaggttggagaagatacttttacaagatttacaaagttataatgagacagtaatactatatcccagcaaagattcaaaaagcatttgtgagtattttttggatttaaaagcaaacaagtatctagaaatttcagataaaaaatctgagaatacgttgtcttctatggaattttataaaaaacttaaacttaaggtaatactaatcgatggtacttggtctcaagcaaaaagtattaacaagtctttgcctaaggagattaaaagaattgtaataagtagtaaattaatttctgattttggcccactcagaaaacagaataaagctggaaatatatccacagtagaagctgcatctctattaattaaggatattagagaaactctctcaagagaaataggggatgatataccagccaacaatatatcccatcttaatttacaatctgaccttcttgaagaatccttgaaattattgatcaaacatgttattgctcaatgtaagagagaatatctaagagagattctcgaaagtagaaacgagagaaaatttagtaagtacaaatatgaaactttgtag

SEQ ID NO: 1818 - DNA, 2133 bp, Cryptosporidium hominis
atggcagatcaagatcctctttcaccactttcaaacacagaatcagaatcagctccaaatgaaaggtttagcaataagatagcacatgaagaaaacaggaaaaacttagaaaaaatgtatacaaattttagtaatattgtgggaaagggaactccaatccagaatatgcaaagatgtatttcaataggtttaacaggggaaactttctatgattatgattctccatttggaccggaggatgatatttgtatactacattttaatgatgtttataatattgaagaagatgtgaatagtacaggaggagttgctaggtttgtggaagcattaaaaagttttcgttcactaaatcctcttttgctattttctggtgatgtttttaatccatcaattatgtcagtaacaacaaaaggtagacatatggttccatttttaaacatgatgagagtgcatacagcttgctttggaaatcatgattttgattttggagtagatcatcttgagtatttagcaggatcctgtaattttcaatggattctttccaatgtttatgatgcttatactggagaaccattagcaaatgcaagaacatataggctttttgaatggcaaggaaggagaattggaatcatgggtttggtagaaaaggattggcttaaaactcttccaacgatttctgaagaggatgtcatttataaggattttgttgaggaggcaaacagaatttccaaaattttaagagaaaaagatgcggaactaattattgctttaactcatatgagagcaccaaatgatgaactacttgcaaaaggagctgatgatatcgatttaattttaggtggtcatgatcatgagtactatggagtgaaggaaataggtaactctgtagtggcaaaaagtggaacagattttcgtgatttaacaatgattgtaattaaacctggaaaacattgtctagtatgtccaaattcggattccaagctacacttggaatcgtgtagatactcttcatttagcctagatcaaccaaaaaatatttatgaagagagactaattcctaataacaaagatggaggcgatatttaccttagaagattctcaggaggatctataatgacttggagctatattgatatcagtacatttggcccaaataggcatgtaacaaagatggtcaataaatatcttcgtgatcttgcaacacaaatggataagattattggtgagtgtgctgttagattggaaactagattttcagttattagaacttctgaaactaatgcaggtaactggcttactgatattatgagatcagcagctaagactgaaatagctttgataaactcagggacaatcagatcagattgtgtatttaatattggtccagttagaaatcaagatattctgatgatgttgccttttgtagataatctggttaaacttggagttcctggtaatttacttttggacatattggaaaatagtgtcagccagtggccaaataaagatggaaggttttctcaggtttcagggcttaaattcagatttaatggtgacctccctcctggacaaagaattgtacctggttcagtttatattcaggatttggataatccaatggaatttaaaccattagaacttgatagagtttatactcttgtaaccaaggaattcctttatacagggaaggatggatttgatagcttcacaaagtgtgaacttttaagtaacccagaagatatgcctccacttccaacccttgtaagaaatgtattttccttagcagctctggctaatggctatagaaaacctcataatcttgcaactgctagaaaacttaaaacttttcttttgaatccacaacaaactatgactggccttaataaagttccatcgagagcagccttcaagagtgaaaatattcaccaacttactccaaattctatttctggaaggtctaatgagtctcatgaattaattctgaacgaggagaacattcgtcgaattgaagagaagattgtggatgagcctgagtattgttttatgattcaagtcgaaagggaagggagaattataagagaaggaagcgctcctgacccattaattgaatctggaattgaaagagttgactga

SEQ ID NO: 1819 - DNA, 591 bp, Cryptosporidium hominis
atggtaggagaacaggaaccaaagattgtggagatacatgatgaccaaattagcagtggagagtcatcagaagatgaagacttaaactcaggaaagaccgagggtgttcgtccaagacataacaagggtgaaaagaaaaatagaaagttggttcaaaagttgggacttaaaccattgccagactttgagaaggttgttgtgagaggagctagaggtctctcttttcaaattgttaatcctgaggtatactgtgtcccaggaacaaaaagttacattgtatttggagatgcaaaattagaggatcgtaacacagcatcccaagctgctgccttggcaaatgctacttcacaattagagcaaaagcttgctgctatgaagacccaagatgatgacgcatcaaaaaataatcctgccacttccagtagtaaagacgatgctgctgatgaagaagatgttgatgaaactggagtagattctgccaatattgatttggtaattaatcagacgggatgctcgagagcaaaggctattaaggcacttaaatctaataataatgatgtagttgaggccattttgtctctctctccttaa

SEQ ID NO: 1820 - DNA, 1272 bp, Cryptosporidium hominis
atggatagcaataaagaagaggccgatagatgtgtaatgttagctaagaaagctattcatggaggggacctagataaggctaaaaggttattggaaaaggctaatagaatgtatcctagccaaacagtaacagagatgctcagtaatctaaaatcttgtggttcaagcactccagaagcacaccataatcatcaccagactcatcatacccatcaccatagtcataaagcatcatctccaaaaaatatgcataaccactcatctaaaggaaagaagcgaaatgaggacgatgattctcgtaattcacattcagcaagatcaaattttagctcaggttctgcatcagagagttcagaaagtatgtgtaaacgtatcttaaaagcaaaaaacttttatgacactttaggagtaccaaaagatgcagatgatgctgcaattaagaaggcatataagaaattggcactacaactccatcctgataaatgtaaggctccaagtgcagaagaagcattcaaaagaattgctctagcattccagactttgtctgacgcagagaaacgtaagaactatgatacttttggagaagatggaccgccaatgcattcagcttctggtgatgttaggtattatcaatatcaccaaggtgatgggttcctaacacctgaagatttatttaggatgttttttggaggtatgcctgcagaagtatcatttaatagacaaagatttccaaatagaagtggacactcaagatctcacaatagaacttatacaacaaatatgaattcaggaggagcaacatctgatggattacatacaggaccaatatggcaaaaaatagcaggtattattcaaatacttccagttttattaatgctatttttggccattatgggtaactttatgccaactttgtttcctgaagataagccaatttacagctttaataggactagagaatacagcaaacaaagatggacaggaatacacaatgttggattttacacaaatcccaaggccaactttgattcaaagtttccaccaaactcttcgaaactgcatgagctggaagttaagatagagattattcattttactagagaatgtagtgtagaagaaagaactatattgcaggatattgcctatgcaaagtactatcaaagtaaaagcaaattaaaagagatccaaaatagaagtaaacctaattgtgataaacttaaatggcttagagacaagtatccaagcatttatagacaaactatgagaaattaa

SEQ ID NO: 1821 - DNA, 366 bp, Cryptosporidium hominis
atgactcacatcttctcaattaaaactttgattgcttgtattgtaatcgtctctactatattcattattatcattggaatttggcttgcttggatatttagatataaaagacagactgaaatttatgatatggatcatcttgagagagttgagaatgctagaagggtgcttcttcagctttctggtattggatatacagaaaatatgagttatgatcagactacagaaaattcgaatatgatcatacaaggtcaagataggctctcgaatcatatttcttcgcctccctcttcctcctgggaaagtcttaataactttattgatcaagggaataatattgggaataatacaggaaaaactacctaa

SEQ ID NO: 1822 - DNA, 1488 bp, Cryptosporidium hominis
atgatggataatcaaattaagatagaacatggatatggagttaagaaagcaattgaaagcaaacatttggttttcttaatgtggattgtactaagcttaatatttacactttattcgaaatggttaatgaataattactttccttatcctattacaatgtccctaattcatatgatcattgcttcgattctaagccatgtgtttggaggttttgttaataaaagatttggagataaatccagattttcttctattggagaattgagtttccaagaaaaaaagagtattttggtttttagtataattgtggcagtgaatatttggttctccaatgcctctttacacctggtttccatttctcttcatcaaatggcaagaactacaattccactcttcactatggcattgggtatccttttttttaaacacaaatatagattgtctcagattcctcctgtcattttggttattgtaggagtagcaatcacagtgaatggtactccagaacttagtatttatggcttgtttatagtattcatgggatgttgtgtttcttctttgaaaggaattgttgctcagaagttacaggttgagaatctgaagattaatgcaataattatgcttcaatacgttggacctgttgcatctttaactttgggatttttttcagtaattcttggagaagcacaaaagatatcaaaaaaaagcgaaaatatggataaaatttcattcttgatgacaaatgtactgttaatatttgcaggaatattggcttttggtttaaatattttaagcctaatgagttcttccatagtatcacctctagctatgaatattgcaggtaatgtgaagcaacttctgacatgtttacttggatgttttatttttggaaatattgtaactgataaattacttttgggtattttactaactagtttgggtgctttatggtattctcttgataagcaaaaggattctggtaagaaaaaagtcaggtatgtaaagggaaggtatattgatagggttggattgggaattccaaatgaaatgggcaccccacacactaaaagggttaacaacaaaaatcctagcttagaatctattgagattaaacaaattggggattgtaataaaacccaaattgttcaggtatccaaagaatcagaaattcatttagaagaagatgttgttcttaagcttactggccaaatagatggaactgaaataagccttgaagatgatcaccatatctcttctaaagaagtaagttgctacctaaagatggaaagtattatagaagaggaggaatgccaagaaattcaagtcaatttagagcctgaggatttggaggaagttgataatggagattatacctttaaaaaaataacagatttaaacaataatatggatattatagttttagagtctggcgccaaaagttcacaaaatttggatgagaatatagattacagtaacattcagagttag

SEQ ID NO: 1823 - DNA, 1128 bp, Cryptosporidium hominis
atgagcttaattttaaaaaactccatactaaaacttggatgttcaaatttgttacgagtattgcctactagatatgcaagatttaacagcactctgagttttaaaagaaatgatccagatttaaagatctccaaactctcaaatgggatgagagttgcaaccatgaagtttggaattgacagtattcctaattctctaacttttggactatgggtagattctggaagtagaaatgaagacccaggaaaaaatgggattgctcactttttggaacatctcatatttaaaggtacatacaatagatctagaaaagaaattgaaagccaaattgaagacttaggtgcccatttgaatgcatatactactcgcgaacaaacggtttatcaaatcagatgctttaatcaagacctaccaaagtgcatggatcttttgagtgatattattaaaaactccaaattttgtaaatctgctattgaacaagaaaaaggagttgtcttaagagaaatggaagaagtaagcaaatctgaagaagagattatttttgatgatttacatagagaaatgtataagaatcatccacttggaaatactattcttggtccaaaagaaaatattcttggattcaaaagagaagatttgatcaattatatacgtactaattatattccagagaaaatgatgattctaggagttggtaatattgaccatagttcttttaagaatattgctgaaacttattttggaaatgattcaaataactccagaaatctacttggtttaaagggatataaaaatactaatttacccaattctcaatatttgaacgaaattaactctgataaaaatcatcctgtattagtacacaaaaaaaacaatagtgatggaaagactcttcttgctatggcatacaatggtacatcttggaattccaaagattttcttaaagttatgtttctccaaagtatgctaggggaatatggaaccaataatattaatagagtaactggatataaaaaccaaattattgaaagaattctttctggtattaaagaccatgttgaattctttgaaacttttaatacttgttataaagatacaggtaagttatatctttattcctcttcttaa

SEQ ID NO: 1824 - DNA, 273 bp, Cryptosporidium hominis
atggaaaatgccaaattaattagctctcgatttaaaaacctacattcattaattactgaagacgatattattagagttaagagaattctttcatatcaattaacttcattatatgaaaattctggaacattatttgaagaaattggtagagatttaatagtcaataaccattataccagtattgatgataagcttaaacaaatacaacaaattgatcttgagggtattaaaaaaattatccataaatatttcaattttaatcctttttattaa

SEQ ID NO: 1825 - DNA, 603 bp, Cryptosporidium hominis
atggcaatttggttagatgcccagagaatcattattagaacacctgatcatgaaaaaagtaaaagtgaagcaatagaaagccaatcttcattagtaatttttaatatcctatattatggatttagcccagaatattgccaagaatatacaaagtggtttaaagaaacaattattaagtacggaattgattctgatgaggccgacttaagtcttttaagattttcactagtaacaaataatttctatgaaagcgttataaatggagacagatgtttggaaaagtcatggagctatgtactttggagtgaaaaggaaaattatagctatcaagaacaagaaccaatggatttgaatggaagagtcatactaaatatatcaaattctagatatttggatgggtgggtcttgcttaatagaagaaatgacaaatatcaattaagctcaacctggtacaaagtccgtgatttccaaatcaaaaacaatttcaagttaaaggtagtatttatttatgatcttaaatttcaatttggaaaccatacaaatagtagtaagctaatatgcagaattttaatggcaagttctattggaaaactgatattataa

SEQ ID NO: 1826 - DNA, 1878 bp, Cryptosporidium hominis
atgataaaactatttatttctgttttcttagtcacttcagggctggcagttaaaggcgaacaattaattaggtgcgactcaagtccaatgaacctttgtggttcagatttaataatttacaaatctgaatgtgattttttggcttcaaaggctagattaagcgacttgactattcttgatttaactgattgtattaatggtaattttagcgagttgaatgttacagagagtagttcaaacttagataataggtcattaagagggagcagtataacaaagaaagattcagataaaacttctgaaaatgtaattttatcactgaaaaatgatacagaaatgaatttacctgaattaatggatgataataacgagaatatagttaacacttatacatttgttaatggttctacttcagataaaaagcatctccaagacatatcactgacagattctatatacaataatggaaataatatatcaaatgcattttacatgggtaaacatagtccaatttttcaaaatattaacaagtataatgtgaaaatgattaatgttatcgtagagaattttgatatctctacatttattttatcaaatggtaaatataatctttcaagattttcaatgctagtcttagagtctgttattaagatattgaaaaaccaaaggtcaaagatagataattatttgtctcaattgaaaagtaaagagttaggaagcgcggatagcgataatgcaacatatccttataaagttatggttagaagaaacgattcaagtataattggtcagaaggaatacgacggtttgaacgtgacattcaagttttccaactcaagcaatgcaaatagtttcttagattcacaaatattaacagatttagcacttaaatattcaagcaaggttaatgttagtagtttcaatggtaatgaaaatacttttaatattagtagtattgataataaccataaaaaagctattagtaatagattactggttgcttcagaaaatgaatatgctcctattaaagaaattgactccaatttaaccgatagctactttgttgttgataattgcgaagtaaatattccaccttatcaaggagctccgttggttcccaatttccattgtatctttccccaaaactctacaggtaacaatttggaagttgtttacaatagtattcttagttggagccaagtggcctttatgaacacatttggaaataattcaaatttaagtttgattccatacaaaatattcaatccaatcatgaacgtaactagtttgtcaggaggtaatatcagagttttgtcaagcaatcaatcttgggagggtgaaagtcaggagaaatttgttttggatttctttgatttattattatccccattgaattttacaaatgagataatggacctcgaaattggtgagatctttgtgaactttgattttagtctcttatctaatggtgactttattgactcttcggtctcaaatgtcaatgatacaaccactttggaagaaatagatgagatttttaagttagactctattttaaaggatttaaatttaattctgaaatccaataacacagataactctacgttatcaagttcattgagaatcacaagtgaaacattaccaaaaatagactcaaattatacaactgatggcatatatagagatttccctcctgcatttgatagggtaagaggaccagattgcgtagttaaatgtgatgataatgttgacttacattgtgcaaacgacggaatagcatacaagaacctttgtgaattcagaaatgctcaatgcgatgatcaaagcttaatttttgttggctttggaaaatgtttgcctttagttattaaaacttaa

SEQ ID NO: 1827 - DNA, 450 bp, Cryptosporidium hominis
atgggatcaatttcaaacaaaattgccattgcaaatgacaaaactcttaaagctaacatggattcaaatagcgtttctagcaatagtgactatgaccagttcctattaacccattattctgatattctcaaaaactataacaagtcagaagccattcgtgttgcctctaaagtttcgagcgtagttaatagctttgaatctgccaataatacaaacaattctaacattaaagaagaaaaagttagtggatggttctctatgggtggtggtggacaacatgaagaatcttctccaagtattaataagagtgacaatatcgcaggctcttttattaataataatggatcaggtgttatcggaattaataagaaaatagatactcagtctatttggcaggtttccaatctactcaaggaaacagtcaaggatagagtttttggccaacaataa

SEQ ID NO: 1828 - DNA, 1116 bp, Cryptosporidium hominis
atgtcaattctagtggatggccaggcattatcagtaacagatctcttccaaaaatatgatttagatgaaattagtgatattctggttaagataaaaaaagagatttttgtaagaacaaatgaagttaaaaaagttattggatctaatccagacttaatgattgattttggagagaatgtttcgaatatttatgatgcaagtaccaaattgaatatcagcacatttgagctacttaatgatattgataaatttagtaatagtcttaatgatcgaatttcaaactttgttcaagaggagctcccagatgtgataaataaagaagatttaacctctattttgagttatcaagagaaacatgagaaactttactttggcatcctagaatcattctcaaagaaaagctttgtacaaagttatgagctatatttgaaacataaacaatttttaagtgaggatacctcagatttagataattatctatttaaagattctttctttattaagcaaagtatttccagtaattgttatacatttatccaaagttgtgagaaactaacttcagttgaattggcgcaattaattatgatcagatatttactagagattgaggataaacattctgatcatttggaatatattgaatctgatctcaaaacaattctagaaaatgcattgattttaagggttgacgagactattaaaggtttaaagtatgcgaggattacggataatgatgatagtgaaaatatggaggagcgtaataataagctttgtcagactttcatgatagctatgactgttttggttgatatttatgagcttaaagagtcaatattacttgtttattctgaatttaaacaaaaaggatggtgtcaatttcaatctttggatgatatttcagcctgtgtattacttttaaataacagtgagcatatatcaaggcttttatcagttctattggaagagtttaaatctatgggaaaagaaaaagtggctgaaactagccatatagaaaatattgatacgaactacggtaaaaagcctgagagaataaaacaaagttttaggtccagattcctttctagaatatatctgaatctatttaatacaaaatag

SEQ ID NO: 1829 - DNA, 663 bp, Cryptosporidium hominis
atgtcaaattcgaaaaagcataatttaattgttattggagctccaggaagtgggaaaggtacccaatgtgaattcatcaagaaagagtatggattggcacatttatctactggtgatatgctgagagaagcaataaaaaatggcacaaaaattggtttggaagcgaaaagtattattgaatcagggaactttgttggagatgaaattgtacttggattagttaaggagaagttcgatttgggagtatgtgtaaatgggtttgtcttggatggatttccaagaacaattccccaagctgagggattagcaaagatattaagtgaaattggagattctttaactagtgtaatttactttgaaattgatgattctgagattattgaaagaatttcgggaagatgcactcacccagcatctggaagaatttaccatgtaaagtataatcctccaaagcagccaggtatagatgatgttacaggtgaacctcttgtatggagagatgatgacaatgcagaagctgtgaaagttcgtcttgatgtattccataaacagactgctccattagtgaagttttatgaagacttaggaatactaaagagagtgaatgcaaagctacctcctaaagaagttacagagcaaatcaaaaagatcttggaaaattag

SEQ ID NO: 1830 - DNA, 504 bp, Cryptosporidium hominis
atggagtcaggattgaaagcacaaggtgaggtatcacctctttcagatgcaagcccaaatactttaataaagttacctgcaaagaaaaatacccatgtattttttgatatttctattggaggaactccaacaggaagggtggtatttgagttatttacagaaattgctcctttgacgtctgagaattttagagccctgtgcactggtgagaagggtataagccaaaatggagtggatctgcattataagggatgtaaatttcacagaattatcccagaatttatgtgtcaaggcggagatatatcttcaggtaatggcacagggggagaatcaatttatggacctacttttgatgatgagaattttgtattaaagcataattctgctggattattatctatggctaattctggtccaaatacaaattcttcccagttctttattacaaccattccatgcccttggttagatggcagacatgttgtttttggcaaggtaagttaa

SEQ ID NO: 1831 - DNA, 1188 bp, Cryptosporidium hominis
atggaacttttgacatttaacttaaaggatgggtatttggaggcaatggttcgagggtatagatcaggatttataacaatggatgaataccacctaattggccaagctgaaactttggaagacatgagaacagcattagaagagacagactatggtacatttatgcaagatgagccacttcctctgtcagtgaatgtgataactcaaaagtgtagagagaaatttgctcatgaatttaggatgttacaatctcaggcttatgagccattgggaaagtttttaaattacattacttatgagaagatgattgataatgtggtaaatttgatccaaggtgctttgaataagaagccagcagaagagcttcttgctcgtttagacccattgggatatttcccagaaataagagcttttgttgctttagatttgtcttcatcttttgatgagctttacaagtcaattctcattgagaccccaattggaccatactttgatgaatttttgacatccttcagtggtgaaaatgaggatgttacctcaattgttaaggaaatggatttagagattctcagaagttctcttaagaaatcttggcttgaggatttctatagattctgtcagactttgaatcctacatctgctgaagttatgagtcatgtcttaaaatgtgaggcagactttagacttcttgcaattaccttaaactcactcaattttaatttttcgagtgcttctacattatatccaagctttggttacttatatccagaaggcacagaacaaattagaaaggcctggaatgatactcgtgtaagagctgctttggagccatattcaaaatacagtgctctctatgaccaatgcaaagcattctatgttaatgacaatgccaatgattttggacttgctgatgataaggacgaatctactgataagaagaaatcttcaagtcacaagaatcttgctgatagacaatttaagagtttagaagatttattatatgctgaaactgtctccatgtgtgagcttgtttttgatcagcagatgaattatggtgtattttatgcctgggccaggcttaaggaacaagaaattagaaatcttacttggattgccgaaatgatccttatgaatagaaaagaccaagttgatgctattgttccaatatttgctcctcgtgccagataa

SEQ ID NO: 1832 - DNA, 633 bp, Cryptosporidium hominis
atgttggtagtgaataatattccgccagtaacgaaggtctacttcgctatctcaaccttattgatggtgttatgcactctagatatcatctcaccctttaatttgtatttaaattggctacttgtgatcaacgaataccaaatatggagacttgcaacttgttttttcttttttggaacattcagtcttcacttcttttggaatgcttatgtacttctatattactgtgcgtctttggaagatgtagttttccacagtagaccagctgactttctttggatgttaatcacatgttcttggatgcttcttctcctttcatatttctttggagctggatatctttttagtggagcagttatcaacgtaatgacttatatttggggaagaagaaatccatctgctagaatgtcggttttcatattcaccgtaagagctccttacttgccatgggtattaatgggtatgggtttagtcattggatggagaccttgggataacttaatgggaattattgtaggacacacctactacttctttgaagatatttaccctttaatgccaatttctaatggttttcgactatttaaaacccccaaaattattactaaattaatgaaacaagaacaaaattaa

SEQ ID NO: 1833 - DNA, 324 bp, Cryptosporidium hominis
atgatatttcccacatcccatggaaatttacttaatctaagtagtttactcgtaagaaggtcatttcttacaagtaactccaagcaatttcttcatatattcaaatatttcaaaaattccaagtttaatttaaataagaaatctgaaattattaatggtgacaaaatagcagatcaggctagaatgcaagaaaaactctggaaaactctagttccagagaaatacattaccttcaattcttcttcattcttctttcttgctgcattgactttaggattacatcaatataatgtacaaagagaaaaatccaaaaatagtaaataa

SEQ ID NO: 1834 - DNA, 801 bp, Cryptosporidium hominis
atgttaaatctcatagaaggaaatttagcagccaaattcactgtaccaggaatgaaaaaaaatggtcaacatttgaatagaaggtatggactttttactctggtaaaatttaatatatcaggaacttattatgctgtgctttctcaaagagaacttataatttcaaatataactgatgaggaagattggtatttaagttcttctattactgattttggagttggaccttcacaaataacttctttctgttggattacaaatcaaatctttttggttggtttttccaatggactaattcgaattcttcaagtaactaaacaatgtctaataaatttggaaattaccttcacagtttcaaaaacaacttctgatgagattaagaatccacatcttggaaacagaattaaaggaatttgtattattggttataaccatctcaaggatgaaaatcttggtaattccaatatatgtggaaaactagtaacatgcgattcttccggtatttttgttctttttaactttaaattgaaattaaataaagaaattggtaatagtttatgtgaacttgaaattatggatatatttgattctgataatagaatcacatgcatggcaattgaagataaaagcccaatagatcctttgtctttatttttgccttcaaccaaccaggaaaactcagattccaaagttgataaaggctgcttgtctagtactccaaccaaaggtaacaaaaaactgagagtcattaagaaatctaagctggataattcaaaaaagaaggacaacttaaaacagtag

SEQ ID NO: 1835 - DNA, 6216 bp, Cryptosporidium hominis
atgaaaaccagggaccaaaagcctagcagaaacagtaaatctggaatccaagctttaaacttggagaaggaagcagctggcttggaaattaatcacaaagaaaatgactcagaagagcggagagtgactagatctatgagaaagagtggagaaaaggtggtttttttgaattccaatgctaatcaggatacagggaataagtatgtcactactgacataggggtcaaacagtctcacattcagacggatggaaactctactcatattcaggaacatgaaacagctactactgttgctgttactactattaatgattcaaagaatagcctcaataatcctgctcaggttacatccaattcttctgtgaaacgaaaaaataagaaagttttacgtaaatcgaagagaggccgacataagaataagtcaaaatacaagattgaatcaacctctcttggtaaggatggtgatcaaattggctcacaggcacgaaactttgataatagaacaggaaaggacacgtattctgtgagtgaactggatatggatataacctctgtaacattaattaacgaaaactctacaaatactccaacttctacaagtggatcttcaagaatggctaaaattggttggagtaggtttgactccttttttagaaagattccaatgggggctaaaaaggatattattttaaaaaccattccatcaaatccagtacaaagaaaaccaatcatccaagagttgactactcttgaacagactctttttacagaccccccatggggaaagatagggagagctactccctatgttaacaaggcaagcctttcattaccaccaatatatatgaaaagttgtagtttggatgctattgttgaccttgtttccaaatcaattctcaagagtagaggtggaaatccatcaaagatgcctccagaaattcagaaaccttattttcttttatttaagctccctagatctctttctttagttgctttggagccaaagtcgccattagaacttggtatttcagaatatgattatcttgaaacagattccgttacccatgatcatcacatatttcctacaaatgctttcccagaaataaagtcagcaaatacgaatcttcatattcagcaaagtcaagaaccacatacattttctcatatttctacaacagatattcaaaatctaaaacttcaatttcctgatattctggatcattttaatgttaaatgggatattctccaaactcttgatctatcttattatcaattcaagtatatcgagagatatcttcatgatgttttctttaactatgatcaaagccacaagaaggtattctttactcctgctaaaatcaacaataaacaagatttgtatacagttaacatatttgagaagataaagagtaacttgaatgaacttaattcattagttaacttaaatgtatctaatcaaataaaatctcaaaataccgttcaagaagaaattgacaataatatgtttttaattcaacaatcaactaataatggccaaattgatcttgaaaatcttattgatgagttcaatattatgaataatccttgtggaagaaatttatctgaaacaactaacacaaatattaataccaataatattaacaactcttcaactccagtaataggaacaattataggatcaagtccttcattacagaatcagaatacattagagactcccttatatagggaagatgtatggggaacttacagaagttatgatcctatttactggtgggttgattttgtcctacaatcaaacaatccttgtatttcaacatattctgaccaaaaggtttaccttcataagaatggcttgagttatatagatgctcccagttgtgttgaattaggagggttatattggttagatccttataagcctataaaacttactagggaagttaaagataaggatagattcaacattaatgcacaaaatttagaagaagacaagaaaaatattgaagatactgattctgtccatcaagaagaccttaaacaagaatctgatacactttttattcatccatatatgatgaatgattttgttgatcataaagattttaattttgttgaagcaaatctggaaagatttcttccaatatataatgaaattattgactctattgctaatcttagattgaagatccagaacagaattatatatgaaaacgagaataatgttagaattactgatattcctttcatttggatgaatgtggtacaaagataccaaattgttaattcttggaacaaattaaagtttttcctggttaatggttataaggacttatatccagcatttcttagacaagctgatgcatctaaaaagatggaatcagatcaaaatcaaaataaagatcttgagataaaacctaaggatgaaaagaagaccaaattatccaaatttgatgctttattagagtctaaagaaaagaacatgcacttaacaaatgtctgttctgtctgttttaactgggaaactgatactttaaaaccatttgttgaatgtgtaagatgtggagtagtttctcatgtagcctgttatggagtcaatattccactaaatgaacttcttgacttttatggttggctttgtgatcgatgtgaatttgagaagaaatttctaggtacccagtatcttatagctttcaatccaggaagtatttcttgtgccttatgttctcattcaggaggagcaatgaaaagaaccaataaggatggaatttgggtccatcttgtatgtgctatttggcacttacctttggttacatgcgaagattggaagaatctgagtaactggaatgtcgatagagttaaaaggagttggacaaacaaaagaataggaaaggaaaacaattcatctcatgtacttagtctcggtaaaaatggtacatctagctctagtattgatatttcagggacagggacagggacagggacaggagcagtagcaggtacgggagcttcaggagttcctgactttggacaaagatccacttcttcagtattttcgaatcatacagattcagggaaactatcgaaactcgagtcaattaactcagattctgggactattgaagatgagggaagaaatttgaccccaattcagaatcaaaatcagaatctatctctacctcaggaagaatcctttgaaaatagctttactggacctcaacccatcttagatttggatcatgaaactcttaacaatggttctccaagatgcgtattttgtagaaatgacaatacttttggacttgttggatgtgatcatgagaattgtatacaacttttccatccaatttgtgcctggcttaacggagtacagattgaggttgactgtgatccatgttattccagaggagaaactttggttggatatattcaaggatggagaaatgttcaggatgaggctctacaacttgttaatatacgttgcttttgtttgtctcatatcaggaacaagggtaatatcactagagatcttgatgaagaggtgaatctacgtaagaaaagatacattaatagagatatgttccctgatttatttagtagcaagtataatcaaaaatctagcagaagctcacaaattggagttattcaacgatctagaactagatctatttctagatcaaagtcttgggatgttacaagtccaaacatgaccaaaaagacttcatgtgagatctttaaacaaaaccaaatatattattgcaatgctctaaaccccgataaatatgacagagatatttgtagtgtctgtcttaaatatgactcaacagattttccttcgaaaagaaaagttcctttggatactaataatggtatagtacgaatatcaagctctgaagaggaatgtcatgattctaactttagcattattttaccagagagaactatatctgataatgaaggagaagaagaagaagaaatacttgcttctaatatattagtgagctgcaaatgctgtggattaactgtacattggagttgctatggattaggagagaaaatggaaagcattaatgactttgcatgtcaggcttgtattaaaggagttagacccgaaaacacatcctgtattctatgtccaagacgaggaggtgcacttattgaggctcagggaatacctcaaaaccacactggaagaccaggagaaaaaactcaatttgtacatattatctgttccttatatactccaggaatctataggcttgcatgtggacaagtttatggagcagcaaattacttaggaatgacatctttggttaaattacaaaaggatggaactataagtaaaaataagggaacatttgtgagaagatttggaggtattgaaggatctgtacaacaatttccttttagagatataagaaacgaggaacagttcatcttggagcaattttcagatcaagacactttagagattccaagcgtatattgttgtatatgtaaaagcagttatggagtaaatttggcctgtaatcatcctggttgtacaagaacagcccatcctctttgtttgaagttatatggatgttatatggaaacaattgctgaaatagatgaacccatacaaatgaatgatatgcttttagatagttcaatttcaggaaaccaaggattatataggaaccaatctaatggaggaacttctaatgtattgtatgtttctccaaattgccaacctccaaatttggataatagtacaataagagggtcagaaataagagagaactatttttctcagaaagttttttgtccagaacatggaaaacaaatgggaaagctaaatcctggtggaaagttattacattcaactttatcatctttgaagattgtaagtaaaatcttaggagatcttggtcattctgagagacttaaaagacaacttttcacaacacaattggatataatgaataaagaaaatccgattttctcacctctaatgataagaaatatcaatgctttaaggatttattgggattactattcaagagggattctacaagagtctgttaagataagaaatggaacaataaacaaattcaaggataaccctaagaatggaattctaataaagcctttaatttctcaaggtgaatcatttatttcaggtaattataagtcgccaaaaaaggttcaacaacaatccaattctgtcttacaatacaatcaaacaactccttattcatcttctggtgctcctattaaagctacaagccttaaaagaacaagatcatcgggagaagctacagaggttccttctctggaagatgcaattaaagaggctagaaaacagagagaaatttataagaaagaattagtggcttcgggaatagttgtaaagaagagaccacctccaaatagaagtccagcaatccctttctctagactgacagatgctgaacttaaggaaagtgctttgaactgtttaagagctataggtagttcgtcaagattagctatgagccttatgactacaggatataacaatagctctgaatctaataacgggcaaatgaacataacagagaacggttctcaattccaatcaaatggagatccatctcaagcttccacattaactactggtgttccaacgattagatctttttgtattaagcagcataggcatgattgcttcagaaggaggcttgcagaattcattatttatcctccaccagtaatggaccacagaagaaaagctttaagaagtcttactcgtcaacttaaacaatatggagtcacagctgaagaactgatggcaagtgatactcctctccctttaatcaagtcaaaaccaccatctcaacatcattttaatcaaggggttatagaacctgttcctagtcactccaatattaattcttcagtagaaaatttcggagtcccagttaacacaagaactacgactactactactattactaaaatgaatacaaacaatatgtcatccattacttttaattccaccatcgatcataacaattcagaattggcagctcaaacaatggttgctactccttcctctactattagctacaataacaataatatgaataatacatttattccagccaatgaaaatgctactgaacaagttcatgatcaagaaaagctatcacatactgtaaatccacaatctgaacacaatttatacttttag

SEQ ID NO: 1836 - DNA, 411 bp, Cryptosporidium hominis
atgaattcaaagatagagagtttgaacaatttagatactgaagttgttctattatctactggaaagaaagttgaagttcaaaaaacaaaagtgaaaaatgaacaagaagaggattctgttgatgataaagaaacttttgagagaatccgtaatgttggaagctgtagttcagcagcagggagtaatttttttcactcttatagaaaaataaaacaaatagaagaagaacggctaaacaaaatggaagaggaatatttagaggagaaggaaaaaagggaatttagcatgcaaagagaatcaagaataatgagttatattgaatctacaagtaagaaatctgaaaagagaaagaaaaaaaagatgcaaaaggttttaaaaaagccaaaaaattcaaataataaaaatgattaa

SEQ ID NO: 1837 - DNA, 609 bp, Cryptosporidium hominis
atgacaatgaatttagagtcaggaaaaatatttgttggtgggctttctcaacaagtaacttcatcaattttgatggaatactttttgcaatttggtgtaatattggatgctgtagtaatgtatgacaatgtaagtggaagaagcagaggttttggattcgtaacttttaaggatccaaaaactgttgagattgttcagaatattaccccgcatataataatgggcaaaattgtggactgcaaaagagcttcacctagaaataccaatttgatgatcaaagagtattttgaagacataacggaaaatgaaaatacaccagaaaattataacaatgcttttacaaagggaattaagaatgttagtaaaatttttgttggtgggcttcctgacctcactttggaagaatttaaaatatattttcaaagatttggaaatattaaggatgcagtactcattactgacaaaaataatggacgtcctagaggtttcggatttgtaacatttgagagtgttgatgcagtaaataacgttaccaaattttatagtaatcattatcttaaagggaagtgggttgagtgtaagagggccttacctagagatgggatataa

SEQ ID NO: 1838 - DNA, 243 bp, Cryptosporidium hominis
atgccggatgtaacaccaagtgattattccatgctatcaaagctgaatgatgaacttgggttttctgaaaaattaactttaatattttatccttttacatataaaatcaagtacaaacagactttgaagcatgtttctgaggcaacaatgtgcagacttttattaccagaaatgatagataaaagaattgataagattttatatgtagatactgatgcaattataaaccattcattaaggtaa

SEQ ID NO: 1839 - DNA, 981 bp, Cryptosporidium hominis
atgatacctccaattaaacccaaatatattttcctactcaagtacaaacataacaataatttggataatgaaacttcattaataccagaaataatactcaaaagtaaaaaatgtagatttatgatacatatacttgctattaattataaaggaaagcataaagaacaatttgaaaaacaaataaaaagctatattaaagatgatttttggattaattataatttcttaaatgattcaagtgataaatttaaagatccagaagaattaatgagccaatatgcattatttaaaactccacaaatatttcatgaatatgtagataaaactttcttggcaatcaacaaaattccgaatagtcattatttatgtaaaacagaagaaatatcattgaaggcatataatactggagaatcatataactataatgataacaatatcttttggatggatttaggaatagatttgggactaaataatggttttaacattaataattcatttaatcaacaaataaaaactagtggtatgacaactgctagtactagtacaacatattcaagtactgatacttttgattcagaaaataatcatattaatggtagaattgtcacaaataataacttttttgatccgatatcagggattaatacaaggaataaatttttatggtgcattgaaatattacatcaattctattatttaaatttagaccttttgagaatggaaaaaaaacgtattgaaaaaagtgttaagaacgataatattagctcccaggaaatttttaattctgaatgctataaaattcctccaatattcaatgaacaagctgaaggagtagaaatggaaactgatccagaaacggatgtagataataatactgaccacgcggaactcgatgatgaagatagttttaataatgaagtcaatcataatgatcatgtaaatggcaacattcacattcaaaataaattttatttctaa

SEQ ID NO: 1840 - DNA, 666 bp, Cryptosporidium hominis
atgtcaatcagatttatatttaataataactctaaaaagttagttaacaaattttgtagattattctcagggatgccgtttgaattgccacctcttccatatgacaagaaggctttactgcctgttatttcacctgagacattagactatcatcatggcaagcatcatgcaggatatgttacaaagttgaattcattaataaaatccacagaatttgaaaatgaaacagacttgatgaaagtaataatgaagagttctggtccaatctacaacaatgcatcccagatttggaatcatacgttctactggagctgtttaaggtctccatcagaaactaataagccaacttcaaaggtttcaaagttgattgaagagtcttttggaagttttgagtcattcaaggagtcatttaccgctaatgcaactggtcattttggatcaggttggatttgggtagttattgacccaattaacaatcaaaaacttaaaattgtccaaactcacgatggtgacaatcctgagaagcttggacttggaaaaccagttctgacctgtgatgtatgggaacatgcctattacatagattacaggaacaatagaggttcttatgtcgatcaattcttcagtattatcaactgggactttgtggaatcaaatttaagttga

SEQ ID NO: 1841 - DNA, 840 bp, Cryptosporidium hominis
atggaagaaagtaaaaagaattcgtctagagtcatagtaaactctggttcagctgtaggaatcaagtataaagatggcattatgttaatttcaagccctttattatgttatggatcaatgaagatgaattctgatatttcaaggttccatgtaattggatcaggaatgattgatttatatgatgaaagacaaaaacttaaaagcaaagatgaggatatgagttccgttaatactgataaaagaccattggtcagaaaattgacagaagtagatgaagatgcaaaagtaagattttatgaaggaaagctttcagtaatagtatcaactggggaatttagtgattttcaaaacattattgagagagttgaagaaaaagcagctgaagacttttttgaagggaatttcaaatctgccaaggagtatagtggatatatttcagcagttcactatcaaagaagaaataagatggatcctttattgaatgatataatagttgcaggactgcgaaaagatggaagtaaagaaatttattcagtggatccattaggtactagatttgatgaagactttattgctagtggaatggctgagtatcttgcaattacattacttagagataaatataagccagatatgagctttgatgaagcaaaattgatcttggaagattgcatgaaaaactcattttatattgaatgcaaaggagctagaatggttcagattgccacaattaatcaagatggtaccagaatttacccaaagtatcctcttgatgttacttggaggcatgatctttttgtcaaatccaacttggatagaaaggactatgttggattctaa

SEQ ID NO: 1842 - DNA, 1101 bp, Cryptosporidium hominis
atgcacacattagtatcttgtgaaaatttcgaagaacttataaacccattaaagaaacaagtttttgagcaagtgagttttccaaatactatttgggaatctttaacaatagaagaggaaaaagaatataaagagatttacgataatataattctagagaagcaagtagaatataatataataatacgagaatttgaagaatctttggcaaattataaggtagaacaaggagaattagacacaatattaagaagtttatctaattcaattgataaattgggggttttaaacaaagaaaatcaaattcaggaaatattaggaggaaaaggtattgtcgaattttctaagttgaatagaaaccttgaatttggcaaaaaattgttagaaaaagagttattaataaacaaaaattctattgaaaattcagacaatgagatatttactaatctaaggcaacctgtggataatttagtactaaaagttactaatataagtagtaatacagaaaaatatcttaaagccttacaactattgaatgtatatagagaaagaagtcacgaaatttataatttagaacaactcatttcaaaaaatacagtttcaatgggtttattggtaagtagttggacatatatattaagtgaaattgaaacacttattaaagatcaactacaacctcttattgatgtaaagaatgacaagttaacttcaggtcatgacatcttgaaaaagctggaacttattaattctataatagataatacaattttgataaaatatggaaatttagaaaatgagaaaattgatgaaaaaggtggaaatgaaagtttaatcaaggaaattaaaattaagaatttagatatggaaaaaatttcaatcactgatcaattaattaagtggagacttgaattaattccatctattttgaacatatttcaaagtccactatctaaattattgatagaaatcaataagtatatgatgaatgccaacttgttagatggatttgatcaaatcaacgaaaggattcaagaaacaaatgaagcctatagtgaattaaatcaaattaaatcaaaattgactcaatttggcttagtttaa

SEQ ID NO: 1843 - DNA, 2052 bp, Cryptosporidium hominis
atggggaacattacttcaaacgttttttatcaacatgatgattttatttactcctgcccaatagaaggaacaggagattcaaattcaactgaaataagacgttgtaaagaaacggttaactctgaactcacttcaaattttcatgaaaagttggaaaattgctggggaatccttcttcacggaaaagaagctagcaataatggtgactatatgggtattagggtgccattagaaaatggagaattgagtgactataagtttgtaaaatattcctacgtaataagaaaagcaaaagaagtgggaagtgccttacttcatattggagcagtccaggagagaagttttgaagattgtaatataaaattgaaatgtgttgcgttgtttgcaaagaactctctgaactggtcaattactgagcaagcttgtaatgcatatggaatttcaacaattcctctttatgatgtgcttggaaataatggattgacttatattttgaattcaacattaccaaagacagttttctgctcggttagttgttgtaagaagctaattccattacttgaatcaatgaagagtgttaagtttttaattatgttggataatgagtcaaagctaatacaagaaagtgctactgattatataaaagaaaatgttacaattatggattttgatgaacttataaaaatcggcaaaagtaacttgagagagatttcacctggtaatttggaatcaatccactcgatccattacacatcaggcacaactggtaatccaaaaggagcagttttaactcatagagcttggatttcttgtgctgctgcttttatatatggacaattggggcgtgaaggtacaaaacttggctctaatgatagacatattagttatcttccgcttgcacatatttttgaaagaattgttcatatggttataacttatttgggtggtaagataggtttttatagtggtgatgtccagaaaattgttgatgatatccaactatttaaaccaacgatttttattacagttcctagagttttgaatagaatccacgataaagttatgatgagtattgaagaaaagccaaaaccattacagatgcttttccactttgctcttaaacagaaagaaaaaagtaattctcctttccattttatttgggattcaattatcttcaataagaccaagaaaatccttggaggcaatgttaaagcaattttgagtggagctgctccattagatgagacagttttgaccagattaaggtgtttttcttgttcttattgttttgaaggatatggtatgaccgaacttctcgctgcttctatgtctgaaatcaacgataactccaaaaatattattggtggcccccctggatgttacgaatttaaacttgtttcaatccctgagatggattacagtgttaaaaatgatcctcctactggagaattacttatgagaggcccctcttcctttaatgggtattttagaaatgaagaagaaaccaaggctgtaaagtgtgaaaaggaaggttggataaggactggagatatttgtcagcttctccctaatggctctattcgaatagtcgatagaagaaagaatatattcaagctttctcaaggagagtatgtagctcccgaaaaacttgagaacatatttgtgatttgctgtgaactaatatcccaggcgcttgttattggcagatcaactgaaagtttcttggttgcaatttttgttctggatgaagaatttaccatgaaatatgtaagagccaatcaattaggagatgatttgaaattcaaagacgctgtcacccaccctaaaattattgagaaaatcaaattagacattgaaaaggctgaattgcaacacaaaattctcggttatgaaaaaattagagcattcaaatgtatatctacaccattctctgtcgaaaacgaacttcttaccccaactttcaaagttgttaggcacaaagccatcaagttctatgaggactcgattaatgaaatgtacaagaatggctactcaaaacctaagaatgaatga

SEQ ID NO: 1844 - DNA, 1005 bp, Cryptosporidium hominis
atgttgttaatatattccaatggggatatatgtatagagactgagttaaactcaaaagaaaaaaaatttgaacttaaagaccatcaaagctactataatatattagaagaagttggaatagtttattttagggaaaaagatcaaagcaaatttgttggaaaggtatcgaaagtaggccgtaaaggaaaagggataatggtagaattagatggaagtatgtatgaatctgagtataaagctggggagtttagtagggggtatttcttaggaaggtatgaaataccaaaaatagatgaaaacttgtttaaaacaaaaactattataaatattgacaggaagtttaatgaaaagagaaagatattagggaattcaagaatggaaaagtattacgatataaacccagaattagagtatttcaaaaataatcaattacatgatcgagaaaaatttgataatttattgaaggatttattaaaaaattgggaattagatgattattttgagctcattcgtaagaaattaacattagatgatttgctactttcttccaatcttttatcagctaatggtattgctagagcacttggagttaataaagttggtcatagaattaagctaagcaattgtattaaacaatttagattagtttttggaccattgttcctacctagacaatttattaaatatccaactgaatctgaaatcactaaaaaaagttttcttccacctttattcatatcaagacctttaaatctatatagttattctgggattaatatcccttttgaacagttgatctttgtccaaaagttagaaaggacagattttccatgcaaatgtagtaaaggaggtaagttctttcaatttaaatgttatataaagattttgaataatagtaattcacactatttacagttttttccagtagttcctgctgttatcttggaaaatggcttggaaaggatgttgttattaaagtctttagagggaagatattacaattaa

SEQ ID NO: 1845 - DNA, 1335 bp, Cryptosporidium hominis
atgtataattgtgtatggaaagattctgattcaaaatccataaaaatgaatttcccaccatattattataatttaaaagatacaattaataacaattcagaaaaagttagtcatgatgagattaagatgaatcctgaattcacttattatataccaaatttaaattttaatccaaattttgaaactgattttgaaatgaatactggatcagagctaaataatatctcggatttaagcatgtccagtttaaatctaattctaagtccaaattccagaagtcaaaatccatcattttggccagaaattccagaatataatttatcttttggaattcatactcaaagtgctatcaaaattgctaaaggaatagctacaggatgtttgtatttaaaacaaagaggtatatttcatctaaatttaaaacctactaatatattaattgaggaagatttatcagttaagcttgcagactttggacattgtttactggaagcttctttttatccaaatgatagtatttacttggatatactaggaaataagaaagttacaactaatactgactctaattcaagtttggattttccaaatctaaattgttcttccattgaaaatgaattttcatttttaaatcaggtttccagctcccctagactttcagatgatagaatcctgaactatttacctccagaagttcttaaaaccaattctcctctactagagccggcaagactatatctagagaataagtttgaacactgtcaatcaattgattcttattctataggagcaattctttgggaaatgattaatgggcaacctccttttggtggacttgggaatctccaagttcaagcttatgttggttattctggcgccacattagatcttaatcctgttaaagactcacttttgtttagcaatatatctctcatccaaggtcttgtttcaagatgttgtgggttttcaaaattatcacatattcttcattttaaggagattattggacattcaaaaaaacgattaatgacatcttctattcaatttccacaatcttgttcttcctcttcttcatcatcttcatcttcccaatctttatcttcatctttccatccaacatcctcttccacacttattgttcaaaataatacaaatatagaattacaagtaaataaagttagttgggagaattcctatccaaaaaggattagtattgtacagatattgaaagagctaaaagcaatagaaagaatggtaagttcaaaaggagtaacatccagtagcagaatttcacctaccctaaattcttcttcaacaaactattaccatctctag

SEQ ID NO: 1846 - DNA, 348 bp, Cryptosporidium hominis
atggccccaaaaatgtcttcaaagaacaataaaggtgcagctccaaagaagatccacaagaagaagaaggagagttactctacatatatctacaaggtattaaagcaagttcatccagaaaccggaatcagtaaaaagtctatgatgattatgaacagttatatctctgacaccttcgagaaaatcgctcagcaagctgctcagctttgccaaactaccaagaaggatactatcgcatccagagaaatccaaactgcagtcagacttgttttaccaggtgaactcgcaaagcatgcagtttctgagggtactaaggctgttaccaagttcactggaggacaaaagtaa

SEQ ID NO: 1847 - DNA, 1131 bp, Cryptosporidium hominis
atgagtgaagaagaaacacaagcattggttgttgataatggttctggtatggtcaaggcaggtgttgcaggtgatgacgctccaagatgtgttttcccatcgatcgttggtcgcccgaaaatgccaggtgttatggtaggtatggaccaaaaggactgttatgttggtgatgaagctcaatcaaagagaggtattttgaccttgaaatacccaattgagcatggtattgttacaaactgggaagatatggagaagatctggcatcatactttctataatgaattacgtgttgctccagaggaacacccagtgttattgaccgaagcaccaatgaacccaaaggtaaatcgtgaaagaatgactcaaatcatgtttgaaacattcaatgtaccagcaatgtatgttaatattcaggctgtcttatcattgtatgcctctggtcgtacaactggtattgttttagatagtggtgatggtgtatcacatactgttccaatctatgaaggttatgctcttccacatgctattatgagattggatctagctggacgtgatttaactgatttcttgatgaagattctccacgaccgtggttacagctttacaacaacagccgagagagaaattgtaagagatattaaggaaaagctctgctacattgctttagattacgaggaagaaatgaagaaatctcaagaatcttctgaattagagaagacatatgaactaccagatggccatgtaattactgtaggtagtgaaagattcagatgccctgaggctttattccaaccaggtcttttaggtaaagaagctgtcggtattggtgaaactacattccaatccatcatgaaatgtgatcttgatatccgtaaagacctttatgccaatattgttttatctggaggtacaacgatgtatccaggtattggagaaagaatgacaaaagagctcacttctttggctccatcaacaatgaagatcaaggttgttgcacctcctgagcgtaaatactctgtatggattggtggttctatcttatcttctttatctactttccaacaaatgtggatcactaaggaagagtatgacgaatctggtccatcaattgtacacagaaagtgcttctaa

SEQ ID NO: 1848 - DNA, 1050 bp, Cryptosporidium hominis
atgagtgatagggaggagcttgagttggataaaaatgtaaacagaatgcgactagaactagaggaggctctagatattctaacatgccatgaaaatgaggagataagcagtaatagagaaggggaatgttgcattctggactcttatccactaagtatgactctaataagatgtgaaaacgataaagaaaagctaggactgatatttcaactgaatgaattttcaagaatggtaaaagggagttattggatggttttggaagataataaggatccaagaaatctatgtatgcttgaattttttaattatagtgatggtgtttttagaaataagatgtttgaagtaattgtggacaagaatgagagagagattttacagaattacttttctcactcaaactcaattttgaatatgaatgggggaaataagagcgaaattagcaatgaaaagtggatgatgacaaccttaaagaggagaagagatatagagaattcacgaaataacttgggattggcattttgcaatacatttttaaaagaaagtaatgagaagattcgaagttttgatttgtcttctttagcttttatggtgaagtttagtgaagttagcaatatttcagaacttataaataatgttgagactttatatgaagatttttggttaaataagatggaagaatcattcctaactgtttttagttttagcattgagaatagattggacggacaagcaagatttgaggatgaattgaagaaattatcattatcaaaccctaagaaagatgcttatatgattcacatatttacaagtccaacagattatgcaatggtaacaagtacttataattggagcagttacatttcaaccttaaaagatttggctcttggggaagctaggacggagtttatgacacagaagttgatttataattcactagagaattttgagaatttaaatattttcagaacagaagactctgagagagacctagagattaaagaaaatatgatgggatgggaggggaaaacttggatggcaaatcaacgatag

SEQ ID NO: 1849 - DNA, 2253 bp, Cryptosporidium hominis
atggtggattatgattctagaatttgtcaaagacctcattctgaaagagctttagaacaatatgaaaagtacccagatgaatatatagaaagtgcaacagtaagaccagaaaagtatcatgttttagagcaagaagaatatgatgattgtattatcacaaaatttcaccaaattattaatagcgactatttagacgtggaaagggagttgataaatggaaagttaatgaatagtgagaattatgaaagcagagtatttaataaatatggattatctgctgaccaaaaaggaggggatctgagagaaaaagattataatgaaacaggagaagagaattctgatgatgagttagacgatggtcttgaagaatgtgaggacgaaacagaatctgaagaattggattctgaagacgaaatatatgaagataatagtcgtgaattattgatgttattaaagagcagaggaaaatcgagacgtattcaaaagagagaaatactaagtttaccaagctccgaatttttagtaataagggaatttccggtatcttttggaattccagtaatcacattacaaaaattgaatgtacgtccaattctatttctttggatattctttttaatttcaatggtttatactttttcaatatttctagatgagtatattgttaatgatattattccattataccctttgggaagtatttttgagtcaaagaatgaacaaactgaagtattagttccttcattactaagatcaaagaatccaacagtgatatcaagaactggtaacagtgatatgggattaataggtaaaagtaacttattaaagaagctttttcctttactcaatattaaacaagactctgatatttttgaaaattcaataaatagaccactaaatgtaactttggatgttaagcattgccatattcaattccttaattcaactagcgatctgagttatattaaagttagatcttggagattattttccaaatcacatatgtactatggtagttctggaaggtacagtataccatctaggaagaaagataagttcgaatatatatgctctcacggaactttcttctggatattgaaaagatatattcttccttgggatacttatagtgattataatataaagaatatttcttggaaggattataaagaatactgtgattcaagtcctagaccttggaattttaataatgattcaaatttgtcaataaaattacaccaatctaatactggtgattattttcaatgctcaataaactttttcttggcaaataacttccagtttgacgaactttctgtcaagtttgtgccatcttcaacatatatgaaagtttcatcatcgattccgatcaaggctaaatcaatatttcacttggaagcattacatgggacttttgatttaaaagatgtatattcaccaaatatttcactcacaatttcagacggttgggcttctattgatctcccaaatcttcaagattcaggtcgtaggaatgtgtttatagaaagtagaggagctccaatatatattaatagtagaacaccaattgttgttactatgccagtcagaattgcagaattagcagtttttagagctgagcatgttaaagtcaagcttgaaagcaaatcaaatgatttagatggccatgggtattataaaactgcatcagttgttgcaactctgaatccagatccgtcattcttggataataaactttcaggttcttcaattaatacaagaattaacattcaaggaagtattccaccagtatatgtaaatgcttattcaaactttgaatcaagttcagattttaataacatatcggatgaacttattacttgggcaggaagacaccaatggaaagatccacatttacttgcattttcaaagtcaagatttaatgggttttcaaaatggcttcaagaggatcttgcaagtccatgggtactttatattaatgttttaggaaatagagaatatcctaggggaacttggaaagcagtatcttcaagagcttttattcgagatccatatgctttggttttattatcaggaggacttttaatgccaaggatatacactctatttattcatattcttggattaaggtgtatggttccagtaagtcattcagatttggaagatctagatgtaatcaatgttgatgataatccttctaatacaggtaatattaatggaggaattagtgggaatttatgcaaatataactaa

SEQ ID NO: 1850 - DNA, 207 bp, Cryptosporidium hominis
  misc_feature (36)..(36): n is a, c, g, or t
  misc_feature (41)..(41): n is a, c, g, or t
  misc_feature (56)..(56): n is a, c, g, or t
  misc_feature (59)..(59): n is a, c, g, or t
  misc_feature (62)..(62): n is a, c, g, or t
  misc_feature (67)..(67): n is a, c, g, or t
atggatgaggatggatttttgaatagggaagagttnctatnctttttttttttctnacnctntgatngatttttgtttaatggattattttctctttcccaagaaattattgattatttcaattctatcctgtccccaaaagtagcccccccccacggcaccccccgcggaacacaaaataagattgcattcattgtacgcctgtga

SEQ ID NO: 1851 - DNA, 366 bp, Cryptosporidium hominis
atgaatgaaggagcaaaccaaacaatgaataatagtaatggcagtgatattaatacgggaataaataagtctcaaaaaaaattatttaatattaaaaattcatcaaatgaatctgataataacttgggaagtttaggaaaagctggaggtggaactggaattgaaatagatatgcttgcaaaggagttattaaagaataataataatagggaagatttggtgatgccatatggaggacagttagttcagatgaatagaaagactttcacaatttattgtataataagtgaattggatgagaaagttgttttcaagactagagtaactttccaaattgttccaagaacgagaactcaaaagagttag

SEQ ID NO: 1852 - DNA, 1185 bp, Cryptosporidium hominis
atgtacaaaaatgaagaaaaagaaagtcaaaatagttatcatggaaatggtgaaagtttgaattctgattcttatattttaaaaagtaacgaaattgaaacaataagatctttaataaaaggaaaaagaaaagaattaattttagaagaaaatgataaaaataatcaaataagaccttcaaagatgaaaagaaaggaaactcataaaaatgatcttaaaaatggttctattgaggaaataacaaaaccaaaaatacgagattactttacatgtatgttatttattacattgaaattacaagatatttttacaaagaaaaattcggaaataataattggagagttaaattttaatgaactatttatcaaattttcattaaatattttaactgaggtatataaaaaatactattacaaagcagaaatttcttctgaaaaacctaaaatatatccaacttttgattttcaggaaattaagaaaaatccaaatggacaaaagatatataacaatatttgctctaattctaactttgaccttattgttagtgatacaaactatcaagtaaatcaaagagttggattacatttaagcttaacaagaaatcatcatattagtaagaaattatcaatcaaatttttggaaaatattatcaaaaaattcaataattgtttggatattaataatgaaattccagaaaaagcctttatatcacaaagaattgaaattcaaactaaattaaaatccttttgtattcttttagactatgattctgttattattttgaaaaatacatgcctatattccaaaaataccaatattaatggtggtatttttgtagcaattcaaattcatcattcaagcaaaattaattacttgaatcctattattgaaattattgatcaagcttgtattgatttgggtatacaaccactttattctgaaagagtttttcatatttcattattttatattaaaaaatctgatctatatttgggaaatgctgatcataattccaaaagtgtaattgaaacttacaactttaaagaatatctttcatctaaactcatatcttcttcttctattaatgatttctcaaccctaaccacaaaaaataatatcatttggattaataaacttgtattcagagttggaatatatgagtactatttacttcttgattcttga

SEQ ID NO: 1853 - DNA, 2430 bp, Cryptosporidium hominis
atgtcactaatagataggtcaaaaataatattacaggaggttattctccgtgaagatcagattaggttgtgtattaaagataataattatcaatttggaactaatttaaaagatgcaataaaacaattagaagaaatattatctattttggatagtaaccaattacaaaattcagatttaatttcaagaatcccaatacttttaagaagaatggtattatactcagaaattggagatattgttttggaaagatttcctgtaattatttttggtttaattgaagatatttttaaagaaggtattgaatataaagaacatggtatgcttgaaacattttatgtaagtagatatttatatttggttgtttcattattggacttaccatattttgttgacagtttttctttattttggtgtaaagaacaagaaagaaagaaagaattatcattattattggataatattattgaattattaacaaaattacatgaaatcaaagaaattaataaagaagaagttttaaataaagtaagagatttggttacattaaacttattatgggaaagagttattccaattagagattatttaaagtcaaatcataaactgtatgaaattattgaaaaatttatgttaaatcttcaaaattataagaaattaaataaaactatcaaatatttatttttaagactttattcaaatgttgttcaattgggggaaggtaaaattcaactttatcgtgaaaatcatgtagaaaatctatttatttcaattcaaattaatcaggaatatgctattcatgatgaaattgatttatatttacaatattttatttttaaaaggccttatttaagtgcttttagcttggtttttagcaaatctcaaatggatatggtgaataaaagtttaaataatgatattcaaattattaaaaaaatacaaaatcaaacagacttaaatgatcgagaacagcttaataaaaataaagatacaaatcaaattacagttatggatatttatgattcagaaataattaataatttaaaagaattggtactttcaagtattttcacaagaacttcgttaatatttcttgaaaatattaataatggaatgcaaatttattttcatctaattaaccaaattaaattaaactattttcaacacaaacaccattttaaaattgttagattatatcttgataatactattgatagtaaatctttacttggtaattggattgttggagatcaacctggtgaatttaaatgggaatatggaattttatcattatgtcttattaatggtgattggttacttattgaaaacattcaagattcaccaaaagatgttattattaaattgaatgaaatttctgaaaaaatttcttatcctcttgttaatggatttaatattaatcaatcaagaattcaagaaactcattattttgaattaagtgaatttaatcgaaaaattaaaattcatccaaatttccgtatattttctagttgtatatatacaaaacaaaataattattggaataatcatcaacataattctaataatgagaattatgaaaaagttgatatcattaatcctagtgaatatattaataatgatattttaaaattattaaacaatgataaatggaatatttgtactattcctacaccaacaaacaaagaattaagaaaaggaatagaaatcaattataagaatttatctccaattaaagaagaattattggaatctttttctaatattgtaaattttatgaataaccctaatagtttttctggaacaaatattacaaaatctttaaatataagaacaccatcatgtaatgatttttttaaaggttgtgaaagcatttcaaagcaatatttttcttctcaagataaagattataaaaattcaacatttttaaatgaaaaacttagaatgaagatttcaatactttttgcaagtgttttacttgatcatatttcacttcaaaaatatagaaacaaatgtcaaattgaaatttccaaatcttttggaattaatacgagtgaatcagaatattatcttaaaaatggaaaatttgatatacattttattaaaaatggagaacaatccagaaatccttcaactattaatattgttaacaaagaactcaatattgatattaatattaatttacttagagctgggcttaaaaattcgatggatccttcttcatccagattagttctaaaaacaaattatcaggatgattataaatatcttaattatacttttacaagtatacattcaagaatattatttaaaatcattatgtctatatataataatgaaaatattctattagttggtgatactggtactggtaaaactactattattcaacattacattatatgttatatggtactaataaaaactacataa

SEQ ID NO: 1854 - DNA, 1425 bp, Cryptosporidium hominis
atgtccaagagtaaatatgaggaggaatgggaggagaagtttgcaaaaaatattgaaggtagcaagattagtagagatatcagtgatattctttatgatattgaaaaaagttgtttaaagcctttaatatactttttaaagtcaatcccttctgggtttgctccacttccacttccctctctggaagctatattggagcatagtgaaaacgaatatgtttcatcttcttttggagttgagagaagtatagaaagtgaaattcgaaacttagggactaatttctggttcgatatggttatgagtaatggatctgggccattcaattctaagcaaattaattctccaaatgtatttaatcattgcttagttaatcagcttaaacgtgtctctcgtaatgatgattcaaaggcaagtgatgaagataaagaacatggttgcgaaaatagcacttctaataatcataatgatgatgatataaatcagagaagtaatcaagttaatcaagaagatgaaaattcacaatataagagtaaaaactttcagattgtgatttctcttcaacaaatgttgcatatttatagaattggaggtattaataatgaaaatgtttggacagctttatttggagcacaaataatggatcatcaaagtaataaagtagttattaaatatattatgccttcatttctttcaaatcagattctaatggatgcatatacaaacattatacaggtttcagagcctcagaataattcaatgcagatttatatgtattgtagaaatattttaaaacatttttgtactgatattattactcccagaatacttatacatgcaaatatattcttattatggaatagtacattgaaagattttttcaataataaaacatatgataaatttctctctgatatatttaatacgacttcagataattcaccaaaagattcaaataactcaagtaataatcatagaagctcttctgatagtgtcttttctttatattctggcttattaggtggaacattaccaagcttgcttttactcaaagtaattgaggaggaatttgcaaagtttagtgtacttactcattttttgattcgaatctttggttatttagacagaaatagctgtcatgtattttcaaattcaccagatctaaatattacagctttattgtacttttataagtgtgtattctttccattatcatcatcatttacggcagctttattaaatataattacagttgaaagagatttttttgtacaagcttgtcttagaagtttattttctccaaaaatgagtgacaaaaatgtatttgattgtattaaaagaattgaggatagtgagaaggagataatagaaatggatgaagttgatgatgttgaggagattatatcaggatcttttggaggaatgtga

SEQ ID NO: 1855 - DNA, 486 bp, Cryptosporidium hominis
atggcttgtattagaagagccacaatagatgatgtgttcacaatacaacagaacaatttgtactgtctgccagagaactaccaaattaagtattattattatcattcaatgacttggccacaacttttggatatagcaaccgattcaaatgactcaaacaagtctgtagggtatgttcttggcaagattgaagatgattcaaatcccttacatggtcatattacttcaatagcagttttaagaacacatagaggatttgggttggcaaagaagctacttacacaaaatcatcatggtatgcagagcatatataatgctccatactgcagtttgcatgtaaggatttcaaattatactgcaaagaatttgtatcaaaaggcattaaattacaaggtagatagtatagaaaccaagtattatgctgataaagaagatgcatattttatgaagctttactttcaaggttctcaagttaaagtctcatga

SEQ ID NO: 1856 - DNA, 258 bp, Cryptosporidium hominis
atgactttccaccaactaattgattcaaagactattccacaatcaaagaatgttgatagtaataccttcactggtgtcagcagaaatgatgagaatgaaagtagaaatctgaatattaatctgttagatgaaaacattgaaaatcctaatagcagcctttcagatgatcagttcagtcaaatctcaatcttaactcaaaatgatacaaaaaaagatatttcagataactcgaatattaatggtaatgaggaaatttaa

SEQ ID NO: 1857 - DNA, 513 bp, Cryptosporidium hominis
atgaagttaataatagttcttttatttctggtaagttttaaagacttcattcatttacatattaatatcattcctcttttcaaagaaatattccaagctcccaagttttcactgagaaatactccaaaaggagtagtatgccaaaacgacgatgttgcctgtaaaacttatgtatatgattgtagcgataccagattagtttgccatatggaagatatgatttggttattccagacttttccaaataaattgaatgataatgttgatcgagtttttatcaatgagcagaatttagctttaacatttttctctcaattaatcaaaaagtctttgggagaaactgagactctatcaaagaaacaacaacaaatcttcagaaagtcgtctttctctgaatcttttgatatttcttcagatgttaattcttgggattcattttctgatggaggtaagtccaaattaatattatctttttttccccataaaagaaaaaatcttacaatttgtacttaa

SEQ ID NO: 1858 - DNA, 1722 bp, Cryptosporidium hominis
atgaaaaaaaattatcattttaaaataataacgaatttgttgttaatattatttttatataagattgaagtttttgaatctgttgaaattgaaggcatacaactaataggaaagaaaaataatggaattacatcattctataatatcagatatggtgtagcaaatcgttttcaaccacccaaattattatcaattactgaagctgtaattatggacgaggatagaacatccaaaattccaaaaagctatgatttatcaacaaataaaggctcatcatgtcctcaagactgctcagatactcagcaaacaagtcaaaaaacttttctatgtagaggaactgagcctgaaactcaatctgaggcttgcttaactttgagtgtatttacagcaactaatcagattgaggaaatattgagccagttttctactgttgcaaaacatgtttcttcaaataatactcaaattaatatgctttcaaatgtaaataatactctcatgaataatcttaataaacaaaaatcaaccatatcttcaattgtacaagctaatatgtcatctttaaagcctgtctacgtttttattcatggtggattatacctatttggatcttccaattctgaaactaactttggagaaaagcttgcagaatctggagctgtaattgttactatcaattatagacttggaattcttggatggttaagaacaaaaaatctttcatctggaaatatgggatttcttgaccaaagaatagctttagaatggattcacaaatacattgtaaatttcggaggtgatcctaatcgaattattcttgcaggacatagtgcaggagctaaatcagtattgtgccattcagttactgaggaaagtaataagtatttctcaggtgtaatcatccactctggagccctctctcaaaatgaaactgcacttaaagaggcagaaaatatgggtgaaatggctgaagccattgcatctgaaaagtgtcttgcaactatattaagctgtacaactaagcaattattggaaattcaaaaagaggttagagcacaaattgttcgatcaaatccatctaaagctcttcattcttggtctccaattgttgatggagttattatcaaggactcttgtagaaatctggcattatctggatctattcctaaaaatatcaatgtaattatcagtacaaccaattcagaaggtgttcaattctttagatcatttattgcttatttaccagcaatttcaagaggtcttgctactagtaattttgcttttaggtacctagtgtcaagagtatttggcccaaaagcaggagaagctatgaaaatatatagtaataataattttgcaaattctgcatcaatagcttcagatcatgaaatatctgatccaaattatgatttgcaaaataatactaatattaatcatgataattcttcctatgttaataatgaaacaatgtccaatcctattgaaattcaaaaagaagataatgaaactatgactgggttcaaagctgatgatattaaatatgcagataaagaaaataatcagattgtttctagttctggatttaatttgttccaggttggaagaaatagagatgaagaaaagtggaatggtataattgatgatcctgtggctttagcatatgcaagaatgattggggactttatatatagtgtaagtttttttattaaacaatattttatttaa

SEQ ID NO: 1859 - DNA, 933 bp, Cryptosporidium hominis
atggagggtgagccaattcattcaaaaataagagaattaacaagagcaattgagaaaaatcaagaccttctaagcgatccacaaaaaagatcagaatacaaagaatacgtattaaaagatgatgagttttttgaaaatattggtgagtctgattatcggtcattttcactactttgtgaatttggatcagtaaaggcacttgtaaatgaaaaaagatataacaagatatataaacaatctcaaaactcattgttaagaaacatattaaaaaattggaaagataaatatatgaataaaaagcatcggcaaaatgatatatctgaggagaattctgactttcctacagaaaatgatgatgatgaatttgtcaaattgaattggagtggatggttttatgatcattatacaataaacgttttcccaattaacaatattaaatttaacacattacaaggtttactcagtcaagaaacccatagcgaaccacctgcaaaaagggttagagttgttaataataggactaaaaatacattatcgaaagaaacaaaaaccttagaagatgaagatgttcatgatacacaaaatattcaaatattacaggaattcaaaaataagttattgaataaaatacaagaaaaagatataaataatgaaggtattgaattatgggaacttgttttagaaaaagatcaacaatatggttttgcaaatacatgttttaatttattttcactattatctttactaaaagattcccttatttcaattacttctccaaatactgtcattaagaatactacaagtaaagacaagaaggttttggtttttttggccaattcaagtatttcttctgattttgagaaaaatactggaattatctccaattttacatatcatgcttggcaaaatctatgcaaaagatatggtaattaa

SEQ ID NO: 1860 - DNA, 621 bp, Cryptosporidium hominis
atgcatgcaagaagattaaatagcacaaaacttgaggaaataacatatcttccggaggaagaagatattctaatttggcattcaaagggtttagaaagtaaagaaaaaagtaatttagaacaacgacatcctaataaagccaaaaagagttccaataatttaaaactgcaaacaaaattgatttcttccccagatactgaaaaacaaaccaaactggtaaataaattccatacaattccggaggactcaaaaactaatgtttttgatcgtcttctagatccaaagctttacactggaatgcataaatatagatttgataaagatggaaatggactaggaaaagcaggtagagaatatttatttagggaggatggatatactgaaagcacaaaaagaaagcacgaagttgttagctcctcaattaagagacattcatatgcaaatatttccagtaatgacttcttacaaaaagctaaagttatttggctttataaaaatggagataaatatgataaaggaacaatttattatgttaaaccatatattagaaatatgacccaactacttaatgaaattaatagggtaagttcaattattaattcttttattattttgcattaa

SEQ ID NO: 1861 - DNA, 603 bp, Cryptosporidium hominis
atgaaaggaaagtgtatcaagaagaacgattcaccactcacccaattggaaaaggatgttgagagatgcttccaagacatcgaatcatcaagcaatgacgaggagttgaaagcgatcgttcaatcagtagttttctcaactgcaaaggaaattgattgtggttcaagaaaggcagttgcagtatttgttccatatgcaattttcatggcatatgtacgtaagattcaaggacgtatcattgctgaattagagaagaaactcaaatgcccagttgttatgattggtcaaagatcaatcttaccaagaaactatcgtaaatatggtttcaagtcaagaccaagatcaagaacacttacagctgtacatgatgcattattggaagatatctgtggtccaagtgatattgttggaaaacgtcttagataccgtgttgatggaagtactttattaaaggtaatccttgaccctaaagataaggataaggatatcgccgataaagttgatgtttttggtgcagtttacaagagacttaccaacaaagaagctgaattctccttcccagctacaaactactatccaggtagattaggaattatagcttaa

SEQ ID NO: 1862 - DNA, 342 bp, Cryptosporidium hominis
atgagtaatactgtgaaaactgtaactacaataaatgaacaagtaattgaagtagtatcaaatttggaaacaaataaaatttcagaaaaactagaggatatatccactaaagttaatcaactattaacaggttatataagtaaagaaaatgatgaatcaagtgtaagtagccaagatgaatacgaaggtcaaacaagtgaagaaacaagccctaataagtgtttgaacgccaaatgcaaaaacgcaaacgacaatgaaagtgaaaaagagtcaaattcagtagataattcagaaacatctagtagaggcaaaaggcataaaaaagatactagtgataaataa

SEQ ID NO: 1863 - DNA, 2514 bp, Cryptosporidium hominis
atgttcaatgaagagtattggaaatccaagaaaagcgatgaggctttggtattagttaaaaatgttgatccaaaagaattgacaagtatttgtactatatccccatttaagcttaaagaggaatggttaaattacttagtgaaattagataattatgagaaagaaattctaattggtcagaattgtaaattaatttgtggatcaacaaaagattcaacaataaagattttttgtgaggaagatgaagacgaatttttgtcttgttttaatatagtaaatgtaaatacgcatgagaaggttgaatataatattaagagcatttatagtattattagacaagaaagtatggaagaactaagatacagtttggaagatgattcttcattagaatcactttataaagatattataataatcataaatacagaaaataaattattgtcttgcaagattcccttgcattatatattaactttgtttataaggagtcggattagaagaatcagagaaaagcttggaaactatcaaaattccgacattagtgtctcaaatattagaaaaactttatggatatatcaaatagagaatattagtggtacaaatttaatttcttgttataacattaataatgtttatccttatatactattaatttctaaagatgaagagaaagagttcaaaatgaacctttgtttgatttcactaaatagaatggattttgaactaaatatggaatgtgaaaagataggaaatcctttgaatattatttgttataatagctttattttgggagataattcatcctattttgagattcttgaaaatggaattggattctttccgttaaaatccagttatatttgggtaattacaacaaaaaaaacagtaagtgagaagatattagggaatagtgataataataatgaattaaggttggataaagatatctttaacaataatgaaaatgaagaattaaaaatagaggatctttcagaaagctcaagttgttgtttctatctatttgaatcaaatagaagtgaaataaggcatagagggaatatgttatgtacaaattatgatatagaattttttaggatcttgaatttgacttgtacaaatgatggaaaagatcaaacaggaattaaagagtatataataagaacagtttcctcaacaaaaaatccgaacggtttgttttgttttgatttcaagcttagaataaacccaaatagttcagaaagtgataggatggtcattttgtcattaattttcatgccaattttggaaagagaagttgatagacacattaataatggagatacaagaaattatttgaactattcttttggaaacaatgatggcaaaagtcttaatagaagcaaaaatgatgaggttagttcattttctagaggatataataatttaagaatcacgactttatgtgtaataccaaattatattcttttattatttggaagaaatatagaaaatgaattacgtgagaattttcctttaatattttgtggattatcaaatggtgaatggagaacttatagtataaaatcatcattaaagacaagcaagaatgaaatacaaaacaaaattaacctaagcactgatgatattggattttttgttcttaaaggagttcacttactaagaggagatgagctttctataaataatcagcttgatggcttaaatttaagtattaccccttcatgctggagttttgatcgtaatatcaaaacatcaatactatcagtggcagcatcaaatagtatcggtaatgtattcttatggtgtttagaaaatgagagaagacagcttccatcaagaaatacacttttaaaaaaaagagaaataacaaaggagaacataagctttgaaataccatcaaaaaatatagaatcaaagctcagtaatataaaaaatgagcaagataaagagaagagaagtttaatatcgtcaaataaagtttcaaagaacaaagatattctgaaaactatggacgagcatatcagaaggattgatgaaaggttgagaaaagtaaaaattcaagaggaaataatctcagatgctgagagacgtcgagaaagagtgagaaaaaataaggaaaagttgaaaccaagaaggaagctgacgaaagaggaagctgtcaattttgttccagattgcttgagcaggtcagttagccccagaaaaggatgtaattcctgtaactactcagaccctgatgagaagaagccatttttctttaaatcaaaatatgataattttgactataaaagatatagaagctactataaggataacgatcacgaatatcttttccaattaaacaattttctaaatatagagtgtatttacaagtctaaattgttcatagaggctggaaacaatattaaaaacccacaaatttttgatgaaattgtcgactttgatagtctttgctctaaatggtcaaaaaatattagtgtcgatattcatttcgatgaaattttaaatgaataa

SEQ ID NO: 1864 - DNA, 2121 bp, Cryptosporidium hominis
atgaacgatagttcaaagaaagtggacgatattgaggtcttagatttattaagaaaatcaagaaatagagtattgaaagattcagatgaaaaaaatattgttgataatgaaatggaaaatgaagatatggatatagatgaagatgaagaggaagaagaggaggaagaagaggaggaggaagaggaagaagaagaggaaaagttagaaatgacaagcgattcagattctgcgcaaagtgatgaaagaccagaatttgaacgtgaagcagaattagcaaaagagtacgaagacgaagctcaggctaaaagaaagtatgagctattatacaaaaataagaggagtccttcaaacaagcaggattctgcattaatgaaattacgtaatgcaagacagagaaaaattaaaggaatgagacttacaccatcagaagatgaagaagatagtgaagaagaagaatatcagagtaaagattctgacgaaaatgataatacagataatgaagacgatgatggagattattatggagaatatgatagtagacatcaaaaaactgataaaattagtaaatccaaaagaaaattaagacattctgaatcagattctgaagaatatgatgatgataataacaattatgaacgattaaaatcaaaaggacaaaaaagatctagaagaagttcctctaatattcaaaaaagtaacctatttgatgatgataatcaaaatcaagaaagaatgttaagaagatgtgaaaaagtacttgaatctattaatttaaagctaatgaagtctgtacatttaacaaaagatagaatagagttcatgttagaacatccaaagtttactgaatatttatgtgggagctacgtaaaagtaccaattattaatccatccacaaatagtgagattttcttaacatgtgaagtttttgattctcatattagcgatgaaaatcaatgtgtattaactttacagagaggaggatctaagaaagagtggggaattgaaagtatttcaaacaatatattcacaaatgaagatttaattgaatggaaagcaatgattaaagaattctattccaatgatcctgattatattttatcattaccaggaatactacaaaaaaaagccagggatttaaataattttcaatatggagatgacgatattgctcttattcttgaaagaaaacaaaagaaagcaagtaatcaatctttatcaggtaaaaccttaattgaaacaagaactaacttacaaacacaaattaaacaattagaagctcaacttaaaaatattggattggataatattgttagaaaatctaaacttgctaaaattgatcaattacaacaagaattagagaaaactattaatcaaattgagaaacttaaattacaaaaagaaatgatccatcctgataaatctcttagaatcacatcttctagatatattggaggagtacaaggtaaaggatctggtactatgcctacattatttaataagtcaaacttaagtgaaaataatatgaataatggaatcactacagcttctaaaactaacaagacttgcaattctttatataaacttatttttgatccaacatctccaagaaattattttaaaaataacctaggttctggcgccatttctaataatgactataatcatgcaaaatctcaattattttcatcaaattctaatcaaaacacagaaattcattttggaagaagagaatgtagaccttctgttatgtgggaaacaaagagaaataagccgaacacaagacaaccaataaatagtaaaattgaatcttctgatattcaagaaatttcattaacaccatctaaccaacataacaataaaccatctgattatgttattcaagacattgaaacatctaaaaattttcctttagaaacagaagaaattatttctgatttcaaagatttcttttcaaaaatcgacttgaatcttatagtatcagccagaaataactctcctgtttgcgttcctcctatatataatagtttttggaatccttcagaattcaatgctatatcaaaaaacaataaagatctcaactccaaatttcaagaacttgttaagttagtaacaaatccttag

SEQ ID NO: 1865 - DNA, 1596 bp, Cryptosporidium hominis
atggagccttatatattagaaaatgtagaaaaaaggaatcaggctaataaacaaaagtatagtggaaagagtcaaaacaaatataaaacatatgaatgtaatagtattaaagagttgaaagacttagtattttcttcaaatatggatgatacatcattatcatctcaactattaaaatctcttaaagaggattttgaaggtattataggagatacttatggattaccatctttaatattgtttattcgggcattgaatgaattaaatccacaaaaaaatgctgaattagtaaaattatttaatacaatattaacaattattataacaaatggacaagaaactgatgaagatataattattggatatgaaaatggagatgtagattctgaaaagatttcaagattactttcaaattcaactagaaattggatgaattcaaatttaaagagtcgattattagaagcactattagaagtgattccatatgaattcttagttatttggattaattcacatacaatctctaaagaacaatatgatcagttattcttaaatgatatattagattcagaatatggacattatataattttaaatcttttaaagagtaatagaattaaacgtgaggaatttatcccaatattgaaatgtttagatttctcaaagatgataagtaaaaaagagtttttagatatattaatttctctaatagataattgtagaagattacaaagtgaatacaaatatttaactaaaaaattatggaagtcaatagaaatagattcaagtgaagattatcaatatacattttcatgcttaatatttcagaagaagaagagtgaattgttattattagaagagaaagaaaatgacagctctaaaacagagacagaatctacagagaaaaggttgaaaataacttctcaaggatgtttaatgattagctctttatcaaagtttccagtagatacaattcatcccttaacttctggtattacatattttattagcaaacacaagaatgtaatgcttaaagatattcttgaagttccttttggaattaggatgattgaaacattagtttcatctactagtaacattcctcaatctcttaagaaaagatggattcaaagttattttggaaactttttaaatttagtactatcaggaatatgtaactatgctattattgcaatgttttatgcttctgataatcttttcagaaaaatgatcgttgaagaattacttaatgaagaacaaggaggtggaaaggatgtactaatgagcaagaattttaaaatatttaaaagtctaaagattgagagctttaataaaaaagatgattggaataatgttaatgagaaaattgataaaacaagaaaactatttagtaatattattgacgaaaaaatcgatattcttgataatctggaagaatcatcatcttataaaaatgtttcaaataataccaagatttcaaaaaaaaacaagaacaaaagaagctccaataaccataatattaatgatttaaatgatgtcactgatgatcaaagcatgggaaatattctcaaatttatcaaaaaaagtagaaaatga

SEQ ID NO: 1866 - DNA, 846 bp, Cryptosporidium hominis
atggatttattatttgcaatggttgatatatcaagttcatatggctggattaatacttgtttaagaataatggaactttcacaaatgttagttcaagcaataagtaacccagtaaatgataaattaatgcaactttcaatgtcaatgaataaagatcgaattcgaatattcaaggaaagtggcgttactgatatttatgatttaattaatatgaacgatgatgatagagatgaattattaacagaaaaactctctttaagtgaaaaggaaatatctcaaattgctcaagtttgtaatgatttcccaattatagaaactgaatatactattcttggctgtaatgatttgaatgaaaaaaataaaagaagaagagtagatttagagaattccactaatacaaaaaatggagaaactcaaagattatttgaatgtaatcctgaatctgaactaactttatctattgacatatcaagagattttagttctaatgaagaagaagataatgatttgaaaaatcaaaataatattaaagatcaagaaatttatccatgtattgttaagaatttgaattattatcctcttgaaaaggaagagaattggtgggctatcttaataaaaattggtgttccaaatttaccaaaggaaaatagcgatgatgaaaatgaagatgaaattttgtctataagaagaatacaacttaataaaataagtaatcaagtcttgttaaagtttaactcaattgaagattctggtatgattacaaactataagttactggttatttgtgacagctacattggatgtgaccaagaatttatgttttctgtcaagacagtagaatattaa

SEQ ID NO: 1867 - DNA, 216 bp, Cryptosporidium hominis
atgatagaaagaagatcttgggaggctatgctacctttaagacaatttaaaggtatttccgaagaagttgttaaaagattagaaaagaaagacattaactggaatacttactacagctttaccagtaatcaattgggtgaaatgctcaaatcttctaaattaggtaagtttttcaattttgctaattccacatcttttgcattatttccaatataa

SEQ ID NO: 1868 - DNA, 327 bp, Cryptosporidium hominis
atgatggatagtttgaatagaaaagggactaaaggaaaaaataagctactatttgatgatttcgaagattcagcaaacttagaatctgagggaggattagcaatgactaataaaaaatcaaaaggaaagaagaaaggagataaaaccggaaaaggaaatactaatagcaataaaaatgacaacaataataaagaattaatgtggaaatgtttagtatgtagccaagtttttgaatccagaaataagttatttgctcatgtaaaggagaaaaatcacgcacaaataaagagtagtagtaattataaaaattcaaaggttaaaaagtaa

SEQ ID NO: 1869 - DNA, 789 bp, Cryptosporidium hominis
atgagaaggtatagttcagaggaagatgatgagttttactcagattcgatagagtgtagtgagtttgaagattcaatagaaatggcaagaagccagaatgtggggaacaaagaatttgaagaggaggatggaatagaaatggatgatgaggaggaaaataatagtgataataataatgaatacgggattttgaattctcataaaagatttagaaagattgaatcttcacaggaaagttatacacaaaatagtaattttaattacttgaataatgaaattaaggatattaatagtaagatagaattaataaatagtaacattgagaatattataacaaattcaggaaatttgtcaaatcctgtatgtattttggaacaaatacatacagataataagaattcaggaaagaaagttttaattcaagttgggaattctggactaaagattggaaggaattcggactgtgattttcctggtaaaatggttccaaataagaatttactgagactttctagaaatcatgcttatttatatgttaaaaagaataataaaggtaaagatcagatttatcttgttgattgtaattctgcaaacgggacttatgtaaataatataaggataaagaacaaaattctaaagtcaaatgatattctttcttttggagagaaagatgatagcgataatagtcaaagatttgagcaaaaattgtcattaagtcagcaaagaagaaaaaatattttaacaagtgaaaactgttgtaaatttaaagtaatattatgtaataattaa

SEQ ID NO: 1870 - DNA, 1437 bp, Cryptosporidium hominis
atggaagattgtaattccagctacattttagaattgatttcctctttattaaagtcaggtaacaataaaggcaaaagactggaaattatctttaactcaatgattaagctggatatcactaatgaaggtaatcaagtacaaggtaaaattgatgatttagatactgatgaagataacgactatcctagctgtcttgcaggtctaagtctcctattccagctaaatattagaattttggacatttctaaaaacttaaatacaaaacttctagtagagttttctcgaaagattgctcaacttcctgatttattaaatgctcactcaagtttaatggatggaaatgatgagaattatgacgatgaagattctgaaattgaagctgaaattgatacagataatgagaatgaaagtattgttggaactggaggtaagagaggaggatctaagcacagctcatctctagaaaatgatgaagtttctcagcttttgaaaccaaatatcttctctaaagaatgtaatctttctaatgatggctttaaagagaatgaggatgacaatactgatgatgaaaatagtggtgaggaaggtgatagtaaagatgagattatatcatgtaatgacagtaattccatgatttcacatttactgaatgatgaaaatactccattacctcccaaatatgaaagacagagagaacaaaaagagcaagagaagttacagatacaaagaattaacaatgaaatgcagaataagttaaggatgttggaaacaatatctttgatttctgaacaatataaaccaaaaaatattcaagatagagagatttatactggtttagttcgtacaataatattactattggaaggatttagactggcatgtaaacacgctctatactattctattagaagtactttgacaattttttcagactatgtgaacaaattggcttcaacaataaataaattaatgcatttggatgttttaaaagagaaaaataacataaatttggatgaattaggggatttatttaaacttttagtccatatcattggtaaaccaattgttgagcctcaaacaatgagccgttggagtaagaaaaacaatggaaagcaacttagaaacaagatggaaaattattccaagcattttgagacactttcaatcaatttaattgctttaattgtaatgatagatagagaaaatgtattgattggccaacttatagcacaagatctgataaaaaaatggattagtcagaaaagatttggcattgtcacatcttcattcttgactaaactgatgcatagaattaagaattctaataataataactctttaaggtttttaacacaaagtttcataaataattttgaagaaactgttaaatactctaaaggttcatatcagcttagagaatatactactttaattaac

SEQ ID NO: 1871 - DNA, 414 bp, Cryptosporidium hominis
atgaatttggagaatacgggtagtcaatatgaggcggagcaggaggaggaagaagaagtagttaattctcaatttgaaagcctttcaagtaaagaaacaactactatatttttttttattactttaatgtttaactcaggatcgaaattacctcagcttaatattgaacttctaagagatcaaagcactaaattacaaatacttaacatgattatccctcagctcctcaagcctaacgaaaataaggttttggtattctcagaaagcttactaatgctagatctgatagagcttacgattttaattccaaacaaaattgattgggaaagacttgaaggaaagcaatctctagatgaacgaaattctagtattgattctttcaacaaaaataacgtaagttgtaatgtaaaatga

SEQ ID NO: 1872 - DNA, 651 bp, Cryptosporidium hominis
atgtataattttgttgataatcatgatgtaactagaattgcaagccaaattgaaatagaagacgatcttttaactgtatatataattctctttatgttaaatggctctccttcaatttattatggaagtgaatttagatttaaaggagttaaaggaaaaggtcgacgagctgactttcagcttagaccaaagcttacaattaaggatcttgagtggcttaattctgataaaaatgatggatttttggttttgattaggtttatttctcaaattagaggtcatccaattataggtaaaattctaactaaaggaaattatttattattattgaataccaaaaccttgttggtattcgaaaggcgtattaaagaagaatttatttttgttgcaattaatattgataccaaatctgttgaagattttgaagttgattggaaagaaaaagatggccaatggagggatattttatctccttcagatacttatcaatcaaaaaacgggaaaatcaaaattaatgtgctgtcaaattgggcaattattatttcatcatgtattccaaaaacttcatataatcagtacaaaattaaaaagtttaaaaaagttctatacaacataccaactttagatagaactgaattaattgaaaattaa

SEQ ID NO: 1873 - DNA, 1287 bp, Cryptosporidium hominis
atgtggaatattgctagcgaatttatttgtggttgttttcagcaaggaagttttgcaaagaaaatgctagaagatactgccaaagagttggatattactagagctgatgaactcagtttctttggcgcagcaatttcttcccaacatgagttaaagcaacagaaaagtagtataaatgcagattcttggttagtttcatggaatttactcggaatagctgatggagtatcttcagtagagtctgaaggatttgatcccagtcaattaccttcagaactactaaagaattgtgttgagctctgtaatattagagaaaataacagagtacaatttgattcagtttcgcaaaaaatattcaataaaaattcgattccatttcattcatatgaattcctcaaacatatactatgtagatcttgctcaaattgtgcttcttatggatctacaacttgtttactatgtttccttgatggtaatcaactttgggtgtcaaatgtgggtgactctcaaatgattgttttaagaccatcaaaaaacgagccaaaaaatcttccaccaataccattcattgagaatccaatagaaaggaaacctattacaggagatccaagaagaagattaccatctaatgtatcagttggcggatatgatattactgctagaagtgaagttcaacaacatttctttaattgcccgcaccagcttactattatgccagatattaattgctcaaatgacgaaatcttaaagagagctgcaaatgtgtctcagtcttttagggttgatgtaaatccaggagacttgataattattggtactgatgggatatttgataatatttttgatgaagatattattgatattgtaaatcaagcaagaaaaaggtatagtcgagtttttgatgataatcctattatggtttcagatttcattgccaaagaattacttacttatgctttaaaggctgcaaataatgttccttcagggtcaagagctagagtaacaccttttagtgaaggagctttgattgatgttaatagacatatcgagggtggtaaacctgatgatattactgtaattgttgcctttgttgcatattctgataggttaagtacaagaatgtcaaatatttctcctgaaatttatagtggaacttcatatttgggtagttctgcaaaattcagtaatgatatgtcaacttacataattaatggtgaaaagtattcgtattcttctatcagtgagagattctcaattcttggaggattaacctcaaaatataaataa

SEQ ID NO: 1874 - DNA, 1041 bp, Cryptosporidium hominis
atgaaaattaataattgtgttaatatattacttggagatgtgggactatgtagcaatcttaatgctcagcatctcaggaaaacggctttaaaatgtgatataatatgtatatatcacaattttgaagaatctgatttaaattctattttagccattgggagaaatccaacaaaccatgtaagctatgaagatttttacaaaactggttcaatattgtttgcaccattttttaataaaataaaaaggcttttcaaaaagaatgtaaataatatatttatgtggtactcatattttcgtggtaatatttatttggaaaatacctcaagaataagatttgaaattcctgatggttataaacttcaaaaacaaagtatagatttttgggaatttgatatgggagggtgcttcttgaattttagacgattaattcttgcaaatgttaattttacatatttctgttctatcaataaacaaatttcttgtatcaagtctttaagatattctattaaagaaattgtttggaagaattttataagtgagttaatcttcaaccctcaaatcaaattaaacaaaatagaagatgatacagtaattataaaccttagtgaaatgacttcatttataatttgtggtaaattttcaaattccaatttatcaaaagatttcctgactctttttgggcatggagagcttattccaattggtagtaattcctttcaatcaaataactgtaattttgacaattatattcttaaaagtatagtattttcacgagaagatgttctttattttatttcagtattcccagttaataaagttattgggcctgattttaacaattacttgattccaaatcaattcatcaggatgtttgaattccaccattcaaactccagtttgttgtctaatatcaataaaattcactccgggaaaagttctagcccaaagtttacaaaattcattttttatgatagtgtaaatataaccaaaacttctgtcgatcctgaaaataatattcacttgcaagttatatccttttag

SEQ ID NO: 1875 - DNA, 1824 bp, Cryptosporidium hominis
atggaaataccatcaggaataggatttaatactggggtaggagcaggttctggagctatttctggactaggagttggactagggttagggcaaggaattggaacaggtatagtagcaggagttggaataggagtaggaacaggaacaggaacaggaacaggaacaggaacgggaggattggggtcggggcaaggaggtggaactggaggagatgtgggctcaggggttggaatgacaaagtctcaagtaagagcttataagattgaagcaggaagtgaattgagaataattgctcatccaagtcagccttgcacaattagactttactcttcatcatcatcaggggcaggagctgtgacaggaagtggaggaactcagacaaatgcaatgacaacagcagaaatatttggagctgagcttcctccagatgttgatatgaagattgctccattatcaagagttgcgatatatacttggcatggatgtattttacaaattagaggattggttcagcaagaatatgaaagtgtgaataaaagtatgaaagagtatatggaagttattcaagtattggataataggagaaatttttcaaagcttcatgggactttaggtccaagagttatggtaacaggatcatctaattcaggtaaatccaccttgtgtcagattctttgtaattatgcagccagaagaggctatacacctttatttatagatttagatccgagaggatctacggataaagaaaatatgcagtttccagctggaacaattggagcaataaaagttaatgaattttttcttcacagcaaagagttaaggaatcctctttcattcttttttggtcatttaaatgtaacagatgaccttcaattatatttatatttgtgtaggcttctaagtggtgcaatatcgcttaggagtcaaaatattcaagatacaaactctcaagcttcaggatttatattaaacgctccatttcagccgtcaaatgaccttttaaaagaacttatttctattttcaacattgatgtcgtagtagtaatggacgatccaagtacccaacactatttatcagatcaatatgactataaggaaccccaaagctatgaaatcttagaaaagcaacatttggaagagtcaggaaatgcaaataactcaagctctgatcaggaaattgatattaataaactaaatattgaaaaacagtttgaaaaactaccaaagatttctgttgttggagtctcaaagtctgacggagttatcagtatcacctcgcaaaggcttgctgaaattagaagagaatgtttaaaatcctatttttttggaacccccgaattcccgcttaaacctcatacaattaatctcaaagtaatacctatgggagatgatggcaagtcattaattaatactagtacacttgtttcaagtacttggtgccatctagttgaacttcagattgcatctttacctgcatcagctctacctgctgaccaagatgtatctatgattgataatcaagctcaaattcttccatataataaacctttaaaaaatcttgtgaatactattgcgggaatatgtcatgcaaaaaattcaacatgcgcgccaatttcctcaatggcaggaattgtacatattagagcggtgcatgaggataataatgccggtatggaagacatgcaacaaaatcgtccatatacaaatatgacatttccaacaatagaagtttggtgtccaggattaaatgagcacggagaatttccgtcgcattatatatttgttggtaacacacagaagctaaagtttcatttggaatag

SEQ ID NO: 1876 - DNA, 1071 bp, Cryptosporidium hominis
atggcatgcccaagattgttaagcgataatgatttatgtagatttagaacaaaaccttgtagaagatcaaagcaaatgggatgtgattttggaattactagatgccaatactctcataacatttactggccaagaagatgtcctttctatctctcaaaccaaagtactattaggtatattccagttttgtgtcctgatatcataattaaagaggatgaaagttcaatttcacattgcaatagaggaggaggatgcccttttgctcattcttatgaagaaattaattatcatcctttaatgtacaaaacaaagatatgcgagcaatttcaacgtggagattgtaatacttattattgtcatttaattcatggattagctgaaagacgagaatctaaagtttatttgctaccatatacgcaaaatgttcaagttcctaattttcctggtgttgtaatagctaatagagttaacaaaccatttgttgcaaacagccaactgaattatcagacacaaaagtctttagttaataatgagaatatttgtaataatcatgaaaatggttttatcattagaagaaataattttcaaaatatgatttctgataaatggagtgaaagaattttttctcaaaataataatggtgatgatttttggaaatctactgaaaatgacgagctaactacaatggattctatttctaaatcagaatctgaaaataataactgtgaaaatatgaaaacatcaaaattgattactaaaacacctacaccacatgctttaaatagaatagaaaatgataaatctatccacgagaaaatgagaaatgaaaatattctcaatgtctttagagcatttgtgctagaagatagtgatatgttatcagtttctaatgataattgtagagtccaagcaattaattctacactttctaataacaaaatccaacaattaaaagttagaaacgaaaaccttcaggctcaagaacatagtaaaggtttcaatcacataattgaggactcggagattattaagaataatgaaaattcaaatacaagcaattttttcgattaa

SEQ ID NO: 1877 - DNA, 243 bp, Cryptosporidium hominis
atgggaagaaattcaagagaagagatttttgatagaagaatgaaaactaatgtttatgatgatgcttctctggaggagattcgtggaagaattcgtagaataaatggacatagaactagtagtctatcagatattaaaaactttcaagctaatattgatatatcagcattaaaaggaaaggataattcaactattttaatatcagaaagcactttattggagctaaaaaacaaaagtagatga

SEQ ID NO: 1878 - DNA, 801 bp, Cryptosporidium hominis
  misc_feature (679)..(679): n is a, c, g, or t
atgacaggttcagcatctgaaagaacttcaatgaattctagtagaatcatgtcattttcagatataacaacagaaaagaattcaatggattcaattccaatgattaatacatcaagatcttcaaagttttcagatagaatgaaatcaagtattgatcaagtttttatgattaacaagagacttttattcacattagtcagattaaaactttggattgtagaagaaattctatatgatgaacaaattttggatggatcccaattaagtagagaatatgatcatgactcttcaagatatttgttaaattactttgaaaatgcttatgaatttatggtaaacttagaagattataaatcaaattatttgaataatgaatacttaagtattggtattatacaaatgttatatattctaaataaacaatgggaaagatcaataaataatgaaaataggttacttaatcaacttcaagaaatggtaagaatataccatagattaaagaaacatttactaactttctcaaaaagtagttatcagcagaattcaaaggaagatggaagaatagtatataatgaaatagaagatacagaaattgaaagtttacatctatcaaatgaaaataactatgtattccaaatagaaaaagaattaacaagtcttggacttgggattttctcangacgtgatttgaatagtggaaataaagttgagaatgaatcagatactgtattagcttttaattctaaagatagacataatcctaatgaaatgaatggtaatatggatggattgttaagttag

SEQ ID NO: 1879 - DNA, 2007 bp, Cryptosporidium hominis
atgaataatagatatcaagtagatgaagaggaagatgaaaatggtcaatttgggacaggagggcttgactataacaaatatataaatgagcaaagaaggattgaagaagagttggataatattgaagatgataaaatgagcagaaatgatttactaatgaatattaaaatgtatgatgattcaatgaaagagatggaaataatgaaggatcgtttaggattatggaaagaaagtttggaaggtttaaatgaaagtataggaagggatggactatatgtgaaagagattgcaataaaagtagtagagagaaaggtggatgaattaatgaatgaaagaaagatgatattgaagaagatgatggataaattagaaaattttacaaatgtgatgaaaactagtatggattgtatgagcaattcaattatggattttgagaagaaggtttatagtagtggagaaaatggagattatctttcttttgattttaagagtaataatagaatctgcaaatcttactttcaattatgtcaaagattgaaagaatatttaaaaaatatgagtccttactttaaagataatttggaagttgatattggactggatatggaaatgaatatgaataaaggtatggatttagaataccaacaatttgaggctcgtaatggtaattgtaaatcttttgaatgtgaaaatggtgaattgaaatcaataattatgcaagagtccaagttattgagggagcctataattttgttgattgatccaaaaagaatgcaaatcattaatttgagaaataaaattagcatgacagatttggatgaaatactttcaagttcaataaatttgaatccaagtaatgaaagctgtttctattcaaaattggaaaacaataatccatgtaaatttaaagatcaatatccaatggcaaacgcaaataattctatgaataatagaagatttgaacgaaactgtggccttaggcctcatattagtagcaattctggtgctaataatcatatcaaatttgaacaggagagaaatcatgaaaaaactgaagataaagcagaatacagttataatgatgaaggaaacagttacattgatactgatgttagcattagtattaaaagagttaaacataagcccgggaatagtggacagaaagcaagacttaaatccagtcccagttctagttccagttctagtcccaggtctagctccagctccagttctagtcccaggtctagctccagctccagttctagtcccaggtctagctccagctccagttctaggtctagatcgaggtctggatcaagatctggatttaaatcagaatccagaaccaaatccagatcagcttcggaaccaagaatatcattcaaaaaagatggagagctaaaaatgaataagattaggggtttggttagcaaattagagtcagaactaggttcacactctgagacagaatctaggatctacataagaaaaggcaagtcaaagcgaaagggaagaagtattacaagaaagaaagccaataatttagtacccaataaagctaatagttgtaccaataatgaagataatactagtttcaaaaagaaggtacctgaaatgaatacaaagctaaatattcaaaattccaggcttgaaaagaaaagctctagttcttgttcaaagtcaaaatccagatccaggtccagatccaaatccagatccagatccaagcccagatccaagtccagatccagatccaaatcacactccaggtctaggtccaagtccaaaaccagatccaaatcatattccagccgaagctctatttccagtccaagttcaagcttctattcagaaaatgattccaattctgattctagttctatatctagaactaatttccatagaaattctaagatggaattaaaagaattaattaaagattactcaaatctgtatgctgagtacataatttcaaaaaatttgtctaaaatcaaagcttattattaa

SEQ ID NO: 1880 - DNA, 459 bp, Cryptosporidium hominis
atggattacaaagattttatttacaagaataaatttggaaatgaagatattattattggctattccagttttgaaattgatttattaaagattataaatcattataaagagaattttcaaatagatattaagaattttatattaaataataaattaaatttatttataattttaagtaattatatatatataacagaagatcatcaaaatgaagaaattaaaaaacaaataattatttcatatattaataatgatcacagtcaagttcaaaatcttcataatcttgtaattaaatgcttagaaacaacaattccagttactgaaattaagatggaatcagttataacagaatttaatattcccgaactttctttcaagttatttaatatacatgatatgtctttttccagaaaaaaatttgaaccatttgttaaagatataattaataataagctttga

SEQ ID NO: 1881 - DNA, 255 bp, Cryptosporidium hominis
atggatgagaatagagcagcaatgaccaattttaatttgaataataattcatttatttcatttccatcaattacaatgtcatcattttcatcagtaaatttaggtcaaaagagttcttcatctttttccaatgatagccaatttcaattgagttcatgtaaacaattctcagaaaagataatttttacagttgaagataaggatgacgcaattaaggtattttctgttttatcaaggtatatcaattctgaatga

SEQ ID NO: 1882 - DNA, 2319 bp, Cryptosporidium hominis
atgtttagatattgtagtaaaatcaccgaaagagtgttatactctactataaagaatgttatgaataagatatttacaaattttgaacaagaacaactttccatctcacttttaggtggaagcttggaaataagggatttaaatattagaaaagaactttttgataatttatctttcccaatcagtttaagtgatggaattgttggaaaagttaatattgatgttatctggagaaaaatatttacccaagagtttgtaaaaatcaccttggatgatgtatatgttatttttaatactactgatatgaaaaattggaatgttgaaatgtttgaaaaaaactggaaaaggtttaaagctaatttattaaaacaagatgaatttattactttcttaaaaagtgctatggcttccaattttctcaaacaaattggacacttttttatatcaaagattcagtttgaaattaaaaacatcaattttagaattgaaaatttgttattccactatatgaagagatttgttattggactaagtattgataaaatttccagtcgaaattgtaatgaatattggattccagtagataaatctggaggagccattttaggccgtaatacagacaaaattaatggatcatcaacttctactgtagcttttgataatagtgatataagaaattcaaaagtatcaggtaactctaataaccatatatcatcacaatctatatccagagaattctatctagatgaacaagatgaaactagtattggatctattgtagacaaatatatgaaatttatggagcctagattaaaaattaataaaggttttactggagattctgaagaaaatctagaaaatattgatgatataaaagaacaggagaacattttaaaaagtattctagcaaaatctaaatccaagcttaatggaaataaatctatagaaactcataatttttggtcaaaacttaaaaaaaggactcctcttagttgggtatggaataaccaaatttacgatcagaaatctgaatcttcaaaaaatcctaatattgaagagaaacaaattgaggtagacaatacaggactcaatagtgggatatggcataacaatgatctaatttttccctaccctaatggaatgggagtcaatagagaagtcgttgataactttattacatccaaggaaaacagagaaatagaaaagtacaacaaggaaaagtttgtccaacctgatattctggaaaaaaatgaaatcttcctcaaatctttcttaatagagaacttttctgtatatattgatgagatctcactttataaccaaactattaactctccttggaccaatttaaataaatcagaatcacaaatttctgatagattaaacttcttaaaaattacttctgaaaaagaatacgatacccatgattttattatttatccacataaaattgaattaagagtaagattggtaccttgcattataagatatgatgagaatatatatgcatcagctttgaatgataggttttatattctatctcaggatgaagataaccagattattccattaatatcatcttattttatttttgataatttaagtattgatattacagaaaaacaattaaagttattgttagattttttggactatacagtatttttatatggagatttttcagcaggttcatgtccaaaggattttcagaattttccagatgaacaatcatgtattaggtatagaatttcatggtttgagtttcttataggaaaaagagacagaagttactcagaaatttgcaatattgaagacagttataatgcttattctttaataaagctcagaaatgatgtttataagtgccttaattattcaatatatcattcagtaaagtcaatacttagctttgaactagataaaagtgatcaaggaaatgttttaacttttcctctatttgtaatcaaagatcatgaagaatataattcaaaagataatctttttggaggatttccaaacaaaaataagccagtattggttaatgaatctgataaaatcagtaataatctggctcagtatattatttctaaattagttataggacagaatgattattactctgtaagtttgaatatgaatgatgattcaactgttagaggaggaaacaaggcaaatattaatgagataaaggaaacagaaatctatttaagtaaggaggagattaaattaattaaagagaatgatttacttgaaaggatcaaaacaaaaacaagcagtttgttatcacagaatgagttacctttgaggtggtacttttga

SEQ ID NO: 1883 - DNA, 519 bp, Cryptosporidium hominis
atgagaaagagaatagaatggcttctttggaaattaataatagttagtatttctggaatattaagaaatgagcgagcaagttgcgccacaattactccaacaagcatgtttgtgacacaaaatatgatcaatacaagctcaaacttttgctgggaatattcaggaaacgttatgtatcttccaattacgtctgctttcagtacaggttgggataatactttactaatccaatttgacttatctagttatgccaagactatccgtaattcaagtcaatcttcctatatttcgctaaaaacttactgtgattcttataactgtacatgttcagcaaattcactcactttaaaatttataaagatttgcgatgatttatgttcaagtaatacaagtttggttaaagacccttctactattgtatctgcttttgaaacgacaggatatacttcagaaaacatgcaacaggctccagcaaccactttgattagaactgatgatatttcaaatattccggaatga

SEQ ID NO: 1884 - DNA, 579 bp, Cryptosporidium hominis
atgcttcaagaaagaaatgatcgtcaaacttccaatggatttaagcctaaggtatggctttggaattctttcttttacacaaaattaacatgtgatcaaagcaatgatgaaacaggatattgttataaaaatgtttcaagatggacacagagaaaaaaaattgacttatttaattatgatattatacttttacctattaatgtcaataatgtacattggactttgggtgttgttaattttaagcttggatatattcagtacatagattcattaggcgggcaatttcaagaccatttgggctgcacaaagatgtcatccatattctttcaaaacatgaatagatatatacaggatgaatattttgataaaaaaaaggagaaatttccaggccagttgaagcattttacgaggttttcggaaccagttccacaacagaataatggctcagattgtggggtattcacatgtatgtttgctgagtgtatttctgaaggaaggtcttttgattttgacacaactcaaattgacaggattcgtgaggttatgttagtggaatgtattaaaaatgaaatattttga

SEQ ID NO: 1885 - DNA, 405 bp, Cryptosporidium hominis
atgtcatcaggagtaaagattcaccaagattgtattgatgcttttcaaaaacagaagatccgcaagcaacacagatatcttctttataagatggatagtacctacgagaatataatattatttaaggcttcagggccagaggagacatatgaagatttccttaaatcaatcccagaaactgagtgtttctatgctaccattgatctcccagatccaaatggccaaaccccaaaactaattttcttaatgtttaccccagaaaacgccaaggtaaaggatcgtatggtctttgcttcatcaaaggatggctttgttaagaagcttgaaggtgtccatggtaagctcttacaagcctctgagagatcagacttagattacaagcttgttgccgaccaatacttttaa

SEQ ID NO: 1886 - DNA, 1611 bp, Cryptosporidium hominis
atggaggaggaagagattgaggtgtcaggcgaatttttcaaatcaagaagtataggaacaggtttgaaaagacggaaatgttgggagatgttggtggatgaattagtcaaattgaaaaataatggtgaatttgaatatatgaacatattaaaactgtttggggcaattaataggcttgaaagagattcaaatataatatttagagatacaagtagtcccttcctgaatgataagtcaatattgaaatggtcagaatatatagaaaatgatcaaatatttactaatactggaaagaagtcaaatcaagaaattatggaatctagtataaagatatttaaggatagatttggtggagattattacaaaagtgagctattggacacgatttaccatccaaattaccctgattattcgaactatattaattttgaccaagttaataattctgtaaagaacaatataaagagcaaaacaaatacaaaagaaataggaaatatgttcacaacaggcttaactgagttaggtaaaagtaatccagaaatatacgaaaagcaaatcaataaagaaaattctgatttctcaaactctaaaggacccaatctgttaagttatgtagggaaaaatcctgttaaaagctcaactggtaatcatactccaaatatcgaagctgaaagaatacttgcttctttggggggaaaggtcaaaattgaacatattgagtgggttctaagtataagaactgaaccaaagaattttatatcggaaaaagatgttattggtttagaatccattaaaaaaatgctcagagttaaaattattaacccaatacaacgacccgatctacatgttggtttacactctgctccaaggggtatcctcctatttggtcctcctggtactggaaaaactatgctagcaaaatggattgcaagtgaatgcaaagcatcattctatgatgtttctcctggaagtataatgagtaagttttatggagaaactgaaaatattattaaagctctttttatgatttccgagtattcatcaccttctattatatttattgatgaaattgatagtatattcagtaagagaacaagtaaagacgatgataatagtattcgacttaaaaaccagttcctacaaatgatcgatggtgtacaaagtgatttatctaaaattgttgttgttattggagctactaataggcctgatatgttagatgatgcagcattaagaagactaagtaagagagtcttggtacctttaccagatgtggaatgtagactagaacaaattaagcatatactggaaacaaatactcaaggaggatgtcaaataacttatgatcaattaaagtccattgcaacagaaactcatggttggaatggaagtgatatcaagaatttgtgtattaaggcagcagaattctcttatgatgaaactattgaaaagtataatggtatccataacgttccaaatagagaagcatttaggcctattactatacaagattttaacttatcattaaaacttgttaagccaagctattcttccgaaaacgatcaaaataatgaccttattaagtggtccaatttatttggagttgtgtaa

SEQ ID NO: 1887 - DNA, 387 bp, Cryptosporidium hominis
atgtcatctcatgctgtatgtggttcaagagcatctttggtttcaaaaaagaaccaaagagccatatattcttacttatttaaggaaggtgccattgtagtacacaagaatccaaatgatccaagacattctgaattggacattccaaatcttcaggttatgttaacaatgagatccttactttctaaggaagttgtaactgagaaattcacatggcaacacaactattatttattaactgatgagggagttgaatatctccgtcgttatttggatttaccagcatcagtcttcccagcaacacatacaaagaagacaatggatcgtccaggtagatcagaaggtaaccaaggtagaggctatggcagaaacagacaacagcattaa

SEQ ID NO: 1888 - DNA, 786 bp, Cryptosporidium hominis
atgttcaatctattaaggtcagccggaaaggttggaatgaatgtgatatttactggcatttcaggatccgggaaaacaacgttattatattcatcactacttggaccatttagtgaagttcctaaattaaatccaaccgaaagctttaattttgagagaattatgtacttgaaaaagttgctacttgtatgggatacttctggacatattgcattcattaacaaccttttgccagtaatgttatctactattaaattcagagcaatagtatacgttgtaaatcttctacaaggagacaaacttatatttgatcagattaataatgaaattagaacactactttataatcaacagctttctgattgcagattttgtatacttttcaacacattcggatcaagttctgattcatggcctagacaacccgcagaatttgccagcctactcgggctatgctacttgccccctcaaatcgataatcgaaccaaatggtttgttgtagacacagctaaaggattcactgatcatggatggagaatggcggtagaattcatactatttggaagtattcctaatatgccctactatactaatgtaccagattttgagctaactcccattcactattatcattcacaatatgatgggaaaacaccatatggatataattttagacaatacattccaaacgactatattaacgcactttactatcaaaacctaccaccacctgctgatactaaaccaaaaacatccaaatttgcaaaattatttaaaaaaaagtaa

SEQ ID NO: 1889 - DNA, 891 bp, Cryptosporidium hominis
atggaagaggaaactaatattagagcagctgaagaaaaggcaataaaggaggcagagtttattgctgcatctgaaagtattaaattagctcaagagctttctctgagactggaaatttctgaacctaactcaaaatcatcgtccagaagtccttctatatctgctattaaagaagtaaatgataacaatgagcaatctggaagccaaccagaagagattgatgaggaaaataataacaaaaatgagaatcctatagagaatgaaagtaaatctatagaagatgagaaggtagaagaggagcaagataaagttgctgaggaagatgatgaaaataaagaaattgtagaaaatgaaaagactttatcacgagaggaaataatttcacaaacccctagtaatactcaggaacctataattgaaactagagaagacgatggtattgctacccaaccttcaaaacaggaatctaagcttatattaagtgaattcagagatgattctatgagttttaaggaggaacaacaagaaactaatgggcatttagaagatgctgaagttaccattttacaggaatctaaagagcaagatctagagaataatggacattctaatgatgaaatattgctgctaaataatcaagaaccttttgagattcatggttgtggtcataaactaaatgaattttcagaatctgctaaatctagtataactggaatctttgatggttgtaaaaacagccacaattcaatgaatactcaactcaaaaaatctgcttgggaatattttgactctctacactcaaaacttattaatttagctggattccataatcctgatgaatgctctatttgcaaggatttcaaacaccaagatgttccattactcaactaa

SEQ ID NO: 1890 - DNA, 2559 bp, Cryptosporidium hominis
atgcttaaatttatcgaggctgtctttgggtctctgttaaaagaatgcaagctccttacattgattatattgctaatcagtttggcccaattgaattatgcaacatctaatataagcaaattggcaattactgaaggttttatattctctccaaaatcactaaatttaatagagtgtacaaacaatgtagttgctgatattataagagaaacgacaagagcaaatgatacaaattctcacaaagtcgaagcatgtcttggaggccaacattttcagagaagcatgatgggactagctttgagttttggttcaggagaagatcttcagtataagaaatttaaatgtccaaggttaattgcatctttctttagagatagaatacttggatattcttgcccttatttgtcaaatattaacgaattctttaattttgtagaaaataaagagcttaaaactgaagattcaataggaaaaaggaatattcgttctcatccaaataacgcaaagaatagtaaattacctacgatattaacaagtttatacacaagattagttcatggctgcgataagattgaatattgtcttttgaacaatgaagaaaaatctcaggaaaagtattctatgcaagaccatatagacttggataagtcattaattggattaaatacacataatattgatcttgaagcgaaaagaaatatgattgattcaataatttcactttttccaagaaagattggaagaagagatattttaacttattccaataacttattaagaagagcaacttttgaatttgagactaattttgagaaagaaagtcctgttgatcctttttggcttatacaagcatatagaatgcttttaatatattcagtattactcgatgatgctggaatttttgtcaatttgaattcgcattactttcagaagatatttaattatttattagatactcaatatttacgaagtattgattctttgcaactacagacaaaatatttaaatctcgataagtcatcaagaaaacagttattatttttaagagcttcatatactattttggagtcttgctttcatttttggaaagatcttcatgaatattatgtttcgtcaatgttcactagtgaatataattttggtgatactgaaatagttttggatttctcaaaaatttgtcaaaaaggtcttcaattacctttaagacaatcattaatatttttctattatgcaggaattaaagaagtcattaagtattttgatattgctgacaatactagcaataatgatagtactagtaatgctcaaaatgaaagcagtgaattcactgaatctactgaaaccacgggttttattgctaataataaaaataatgattggtatgatagttattgtacagactttacaattaacactccttggtttgttgaaagtacaaacttgctctatccagttacaagtattgaagagttggatttaatatataataaagaggttttagccctaattaaacaaagtgacccaaatttaaatccaaaagctactgttttgaacttgaatcataacattttatcaggctattttattggaggaaatggatcaatgatgtataaaagttgtacctattatttaaaaagaaaactgaagaaagggtctaaacaaatattattggctcatgttacaaaaatgagtaagaacaatggattctatgaagttagcccaaacgaaaagattagatacttttgctggtatacagctaagagtgcttatccaaatgattcgagttttgaagctgaccataagtacgaaactagccagttttctcaaggaaatttcagagtttctcagtctattgaaacaggtaataaaacggctattcaaagcaaagcctctaggcctccttcaatttcttcttctccaaaaagacttgaatatcaggatattgaaactcttgaacaaaattctgatagagtttcttcagcgttatcttcggttgcttcctctacttctcaaacatcttcctcaagtagtccagcaaaatctagaaaacattcaacatttttggataatagacgacgtgaaattctaaggagattatatcctcaaagctctgatttggatatgaaatctctagtatattcaatttctgacaagtctgatgacctaagaggggtaccaattattaaaaaacattcaaattccccatctcaattattagaaagttcatcttcaatgtcaaatatcagaggaaaacaagaacaagctagttgtaagaataaagataaagaggatgagaaatcaaaaaaaggtttaattccaaaattactcgaggaaattagatcaggagtaaagctaaaaccaacaggttcttcagcttcaagtgaaattatggagaatattaagaaagaaatcacaagttctgctaaatctgtgaatcttggaatttcttcttctcaaatcaaaaatgatttagattcaacagaatttgcacctcctcttgttgaaacaaatttgttggatgaaatgagtaatagtaacagatttctatttgaacaataa

SEQ ID NO: 1891 - DNA, 1113 bp, Cryptosporidium hominis
atgagtcagagtacactttttcataagagtgtattgattttccttattgtaactattttctatgggtaccaaataaagttattagagtgtgcaacaacaaattccgatgtttcggaacagaataaaccgaatagcatgccaagtgcaataagtactaggcatgcaacgagtctttatgaaaacttggtaccaaaacatcctcaaacttcaacatctttactatatggaagaatgaaagtacgtaattggctttatgtaacaaggcgaaataaggaggtgggggcattaagatatggacttaacaatgatgatatgcatgtaacaattcagatgtatgttaacaacttaaagacccacattccagttcaaaaaacttatttacatgaacgaagaggtaaagcaagaaaatataaaagaaaatatatgtattggatttggagacgttggagatatttactttcagcaaaggagagaatgccaatattagttgaagataaagatttgaagcaaatgccaatagatccattagaaagagtttatagctatgcggtaaatattatagaggttccaaacgcattttatttagaacaggtacattgtatgtatactggtattaaaccatttattaatggtattttaccaagttattctttacaagatttaattggagcttctctttattcaataggaccggatggaatatttaaggattatttctgtattcaagcaataaatttatggagtgatgatcaaatagtaccaaatgctaatgcaatttgtgaaagaacaaagaaatgtttagataatcgtgaagtaaatgaaagaaagacaaaacaactatttaatgagtatgtgaataaaatttccatgatatattcaaataaaaggtttattggagcagattctggatatacttttgcatcaaatgcattcttagaaatggtacaaatatttcatgaattagaagcacataaacgtcctgactatattgagaagctttttgtaattgttaggtcaataagatttctgatttatgcaaatgaattattactaagatcaggagttaaaaataaagcagttttcaaagcctcaaatgtttcagatgttattcaa

SEQ ID NO: 1892 - DNA, 1002 bp, Cryptosporidium hominis
atggtggaaataatgttatattggacagaattgctggacagtgagattttaagtgttgagattgataaagcaatgatgaatggaagaagaaaagaaataaaggatatttggaagattggaaaagaaaaaagattagatcaagaaaaaattaacgagtataagaatatggtcaaattgattcgaatcccccttccagaatcacgacttagagatagatatggccaaatacatcatcctgattcagaaaataaacttggagtcccaacaagaatccaaaaagaaagtgataaaataaaatcaaaattgaatcaaattaaaagagatgagaacattcttatgggagcaggtaatgagagatttgttgattatgagagaagaaagtatttagaagcagctttaaagagaaatcaaaaacttagttttgagaaaaatcaacaaataatttcagagaggagaaatgaggataaacaaaacgaagaatccagattaaaatgcgaatgtgaagaagaagaatgtgaatgtaggattgttgatctttatggagaggttttaggtaagcctgtatcaataaaacttgaagagaaactttttaatgatcatcaaattcttggaaagaaaaataagaaccgaaaaaatgaaatcaagcattttaaaggattaataactggagcaggagaagaatacagaaagtacaaaggtaataatgaatatcaagataattctactagctccaatttgagaagaaagttacatgttccaaatagttacattgagattcctcttagaggtttatctaaacttcaattattaacacttgagcaactttctgggattgatattaatacaagaagttcaacacaatttttacctagaattaaggaaattaatcatgaaaaaaacattaaagtatcagaatcagtacctattaatgaagatgataaaaattcttctatcaagaaaccaaaaagtatcttacataatagaaacagaaactatgtttaa

SEQ ID NO: 1893 - DNA, 216 bp, Cryptosporidium hominis
atgccacctttaaacgcttctaattccagctctaattcttcaatatatctctttgcacttctttcatcattttcacttatgaaagtactttccaaattattttgctttccaattccaatatttcttactcttaattcatttcctgaaactgttgagtcaactattctgcttattattccctattcaaacaaagaaagaagaaatgaaaggaattaa

SEQ ID NO: 1894 - DNA, 2904 bp, Cryptosporidium hominis
atgattcaagagtttgttaatcctttaggaattgagaataataatgggattattaatggtaatattgttaatagtggtactattagtagtaataataacaataacagtgataagaagaataaaagttcttttactcctattaatacaatggatgatatcatatatccaacaaatcttgaaggtgtattggaaaagatacttgaaattgagcctttagctttaaactttattatttctggtcgtggttataaatttctaaagatgattttaaagtcgaattattatcttggatatcacttcttaacaactttagtaactttttggacaggtggttccaaattccgtcaacattgtgatatgcatccaggaaacatccttacaagatttccctccagttggaaaaagtataaatgggagaaatacttaaaaagtgttttagatcacgtagatcagagatacttttctattattgatgttgatttttcttatgaaagtgaaatgaagattacaaatttggaagaagatattgagagacttcctgataaggacccatgtaatcatccttcagtaatagaaaataatagtcaagtatctaggaatgattatgagagaattatgtgtttcttttgtgattctcatatgtctcttgaaacatttactgaagtaatttcaaattcttatccttccaagacaatatattatgatctttcaacacattatgaagatattatgagaattcacaattatacaatgaattattgtgaaaaagcaaagaatatgataaatgaattaaaagaaaggggagaggatgatcttgcaacagggtttaagatgattcaaaacttaagaaaagtgatatggaattcaattcttggacttgagagatttgatacattttcggtttcaggtaatgaacttggaaataatgatttatttagtaggtttttattttcaggttctggaccaaatttagaatcttggttatcattacaaaaatcatcagaattaaagaataagaaggaattaataacaaggaatttaagaaggggagattcaataatggataatgagaactcgtatttatctaataatgatgatttaaaggaatcagttttagtagaaaagggtctttctttaccagtattcccagagagaataatgccaggaatgatttcatcaattccagagcagagtttaagcttttactgtactgcaatatcaacaagaaagcttttaaactctccatcattaaaatttacagatcttgtaaaaaaattattacaaagatcatcatctgagggatatataagaaagattcattttggatcaagttttgaagaatttgaatcaacaaaaagtaaattagaatctgtggagcattcaaaattagcatgtatggagaattatgaaaataaaaggattgtaatggaaatgataccattaatatattcaaaagctgatatggtttgtccgaaagatatttgtacaagtgttaaacattatgatatttttgaatcaatagtattagtttatagataccgtttgagtcacttaatttcaacagcttatcatttgggagatacttatagtaattttgaagaccaaatgttaagtattaaagtttggatggtagagagaaagaatgaaataggtaaggatggtttagatttaagcatagcagagaagaagttattgaaattaaatgaagaaaagataaattctatattagagctatatcacttttgtataagagatagattttacagttctttatcttatggtcaattaaaatgtaaaacaataccagaatttgaaaagtatggagaagattcgaatggactattgattttggaattatcatcaatttctgatagatcttcaagtaatatattatttccatggatttacaatagtgatttttcaatatttgaatcagaattttcatttaaagatgtgaatggtatttctgtgattggtattgtaagaccttttgatcaaggagaaggaatagagaataataatataaaggaaagaaaagtgtttatacataaaggaggtaaatttatttacaattataattcaagaatagatgaatataaggctcctccaagtattacaaacaagatttcagaaggacatgaacatttatacaggaatagttttattggatatgataagatggaaataaatagtttgacagtttttacattagatgaaggtaaaagaataagtttttattcttgggttaaagaaataatgaatgcaagtacaggtttttttcaagagaaagatttaggattgtcaggaataggtttttcttcaataaagaaaaattatcagattgagttaataattctagttggttttgttgtgaagacatttaagtcaatttggattccaaatccagaatgtaagcattatagtaagtttaagacagtttgtttcccaatgttttgtggtttgtcaagcaagaatattattttaaatgttggtgataacagaagaattagaggggtgaagtttttatttgggcaagatattaaagtaataaatgcatataatgatgttacaggtttcaatttcgaaggctcagaattacagttgaaagggaaatcaaagtctgagcttgaggagttagttagtctaagccatattttgccgcattattgttttggaaataatgatcaagttaatgatatgataacagttgcatcaactttagagtatttgactacagtaattgctacagacggtgctttggaccctttaaagttattttcttcaaatgttggcgatgtctattataggtactttaatatgacattggaggagattttaggtcaagtaaatagattttgcgatatattgcaagcttattcagggtcaaagagccgtgtatgttag

SEQ ID NO: 1895 - DNA, 723 bp, Cryptosporidium hominis
atggtgaagaaagagttaactgaaaatatccaaaactatctagcatgtcgtctatgtgaatttgatgtggttgtagtgaaaaaaaaagacgcaaaattccaccttgaagaagctcattctttatctattaacaatgaaataaaagatgaagaagaaataatattggaatcaatgaatagtcaagttctagaaagatgttatagtgaggaaaccttgagacaacttagaaatgatctttcagatgagaaacagaaagatttctacaatgaatcaggaaaagatttaagtatatttgaggcaacagaaactttaaaagttgcaatacttctttttttaactgaatttaagagaaaaatcgtggctttgaattatccaaaggtttatgttaaaaatttggagaatgaacaactaaataagtttcttttagcaaaccaaggagcttactattactattcattaattgatttagctaatattcaagatattacagttcaaatgcttttagcaagatcttgggattggtctattgaagaccaagatttaagaagagaaattgtaaacattagagatggaataatcgcaaatacattgcattgctctcattcggaagctctagaatgtattaatacaggaaaattactcctccttacaatgcacgaaagtgtcaagcaccttctgcttctttgttacttaactaaaaaggtaataaagaggcaagaataa

SEQ ID NO: 1896 - DNA, 999 bp, Cryptosporidium hominis
atgaattggataataggaaagggaggaaagctttctctgcatattatggttttggctttaatcttggtaattcagttaacacagtgtgtaaaatgtctaaaaataactgaattaaacgctcttttgccaggagaacgatataatttgtatacctcgttatcgaaaaaaagagcttcattcttggaattatatttaattgaagaggagaagaatgatgaggaaggaaaaccaaaagttaaagtagaaactgattgtatgttaagcgttttacaatacaaattggtagatttattgacaggagatcgtgaatttgatcagaatttggatacaattacagcaaaaaagtgtttaaggaaaagtttaactcagttgcagagcttttatgtacgattttttgatttaaaactaatttacaaaccaaactgttttgagagagcttgttttaagaaaccagagaaggttttctttgaaaatttggagaatcttgctctatctatgtattttttctttactgtaaataatttaataaaagaaaaaggtggttttgcaagagagttggctcttccacaggaattggaacataaaaatgaagcaatttctattttgaataatgtcaatcaacttcattcatataaagaaggcttaaaagtttgcatgaaatttaatatgttggacatcatgttatatccaagactaaacaataaaactctattatcagaatttaagattttctcttcaatactacgtattttgacagctagtgctgaaaaacatgttcgttcgtacaaatataacaaaaataattttgaaataaatgggaaaaaaaattatagcaagaagttgatttcaggtattaagaagattaggtcttcaatgaaactactttcctatgtaattctcactaaatactttatcattgcagacatttttaatttggaaatatatgaacagatttacaattctatcatcaatactaataccacttataatgcatattaa

SEQ ID NO: 1897 - DNA, 1938 bp, Cryptosporidium hominis
atgaatttggaaactaatttgttaaataagacaaaaatgcaagtaaagaaggtaaaactattattgattctattatcagtcttggtgatttttgaattttgtttaggaacagatttgacagcagatttggactcttattcagcagttacagctgatccaacaagtagcacaaaattattaaatttagtagcacaagaagcagttcctacacatggagggaatagatttatggatattggggatggattggccacaaaacacgttattgaaaaaatcaattcatatacgcctcaaaacttggaggtagcagaaaggtatgcagcaaatatggtagcaataagtaagctcagagaagaaatttacattgatactaaggaatattatgagtccattaaatcacaattagaagcagttccagaaagtaagaagcttaatgagatactgaagaattctgagttaaagatgaaaaaaacagagcaaaattatttggaatcaaaaaaagctgcagaaagatctcttgagatttatatgaaatttataagaccaacaactgagaatgttttgatcaaagcagaagcaactgaaggaaaaggcttgaagatagctcatgacgaattagcaaatatggaatcaatttcattgccagatatggatactagtggatatgagcctttggatgcagatgcatcattactaagtattgcagaaagtgtattacctccagaagaaacaaaagaaagtttgattaataaggctttagaaaagatttcagcaacaattgaggatgactttatgaataacaacgattcagatggaaaaggaaataaatctgataaaaagttagtaattgaagatttgggtaatggtgatgatgatgatgaagatgatgatattgaggaagatgaagacaatgatcaagatttcgatgttagggataagagtgtttcaaataaagaaacaaaagatgtttctattaataaatcagagacaatttcacaagttggtaaaagtgaagaaatctttggaagtacaataactagttctaatgatgaaaacaaaaatgataagattttgacatcttttccatcatcgatttctgcttcattcccatcagctgctgatccaacaataaaaaataagaaaattattatgattccaggagggactagtttaagtggtaaagttcctgagcattttcaatatattttcaggagaagttatttattagtttatattgcttcaatatttgttgaatcatatgtattaccacaattctttacagaaaatcctgcaatcaaattatattcattttttagaataaaaagaacatttatatctcacatattatttggcttggcaagtaaatatagaatcattttcaaagagttacagaggttaccttttatttacaaggattcagaacttaaagaaaaaattgaaaaagttgcatttgatttatcagccacaaatcttcttctccaaaatgctctatccgattctgaagaaggttacaaaaacgttgcaagtttattagtggagtttccattcaaagtaaaagaagttttttcaaagttttctgctcctattcgagttaattatccaaatattgattattcttttgtaatgagtggatcaatctattctgctccaaaaccattctttccagagctttccccatcagaaattgagaacttgaaactttttgataaagaactttcatcaaagcttgaagaatttgatattaaggaatctttaagtgatctaaaagaatctcagctatggattaaagattatgttttaagaaatgcagcctataggcattatcaatttgaaaagagtcataatattcgtccatactttgatttttctcaattcaatatctgtttagtacctcaagttgaagaatttttaaagtcatcgattaaaaagagtgattaa

SEQ ID NO: 1898 - DNA, 1800 bp, Cryptosporidium hominis
atgactatggacctcaattcaacattgaacagtactttaccaagaagtgtattaaatgaaggaacaaatgatgtattttggggtgaaaagttgaatattagatcaaaaaatgtcaagggagattatgaaatagattataattcaagatgtttctgggattttgatatgccaataccatttacagccacatctgtattaattaataatgttttaacttatgtttggattaattatgattcaaaattactctgtattcaaagaaaggattcccctattgaaaaaacagatttcaagtctaatgataatttaaagaatcaattaagccaaattaatcaattgaaagaatctatggctttaaataaaataagaagttttgatgatgatattgtaattgagagtgtgaataacactccaaattctgattcatgtattgaaattttgaatctaggtaatattcttggcgagaaaaataaagaaatcaagtattctagtgataatcacattaataacaaagtaaacactgttacaagaggatttatggataaaggaagattatccacaaattttgaccaagacaaacaagaggaaattgagacagaagcacataatattgtcaataaatggttaccgtttgacaaaagcttatatccagcttttggtgttttgacatatgatgatatccaaaatcttcatcctgtatatgcagtacctggcattttaaacggaactttttgtactagaggattttttattggatcaattataaatgtgcatgttgttggagactttgttgatgatattattgatgaatatgcaattggaatagaatctcagttattaattacctttgagggcggattaagtttaagaattaatactttttcccaaggagcagcgaactctcttaaggagaatttggaatcaattatcgataatttagaagaaaacatcttattatccatgagacaaagtataagcaatttaagtaaagaaagtaaaaaagaactaaatagtaaaagcaatctagtaactaatttggaagatactttattttcagttggagtaagccctcctgatttgatttctcgttgtgaacagttgactgaatatgagaaaacctctttcaaagatagctttataaaaagttttacaagattcaaccctctaattggaagacttcaatggaactcatcttctccaaggacatataggtggctttcatatactgcaagtacttctttatcacactttttaatattctatcttttgagttctataccaagaattaacaaggttgaaaatggaattttggttggttggattgcatattgtatattaaatatatcaaagataactttagatacagctatgggattttcctcagtattatatatcatgtcaataagacaacaagctgcttattcatattttagattatggtctatttggctcacttcaagcttttgtattctaattacaatagttttatcagttttaactattttacagtcagcaaagcctataaacaatattgaaacatcaagtggattcattctcaatgatattaattattccatttcaacatggatcgctggatttattgtcacttttctatcattattcctacagcctttggttctagctttgagttatagcattatattattactttctaagaaaacaagttcatttgatggacttgtggcattcttcaagatattcagtgacattcacgtcaaaaaaaatggacgaatgccagtgagacctgaatgtgttattaagatgcaatgtaaacattaa

SEQ ID NO: 1899 - DNA, 1065 bp, Cryptosporidium hominis
atggcagtttatgagtcaaaagcatatgcagctttgggcccttctcaagatttagtaccacataaatatgagataaagtcatacgaagcaaatgaagctaaaatcaaagttttatattgtggaatttgccacagtgatgttcatcaagtaaaaaatgaatggtttccaggaattttcccaatggtcccgggccacgaaattattggtattgttgaggaaattggagaaaatgttacaaaagtgaaagtgggtgattgcgtaggaataggatgtattgttgattcatgtatgagctgtaatgcctgtaaggatgggtatgaacaattttgtggaagcctttcactcacttataatggtcgctataaaaatggaatgaatacttatggaggatatggtacatatgttacttgtaacgagcacttcttacttaagatcccagaaaacttggataaagcagctgctgctccattgctctgtgctggagtcaccgtttattctccaatgattaggaacaagatgaacagaccgggattcaagttggctgtagttggattaggaggtctgggtcacatggctgtcaagtttggtgtcagcttcggatgtgaagttgctgtaatcactcgttcagaaagtaaaaaagaatatgcccttgctatgggagccaaacattttattaaatttgacgatccagaagcacttgagaagttcagtggatacttcgatggtattattgatactgtttctggaaaaaggtcagtggaaaacctattgagattgctctcttaccacggagtcatggcatgtgttggagctcctcctgctggtgaaacttccgaattcaattcattttcagtaatatttggtgaaaaaaccatcacaggtggtaatattggtaatattgaaatcactcaacaaatgcttaactactgtggtgagcacaatattacatctactattgaactaattaagctaaaccaagtcaatgaggcctacgaaaaaatgcttaggagcgatgttaaatttaggtttgtaattgatgtcgctaactctcaagatcaagtttga

SEQ ID NO: 1900 - DNA, 3819 bp, Cryptosporidium hominis
atgccaattgaaaaaaaagaagttttcaaagccatattcaaatccaaggaaagaaagccaataaaggaagagaaaaaaaaacaaataaatagagataaatttatcaagaataatgtaaggtatattgctccaaataatgaaaaggtcaaattaaagattgaaaagatggagaaggatttaaagagggcaaaaaacaaaacaaaactgatgagattttttgataataaagcaatttcaagatcaagtccattagatagccggcttggaacttactatgaatttgaaaatgaagtaaaaatgagtattcttacgacagaaggaactgaagttagtagcattaccttaaatttagaaattacggctgaaaatattaaacatgaaaagataccagggctttaccactttatgattcaaatacttttttctgagaaatttcttgaaattgagtataattggaatccacttgaaccatcatcttttagagaatatgttaaagatataggaggaaaaattaatatccaatatttaccttcttgtattatgataagtgttggatgtccttcaaaacactatattaagatgttggaacatttctttaatacaatttatttgaaaaataaaggaaaaccaagaaagttaattttaaggaaaagttcgattgaggaggcaatacaaaatatgaatttgaattatgttgaatatatccaagatgaatcttatttacgttttgaaattctgagagaatttattaagaataatgtcaaatcctttcaaagaacaacaaaccacaaaactattgatatacttaaattgtggtcaattggttcagaatccacaatattatctttaattaaagaagggaatttggaggtagaaataatgcaagcttataatcgaattatcagcaataaaccagtaattgttgctttccattcaaacatttccaatgaaaaactttttaaaatattgaatgattttaatattccaattttgcaagaaaatgagaaaattaaagataataccaataaaaccataggagataaatccttctttaagcaatcgaaatctaagaataataagaaccaaaataataattattctgagctacctcctgtttcagtagcagatttgaaaccttcaataatagtaaattctccaattcatgattccataaatagtaatggagagattgaaattcaatggattattcctgctttctattcatctctttcgtcatcaaattcaaaaccactaaaagttatttcttatttattagaatccggaagtcttgtgaattttttgaataaaagaaaacttatcaaatcagttagtagtggagaagtatactttgcagctcactcatcacaaaagcttggatttactatatattctgttattattaaactttcagaaaagtttgaatctgaaattgacccaaaatcaccattcattcaatttattgttcaatccatatttgcttactttaattcattaataaaacaaattgaagatagtttaaataacttgaatattaaatccacaaaaaaagatattttagagaataaagaaataaatcgaccatttcttgccatatgtgatatactccaaattgaaaactacatttcaaactcaaattaccaaatgaatagtgaaagagaaaactatattgattactttgatcgtaattttgaaaccacagaaattgccatacaaaacttaaaatcccataatccaagcgaaattctggttggtaataaccgtttttattcaaaaattaaagtaattttgaaatatgtaaaattcactcttgaaaatgcacttaaaccttcaaattttattatttttattacttcaaaagcctttttcaataataataatgagtataatttcaaaaagctcaagcttctattgccagacccacctacaattaattattttgagctcaaatttgagccgaacttcctcaatttactgaaagatcctgaaaacttgaagaaatatgtcatcaaaatggatccattaagacaagtaatacttaagaacgaaataaaagatgaatatgatttcctgatttctccgcatcatcttttgaagaattcagaattaacttttttagatggagaatttgaatggagctctttttcaaaccaaattgaagatgataatccaatacaaggcacaactccttatatttcagaaccgaaaatcatatcacaagatgagaataataaattcttaatttactactctcaaatcaattatccagaaaaatccagtgaaattcttcaaagctctctatcttctgctattattagatggtatgatagtattgattactccaaacttttactaaataaaggaaaacaaggaaatctaacaaaaaattcagtactcgcttcctttatttcaagaattatctttgctatatggataacaacgaccttatctctgaactttaattcatatagaaaaattggtgcaaccattaacttccagccttgccatcattttggcacagctttatcgacaaattgtgtacaattacaagtaacatctccatcacccatgtttccagaatacttgaaagaggttcttaaatctattcgaactgtctctatgctgaatatatcgaaagaactctctgaaaaggttaaagtggatgcaattaaggaaattaatcaatcaatattagcgaatagtgcaaccaattattgtactgataagatcaaacaattgtttcttcctgagatatttacacatgaagaagtgctttctgagataaaagagttagaaagtgatgagataattattcttttggacaaaaaacttgatattaaaaatccatatatcaatgtaattggattaattactcatattgatgaaccaaatgttagttttgatattgtaaaagagtcccttatttcaaatacatgctttaatgactttaaatactttcctgattcactttacacgaagaatacttccggagaaatcaaatttccccatcctttattagaagaaattgattcatcaagaacaagattattattttatgccaacaaggagaacaaaaataaccgatcaaataaaaatgaaaattttgaaatgttaatttccactctttggatttcagcctctaaaaatgatatccaacaaaagtcaatgttaatacttcttgttcgtctcattcaatttacttttaaaaacatttatctcccaacttcacttttggttgataaatctcaaagaaagaatattaacttactcgtgataccttctcctttccttaaaaaacttgggctacagttaattcttgaagtttctgataataaagtcttctctagtaacgacataacgacttcaattttactattagacttcctttcatttattgaaaattccgaattcactgaattcaactacaatcaagatgataaaccctattacaaatcaaaccacttgattgatcagtctttgagtctcaattttaaacaaatcaaaactgaagtcatcctccaattattactctctcaaactcaaattgtagcccaatcttcctatctttttagcagaattgtcgaatattttgagtcagaaagcttttctccttcgaatcaaaacacgagtagaatttctaacgaaaaagaacagataaacagaattatcaaaagtaccagtttaaattctgccatatcatttgttaaatccattatttccaataactcaatgattttagttgaattaaacactcaaaatgacaactcaaataatccagaaaatgaaatcatgcttaaatacgatttcaaacttgctaattaa

SEQ ID NO: 1901 - DNA, 2229 bp, Cryptosporidium hominis
atgaattcaagaatgtttgccactcctagaccacgtccacagtttgcaaattcatcagcacttggtggtctagaatttgaccagaagcaaatttcatcaacatctactactactacaccttcaacatcgtcctcaaattccatgtcaacgccttgcatagcgtccataattgatggaacctctacgtttggcacagatcaaaactactttgatgaaatttctagtatgatcgataattctcacctagaaactccccaaacttgtagacttggaaatgcttcccatattcttagaatccctaaacaaggtgtcggaaacatgggatgtggcaccatacacggcattttaggccaaacaaactgtcctatggatatcagcaataaggtactcttagccaaagagcaacactctagtgtgaaagagcatcaaccaaatgggaatcactcaactggagctttgggtggagcagcaatgatgagtatattttcttctccgaagtcattcgtctgtactctttcttctactagatcaacttcggccccatacactcctacagttgtagatgagtgttcacctccatgtagcctcccagcaccaccaggatctgacccctttactatttcagggtttgggcctgaatctacatctactgatccaatatcaggtgacttttcagccccacttcttaattacctcaatgatggactcagctccgattcctgggggagcttcctcccctactcaaagatcaccgattactgctttgaaaactctccggataatgttatcctaaacggtaatggcaattgcagaggtagtagcagtagtagtagtagtagcagcaccaccaccagcggtggtaatgtcaacagtaataacagtagtaataataacaacgctagtaacagcaacaataatagcaataacaatatcaacatcaataatggccatggaggctctgtaacttccacacttccttcaggcatttgcagtggcatcaaccctagtaaatgggggggaagcgttttacctaaatcaaatggcgtcaccacacctggaactggaagcaaacacactacaagcacagctgccactaccgtcaccgccactaccaccactaccactacctcatcttccccctcttctgttatcttatcatctaaagcaaatgaactcctggattatatactcatgagtatcatcaaggataatggacataacggaaatgttttcgagcaagcatcccaaatgctaagctccactgctgctctactagcaaccagattcaacaaggaggtcccgaacttccaatccaataataatcaccaccactctacgataccatctaattcatcgaattctaactctggaaatggaaactggagccccaccacacttggtgtaggaggacccaactttgccgccccaactatgcttgcacaccctgacgagttcaaaaatccttcatcttttctcaaaatctatggtgacccactctgtggaaaacaaccctctaatgggagccagaacccgcctctaatgggaactttgagcggggcgccgcatgaatttcaggcgggagcgaatggggcgggctttgcgaatgccaaccccatgaaagggcagaatgggaattgggcatgttgcaaatgcagtaatgtcaactttccacgacgctttaggtgcttcaaatgcggagagtaccgagatgaaattggggataagatcgtcgcagagtatgccaagcacgtgtatttacatcatctcaaggcctataggtcttttaataatgggaatacaagtggcaactcgggtagcagcagtactggtaataataataataataataataataataataacagtacttctactaatactagttcccagtcaaccttgggttcaggttctggtcgaaatggaatggtttcaaatattcaatccagctttagtgaaggcttacaacctgtatttttccagagaagtaatagcaatagtggcttcattgccacaaacctaccttcgaatctaaactacaacgactccaatggaggacatcttaataactctaagcaattgaataaccaaatttgtcccgatggaattaataacagtacttgctctaccagctcctctacaagcgtgtctccagtgggttcagcctcaacatcatgccaggcaacaaataagaagcaatcctcctcgaaggttatgtcagttaatttatag

SEQ ID NO: 1902 - DNA, 804 bp, Cryptosporidium hominis
atggaagagaaacatattttgaaaccaagaaatgatggtgagagtttgaaaatagcagaaggaatattacgccgtagaaagattgttgacactgatagaagacttaaatatagagaagaaaggagaaagattaaaaaagacttgcataagccagaaattaaaacattacagagaattcttaaaaaatctaggaacaatattcttgataagagaagacttaagaataaggataagaagccatatctaactccaaaaaagactaatggtaggcttatagtattggtggtaagaaatagtcgattttgtggatcactagaatcaaacagaaaacttcgtgatttaggactggtgaacaaattttctgccgtaattttgagtcatactgatgaaacaattcgtgtgttgagggaagtaaagccctatgttttttatggatttcctaatttaaatttattaaagactctagtttttaaaaaaggagcatttactcatcaaaatgtccaatcaaaaggtcaaagtagaacaaaattatctgaaaaacaagataaagttcttcttactgataataatattgtagaagatagacttggtgaaattggtgtcttatgtactgaagatattgttactgggctatggaatggttgtgagactcaacaggataaggaaatatttgaagctattacaagcaatcttgctccttttcagctctgtaatttaaagagagcggaaggattcgatgctaagaaatttgagagtggatttcttggaaaaagtatcaatgaaaaaatcagcaaaattatttag

SEQ ID NO: 1903 - DNA, 1980 bp, Cryptosporidium hominis
atggaaaacaagaatgaaaaaacaaccaagaaaaccttgaaaaagggatctgaccctttggataaggaatttaaaacattatatagtaacctacttcaaacagttggaaaagacacagaaaaatcggtaaaagagaaggaaactcaagaagttattgaaaaattatggaacttaattaaagctaaatttttgcagatttgtcgcaaacctgtgtattcaagaggaattcaatctatcctcaaatggggttcaaatacatatagaaaagccatctttgaaaagatgaagaactatttagtggagctttcaattgatagccattccagtaagatggttgaaaaaatgtataattatggttctccagaaatcagaaaaaccataagagatgaactacttgctagatttgaccaacttggttattcaaaatatggatcaaaagtctttgggcatgtattcagtgaaaaaagaaatccaagtgaatcctgggaaagtattaagaatgaaatattattccgaatcttaagtacaaaattggctcagttttataccacaaatggaggagattctaaatcaaagaaccgttcttttgtaactttcttttcaaatttagaacatcaaaatgcaaaaatgagtgttttagagaattctgttgtaaatattcaaaaatttgttgatggagaattattggatagaccatttgtacatcttttaatctggaactatattaaatgttgtatatctttttaccaattagatgatcaagaacaaaaaaatgatgaagttactataaaaaagatccctattagtaaccaatatttatctttagaaaagatatctcaagaagggaaaaattgtttgacttctttattagatcagattattgaaggatcctatagtcttttaagtactaaagaaggtgttgattctttggtagtattacttggatttgcaaaagctcaacaaagaaagaaattacttaaaaatatcaagaaagatataatggatttagccatgaatcctgttgattatatattattacttagattaatttctacaactgatgatacaaaaatactaaatgaaattatttggaattcatttatttctgaaggagaattaaacagacagattttaatgaattctttctctgttaagttaatcacatacttattagttcctcaagtaagccttagaaactttactcaatatgaatactgggctttaagcttggaatcctttacatctttaaaatcaacgcaagtgagaattcaagaaatgaataaaatatgtttgcctgctttagaaaatcttttatttaattcaaaagatcaagaatctatcctggagaatcttattctaaatgttagtggtaaagagcttattttagccctgatacaatattatttagataataatgaaatatctgaccagaaatatcataataaagtacttgaacttatgaatgatttgctttctaaactgattactaacaattaccaccttttaaaagataatactggtcacagagcttttgtttccattctaaaattaattaacgagctaccaccaaatatttcatctgaatttgacccttttagaaatactattgtagttatatttgaaaagtcacttttggaaatgctatcttccagagctgtttttattttagttgaaatgattggacaaaatttccaaacaaagaatttcaaatcatgtacaatgtggagagtaagagttaaagaactaattaaggatataattcaagattgtatttctaatctcaaagaatcaaacaatagcacaacaggagttgaattagttgccaaatacacaaatattaatgttaatgtacaagataattcgtttatagaaaatgcaaataataacaagaaaccaaataaaagacaaaaaacaactcaaatttcagattctttagaattttcaaattgccctaaacacaagaaaaaaattcacctatga

SEQ ID NO: 1904 - DNA, 1095 bp, Cryptosporidium hominis
atgatgtacaagaatatgccagtagatcttgtacttgtgagacatggacaaagtgaaggtaacttagctcaaaggttagcaaggcaaggggaattacatacatggactggagagtttcgacgtagacacaacagtcaatatagactaactgatagaggaagagcacaagcgagaatagctggagaatatattaagaacaatattgggtttacttttgataaatgttttacttccgaatatgttagagcaatggaaactgcagcaatgttaggtctaccaaatgcattatggaatacagatatatacttaagagagagagatagaggagtattggcaaataaaactcatcaagaaagagtgttattgcatccagatgaaatggtcaggaagcagagaaacgcattttattggcaaccctcaggaggagaatctttagcgaatttgtgccttagaattgaaagagtactagataatttgagtcaaaattgtggaggattaagagttataatagtttgccatggaggagtaattaaaagttttagagcattgcttgagagtgagagaggggatgtaaatactaagataaacaaaattaataattgtcagattgtttggtatactagaagagatccagaaaaaggttcaatagcgaattcttataattgggtaaaatctgtatgtccatgggatctttccttatcatcaaacacttggaaacatattcatagaccaacttttaccaatgaggacttattacaaatcattcaaaaagttccccaattggtaaatgctcctgtattagatattatggaggattctgataactcaagcccgatcgaattttctccaaatcatgaaggaaataatagttcagttaagaaaaacacaacagaaacaaacgaagaactttgtgaacatagttttaatgcttctactaatggctccaaacaaaatatttctaatagtgattatacagatgaagaaatactggatgattcagatatacaagaagacgacgatctcatcgattttaatcctcaaatttttgttagtaaatattttaaagattacaatactcaagataatatagactaa

SEQ ID NO: 1905 - DNA, 1575 bp, Cryptosporidium hominis
atggtaaatccaatacatccagaatgcattccaatgtcggaatttaatgaatcgttaaaatttgaattttcagtcttaaaagacaaatatgacgaaagcttaaaaggggattgtctcgtattatgcgttccaagtaaagatattatgcaaagtataccttcattttacgaatctttagacactattttaaatggaatacttaaagatattatagaaacggcaaatcaagaatcatctcttaaagatgaaaataatacaattcatgtgaatttgcctccaaaatacccgtttaagtatttgatgttaatatcatttgatgaaaataagaatacaagtccagtatttttcaataaaatgataactcaaatgaatgaattccagaaaaaaaataagaatattcaaagttttacagttgttcttggctttgataatgtggtatcttcagatgttatgtatttctgtactcagtttccaattgataacacaattgaaaagagatttaaaggaaacattgtaggctctgagccaaagaaaccaacaaagaagattgaaagaatccattttgttcttaggtcagaagatactataaaggactgtaatagtagagttttggatgctcaatttgtttctaggggtttattattcgcaagagatcttacatctgctcctccaaattattgtgacccagtcaatatggcaaaagaagttattagtatggcaaaatctgttgggcttgaaggaaagattcttcaaacaaaagaatgcgaagaactcaagatgggagcttttctagctgttgcacagggtagcaagtctccagctcaatttgtccatcttacttataaaccaaagggggagattaaaaaaagaattgccttagtaggtaagggaattactatggatactggtggatacaatattaagcatcaaatgattcattttatgaagggagatatgggaggtgctgctgctgtttttggcacagctctctcagttggactaattaagccagagaatattgaagttcatttcatttccgcaatatgtgataatttggtctccagggatgcttatttaccagggtgtattatcactgcctctaatggaaaaaccattgaagttggtaatactgacgcagagggaagactcactctagctgatgcccttgtctatgcttgtaacctcaaagtcgagactgtcatagatttggctacattgacaggggctaactataagctctttgagggcagatatgcttctgttcttggaaataatgacgaattattccagatgattcaaacatgcggcaaaactgtttatgagaaattctggcagttacctttggacccagaatttcaagaaatggtcaaatctgaaattgctgacctaaataatacttctgaaggaaaggccccaatttctacctcagctgcctttttgtgcgagtttgtagacaagaatgtgaaatatgcccacattgatattgctggttgttctggaatgggaacctttggtaatggctttggcgtcaagactttagtcactattattaaagagctttcctcaaaatgttga

SEQ ID NO: 1906 - DNA, 1089 bp, Cryptosporidium hominis
atgcattttaaaggagatatatggaaagttatatttaagcacagaatgctatttgtttctttcctagttctggggttggctttagttacatatatattgataggaagttataggataaagtctgaaccagatgatgataaagttattaggcaggtattttatagtcaaaattatgaaattagcaaaggggtagataaggaaagttggaatactattggtggaaatatattgaaggattcagaattgtatttatcgatagtaattccagcttttaatgaagaggatcgaattttgaagaatttaagttcaatggtctattatatggagagtaggaatagagaggatccaaagtttatatatgaaataatcttggtgaatgatggtgggaatgatgataccttgaaaatttgtgaggatttttggagacaaaaaatccaaaataaagaaataattggaggcagaatgcgtttattgtctagtcttgtaaacaaaggaaaaggatatgctgtcaaaattggggttatggcaagcctcgggaaatatatattaatggcagatgcagatggagcaactaaaattgattgcttctctaaaatggaggacataattttaagtaaagacgaacaacaacagattatttttgggtctagaaatataaatgctttatcagaagacaacgtttctaatattgagagagcttggtatcgtcagattttgaatacagctttccataagatcatgaaagttattatcaatacaaatttaaatgatactcaatgtgggtttaagctcttctcaaggagattagccagagtaattttcccttccttgcatattaaaagatgggcttttgatattgaaattgtaatcatcgcccaaattcttaatcttgagattcaaccagtcagtgttgattggaaagaagtccaaggttcaaagttgtccgtactttcggactccataaaaatgctcttggatatcctaatccttaaatcattttatattcttcacatatggaaagtcaaagatcctagtctattgggtaggccctgcgaaaaaccagtacctgcctacaggaaaactagctaa

SEQ ID NO: 1907 - DNA, 243 bp, Cryptosporidium hominis
atgaagaaaaaaaaaaacgatttaattacgagcatatataataatattcaaagcatagctagtcagtccaaaccagtcaaattacgtttaaatacttcaaaaagtagcaatagcagtaataaaagttggaaagaatggttcataccaaaacattccatttggtgcttattttattttttctatcaaagatatcccaaatatactgtgatatcaactgttcaaggcaagtctccagaagagtaa

SEQ ID NO: 1908 - DNA, 402 bp, Cryptosporidium hominis
atgggaaagtctcacccatctctccaaagcggggaattctattgtgcagaaaagctctgcacaatttttggggaatgtggggagcccgccagggagcgggcatgcagttctgctgcgcaggatgaaagccttttggatttttgcaggaaaacagtaaagagttgtttttcagaagataataaagattccaaacttattggaatagaactgaatcagaaattatgtaataaggaaagaattctagaggtcaacaggtgtattgagaagaaggttcagcagagcaatacaaatattattgaattcctcttccaccatttctcaaaggctctattgattgttattatgttatccacgttttttgtatcatataaaattaatttgcatgttaataaaattaaataa

SEQ ID NO: 1909 - DNA, 1107 bp, Cryptosporidium hominis
atggaagctcgagcaattcaaatatataaaccggtaaataagaatgaggtacggttagtctacagaataaagaattccagtgtttcaggggaaaatgggaggcaccaaaagtcctactcctttaacaaatacggagaagagaatgcatggaatatggcaagagatgcattcaaatttattaataataataataaactaccttttgactttagtgacccatggaagatgaaacttataaataagagaggtcgaaaaagcttaagctataatggatcttcgattaatgagcaaaactcgccatcagtaacaagtaataaaagacttgcttcgcttaagaatgaattatatagtgaaaatttgatagaaagaaatgttacagcaagtaacaataatgctgcaaatcattcgcctccatccatttctagtgtcaaatactcttcattgaaaggccattataataatattgactcgtcatcttccccagtatctccagaggtttcaccaaattttgtattcaaatttgaaaataacttttcagacttagatatgaaaagtaaccataaggactaccatctaccctcttcttcttacctatatttgcttgcaacagcagcaacagaaatctttgagaaacaagaagtagcaagtgctgagaagaatgtcgtggctcttgataacagtaatgattttctacaggagagcaacgatgacttgaaaaaggctgctacatctcaaagtaaagtagagaatgtaggttttgatacttcattgatacatcaagtaatacaatttaatcatcagaatcagagtaaaagcacaaatcttaaccaatcatggtcttccaccgcatcatcatcatcccctacattatcccaagtactcttgccagaaataccaaagataatgttaaacccagattcatactttaagttagcaaatatgccatattataatgtaccactatactttaacaaccaaccaagcaaccaatatcatccggcattaattaataatatcaaccagaatatcatgcttttagatccatcattgtcgtacttgtcaagtaaaaataatagtaatcttagtacaatccagattccaaagtga

SEQ ID NO: 1910 - DNA, 1329 bp, Cryptosporidium hominis
atgggaaggataagaaaattatctgatgaagttatatctcgaattgcagctggtgaggtagttgtgagcccatctcatgcactgaaggaactattggaaaatagcttggatgcaggttcaaggaatattgtattacaattaagaaaaggaggaattcaaagtttgcagatatcagatgacggctccgggatagataagaatgactttccaatgttgtgtgagaggtttgctactagtaaattaacgtcaatgaaggatattcaatctttgaaaacttttggatttagaggggaagcattatcaagtataagttttgtatctcaattaagtataacgtctaagacagaaatgtcagattgtgcatacagagcatcattttcagatgggaagatgatttcagaattggaagaggtagctttggcaaaaagaggaacaattgtccagattaatgatctattttataatatgccatcaaggcaaagagcaatgggttcagcttcagacgaatatgctagatgtttagacttagttcagaagtattgtatagagtttcctgaagtatcttttaatgtgagaaaatttggtcaaaatacgaatgatttgaggacaaatggtggagtaaaaacgagaaagaatgtaataggtttgctatatggctcaaatgtggttaaagagttaatacagtttacagtttcaagggattcagagagaccaagggattcaaataaagaaaaaagtaatgaattaagtttaaaaattcctgatttttcagcagagctgtatatttcgggattgggatataatccaaagcaaaacaccctgattatatttattaatggaaggttagtaaagaataatgcaatcaaacaggcaatagagacagcttatcagtatacaaagtcaaattattgggcatttgtatcagtaagaataccttccgaaacaatagatccaaatattcatccaacaaagaatttggtttatattagtcacgaagctttaatttcagatgcaatacaaaggaaagtaatgtgttctcttcaggcttctaattattcaagaaatatggtcttggaaaggaaaccacgacttgaacttaaggattattccagttctggtgagacaaaatcaaactatatggactccacaaaaaatgtaacaagagtcagaactgattcaaaacaactagttttgcaagagtattcatctaatagtatatcaaaacattcaaatatttctctaattactatagaaagtaaacaagataattccaatggtattgctaagaatgttcaatgttcttcaattaagcccaatggaggcgaagaa

SEQ ID NO: 1911 - DNA, 690 bp, Cryptosporidium hominis
atgcagatttttgttaagactttgacaggaaagactatcactttggaagttgaaccttcagatacaattgagaatgttaaggcaaagattcaggataaggaaggaatcccacctgatcaacaacgtttgatctttgcaggaaaacaattagaggatggtagaactctctctgattacaacattcaaaaagagtccactttacacttagtcttgagacttagaggtggtatgcagatttttgtcaagactttgacaggaaagactatcactttggaagttgaaccttcagatacaattgagaatgttaaggcaaagattcaagataaggagggaatcccacctgatcaacaacgtttgatctttgcaggaaaacaattagaggatggtagaactctctctgactacaacattcaaaaagagtctactttacatttagtattgaggctcagaggtggtatgcagattttcgttaagactttgacaggaaagactatcactttggaagttgaaccttcagatacaattgagaatgttaaggcaaagattcaggataaggaaggaatcccacctgatcaacaacgtttgatctttgcaggaaaacaattagaggatggtagaactctctctgattacaacattcaaaaagagtccactttacacttagtcttgagacttagaggcggaatgtaa

SEQ ID NO: 1912 - DNA, 3354 bp, Cryptosporidium hominis
atggaaaatgatacgaaaatatgtggagttcaaccattaagctcactaaagcctattaactctgttttggcaattaaacttcgaaatattcatcttattttagcaggatttggaaatgagctgagaatatactcccgaaactttgaaacaatctacgatcaattagtttaccacgactctcataatatttatgggataaaatatggtgaattagatgatttagttgctatatatggtcttaacaaagttgtttggtgtcgtatacatattcaggaatcacaacaagatatctccgactcaaaatgtcagaaaattcattctatcaaggttggagaattgaacaagtatgatcttttccttgaatcttgtaattatcttaaaggaaaatggctaatcggaagttctactggcaaaataaggctttgtaaatttgaacaacaaacccaagattatatcattcctaagattcaaaatcttatcatccctcaatctccaactctatattgcatgaaatttcatatacttactgattctgaagaagtcatgattgtatcaggatctgctttctctactgtcaatgtttcaatattagccattaataaagaaagtattattcaggaacaaatccttaaagctcataatggagttgtatatgatctcaggattataggagatggagctgggattctatcttcatctgatgacagaaagattattgtttggatgaaagaagaaaattgtttagaacttactaaaaatactcaaaagttccaattctatcctaaatatatactaattggacatgaggccattatatggtccatagatactttatgggaaaaaaaactaatagcatctatttctgaagatggagatctatttatttggaatctaaaagaagttaaatcaaaatcttatgttaatataaatggtaatgatatacaatgtattaatggtcctaattcaaaagtatcaaaagctcatcaaggaagaggaggaagagtcattcattctatgtctcaattattggaaaataataaaaattattggtcttttattactggaggagaaggaggggatttaaaagtctggaaattttttataggatatgaacaaattaatatcgaagatgacaaatctgagttaacttgtgaagatgattattttgcattttcagaatcgaaaatctctccagatataaataaccaactggaaactaatgattcaaattctatttggtaccaaggagcccatttgatagatcaatctaaactgattggagttactagacaagggattctaagcattgggatgaaatgttctcaaggttcatcacatgagtggaaaagtattaaaattcatgatttaggagatttggtgtattcaatgtcttctttagataacggacatttagtacttggatcttccagagggaaaattatacatggacttataaatttaattacaaaggaaatggaagttaaaaatgagcttttcatgccaaattggacagaaaatattacttttgtccagtattttactattgtagagaatgaactttatcttgcattttcttcatgttctaaaggatttcttggagcttcagtattccagaaaattgatcataattcagaaggtgaatccactaatccatggattacgtcattagtaccaataaaaggaaccccaaaatatggagaattaaaatgtttggatattttcaagtataataataatactcaaggtaaaatagtatgtggaacagtaagtggaaatatatttatattgaatttcaaagttttaagaaaagaggttaatcaagatggactggggattagctcagtttctaatggattagatactattatagaaatttggttatctaatgtattaagtgcttctcataaggggaatgtctcaagtcttaactggattaatgattcgaacgataatttggtatttctatcaacaggtcaagatggtaagattaatcagtattcagtgaaagatgaagctacattagaatggtcacatagatggaattcccagtgtgaatatatagttagatgttttaagttaaataacagtaattggttaataataggagcagtaaaacatgagttattcttttacttagctaaggacaatgttacatctactccaatattattattaacacataaatttggaggaattaaacgttcattccaaattaatattagaaattataatgataaggatcttttggaagtgatttggtgtcagaagccatcaattaggattgatcagttgaatattagaaagattttagaaagtgaagacttttcaaataatttccttaatccattattaatgacaaagtgtttaaacgtgaatcccccttcaaggctaattcattcttcagcttggatgaataataatatagtaatttttggaggggaggaccatattgtaagattttatgatgtatcaaacccctcaaaaatgtgtttaatacattcaattaggcttttagatcctattagaaggcttaaagtggtaaatataagagaaaatgttcaaattttaatgataacaggtgggagacaaatgtttcatatgtttgagattagaaaagaaaggaatgagagtgatattgggataaagacaattttttcgaataataatgacaagaaacagaataattgtagatttatctcactagattatgtaattgaaccaatttcaatgggtgaaaattataagttgattgtaatggtaggttcgagtaaaggagaaattttgatattttctttccaattattagatttgggagaaaagttggaattgaatttgaagaaaattgttacttttggtttaccttttgtacctttttcaataagagcggaaaatgattcaggagagattctggtacttgtggggctttcaaatgggagtattaaggtactcaagagtagaaatttaggaatatctataaatgattttaatatagatttagaattcaagtttgagataaaagctcacaattctggagtaaattctgtaatactattggatggggaaaagaaagatttcagattaattgcgtcatctggacatgaccaaaagatttcaatttcaagaataattacagacaagaaaaaagaagatagtattatagtggaaacattattttcagtttcgaatgctcatttttcttctattagagacctttgctatgatccaataaaaagaattctatattcaatttcatgggaccaaatacttaattttaatagattcgatgaactaatgctaaattttgtagaaacaaggaagtttccaatttctatctgggatccaagtaagttttaa

SEQ ID NO: 1913 - DNA, 2700 bp, Cryptosporidium hominis
atggctctcaaattttccacagtttcgttggcatttgctgcgtcactgtttacagtgcaagctgtaataatgtacctttggatgtatcaagatactttcttatttttaatgtttttaataggagacataccattactaatgaactttttgctcagaagacacgagtcaaatagtgctatttctggaggtcttcaatggttttggtatagtttgatattaacccttaaaatggtttttttagtttggcacaaatcatttgatacccatgcaaatacaacgtttatagatagattaccatatacactgtttccttcttcaattatcccaacaatattattcattacaccagcaatttatattctcctgtctttcagagctgctccacaattatatggctcacctatttatgtgctttcaacggaaagcttattacactcagatttggttacacatgtcctcttagacttgattgatatacttgttcaaatgcaacatgagcagtacccagcaagtttattaatacattcaacttggatttatatgtactcaggtattgttttaactttggtattatttttccatggtttatcatttccaacaagtggaggagaaccaactatttctcaaaggcagggcggggatgtttatatagtaagaaagcacgcagctttggttggtatatttcttgttgacattcctctattgatccttagaacatatatttggcttcattttccagtatttccagggtttaatccatggattatgaagaacatattgttcatcccattacaaattgtaaggttaaaccaatgcaggcttgctgagaaggaaagatctcataaatcccaaagagaaagcttcttctcaagcattgtaagtaaagatgaagcaagaagtggttcgattattaaaagaactattcttccatataattgtcaacagcctcaggtaacacatagtaagcgttctgaaaccagaaataatacaatggagcttcctttgattcaaaataaagatgattttagcgatcatttaaatttgagctcagataacattagctcgagcttaaataataattcatcccaatttaaaaataatttcccatctaaaaatgaaggttctagtatgcaaaatattggtagcaataatttttcaactggaaatatacagaaatcctttaatatgagtattagacaaagaatcccaaataacgacgaaaccagttaccaagaaaatgcttcaggacaattttctcaaaatctttcaaataggaatgaccattcgagtaaagaagttgattctacaattaaaagaaactttgaccacataattaaagatattaattcaaccagaaaaattccagctcaaagtttttctcttgggacaattttaaagcagatcattttcatgttccaaagaagtggccaatcttcatatttatcttcaattctcgataacaccttgaatgtaactcaattccaaaatatcaggctttctcttgcacttataatccctctaatttcccaaattgcactttctgtggtatgtagaacaccagaacaaggtggaatggaagttcaatgtaatttgaactggtttttcccaaatttaactgaagaaggaggattttataaaatgaaatgcaatgcaacttatatttcatttatgtgtattaactttgtctcatacaacctattgtggtttggaatgacaaaatactttgaagtcttttgtggggcaatttaccaacttgtaatctttagctcctatttctttgtagttcacagcataaggaatgcaaagtttgttgatccttttctttctggggtcaatatggatattgggaatattctagttttactttgcgtttgtcccgcagtccttaccctactattcaattatttccctctatctagtgcctttctcggaagaaaacatctcaggcttgcaactccattttcaaaaaaacaatggattgtaaataaaattcctgttaacactgagcaaaagaaccaagaaatcgaaattaacaagattccaaacgaaagtaaaagttccagagatgatgaagtcggctatcttaacattggatcttgtttgcttcttttaaattgcagatttggaattgccccagtaagcatgaacgagcttctaattggtcctgatacaatcaaaggaatcagactcattgaccttctattgtctactttctatagagacgttttattcattttcgttaccagaggcattttacttacactttgttttacatgggcatctctcggagtatttgtttcgcatatagctttcatgattttctatgggattacttcccatactattaggcttcttgcactcagaagatttgaactcaaaatcttattccagaagattcttagagatattgttaaagaagataccatcatcccaaatttctccagccagtcttcaattattctttccaacttcaaccaattatatagaaatgaagaatggaaaaactctagtcttcaacagtcattctttaaagacaaacaagcttctattcaacacaatgaactcttgcaaattattaaccaaatctccctcccctacatttctcacaacaatataatcaagaaatactcttcttcaggatttttctcttctcctgggaatattttacttccatatactattggaactattcctctatag

SEQ ID NO: 1914 - DNA, 210 bp, Cryptosporidium hominis
atggaaaagatatttgatacattgagtgaaatgtctagattcagtctttatgaaggatatacctgggacaatcttgaagtaacctcgaaaattaactctgatatagaaaatgctgattcaaaaaataccaatagtggtgaggaagaaagcttgggtacgtttattctttttctcttttgcgtttttgttaaactaaattactttaattaa

SEQ ID NO: 1915 - DNA, 885 bp, Cryptosporidium hominis
atggaaaagtatcagaaattggaaaaggttggagaggggacttacggggtggtttacaaagccaaggatagtcagggccgaattgtagcgttgaaaagaattcgattggacgctgaagatgagggaattccttccacagcaattcgtgaaatatcactattaaaggagcttcaccaccccaacattgtgagcctaatagatgttatccactctgagagatgtttaactttagtttttgagttcatggaaaaggacttgaaaaaagtactggatgagaacaagacaggattacaggatagtcagataaaaatatatttatatcagcttttgaggggggttgctcattgtcatcaacatcggatattacatagggatttgaaaccacaaaacctcttgattaatagtgatggggcacttaagctggctgattttggacttgcaagggcatttgggatacctgttagaagttatactcatgaggttgtaactctttggtatagagctcccgatgtattgatgggcagcaaaaagtactcgacttctgttgatatttggagtattggttgtatttttgctgagatgattacaggaaagcctcttttccctggtgtaacagacgatgatcagcttccgaagatattttcaattttaggaactccgaatcctcgtgaatggccacaagttcaggaattgcctttatggaaacagagaacttttcaggtctttgaaaagaagccttggagttcaataattcctggattttgtcaagagggaattgatttgctttctaatatgctttgctttgatccaaataagagaatttccgcaagagatgctatgaatcatccatactttaaagatttggatcctcaaataatgatttga

SEQ ID NO: 1916 - DNA, 2577 bp, Cryptosporidium hominis
atgcttggaggtacgttaaacgcagggataggaggaacaggttttaatatgggagttgctgagcattcctctgtagagaagagcggaagcataagcgagacacctataatacattcagttactactccagaaactcctatgacggccttgaatcaggcatctccaatttctctcacgccattggctcctcttggagttttgaatcctattccacaatttggtgtagggttgtctcctttaaatggattatctggcctaagttctcctttagttcagcaccagctacagttgcagaacctatataacttgatttactgtaataaacagggacatctgcaatcacagttgattccaagttcaggggctgggaatggaaacttcacaaatattgaagaatttaaccatttggttagtagggagataacaaatgaagggcataaaaccaaatctatagatgaattctctgatgactcaaccctagtaaagtcctctctgggatctactgcaacaataactccatcaaagatccaagaatctcaaggatcatcaaacatctcaaccactccgaatttagggaacgaaccaaatatttttggtagctgcaatggtaataataacaacgcaatactcagccagtacatccaatacttgcagttcattcagggccaacaagtcttggaagccaacaaaaaccttatattaggctctctattaaaccaaggaaatagtcagcagaatcaaatccaaaatcaaattcagagccaactccagctccaaaaacatcaggaacaaatgagattacaacaacattttgtaggtggacaacccggaaatgactcatccttgttggataaaggacaacaaagtcaaactcgttttcctctaatcaactttcaaaactctgaagaaaaaggtcttaagggaggaggagcaccagctaaccaaaattctaaactgaaattaccttcccaaaagcttgactctaaattagactccagcacaactgaacaatgtaaccattccaaaaaaagatggaaatgggtacattttgatgatagcgaagttcaggaatggactcccaagttttccctctgcaataactctaatatcaatcgaatggtcactagaactgggtatatgctcatttataaaagaaaagattgggcgccacaccaacccacatgcaataccggtattactaatgcatgcactgatgtggacacaaatatgggtttagtgccaggaatgtcactaggcggggatttgggtgtgaaagagtgcgaaaggaatttaattttgaagaagttgagtgttttgaacttgaggaagcagaatgtaacatatttaaagaatgttatattaagaccttctatagatagatggcgagaagagtggactaaaagacttgaggcatcaaaggatgatgacaatgagctagttaagaattacttgtttggtgggtttttggcaatacccaatgattggtggatgtgctatgttcacggagatgacttagagaagattttgtgtcataactctggtgaattcatcaaattttggagctatgagaatttatattgcaaacattctgtagttgaaggaggaaagcaaggaaaacatgaggaagcagaaggtagtaaatttttagacccatttttgttctgggagggacgggtgaagttgtttcctcctgaacttcttagcgctttggctgaatgtatctccaaggaaaactctctgcttagggattactattctttggatgatgggtacgtaaccaatgactcagttaaacaggacaattccaagaaagcagatactttgaattttgattctgaaactcaagttgaatgtttgaatttgagcaagagtatgtgcttaaaatgcgtggaaagcttatatggaattctaaatatttctttaaagcagtcaagaattatttacgagattatgaggactgacattgctaatgagagcgaagtctgcttgaccagcactaggatgtttaatagcttgatagcaaagtttgacttgaagcataaaaatcctatgcaaatgtttcaaaggaaacaaagccaacttaatgataagtttgggatagttagtaagaacgagagctccacaatagattttgattataactggaggtcaatttttactgatattaaaagagatattcagagaaatggaaatacaagtgaacagatgcttcttcaacttcataatgcatctgattcacattcttttcaggctgcaagcattgaaagtggattatataaatcaaccaatagggtgcaggattggtcaaaagatattgcattaggctcggcaaaatgtccacatggatcatatgtgagatcaaaagtttctggtaagacggtgattttgattccactgaggttgttagaggagtttatgtcattggaggagcagaggagtagaaagataacttcctttgtattatttaataaagtcaaaaaggacaaagaggagattattgccagtatttacaagaaatatttgagatacaagtgcagtaacaagctgcttccgtgcaaacattgtacaacgccgtaa

SEQ ID NO: 1917 - DNA, 963 bp, Cryptosporidium hominis
atgaatgtggaagacttaaatttcaatatagaaactgtgaatttagattcagagctggaatttgagacctttgatagaaaaactcacgtcgaatctcaacccttaaagaattctggttatatgggtagaattgatgagtttgaaccaggaacttctataggtggtgaaataggacaatcttacatgagtagccaaactcaaaaagggcttgaaggtgaggatttagtctctaggtttcttggatggtttaatccggtcaattggcaagtacttaaaggacactttaacgttacaactgaagaaattaaacagagattaattagcattgcattagtcacattttcaaaggaaagtatattgaaaaatattaatacatttatgacaaatataaaaaatcctgcaattagcggaatttctgttttccctcacaaaggacaaagtgacttatttgaaaatggatttgaacttttttactgtaaaagtcttgaccaaaataaacgtagtgatctttatggacctttttggctaaatataactctggctatgctcattggtacttactcaactattcttccacatctcaaatccaagtacgtcttaaatcctgatattactcgtcttacaatgtctttctcatatatattcaccagtcttgccattacttgctctgttatttatggaattctactatacaacagagagaatcttccaataactttgattttcacgatatatggatatagttccttgacgtattttcccggaatattacttattatattgtttaaccataccatcctgaactggatatttcttactatatcatcacttttcaatatgatgtttctctataattcactatttatcaatgggagtagaactcatacccacttaaatgtggccttatgtgttatcatccctaatattctccatattattctcctaaagttcctattcttttag

SEQ ID NO: 1918 - DNA, 2655 bp, Cryptosporidium hominis
atgttttatttatgctttccattaagattgaaacattcatgtacacatgaagataaagatagaattggaattaatgtatctgctcaaaaggaaatggtcattttgctaacagaaaagttttctgagttttcaaatcatgttaaaaaaagtatatactttaatagtttagttggtgaagatcttgagaatggagaaattaatgttgaaacaaatcccaaagttgatcaagtgaaactgattgaatcaaaaaattggaatagatactatccaatgaattcccttcgtgttgggcttttcatgactttaaaaatttcaactgtgaatctatttaagatgaatcccggactctttcaaaccccacttttcattaatcccttttataactctacttcttgtccttcatgttatttttcatggctaagacttattaattccaaaaatggtgatgacaataattcctcaaattccagcacttttgacgatattgaaaaggtactaaatgatgaagaaatgcttattcttgcacttgaaaccaaagttagaatatttcttaatggctcatccccacatgaggaatatatcaaagtcagaaaagtaattcaaaatagtactgaaacgaatggagaattagctgaaaatataccaaatatttacgcaggcgaagcaatttggccaggaatcacttctaaaggagcatttaatccaaaagttttgattggattgattaacgctaattccatggttcttggagccaagttagttaataaaatccatgaaaatgaacatgaaaatgaacatgaatatgaacatgaatatgaacatgaaaataacaataatgaaatgaatgctgagagtcagataaatgttgaagctcgaacgtcaataattgagggtgctgatcaatggacccaaggaggagagattgcatttcaaagtaaatacagtgatattgaattatatgagaagaacttggaagactttattttcgagaaaatccatgatgaagatcccaattgttgtggatcaaaaagaaaagaagaatttcctaatgatataaccattggtggtaccagattagttaaagtttgcagtaaatatacaatggttccatactttggatccaggagcattgtaaaaatcaatgattctcaagtacatggttgttctgcattaggaatttcgcgtgataagaaaaatctgagtaaaaatatctctgtgaaccttctttctcagatatgcagctatctacctctaaaggacttttcaaatttcagattagtttgcagaactcattgttgtcgtacaatcttcaattcttacgttcaaaatttgactttattcgaatctgatttgtaccttccaattcttggtcaactatatccacttttatcaaaagccaaatccatttcagttattcaaacctttgatgagaattttaaccaatttgaaatgtttaactcagaatttaatggtaatgttgctaatcttcattctcaatattgcagaattcctccaattgcaattcagtgtttggctgcttatactcccaaagttaagaagatgatctttaccaaccattctaatgctaatctcgcgaaaataatctcaagagcatcaggaagaaaacctgagactattgtagtttcccaaaactttgcaaacaatcagtctcttggaattaactttaatgctgatgaaaatcaagataattatggagatgaacaaattagtcaagagatcatcgattctctagaaaactctggccaaacaatcaattttccagatggccttaatggtggtgatattactggtgaaattggggatgaaattaatgatggtaatagtagtggtaatgctaatggtggtaatttaaatggtgatattattagaagtaataccaatatgattaataatggcaataaccaagatatgaacgaaaatactcaattttccaactcaaatctatcaagtaatccaggtcaaaactcgcaagaaactgaactttcaaatactgatcaatcattattactaaacttgcaaacatttccagaaagtggaacttcaatatcaccaagtctcatagaaattcatataatcggaagcattgaatcttcaaacagtcttccaacaagtctattcagaataccaattacagctcctttcagaaaactcattaggtattttagagatgttgcagctattcatgaaggtataattgacctatatattcttagatatggaatcaaagatagacttattccagatttatctccaattgactatggaatattaagaggtccaacagtattgtttgcaatcggctataaaacgcttcaatactctcaaaaaatatggatttctctttttcttgttggttctgtgcacttcccatatcttccaaaactcaggtttaatgcatctatgagcactcccttttctaggttggcagaaagctactcaagaaacgttaatatttctgtcacagacgtaatgttcatatataaagactctgaaatcgatctcaatctttctccctacgattacaatgtttccgagaatgacacaattgaggttattctccgaactaggattaataatgataatgttagcaattcaatcatttccgacttcaacaatggaagcaacgccctttag

SEQ ID NO: 1919 - DNA, 942 bp, Cryptosporidium hominis
atgaaggaggaagatgaaggaataccagagccaacaaacttaggaaatgtatcagcatctcttgaagacttggaggaaaactttgagggaagtaatgtagtgaataagagttatgcccagagaagaaggtatgagatgtgcaagaatggagacctggtggttttgtttggaggatacgaaatggttatacaggtctttctggaacaaaatggaagaactcagactagaaatggggtcttcttacataatgagattattgggaagaattttggaagtcgaatattcgatacatccaaatcaaagtggatggtagttttgaaactttctcctgaacttatttcaatttccctcaatcatcgtacccaaatactttaccaggctgacatttcattaatatgtgtgctcttggatgcatcccctggaaaaaacattattgaagctggaactggaagtgggtctcttactgtttcattatgtaggtcaacaaatcctggtggagctgtttatactttcgagtatgatcagaaacgccatttggaatctatccaagactttcaaaaatatggtatttccaatgttgtctgccagcatagagatgtatgcaaggacggctttatatctcctcttttagatattacgaaaaccactattcatggaatttttcttgatcttccctccccatggattgccattaaacatgcagaccaagttctccaaaaaggagcaagtattgtaattttctcgccatgtattgaacaggtatccaagaattgtaatgagcttaacttactcaaatatatccatataagaacttttgaagtactctataaaccttggggaattgttagaggatcttcaaaaaagttccctacaaaaggtctaaggtatcaacttccaatgagaggccatacaggttatttgtcttttgctattaaatcataa

SEQ ID NO: 1920 - DNA, 2601 bp, Cryptosporidium hominis
atggacaatagggattgtgacaatattgatgaggatgattggtatgcaggtttaggagtagttccaatatcatcggaaaagacatcttcatcggctccaattcagggttctatggtggcagctgaatctaatatggctcgtgaggctgaccatcgagacagtgaattattgaatgaagatttaactaagcatggggttgcatctggaggaaattatcatggcatagaggatgtttccatgtcagatatcagtttgggccgtgaattgggacatttacatcaaaatcaaagagaaaacaatgcttattctggcactaatcaagaaggatttgacttagtttcaagatcaggagttgctggattgaaagctagacatgaaggggaggattttcatggtgaaattcaagacaatgaaaaaggtattgcttcaactacaatacttgaggaggaggaagaagaggaggatctaggaggagtaatacttgcagaggaggttaacagcaggagttacacaaacattccatatggtaaaggagtttcaatggctccaaaagctagtaaatctgtctcatttgtaagaagagaccgagtagtatttcttggatctcccccagaattacctgagagagtgaaccctgatccaggaacaggaggagctatgactcgagtgggatcaatcatagttatttcaaatctaatgtggtggattaatgatatacatgtacgtgagctagctactgaatttggagctataagagcagtgaggataatagaaaggcctaaggatggaaggtctttgggaatttgtttgattgaatatgttaattcagatagtgctcctaaagcactacaaggcatatcagcaagctttgcaaataagtttgagggccgcccattatatgtggttcctttacctcttcacggagagttacatattgctttggataatattactcctcattggagtaggggcggaattattactgaggagattttggcaatgatatgccaattagttggagttgatgtacagactgcaggtctagagatccaaccagagacaggcactattgttggttttgtacagcctagatttgctgattatgcatcatactacttccctgatggtactccgtcttggtttcctcctttatatgttgaagcacttaagcatttaaaagatctaattcctccatctagacttcaaaacagaccagcagcaacggcttcttcaaccaaacatccttcatccaaggcaagatccaactttaacaatatttctaataatgccggtattaccaattcaaattatgttaatattgaaagcgattcagatcaattaaatcactttgatgaagatattggaggagcaaacaatggagaaatgaaagattcaactttatctcataatgccaatcaccatacaaattctgctttgggagaccatccaaataagggattaaaaaagagtcatgatagtagctcaggaccaaatttgagtagtaactataacaattctaataataataataatcaaagtatggaagagagttatcaatatagtaatagcggacgtggatctaagtctgttaaatatgaacatggtttgtctgagcaccactcaacaggacaaagcggaggatgtgaaagtaataatggagatatggttaattcatttagggatgataacgaacatttcaatactggcggaggacaaggatctggatcaggaggaggtggccaaagtagcagaaggttttctggccaaagacgtgattatagagaaagaggaggagatcgcacggaaagaggaggtgagcttgagagagacagggaacgaggagatcgtggtgaaagaggagaaagaggcgagcgaggagatcgtggagatcgtggagatcgtggagaaagaggagaaagaggggaacgtgtagatcgaggagatcgagatcgagatagagatagagacagagatagagatagagatagagacagagatcgaggagaaagaggtgaacgaggagagcgaggagaaagagatagaaatagggatagaaatagagaaaagaacgacagagatcgggtagataagggagatattaaggctgagaggtctgaaaaggaaagacacagagagaaagattgggaaagagatagaagtggagatcaggaaaaaggttcaacgaataaaggatcaggagggccatcaatggtaacttctaatatgaaggaaggctctgagagagggagcggaggaggaagcggtgctcatagtaagaaatcttcgggaggatctactattctaggcgggaattctttagagtatggaaagtctagcaaatcttctttgaagaaacatagatcatctagtgaaagttctaggagtagaagtcctcaaaggaagtcatcttctaaacatgttaggaaagatttgggtaaattttcttcaaattcgtcaaaggaaaagccatgggaaggtagaagctccggtggaggcggtagcagtggtaataatggctcaagagggtctaagaattcttatagagagagtaggtcattagcagaaagaggaggatgggaaaggaggagtaataggagataa

SEQ ID NO: 1921 - DNA, 2622 bp, Cryptosporidium hominis
atgactagaacttccttgtatcatcctttagtttcacttgatcatatgaaatggatgagaggtatttggaatctgatcacctttaagatttttggtaatagctcaagtaaataccctaaggaggaatatgagtcgattcttttcaagattttaagtcaagcaatgaagtcaatattaactttttacttggaagtgggccaggtattatttatatgggattttgaactgaaagaaaataatattaatattgaagttgataacaaaattgtcaaagatgaaaccatattcatatttaacttaaatcaaattgtccaagaattcattgaatttatttctaatctaccaaaagaatatttctgctcaaatgatggagtttgcgagtacatttcaattctctcttcaataattaatataggactagaacttgatcatggaaaaattttgggtacccataaattttattatgatagatcttttatcaacttggtgctttctatagctcattttttgcagggaatcaaagaacttgagatatttcaaccatttcaagaagaaaatactaaacttcttgaatcttactttatacttaactttatactctgtaaatcctattatttgctcaatattgttggtaattaccatcaacttgagataaaagaccaaagtcttattagggaattgagctcaaactttattgaatggataatttctcaaagtaacttacatatggataaatttttgatattcttttcagaacaaaccattaaaactttatattttgacttgatcccaagatggattactcagaaaaataaataccgaagaattggtttatcccataatagtaatcctgaaataatgttcttgaccttacttagaaatctatacaaatacgcttttttggatggtcagaatgatctcccaattaatgaaactcttaaccaagaagaaatagccaaactcttgtccaatttttatttttgctgtctttactttcatagattagattcaatggctagaaaagaaactttaaaagacaaaattgagcttcaagaatgtgatgaagaaatgattctgtcctttttaccatgtttacgtataactaatgcctacaaatatgccaagtactttgcagttattagaagatacaagatttctagagcgattttcgaatcaataaagctctacactcttgaaagtcgtgcttggattcatattttagtatatattacccaattttatgattgtattatgtcatttttaagaactaatgaagcttctgaatatcaaagtaactcatctttacaattaactttgcaaaaagaccttgttatacaactcaggtacatcataagaaatatcgaatctgacttcaaatttattaacaactccaatatctgcttcttttcgagtatatatttcttagcaatccataagattaatgaatttctctcaaaaagcttcaattcaagattcaatgatgaatcagataatcaacaaattgaccattttgtaactctttcttatttagtggacattcttaagactttatttggacttgcaaatatcgcaaaacctatttccacacatacctaccaaattataactcaaatttattggtcatttaaaaagattactctgaaagttcttatttcttatatgaaatttgcaatggaatccttctctgaaatagaagataacccaaacaatcaaaaatctattaataagagctcagacttattaaaacagactctgctcttggccttgggccaaaaaatacccaaatttaatattcttgttgaaaaaagttttattgataatgctttcaatatattcaaacttattgaatttaacacttttccccaggtaaagtggcagtttgttcgaagaaatgttagttccgaaaaccttgcaaacatttttctattaaacctaagaaaacatccaaatgatcttttgacttctctttcaaagaatcctcgcaaacccggtgaaaaatcgtccttttcactagtttatctccgaaactccgtccttaataatgataatccttcttcatcttcttcgtcagaaaaccactcaaaattccccgaaaatgcttattctattgacttagagtcccgcctgtggcagaatgtcagacctgacacaattttgcatgcatgcatgcatttacttgcgcatgtggggaggttcccgcccatactgcttgtacagaagactcttccacatatttacttaaggggtgaaattctgggtttacagaacaacaaagattgtgttactccttcaggaacttcttctgaaactacaaatgtgggtaatgaccaccaagtggttccagtattgaaactatttggattctttaaaagtggtttccaaaagaatttatcggaagagtgctattgggttaggataaagctttcttatttgtttaaagagggtgaagagcttccagcttcacatattttggacttatctataactgaagctcacttttcttgggcgcaaccaattgtaagaattccaaatgctcaaaaacttaaaattatttcagtacctttaaatcggtacaagatttgtatcggaattccttatacaacctttatcaacatcctttaa

SEQ ID NO: 1922 - DNA, 2034 bp, Cryptosporidium hominis
atggaatacttgagtcctttaatatcatcgaaatgtcagaatgaggctgatattttagaaatgaaaaaattgaaggaagaccaagatgaaacctattcttcaaagaaaagaagtattagaggatcttttaaagccagtgagaggtctcagaatctgaattatatcgcaaaaatggatgacttagatcgtctttgctcaaatattgcaatttttggagaatgtaagcttgatcataatatttgtaaaaaaagccacaacattgaagaattcttaaaaattaaacgtgaagaagctgaaacgaaaattcgtgatcatgaagaatctcttctaattcaaaagtcatgtcctctttttgaaaattatggaatttgtcaccttggacttaattgtaaatttggactttcacattttaatgaatctattatggcaaatgttaatagtaaaggtgaaaaagttactcctgagcatcttgaagaattctttaattcatttgagaagaatactattgatatccaattaagaactgggttaagacaaagaacgatgaattttcctaaaaccaaagatttttttgataattacactttaagtacaaataaaactttaaaagattgtgaaaaaaagaatccaaaaccaaattgtaaaaaagcccaaaactttgacaatcccttattagtaggtttaaaaaacactgataactcaacacctcttgatgaaaagggcccaaatactattactgaaacaaataatcaaccaaatattgaaataccacaagaattaaagctttcaactgaagatatgctgattggaatctccatacatgaaaaagaaaaatgtaagcataaaatctttagaaataaactcatccttgctccacttactaccgttggaaatcttccatttagaagactttgtttaaaatttggagctgatgtcactgtcagtgaaatggtattatgcaatgaaatcctttctggaaaagcttctgagcttgcattacttaaaaaaagtccagaagaaaaacattttggtattcaacttgctggtggtaacaaatctacaattattaaaactggtgaattcattaatgaacattgtgaatttgactttattgatattaatgctgcttgtccattaaaatctcttcatgataaaggcgctggaagtatacttgttgatagagtttcagaacttgaaactatggttaaaggacttaaaaaagttatggatggtaaacttgttactgtcaaagttagaatgagtcatggaggatcacctattaataaaaatctttctgaaaaggattacttcgaaaattttgaaaactggccagtaatttaccataatatgaaaactcacaaaattttaaatattctttgtgactctggaattgatgctttaactatacatggtagaacttcattccaaagatatactaaagaagctgactggtcctatattaaatattgttcagtattaaattccaaattatattcaaacaaagttgccaataatattcaaagtagtaatcattctcttttttgtccttcaatcattggatgtggggatattattaattttcaagattaccaacaacatatccaaaatgatcttgtcgattctgtaatgattggaagaggagctttactaaagccctggatctttactgaaatcaaagaaaataggaattgggatatttctgctagtgagagatttgacattatcaagcaatatgtcaatcttggactcgaacattggggtaccgataaaaggggaattgcgcttactagaagattcctacttgaatttctttcattcttccacaggtatatcccaattggtattcttgaacagcctattcatactcaaaactttaattggagaacacccaaatatattggtagaaatgatctggaaactatgttagcgtcaagtaactctagtgattggatcaaaatctccgaaatgatactcggaaaagtccccagtgattttgtttttatccccaaacataaagccaatagctcccattaa

SEQ ID NO: 1923 - DNA, 3981 bp, Cryptosporidium hominis
atggagaactctaacattggaatacaaggtttgaatcctatgattggaggatgcataggtaatgtgaataatagtagcaataatattggtaataatagtagtaatggtaataatggtggagttggaggaggtgttacatgcttaaatgcgtcatcagcttctttaggattccaaaatggtctacctttggttgcaggaggaggattattaggacaaaatggaggtatttccatccaaggtccacattctcagatgaatgcagttacagcagccaatcaattcttggcccaacaaattgcaatgggaggagggagccatccttcttttccttttatgtatggtaattttcctaataatggtagtcaacagggtcagaaaattgaacttggagaagaagatggaaccaaaccatcgaactcattgaaagctgctgcagcacagatgattcttcatgagatcaataagaatcgtaatcaattacatccaaatgcaacagctacaatcactggaggagatggaagaggaggaaatgtgggaataacggaaccagctctttcacaagttcaactaaatggccagtttcaaatactgggttccaatgaagatctatctacttcagcacagactgtttctcctcaaccaacactggcgcttactcctttaggactaatcccgatacttcccaaagttgttggtagccaccagtttcaaggcttaaatccttcagtaccttctcttccccagaaccaatcaaataaacaacaaataagccaagaacaactactccaggttcaaagacaaatccagaatctccagaatacgaacaactcttacgcattaaactcgaatcctcctaataatgctgctaatttcttagacataagtcaactacctcagtcaacagaaacaacggattctaaatctcagttatgtgttgcgcttgaagagcatgagccaaaagctgaggtaaggcctatagtggaaactgagaatacttcagcacaaaaggcgacgagcgccgatgagttaattgacaaagaagattgtggtgtgaaagggatggaaattgattccaaaattataaatggagagaatacttccagcaaaatagaacttcaggatcaacaagaaaatctggtgtctcaacaacagcaagaaaagtttgaagaggttcaacaacagcaacagcaacagcaacatcaacatcaacatcaacagcaacaacaacaacaacaacaacaacaacaacaacaaatgtaccaacatcttcaaatgctcgcattcgctcaacaacaacagatgttacaaagacagttacagataaaagaatgggctttggctgcagcttatctaacccaacagcagcaacaacaacagcaacaacaacagcaacaacagcaacagcaacagcaacaacagcaacagcaacaacaacagcaacagcaacaacagcagcaacaacaacaacaacagcaacaacagcaacaacaacagcaacaacaacagcaacaacaacttcataatcatccccatcttcagcaactccacgctcttcagaatttggcgcccattcaaggaatgcctcacatgcaatcatttccccacattggcgctcaaatgcagcgggcgggtgggttgcatccaggttttcagccggtactacatcatcttcagcaacaacttcagttacaacagatccagctgcaacagtcattacagtctatggcagcttctgcttctaactcagtacctgttcctgttggtatcccaccgcctggttgcattcctatagttggtggttgtgggacagtaggagtaggtgcaagacaagggggaggaattggtgacttacaacaactgcagcaacaacagcattttcaacagctacagcaacatcagcagcagcagcaacaacaacaacaacaactacatggtactcaccatcactcattgataggagacgagttgcgcgcagttttaggtttaagtgcttcagcaattcgaggagttaaagtaagtaaacaacagactccggaggagttagcttcttctaggagagggtcagagagcctattagatggccatggaagtagtggtagtcatgctatggatttgatttctgggctaggtggatctagtaatattcgaatgggcaataattcatctagattaataaatggttcaggaaatggagaaatattgattgatgatttggaaggaaaggctacaatttcagctctttcatcctctccatcaatagttggttctggtacaacagctcaaagttctgtagggaggagaatgagtaggagagctgcaggtagaggaacaggagcatcgaggagttcaggtcgattccaagcttctaatttacttttaattattgaaagtgaacaagccataaagggtacccaaaactcaaatctgaattctatatcttctaagggaggcggacaagatagtactggcgtaaatacaaaatcagaacagggagagatttctataggcagcgaaggaatgatggatcttagtgaccacacagtttctagtatgataaaaagtaatggtaatgctattacctcctctacaaacatcactgctagtacctacggaagatatgggggaagtaatcgtattaatggctcccaaatgattatttccccttcagaattaagcagaattgagaatcttcattttagtgtggagactgtacctcatttagttaaggattatgtcccggcattttctgggaaatttgctttccttccccaaccacctttggatggatcatcttctacaggagactattctgaatattattattctaataatagcggtaatggttcgcaaaaccatcattataaaggaggagagggaggaggattacaaggaaatcaacaggaaggaggaagcatttcccaaggactcagatctagaagagttaaaagtagcaatgccaattgtaacaatgagaataataataaagaagatggatctatgcagcaagagatgcatctctcaaaacttgttccggatatattgtctagcatttgtggaggagaaggacttaaaatggttgcaaaagagaaactttccttttggatggatttgccatgtaacatggatagaaagaaagccaaaacaggaattggcccaagcacaagggaaagcttaaggaaagagcttaagaagcaaggagagctatttaggcttgtttccacaaaagatgagttcttatgtgattctaagatgattagaggagctgatatcaataagctgtatttagatctaattcagaaatcacaacaaaacgtacaggttttcaagacctgtccaggaactgatgataacccctcatcctctaccacttgcatgatcaacactaccaacaatgtgccagatattgctgcttccgctgttactactaatgatatcgctacagtcattgctaattctactaatgctactactgctattactactaacactactaccgctaccactggccctaattctagtactacaaccgcatccacaactacagtttcttcacctttgctccctcctatagcatttcccaccaaagtaattgatacaaaccaacaaaataatctaactcttcctactattagtaatttaaatggtaactatctaactccatcaaaacaaccaaattttttgacgaagatggaggatgatctcaaagggaaattaatccatcacttttccccctctaccattacttgtccagggatctcaatctcatcatccaccattgaaacaaattcccctaatagaagacttacccagtcaagtatcgataattctgatcacagcggaaatagaacggagaacagtaacaactctaataatgacaacagtatatgcggaaacaatttaactaagacttccactaacctttgtaaactcgatggaggaatctccaacccaccaatcgcgccccatagagcagtcccctga

SEQ ID NO: 1924 - DNA, 1851 bp, Cryptosporidium hominis
  misc_feature (295)..(296): n is a, c, g, or t
  misc_feature (319)..(319): n is a, c, g, or t
atgaaaagtagacaaataaatgatttaaatctaatggattgctggccaaatgatataatatattttgtaaggattttattgttattacgtggtatatgtgctgaattgaatgagagtataccgattttgaaaatattatccagaagagcacaacaattcttatatttagagtcaattaatttagaattaaataaacaacagttattaaaaagaagatttacaaataaatttgaaaggagattaagcgattatattgaaaaaataatgaatgaaaatatggtatggggatacaatnnagctattataaagaatggaaagnatttagtaaatatttcaaaaggtattaagggagaattaaatggaaatcagattgatgaaaatacattatttaatggtttctttatcaatcttggaattttggtaattgcaatattaatatgtgtggaaaaaggttatatatctctggatgatccaatttgtcattattgggatggttttataagatatggaaagaggaacataacattaaggcatgtgcttgatcatagatctggtgtaatatcgttttttccaaaggatatgggtttaaaagaattgttaaattatgaaaagatgatccaaataattgaagattctgctccacaggttccaataaatcaaattacacgatataatccttattttttaggttggatattatcagaattgatagcattattaacaaatcaatcaacaacaaagtttatagaggaaaatataataaatccatttaatttatctgatggtataaaaatgtatttacctgattatagcttaaataatgaccaagtaagtatttttcaatctgaaaagtatgatgaaacaaatattggggctaataataataacaacaagttcttatttcctttattttccccacgttcttcatcttcatcatcattttttgctcaagaagaattttcttcaagtataatgagattatcaaatattaaaagtaaattagaaaatagtaatggtactcaattaatgaatgaaataaaagatataataattcaaaagttaaccccaaaaagaataagcaaggaagaaaaagaaaaagagaaagagaaggaaaaaaatattaatgattataatgaagaagataataatgatgagaatattaatataattgatttttatgaaagatatgcaatggtaaatcgaaaaatggagttttcttcaatatcttttaaacaagtacttgaaaaacttaaatcatctgacttatataaattaaaaaattatggttatcaagattttaacaaaacaaaaatcaatttgaaattatcaaccttagagtatttttttttaaaaccagatatattagatcccttaatatataattcaaaaaaattaataaataaatggataccaccaacaaatggaagatatacatctttatcattagcaaaattatataatcacttaattagaggagagattataggagataaattattaaaacaagttattaaaaatgaatcaattacttttgataattctatcgaaggattaatattaacatatggaggtcctagaaaatggtctcttgggtttcaaattttagaatgtaaaaaaatttattatcatcaaaataatcaaaaagatgatgatcaaccttgttttaaaggaattggtcaatctgatactggtggtaatttatcattttgttttccagaaattgatttatctattgccattctaacaaatgattatgttaaaggatcttatatatcacaatcaatattacgttacatattagaaaactttggattatatttgaacaattatgttccattatatttttcttag

SEQ ID NO: 1925 - DNA, 969 bp, Cryptosporidium hominis
atgaatgagctagattcttggaacagaaaatggagaacattatggtgttggactcatatatatgtgcattacaaaagagctcagatttatacaagaaatttacctgaggaagtaaaatatacatattggaatagtaagcattctcagtttgctgaattgatatggagaaatatatcagagttacgaggatggtggattaaagtggggcagtttttgtcaacaagaggagatttacttccaagagagtatgtgacatatttgagtaaattacaagatataatgccttgtatggagtggaatattgtggaaggaatattaaaggaggaattaggtaaggatattgaaaaaatgtttaaagagatacaagaaaaaccaattgcagcagcatcaatatctcaagtacataaagcagtattgaatgaagaagaaaaaaaagtagtgattaaagtacagtatccaaatattcaagagactcttaatcatgatatgaagaatttggaacaattaacatgggcttttggtctgttagaagaaaattctgattctattcatattctaaatgaatggaaaagctctgcgaatttagaacttgattttaagaatgagctaaagaatcaaaagagagcatatgagatgtttgaggactcagggatagaaataattattccgaaagtttatacagaatatactactgaaaagatattaacaatggaatatattaaaggttttaatatattaaataaaatgctattaaaagaaaatagagttaataaaagggaattattggaaatattatgtgattcctttgcttatcagattcatattcatggtttttttcatggtgatcctcaaccaagtaatatttttttggtttatgatgacttaaagagaaaatacattccagcaattttggactggggaatggttaagatttttgataaaagtaaacaaattgcattttcaaagtaa

SEQ ID NO: 1926 - DNA, 813 bp, Cryptosporidium hominis
atgaataaattaacttttgatacttttgaagggtactttcatggaaggcttgcaatcaactttgaagcaatagtaaatgatcaaaaaccaaaagtacactatcatacaattccaatgtcagcattagaaatattttataaggaaatggaaaaattacctgatgaattttatgatgaaaatcaagattttctaacagaaaaattagatataaaacatgaatggcttaactataaaattaatacacattcaaaaggagacttgactgacgaaaaatcccaacataaaaagaaaagagtttacaatagaattaatatgcttgaaaacttatattcagaaggagtagatacagttattctagtaattgatcaagttaaatggcaaacaactgtgaacttgcaaaataataaaaaacaaaactctatagaaaacactaaaagtgatagcaatgatattaacaataaccattctaatcatatccaggatgataattctgagtctaatcgtattattgatgagaaaactatttatttcgatatagaaaagatgatacaaatcacgcaagaatatctcaagccaggaggtaagcttctcatattcactccttttatgacaacagagctactccaaatccaccaagatttatctctctcaacaagagttgaaaattcgaaattccacccttttattggtattaagcttgaagaaacctttattagagagcatcaaattattgaccaaaggactcaccccacaatggatgcaaatctaccaattttttcaggttttttgctctctgcaatccatatttcatag

SEQ ID NO: 1927 - DNA, 1086 bp, Cryptosporidium hominis
atggatgatagtgctatggggttgaatgctggagtttccggaaggaagaggcgactatcttccgatgatgaagaaacccccatcaaacaattagaagttagcataaaagaaaatgctgatgtttcatcaagagaatctaccccacaaattatggttaacaaatctacaagatcaaaaagggttctcagttctgatagtagtgatggctgcaaatcttcaggagatgagagcgaagagtcggctagtaattttcaatcacaaccatcaaattatacaacatctgaggatgaatcagataataagtcgtcagacaacgaatcagatgatgaatcagattcttccttgtctacaagaggtagaagaaaattagttaaaactgaaaatggtactccagttatatcaaagcaaattaaaagtgaaagcaagcaaaaaaaaggaacttcaacaagtaaaaaagcttctactaagtctaaatctagtgtagattctaaaactaaatctaaggcaaaaggtaatgctggaaataaaacaaaatctgttgttaaaaagaagcgagtttctgtagaaaaagattctaattctcaagactgttcttctgacgaagaagaaaatactgcttatgttcctcgaagagatcgtgaccataagcaaatattagttgctgcaattttatgtagatggtggcatgcactcccagattggcctccaccagatactgattaccaagcactacttaaggaaagaaatctaaggcttgtttctattgatgattgggaagaagctcctgatgttgatgaagatggattttcaaaggtttaccagctatctgaatatattggtgttttcagagactcaaaaggtaatgcccatgatttaagacccaaagaaaacaagccatgttattctaatttaattaaaatggaggaaagcaaactttatgaactactagttacagctctggaaagtcaaataaaaacattagaagctgattcaccaggagattctaagctaattaacgaattaaagattgaacttgttgaggctcaagccttgttgagccgtagaacatcaaataaaaaaaaataa

SEQ ID NO: 1928 - DNA, 375 bp, Cryptosporidium hominis
atggcagctgtttcaatgaatgaattaccacaatctcaggttcaagagttaatctgctcttatgcagctttggtcttatccgacggtggcgttccagttacatctgaaaacatcaagaagattatctctgcagctggtggaagcgttgagccatacttcccaggtttgttcgctcaggctttgtccactactaacgtcagtgacattgtagcaggctgtggagctgcttccgttgctgtaccagttgctggtggtgcaggtgcaggtgcaggtgctgctcaagattctggagcctctgctgctgctgatgacaagaagaagaaggaagaagaggaggaagaagaaggtgatttaggtttctcattgttcgactaa

SEQ ID NO: 1929 - DNA, 714 bp, Cryptosporidium hominis
atggaagaattagcaaagagaaaagatgaaatagagaaggaggtaagtgaattaacggagttcttgaattcatgtggtccagatgttggtatttctggaaagcttgtagatagtgaggggtttccaaggtcagatatagatatatatgcagtaagaagagcaagaaataggattgcagtattaaatactgattattcgagtgtgatgaaagaaattgaagaaaaactgtttgatattcacagcaaagagaagacttatgttcaaattaataagtcagaaaaaagccaaagatgcaatgcttcagaatgtctaaattatccatttggatatgtaaatagtgttttggagggatcaccagcatttcaaagtggtataaggacaggagatttattattggaatttggaagtcttaaatcagaatctgagttacattcacaagaagaatcaaaacatctgataggtcaattgccggagattgtacgagataatttagataaatcaatcaaagttactctattaagaagcaatagcaaacaacctgaggaacttctttccgagttttcaacatttatagataattctaacttaagctataaagacctaaatttacttgaattcgagaaaaagagtatcgaactggttcccaaaaaatggcaaggaaaaggttatttgggatgtaatatagcattcatacacaagtttgtagaaaaatag

SEQ ID NO: 1930 - DNA, 1278 bp, Cryptosporidium hominis
atgggtgaccactctgagaaagatggagagagatgtccgtacttatctagcattaaaagaagtgtgttagactttgactatgagaaaatctgcagcgtgacattaagggaggaacatatatactgttgtctagtatgtggaataaattaccaggggaaaggaaagggttctatggcatataagcactctctagaactaaagcaccatttatttattaatttaactaactcaagcataatttgtcttccaaacgattacgagatttatgaacattctcttgaagatattaaaggatacctacagccaagatttaattctgagatcatctcctcatcgctatatgacgtgtcaagaacttttgatgggattgagttttttccaggatttattggtttgagtaattttggtaataatgactctttaaattcaatcattttaatattatctcgaatcactgaatttagagacttatgtcttagttaccagctttatagcaaggaaattgagaaaagaattccagatccacttttattcagtattattgagtcgattcaaaaaatctataatccaaataatcttaaagggaaattttctccatataaccttgtaaaaattatagagaagaaatctaatggaaaattttcattttcaaaaatatccaatatttcaacatcttctaattcattcatacaatcaaatgttggtacccaaaactcaacaataattgatccaatggcactattttcttggataacatataatttaaagaaaaagatcgacaaatatctcagaaaatttcaaattaaattcattccagatattgataagaatactaataaatccaatatgaatattattgatgtatgcattaagggaaaactatacaacaaagccagtaaatatccaaataacaaaaaatctgaatctagtacagataatttaatgaaatctaaaaaatgccctgaattaaaatctactgcaagtatttgttttaactgcctatctctaactctaccttcaattattgaaactacaatgggtatatcaaatagcgctcaaagtaatgaagataagacaatttcccagataccaatatatcagctactagactccaagttcttctcttccacttcccaattaatatcgaaactaccttattacttatttattcatttttccagattttccaaggctaatttaaatctggaaaaaaacaaaactttggtttctttcccgcttatagacttagatctttcttcatatattcatccagattaa

SEQ ID NO: 1931 - DNA, 267 bp, Cryptosporidium hominis
atggaaacttgtattgaagagaaaaagaaatttgaagattgctttaaagaatggttgaataatggattatttactggagagtttggcagtatctgtgtgaatgagtggaaaatatatgaacaatgtctaaacaaggagcttgcagagaagaatctgctggatctaaagtcgttcactacattagatccaagtgtagataagagtataaattacaaaggtttaatcaataaagaaaatgaagcaatcaaagaaaattctaagaattaa

SEQ ID NO: 1932 - DNA, 1575 bp, Cryptosporidium hominis
atggatagcaactttttggaaaaaacggaagatatgggtggagaattaaattgtatttttagaaaaatcaaatttgatatccctacagaatgtgaggaaaacaagtcagattgtgtattcataaaaagccaaacttttaacatattaaattctccatgtcaatccccaattttcttaattttgaaaccagaagtacccaaagcatcagaagaaatcaatcagccagaccgtaattatgcaaactacagtgtgagcatttctattaaagttagtcctattcttcaaaatgataataaactatcggctttatcagaaagtttgcaaggagttatatctaaaagtggagataacaccccggagaactttacactcttcaatgatgacgaaaattcaggtaattacgattcaagaaatattacaactggttcaacgcctattgttaatgacaaaatacagatatcggataagtatccctttgatgttgaagaagtttctgtacattttatgggcggaacgagcgatcaatctatacaagaaaaaaaattggaaaataaactaaccaaaagactttctactataaaatccagtattaaaagacagcttacaaacaacaggtacgttgatatatgcagaaatccagaatggccattcattaaacaaacgagcaaagtcttttcaaagaatgagcaggcaggacctaagtctcaaagaggcagagaaattattcaaaaaggaacagaaattgactctagtactgaagataaagatttaaacttagtttcaaagaatttctctagaggtaggaccaggcaatggttggaatcactttcaactttatttgatggagtgtacacacaaagaagcactttaggacgtagtgctggcttgggacttttttcagatcgccatttccggaaaaacgatattatcacggaatttgttggatgggttattgatcgtaaggaagctcttagacttagatctgaaggaaaagctacgcatatatgtgatttggtaaagccgagcctatatttagatggtgagaaggatccaaaaccatatattggtggaggttcttttgctaacgatggaagcgcatttttgggagggcctggaaacaactccagattttggaagtggtatgacgaaagagaaggtagatctagagtttttctcaaagcaacacaagatattcaacctggagaagagatttttgttggatattgcaaggattattgggttgattttgcggagaaagattccaccaacttaagcaacaaaacacatcatattagtttagctccaagaaagccaaacaaaactattccaggcggcaaaaagagaggtaggaaacgatctatcaaagtatttgaacctatcgacaatatagagatgatagattctaacctaactgatgatggaaaatgctctttagagtttgttcatgaaatgtatttgagtccttcaatgagtgaaattcaagacgaagctgaatcaaaaaggaaaagaaaatctctatattgggatactgtattcaactggtccacttcagatgatgatgaaggtgataagtga

SEQ ID NO: 1933 - DNA, 1188 bp, Cryptosporidium hominis
atggcaacattacattatgatgatgtaatcacaagccagccggctatcatagataacggttctggcacgattaagtgtggatttgcaggagaagaagctccaagagtgattgtgaatagttatgtaggacgcccaaagtacaagagatgcatggcaggagcattagaaggggatatttttgtgggaagtaagtgcacagaaaatagaggaattttgtcaatttctcatccaattacaaatggaattattaccgactggtatgatatggaagctctttggacctattgtttctctgaaatgaaaacttcatcagaagatcatccagtattactgacagaagcagctttaaacccacgaaaacatagagagaaaatggcagaagtattttttgaggtttatagagtgcctgcattatttgtctcgactcaagcagttttatcactttactcttcaggaagaacaaccggagttgtcttagatagtggggatggagtgactcatgctgtaccaatatatcaaggctttgctctaagtaatgcaatcactagaagtgaaattgctggtcgaaatattactgagtatcttaatttacagcttagaattgcagggacagtattccacactaaatctgaaatggaaattgtcaaagatattaaagaaacagcttgtttcgtctcttctaatattcagaaagatgaaaatgatgagaaccaaatggggaattcaacttttgatgctgttacaagttccggtaatagagtagcttcgggctatccttataaacttccagacggtcaagtaatttacttgggcaaagaaagatttagagcaccagaacttcttttccagcctagcttaattggatatgagtatccaggaattcatgaagttctgactcatacaattaacaagtgcgatttggaaatacgtagatctcttgcatctcaaatagtattagctggagggtcaaccatgtttccaggacttggagatcgacttctttttgaacttagaaaagcccttcctaaagatgttaagattcgaattaatgcatctagcgacagaaacctgttgccttggataggaggatctattttaggatctttagctacatttaaaaccatttggatttctaagcaagaatttatggaggaaggtcctaatattgttcactcaaaaaccatttga

SEQ ID NO: 1934 - DNA, 3474 bp, Cryptosporidium hominis
atgtccatttgggaagcggattatcgaatctttgaagaggtttatatagcttttggtgagaactgtcaagattattatcaagattttttgaagcttatacacctttatacaagaggagtattaactgttgttgaaactttattagctcttgaattcttcttcccaatggatagtggagatctaccttatgaagtgaaaagaatgatagtacaaagagagtcagcaaggaggaaatattcgtatttttgctgtaattttgcgcaactggattatacaaactctgctaggaatggtagtagttaccttcatttacctaaagactatccaatagcgtcatgtactggaagaattaaaagcgataaggaaaatttgaatgataaatgggtaagtatccctcaaggatctgaagatttttcatttaagcatatgcgtaaaaatgtttatgaagaaaatctttttaaatgtgaagatgagagatttgaattggatatggttattgaaaataatagatcaacaataaacgccttggaaccgatagcagaagaaattagcaagttgtctcccgaagataagaagaattttaaactagttaaaccaccattttcaattattcatctcaaggcaatttctagaatttatggggataatggacctgaaatattggaattacttaaaaggacaccatatagttgcatcccagtaattttgaatcgacttcgtcaaaaggatgaggaatggactcatgcaagacatttaatgaatcaaggtgtatggagagatattcaaactaagaattatttcaaatcctttgatcatcgttcattctatttccgacaagtagataagaaaaacacaaatgttaaagggttcctatgcgacattaataaggcttatatgcaaaatagaaggattgaagctgaatcgcataatattacagaaactaattctgagaaagttctaaatcagcaagttgattctcaaaattgtgaaaaagataatcagattagggaaacgggaaatgataaaactaaaaatattcctcttagattcaagaatgagtccaatagttggagcgtggactcagaatttacatctcaaatgccagatttggaagttcacaaggaagtaatagaacttattagctttacaatttatcgtcaggcaaatggcccagcagctggatccaaagccagaaactttttacaaagatttgtccgttcattattcttacaaactggatatggctctttagataatggattagtcacattaaaagagttgcaaagcgaaggaacatcttttaaggcaggagttagtaaaaatattcaaggtggggcttctaatagtagttttagctcatcttcacttagtggtgcaggtgaaaaatctttacttactgtggaagcttatgtaaatgcagttactgaaggtaatggttcaacaggatccatttcatttaacggtaattcgatgtctagaggaagaaggatgaccagaaatcatttaaggaagtcaaatatttcaggtcagatttctgaaaatgtcaagggtaaaccacaatcaggggattatgctaatgattcagaggatcagaatgcttcaaagattacggatttggtaactggggttggtgagtctgtttcagttgatgaaacaaatggaggcggaaattcttcaaactcaaatggttcagaaaatgcttcttcaaatgaagaaaatgacttgagtacaatatttaaatcattttcttcaacttatgattgcagaggtggacttaagtatatttggaatgataattgtaaggtaaattggcatagtaataatttatctccagattggttttattcaaaaaaggtacaatataacagcgaaggaagaagaataagtatggagcctttggatattggcgaactaaatacatcatcaacctccaatgattcagaagatatggttaggtatattatgggtaatgatcatgtttgttgttttatgaaatattaccagataatatatgagcgtttgaaaaaggcaaaaagtactatagaacaacgcgagcagaatcctcttccattccaaagatggtctccaaatggtcctgatgttcctagaccaacgtacaaacaagtgatttggtgttgttttggacttctatctggagaattggagctcagtttatttgaagacatttgtagagatgcaatgggaaatgattcatattggcttggaacaatagacaaggtgttgcagggtatttcgaaggtagttatacatattgttaatgatttagctacttgtagattaatggctatgaacttagcatacagagatacaatttttgatcattataagaagttagaggagtttatagcagcatctaggtcattacttccaacaattcaaacatcattctatattattacttggtcccctagtaactctgtattgaaaattaggatgagacagttggaggattattcaatgacttttgtaccttttattcaaaatgactcgaataatattgaaaacttggatgaacaaatgaaaattaatgaccaaaaaggggagatatattcatctgattcaacgaaaggaatactggaagaaaatcaaatgagaaatttaagtaattctaatgaattaaatcaggaatctaaacctgaagtagaaaaagaaggcatagataaagtagaagaggagaattcaaaaggtgttaatgaaaatcatgacgatgatcaaaattctaaatcggctagtagtggcctaaaattattatctgaaatgaagttattgcctccagaaaaagcattaaaagacttgggaatggaatcaaaccaaatcgagattggacaagctgtagatttaacaaaccatatagagcttttacagcagattttagttcatcaattaagtaatgttagtgatgaggctatggaatcttctgaaacaatcaaactgaaccaattttccgataaagaaaacgctaagatatccaagttattattaaatgatcccgtttcattctttgtatgtatggagcaaacctttgtaaaacccttattatattattcaccaaaaatgaagtttatcgcaaaattggcagcttctgctcaatggttaggattcttaccagacaatagtcatagagagattgcaagatctccatcaatacttcgcgaatccacttcgactaattccataagaaataatgctaatgagccaagaaaagcgaaccgtcgtggcttattatctgctgaaaaccaaactcagacagatgatgataaaggacattggtctgaagagtcagctgaatcaaatagtcgaacgatgatatctactaatgctggacgaaaaggaacaggaaagaagagaactagaggaatgccaagcgatattgttactgagattgatgatctggatattagagtaacgagaagaagagcaggaaatgcttcaaaaggtggattcagaaggtag

SEQ ID NO: 1935 - DNA, 399 bp, Cryptosporidium hominis
atgaaaaaatcaacaaatagcaagaccccaaattcagaagtttccagtccaaaggttccagcatcaaataatatattggatgtatttcaagaaatgaaacaagcctatttctcaaaagttcctgaaaatatccaaattttggattcttttatattatttatggctataatttccattattcaaattatttattgcctacttattcgaacaacttatccaatagactctctgattggcggagtgttttgcactactggaacagctcttttagtctctgtcctcagaattcaattaacttgcccttcatattttggtgacgtttctccaaaaactgcattcactgattttgttatttgttgcattgtattctttattggatgcgcatccgtattagtatag

SEQ ID NO: 1936 - DNA, 1905 bp, Cryptosporidium hominis
atgatttttctgggtgtgtactattttgctattctgttattattttctatattagaaaataagttcggaattgctcatgataccaaatttcaccatgaaaataaaacaaaagtcattgaattaaatgataaaagtaacaagactttattcccaattgatgcagcagatcttcttgaatgttcaaaatataatggatatatactattggacaaaacaaatcaagtgactaaaaatgaaacacacacaaacaagttattgcctttagaaaatatatatttaagttcccacttttttggaataatggagtcaattgcaggaacatctggagattttgtgaatgatgcaatttctggattacaaattaatcgggttgtgcaagcattaaaagaaacaagaattcaactttatttaggaaatttccaagattctccaaaaataatgcctaaaaaactttcaagtattaatttaagttgtatttatggaaattaccttccaagcttaaatttttatcactttaataacttttgtgaatttactcaatgcattaataatgactatttattattaagtgaagatcatatttgtaattataaatattcagaaaaatatatgtatggtgaaaaaatgaaatactttaatgttcttgcaagcttgaatattccaattattaactatttagagtttgatcaacaatttattacgttgttcaacgctcacaatatttacaatgatcaaatgattcacttaaatagatatttatttctttcaaatgagttgggattatctctatttattaattttggaattagattctttgggaaattggaaagtgataaatactatctgctaattaagatagtaccaccaaatacattttggattaaggatgaatataaaaatttggaagaaaattctagggaaaataaggtaattaatcccgaatcatgtacaaagtacgaaaatggaacccgattttttgaaaaaaatactgtttctatcattgaaactgataaaaaaagcaataatttgatagttaatcgcaattctgttacttatttgaacatttcatttaataaaataattaaatgcttagggaagtattcaattaatatatatacaagatcaagttatggaaagtctttgattattaagatttttgataaagaaaaaaatgaatttcgtgatttggagatgattgaaaatttagaaaaaaacaaaggattcaattatttacacaaattttcaagtaattataaattattttcaataataaatatgatgattatcaacgaaaataacagtaatatctctatcaattacataatttcttgtaaggataatcgcgtttcaatgagtaatttactttcaagcaatttgtatgtattaaaggaaaaagtcctctggattgggaatttagaaatatcattcaattcaacaaagcttgctaattactcgaatggaataatttttacaatattgatattgtcactacttatttcagctccaatattaggactacttgcagtagcaataaaatcaataataaagaggtttgatagtcgtgaaataagtcatttgagaattcccttgacagaaaacgtaaatacaaaatttaagaatactttagaagtaggaaggcaatcaaaatataatgaaggagaaaaatacccgataagaactttggaaatcccatttaggttaaaaaaagattttataagtcctttatcgagcccagtatcttctcaggcagatataagtcgtagtctatataatcaacttcaatctccagatcaaatagaactattcacagcaatttcaaataatatatcgtcagagtctattcaatataatactgatacatgttcgtccccttcgacaattaaatcaataacttttaaacattga

SEQ ID NO: 1937 - DNA, 984 bp, Cryptosporidium hominis
atgaattgtactttgcccattttaaagtatagcagagaattacaacaagatctgctactcagaaattatgatattctgtgggatgtagacttaggagggagcgaattttgtagagtaaaactgggcgttcgtaaatacaatggtgaattggttgcaataaaaatagtaacaaaaacgttctgcagtaactttgaaaaggatgttgtgttatatatccaagacaaattaacaagtaatacatctttacccgagccattaaatacgaaaagttacaatgaatattttccgaaaatttttgatacatttgaagatattgattttatttacattgtaatggaattgagttttggtggtgagcttttccatttactggttagatctgaagataaattaagcgaagaaactgtgtcactaattttctctcaaatttgtagtgctttaaaagctcttcattcaataggaataatgcatggagatattaaagcagaaaatattaccttttctaaagaaaaccggcttgattcaataaagctattagattttggaaattcttgtctgatgttagctaacgaaaaatcaagcttgggaaaaaataatgtagaaataccaatttataatcaatgttttatatttaatgattcaaaaaaggaaatccaatttaatcaaacatatttcgacttttggtcttgtggaaagcttctatacttgatgcttacaggcaaatatctcgaaatagatttttttgaatgttttgactttagtgatagtactaaaaaaaagatatttgagtcgtcagaattaaaactttgtagtgatcttgctaaagatttgttatataagcttctttcatatagtttttatcaaagtgaatcacttacaatggacaaagttttgtgtcacccgtggtttaatttggctaaaaatacaccaataattaatcatcatatatatccacacgacgaattaatcaaagtaatatcttga

SEQ ID NO: 1938 - DNA, 558 bp, Cryptosporidium hominis
atggatttatctacaaaaaaagaagagaatcacgatagtattcaagaagtaagtaaatcagaatcttcttcaccaaaaaagttttctaaaagaaagatgctttataattttgcaaattctgtttgggattatgtaaagccagtaagtttggatgagttagagagaaaacaaagtgagtcaaaaactatagaagacgaaagtaaaaataaagataataatgaatctgagttgcttaaaagtcatatagaagttaaattgaatactgaagaaattaataattcaaatgtaaaattagaagagaataatacatttgaaaataataatgaattactttatgaaaaagtggaattgaatcaagtagaagatttgaaaagaagcaaatctcaagaaataataagtcatttgaataattgtggtaatataaatgatcaagaaattcttatgaatacaagtacaaaattgagtaattctcacaatggttctttggtaagcactccaataaggaagtccaagagacaaattatttataattttgcaaactctatttgggattattaa

SEQ ID NO: 1939 - DNA, 1338 bp, Cryptosporidium hominis
atgcttatttctgagaaacaagtcaagaatcaacatggtatggtgggttattcttttcaaacattagaatgttgttcaggaaaaaattatcatccaaatatatcttctgaatttatatctgaaactttaaagactcaacattcttgtagtaaagttaataaaattaaacagtttaataaactttatagaattaataataagcttaataagaaatttagagaaattaacaacaaaatctctatatttaatcaagaagaaagttatactaaaaaagatattgatttgaaagtaaaatttgatgatattcagcctgattcttctaattttattaatgaaagaccgtctttaaacaaagaaggatatattgtcatagaagaaatactaccaacacatgaaatttgtagtcctaagatatttttagatgcttcagttaacactgaaattattcaaaaatttaataataattaccaagaaaaaggtattaacacccattttgagcatattaaagaagatcaaaatcaatcaacttcttctgaagttcctaaaacaactaatttccttgaaaaagataaaaaagttgattcaatctttagaaatgaaatatataagattcttgataatactagattagtcaaaaaagttcaaaaattaaaatctggatatgctaataatgatcaagttgaaatagaaactgatcataactttaaaaatagtaccagttccaatattaaatacaataaggaaagatacattaagccaggtaataatagatatgatattattactcaagaaactagtagaaaatatataaaagattatccagaaagtaattctgaagaatctattaaagtacttagtccaaaaaataattataacatcccaaaaaatagtcaagtaattatagaaaatactcctaaatacaattacaaatatgaagattataatcatatttcacctaaaagtttagaacctattaataataccaaaaaccattacagttactatttgggtagtaattctaattccccaacatacaataattattcaaatattcgggcttttagtaatattagtaacagtaatagtaataacgttaataccagcagttactactatagtggtggagataatcatactcaaataaaatatcccgaatattttattaaacctaataataagtatgttaatgaattaggaggcagtaactatcatgttaactattattgtggaaaatctggaggatctgaagaagtcaaaagatatatgtatgttgatggtttaactaacaaaaatcaaggatcattttatttttatccccctggccaaggtagaaattga

SEQ ID NO: 1940 - DNA, 1275 bp, Cryptosporidium hominis
atggtaaataataataaatttcaaagaagtggagaatttgttataataacaatattaattatattattggtgattacaaatatttccctattcaaaacaagttattttctacatacactaatatgttcaatatcttctttgctaacttatttggtttgtagcaaattgattccaacattcggagagaaacttcttgagaatggtctttttggaatagacattaacaaaagaagtaatagtattagtaacattaattcaaagacgaatttattgaaagaaaatgaatgtaaaaacaatgaacttgtaatattagataaaaaagatatagtagagaagaagataccagaatcattaggtatagtaccggcaagtatgtttatgattacagcaatttgcagccaaattctatttagtaatgatccagtaaaattattagagtataattcaggattgttttcaatttgtatgatgacatttcttggatttgtggatgatgtattaaatttgaaatggagatataagatggtattaccagtatttgcagctttaccaactttggtttcttataatggaggtactcaaatagttttgcctttatttcagacaggtggagactattcagcaaggattttgatagatttgggatatttttactacctttatatgttatgcctgacagtattttgtacgaattccataaatatatatgcaggagtgaatggcctagaagttggacaatcgataataatctcagcttcaataattgtttataacataattgaaatgcttacaatactaccaaattggcaattcagctttaaatcaaaccaccattttttttcaattttactcttacttccctttacagcttcaagcctgtcgctattccattttaataggtatccttctttagtatttgttggcgatacttatacttattttgcaggagcttgttttgctattgtaagtattttggggcatttttcaaagactcttcttcttttctttctcccacaaattttgaactttattatttcaattccacaactctttggaattgttcattgcccaagacatagagttcctaaactaaatgaaaagacaggaaagctagaatcttctaagaatcttactcttcttaatctggttttggaggtcacgggccctttaacagaaaggcagttagtttattacctattggttatccagatcatttcaagtatttttgggttcttcgtaaggtactctcctttcttcaggatcttcttcgaatag

SEQ ID NO: 1941 - DNA, 1101 bp, Cryptosporidium hominis
atgaagttaaaattggcagtattgaatttaatattattattagtaattggaattagaggagatgaaattaatgcttctattaatggacataatagagctcaaaggcatgcaaaacctacagcttcagcatcttcatatacaccccaaaagcatcatcccacagtttctgtgaattctgagaaaaaaattcaatcttttgttaaagagcttaatgatagcaattttgagcatcttacacaatctgcaactggatcaacaactggtgactggtttgtgttattttatcttccaaattgccaacaaagtcaaatgtctttagcagagttggataaactttctgtaattgctagagaaagtttaaatgttgcaaagattgatgtttctaaaaatcaacaattaattaaccgattcggaattgttgctgttccttcgtttagattctttaggaatggaaagatgtacacttatactggtatgagaaatgctgaagtaattaaggcttttatttggaacaaagactataagaaactaactcctcaaccagttcctgaccctcttagtacccttgatattattatttctgaaatcaaacacacaattaacgatatcaataaattaataaaattagctcctttagttactatcattatcttacttattggtttctttactggaattggcgtgaccaatattttctcaagaagctccaatagatccaagactactactagcaataatagagtaaagcgtgataagtactctgatgatgaatgtgtggatcacgaagaagaagaagaagaagaagaagaagaagaagaagaagaagaagaagaagaagaagaagaagaggaagaagaagaggaagaagaagaagaggaggaagaggaagaagaagaggaagaggaagaggaagaggaagaagaagaggaggaagaggaggaagaagaggaagaagaagaggaggaagaagaggcaccaaaacaacttaagactccacaaagaggcagaagagctgcagaaaacattgcgaaggaggatgatagattaaataatacttataatacgagtgtaaggagatcaaatcgtctaaaaaagctatag

SEQ ID NO: 1942 - DNA, 381 bp, Cryptosporidium hominis
atgaaactaattagattccttatgaaattaatcaataattcagtagtaattgaattaaagaatggaacaattattcaaggaacaatagtaagtgtggatatgtctatgaatacttatttaaagaatgtaaaaatgagtgtaaaacacagaaatcctgttagtctttctcaaattactgtaagaggaaatactattagatactttatactgccagactctttaccactagatgccttattaatagatgatactcctaaacaaaatccaccaagagtgaatccaatttctggccctaaatttgggaataaatctacaacaaatttatcaggtggaggcaattatgataataaatctcgtgcttcttttggtaatagaagatag

SEQ ID NO: 1943 - DNA, 456 bp, Cryptosporidium hominis
atgggaagagtttacggacgtggaaaaggtatttcatcatcagctaagccatatagaagacgaccaccaacatggattaagttaaagccatcagaggcagaagatttaattacaaagcttgcccgtaaaggtttgaccccatctcaaattggtgttactttgagagattctcatggtattccaatggtccaatctttaacaggtagtaagattttaagaattttgaagaagaatggtttagctccagatattccagaagatctctatttcttgatcaagagagctgtttctatccgcaagcaccttgagaaattcagaaaggatactgctgctaaatacagattgattttggttgagtctagaattcaccgtttagctagatattttaagcgttcaaagcagcttccagccaactggaagtatcaagctgctactgcctctactttggttgcataa

SEQ ID NO: 1944 - DNA, 1800 bp, Cryptosporidium hominis
atgaattcagaacaattaattgaatcagaaacttctgatgaaaattatacttcttcaacagacgaatttgaaaggattaatactaacaatgaggatttaggcactaatgttgatacatttccattggggattggtggtttggaagtcccacatgaaaaggaagattttcgtagagtacttactcctttaagcaaagatcagcttgtagagttattagctggtgcatgtattgaggatcaaaaaattttacagagagtttttgccgtaatttgtgaaagcagatcccataggcgtctatatataaagaatttgccattttctgctaataccgaatccgtaatagaagttttttctcaatttggagatgtggaagaagggattgttctcaaaaaggatgggaaatctagaggttatgcatttgtaacttttaaaacaatagagtcagcactattagcttgtaaaaaccctgtgagtatgagtggcaggtttttgatggtaaagcttgcagctgatccttttccatttgaaacaaaaaggtcagatgcaatacgtagaaagctttttgttagaaatttgggttttgaaaccaatgaagattccttatcggaagttatgggacaatatggagagcttgaggagtcagttattttgagaacaaaatctggagaatccaaaggctatgggtttgtaacgtttgctagctctgaagctacaattaaagcacttcaacaaccacaccaccttattgacggaagattagtttttgtacatcaagcaatagaggggaaaacacgtatgactaaaaataaagaagtttatttgcaaaatagctcaaaacaaacttacgagaataaagttatggagagtaaggatcagttgccattgccttgcaattttgatcaagtggtaccaccctcatcttcaccaactattactaatttacaatacgccaattctaaactttcaagagattcattatttttacactttatggagaaacccaatttaagtagtaattttggcacgaattattctggagttgacagggtcttatttgataatgaatatcctaaccctgttaatggtgttgattcgaatttaagcaatttccctaatttaacagatgattttaacttaatcaaaagcgtttctttaaatcaaggtactagtaataataataataataataatattaataatatacgtttcaataaagctaaagatcatccaaatctaaagttagatcactcttgtgattttaatattccaagtagagccaacattgatatgagatcaacgaatgccgtccatctccctaataatgacgaccattctgagaaaaattataatatttttgttgatgagaatattttttctaatgatcatatgaataagaattttggaagatggtatttatcaaataacacaaagacccgctcgttcccgaatatgcatttcaaggcgccaaatcaatcaaacttgtcaggaaatttaccttctattaattgggcgatttctaataattttagagagaaaatgaaatcaagaatggaggatatgagcgtattagatactgaatataacgagtttgaagactttatgtttaactcccattacaaagaatcacgccaatgtccaattaataagtcaccttcttggaatagctttgcagatagatttggccatgattttatttctaacaatctggttctaaaggataaacatattaatagaaagtgtgactttaatcggatcgcatattcacctttgattctggataaaaaatttacagccttttga

SEQ ID NO: 1945 - DNA, 1419 bp, Cryptosporidium hominis
atgactatgaaatcgacagtcaatttaatgcttggggtagcaatcggaacagcaattggctataagctgtatcccaatattgaaggaaataatctgaagcataatctattaaagaatatggatattcagcatgttaatattggacagaaatatttttcaaagaagtttaataagtattcggataaaattgtaaaatctgtgacaggtggattctatccatcagttaaacttcctagtactgaaaatctaattcttagagagtcttatttatcatctgtttcctttagagacaaaatacctaattgggtagctgagaagatatctaatgaaacttgttcaggaaaagcaaatagggcagactgtgttttccaagtagacccagatgttccattgatttggagtgctgaaaacaaggattactttgcaagtggatatagcaggggacatatggcagcagccggtcagcataaaaatacagaaacggcccaatctgatacattttatttatctgggaatatactcccacaagatctatccaataatggagcagattggtatagattggagctcatttcaagagaacttacaaattattatcaagatgtttatgtagtttcaggcccactatttgctccgaattatatgcgttctaaggactttaaaaaattggcacaaaatttagaaagtattaaaaaggaagatcctccaaaggatgcgcttggccagatatgtgttatacacaagaaagacgttcttgacaaggctagagaattaggagatgagaaaaaaatggatccaaacctcattgttaaatctgatttgaaggataccccagttaatactgttacttatgaagtaataggtgacaagctcgtctccgctccaccacatttattcaaagttattttagcagtcaatccaaggaaagaaaaggatattgatgttcctcccgttgcgtttggaagcttcattatgaagaatgaacctgaaagcgagagacatctaattactgaatacatggtgcctttaaaaagtattgaaatttctacaggcttagacttctcaggtctcaaagaatttacaatcaattatctaaaagctaatatatcaagaaaagattttaaaaagcttttaaaccatgaagatttagataaatttgagaatatgtacagcatttgtaatgttaaagacactctaagacatggtaaaagtgctcaatctatatgtaatgatgaggactcagaaagagtaaagtcttggaggtatcttgggtatattaaattatctaaaactaaaaaagaactcgaagacatatggaataccatcaaaagcaacggatatgataaagaaaatttcttccttagaaaagaatatgtaaataaatgtaaatctcttggaattgaaccagagaaattctaa

SEQ ID NO: 1946 - DNA, 4767 bp, Cryptosporidium hominis
atgagtacgttctacaatgataaaaacagagcaagctctcgtttatcgccaaacaatagaagaagtacagagtctttagcaatgaattatcgtcaaagttctgttccacctcttgaccagactatgttcaattctaaaaattcaaaaagtaggccaacaagcgcaataaattctagtttggatagtacaagagggtcttcaattgcaagatgctttaaaaaaggcttgggtggtagtatactatcaagttgtatgggcgttaacgatactcatagaggacaacattcagaacattttgttacaggctcggatgctcaagaaaccgtaagaagatatagagataattattctcaattaaggcaactttttgaaaagctcaaggagcagaatgaaattctccaaaatgaaaattaccgtctagaagagtcactcaaatctgctcaagatgcccttaaagccaatcgaacaatggactcaaagaacttgagtagtaatttgaactatagccaaaaatgtttggatgcatgcgtgcattacatttcttatacattgaagtacttacttgataacccagaagaaaatgctttgaatatttctaaagcattagtagagagagcagttcaacaaagaatttatttattagagccaaaattggatgattccattaaacatcttcaagaaaacattattgaatttgagaaaaagagtagagcagccaagttaaatgaagaaagattaaggatagaagctaataaaaattcggaacatcctgaaagtattcaacaaaacattataggatctaaacattcaatgctctcatcaagtaaaattaacgatgaaagtgatattaatccagagagtgagtactctaagcacaagtctcaattagaatctggaaaatctgataaactttcaacaccaaaacaatcacaatctaagatgccatccatggatcattcaaagagtcattctcaagcaagtcgttcttctttggaatcatcaaaagctttatcgcagactttgcctcaaagcaaatcaaatgcttcagtatcgaaattaaatactagcaagagccatattgaacaaagcaaaacagatatttctaaaaaagagggaagtattcataaatttatcgaaaatattgaaaaaccaatcggagaagtaaaggaaatggttgaatctgttggtaagtccgtctcatcctctttgaagtcgccttctatctctgcttccaagaactctagcgctattttaagtaataaggagcaaaatttaagctctgctaatcccaaagataactctatagatttaaattcaagtaattccaaggcatctgaaactataaaatcaaccttggaaagcaatgagccttcactaatttccaaaaaagatgccccagctgctccaccagctaaaaaggacgctccggttgtgcctccaacaaagaaagaggcccctgccgggccactaaagaaggatgccccagctgctcctactgctccaccagcaaagaaagatgctcctgcaacgccactaaagaaggatgttcctgccgcaccactaaagaaggatgccccagctactcctgctgctccaccagctaaaaaggacgctcctaccgcaccactaaagaaggatgccccagctgctcctgctgctccaccggctaaaaaggacgctcctgcagcgccactaaaaaaggatgccccaactgctcctgcttctccaccagctaaaaaggacgctcctgtcgcaccactaaagaaggatgccccggctgctcctgctgctccaccagctaagaaggatgccccagctgttccagctgctccgccagctaagaaggacgctcctgtcgcaccactaaagaaggatgccccggccgctcctgctgctccaccagctaaaaaggacgctcctgtcgcgccactaaagaaggatgctccagctgcttctgttgctccaccagctaaaaaggacgctcctaccgcaccactaaagaaggatgccccagctgctcctgctgctccaccggctaaaaaggacgctcctgcagcgccactaaaaaaggatgccccaactgctcctgcttctccaccagctaaaaaggacgctcctgtcgcaccactaaagaaggatgccccggctgctcctgctgctccaccagctaagaaggatgccccagctgttccagctgctccgccagctaagaaggacgctcctgtcgcaccactaaagaaggatgccccggccgctcctgctgctccaccagctaaaaaggacgctcctgtcgcgccactaaagaaggatgctccagctgcttctgttgctccaccagctaaaaaggacgctcctgccgcaccactaaagaaggatgccccagctgttccagctgctccgccagctaagaaggacgctcctgtcgcaccactaaagaaggatgccccggctgctcctgctgttccaccaatgaagaaggatgccccggctgctcctgctgttccaccagctaaaaaggacgctcctgttgcaccactaaagaaggatgccccggctgctcctgctgctccaccaatgaagaaggatgccccggctgctcctgctgttccaccaatgaagaaggatgccccggctgctcctgctgttccaccagctaaaaaggacgctcctgttgcaccactaaagaaggatgccccggctgctcctgctgctccaccagctaagaaagatgccccagctgctcctgcttctccaccagccaaaaaagacgctccagctcctccaccaatgaagaaggatgccccggctgctcctgctgttccaccaatgaagaaggatgccccggctgctcctgctgttccaccagctaaaaaggacgctcctgttgcaccactaaagaaggatgccccggctgctcctgctgctccaccagctaaaaaggacgctcctgctgcacctccaatgaagaaagatgccccggctgttcctgctgctccgccagctaaaaaggacgctcctgtcgcaccactaaagaaggatgccccagctgctcctactgctttgccagctaagaaggatgccccggctgttcctgctgctccaccagctaaaaaggatgctcctgctgctccaccggctaaaaaagatgctcccgttgctccaccaatgaagaaggacgctcctgctgcacctccaatgaagaaagatgctccaccagctccagaacctccagcaaaggatgcccctgctgctcctccggctaaaaaggatgctcctgctgctccaccaatgaagaaggacgttcctgctgcacccccaatgaagaaagataccccggctgctccgccagctaaaaaagatgctcccgctgctccaccaatgaagaaggatgccccagctgttcctgctgctccgccaatgaagaaggatgccccctctgttccaccaatgaaggatgctccaccagctccagaatctccagcaaaggataccccagctcctccaccaactaaaaaagacgctcctcctgctccaccaatgaagaaggacgctcctgctgcacctccaatgaagaaggacgctcctactgcacctccaatgaagaaggatgccccagctgctgctcctccagctaagaaagatgccccagttgctcctgcttctccaccaaccaaaaaagacgctccagctccttcaccaatgaagaaggatgctcctactgcacctccagctatgaaggatgccccggctgctcctccggctaaaaaagatgccccagctgcaccaccaatgaaaaaggatgccccaccagctccagaatctccagcaaaggatgccccagcttctccaccagctaaaaaagacgctcccgctgcaccaccaatgaagaaggatgctcctactgctcctccagctaagaaagatgccccagctgctcctgcttctccaccagctaaaaaggacgctcctgctgcacctccaatgaagaaggatgccccggctgctcctccggctaaaaaagacgctcttgctgcaccaccaatgaagaaggaagctccaccagctccagaatctccagcaaaggatgccccagctcctccaccagctaaaaaagacgctcctgctgcacctccaatgaagaaggatgccccagctcctccagcaaaggatgctcctgctgctcctccagctaagaaagatgccccagctgctcctgcttctccaccagccaaaaaagacgctccagctcctccaccaatgaagaaagacgctcctactgtacctccaatgaagaaagatgctccagtccctccagaatcttcagcaaaggatgccccagccgctcctccggctaaaaaggatgctccagcttctccaccaatgaagaaagatgccccagctgcaccaccaatgaagaaggatgctccaccagctccagaacctccagcaaaggatattccagctcctccaccagctaaaaaggacgttccagctatgcctccagtaaaaaaggatgctcctgctgcacctccaatgaagaaagatgccccggctgttccagattctccagctaaggaagccccagctataccgcctacgaaaaaggatgctccattatctccaacaatgaaaaaaggtgcaccaacttctccaccaatgaaaaaagatttaccacctgcgccacctatgaaaaaagacgctcctactgctcctactcctattaagaaaagccctccgattccaataaaaaaagaagcacctaactga

SEQ ID NO: 1947 - DNA, 375 bp, Cryptosporidium hominis
atgttgagtgaaaaagaaaaaagtattgaatatctcaagaaaattaaaaaatttcgtcataaaattgatacaggaataattaaattaaagagtagactcttaaattatttgcaggaacctctttatgattacttggatgatacaagaaaggaagtggatcagctttataatgaaactagaatgtatgtatattctcatgaaacgccattcaatcctaggtatgctacagatgacgaattaataagtagatattccatggcaaagcttattgatataaagactagaaaattaatggataaaacgattaacatgctaagtttggagaatgaacgtcatattgaattaatgcaaaaagaaggattttatggctattaa

SEQ ID NO: 1948 - DNA, 1062 bp, Cryptosporidium hominis
atggatttattttggcataaatttacttgtagtatattattgcttatatctgccatacttggatatttcttcccagctaagattgataatgatgagaagaataagggacgtaaaagcaagattcttccaattttgactgcttttggagcaggagcttttattgcactggcacttgttcatctcattccagacgcaatagaagattcaagctctggattattgtcttttaaaatagcaggcattgaggttaattgtgtttgccatttaattttgttgggtttcttattttcgataatttttgaaagtattgctgacgagtattttgggtcaaatggaatacatggtcatagccacactaggcataacacagattctaatcatatgaaagataacataaactctaatatgatgagcactaatgtctcatcagagtattcatcagatgaagattcatgcattattgataaatttgacacagatttaacagctggtaaggaaaattcatcgttatgcatgtctggttcaattaataaaaactcaacattatcgtcaaaaaaagccagagtaaatttatcagagaatgataatggattgagggcagaattaggcaaaagctcagttggatttgttttggtttgtgcattattcttccattctctatttgaaggtatggttgttggaacttcaaaaagtattatgggcacttggatgattacctgcgttatttttgctcacaagtggattgaaattttaattgtatatatgactcttgtttcaaagggcattaaccctttggcttacattattattctttcttttggatcacctttaggcgcgatgattggagccattgttattatctcaaattcagttgcatcagctgtttgttcagctcttgcagcagggacaatactttatgttgcttgtattgaagttataccagatgtttttaacgacaagcactcgatccgcactcttgtaaagttaggatcttttgttactgggattctaactgtttctacgattaccttagttagcgaaatagtagagaattcttattaa

SEQ ID NO: 1949 - DNA, 834 bp, Cryptosporidium hominis
atggaaagggagaatatatttaccgaaagaaacctaattgaaaatttgttcagcttttcaaaaagaaagaaattcgatatacaaatcaacaattctaagctttgtatttgcttgaattgcaatcaaactggccacgtaaattgtggtagacaagctccaatgttttctaaaggatccaaaattaaagatatgatttcatcaacagaaagcaaattcctcatttttccagaagattctaactctatatctcaaatcaacagaaaccaatacttaaaaactaacattattatccctagcaataagctttttaatatatcttatcttttagagtttacaaaaagctctctaaatcaaacaaatattaaagataaagtagtcgaaatcgaacaagaaagtagaccaatcttcacttctcgaaataataactttagccaaataaataatagaccatacccacagaatcaaatccaatttcatcatcctaatcaattcaatatccacaaccataatgttttacaacagcaaatccctaatcaagcctattcttatcataatcataatttacaatatcagcactttcagaacaacctacagctccatgctcacttattccaacaagatcctatatacagaaacccaaaccaattactacaaggtcaacaatacaactatgatcgactagttagtaatcaaatcaacgccggtttcgcgtcaaatcaaaataatacagtctactccaggtctgcagtgcaaacaaatagaactacaaccacctctaatgccaagagaaaagtattcaactgcggctctaacttcagaggaaggaggaaatag

SEQ ID NO: 1950 - DNA, 3228 bp, Cryptosporidium hominis
atgacaacagttagtggagatttaagcgaaggtactggaagtggaggtacgcagaaaggacggaaaggaaaatcaaggcgtcatagcaaccaagtacgccagacaggtatctcagagtctaagggaggcagtatgaatgatattcctgtagaaaagaatggagtcatttctgtttgtgatatagagcttttgtcagaggaggataaagcacttccagactcaaagttagcaagctataatatagaggaggagtacattggatttggtgtgggcctatctgcaggtttcgatagatattctcaatcaaatggattcaactcaggtggaggaaatatggggattcgactttgttattccagtctttggcgaaaacttcctcagcagattcctgttagagagttagccatgtctagatatcacattgcggtgctattgaacaatggccacgtttatgtatcacttaatgatatgaatgaaagtcttcacggcaatttggagaactatcaaaagatccaagggatattagttggtagtcaacaagagcgtcccgaatctggaaatgaacagagaaatagcataaatagcagcaacacactgcttcttgagagtagtattgtccaaggcagttggcttagcatcaaggagttagatgataagaatattcgagggttgagaatcacctcattggcggtggaggctgcaaattttgactacaagttcggtattaaaagcttcgttttagcgtgcctagcaaatgatggcaaagtttggatcgtggaacatagctcatccatccaagggggatttaataatgtccgctgtatagatctaactcagctaaacccaaagaatcatgatggaagccaatctgagaggcagatagacaatgagttttacaggactgttgatgtaacactttccgagattatgccaatgtacaaaaaagactttgaaaagggtgtcagagctgaagaatataatgagtatcaggatattgcctttgatgactttccatctttcccatataaatatggaatggccattacctcccttttggctgatgggcaaagcaatagtatcattctaaaaaaaagtagtgaaattggtaaaaataataaaatgattgtattggatcttccagttatatgtagaaaggtgttttgtggatctaattctgattttgggttgatattattgcaaaatggaatgctttggaattgggatcgaagacaagctcagacagaagagccagagcagagctgtgatcttaagcccaagatttccattagagaactagacagacgagatgaagagtgttttccaagcaagattagcctaaaagtcttgaagggatcactgcttgggagaaaggttattgatttttctagtctaaatggagaatttattgctttgactcaagatggatttatccatgaatggaacgatccggatagaatgagcatatttaaaaggccattaattcaaaatccagttattttggctccaaaaactcaccacatgatggttaagaaggctctttcgaatagcagatactggtctcttgattcaatcacttctaaatgcccccaaagctacaccagtcaggaacctcccgtggaaaatgaaacagaaaagggagatacaaattctaatactcttaaagaaatgactgatagagaaatcgaagagatgtataatcagaataaccgaattattggtgcgtggctattagaaggtataactttaattctttacaaaaacggagttttaaaagctcttcacaattatttaggtagggatggatatgatacaaaggttggtttcacatctgaagaggacgagctctgttggaataaacataactcctctattaacagctgcattctcttgtcatcaagattgggaagatgtatcccagctaatccaatagcattggttgggctgctctctaattttggacaattcaaatccttaccagatagacaaaaacaactaataatacagaggtctctagttaaactttcactaagggaaaaaccagtgtatcgtatcttagcttgttataactccatagtctttggagtcttaaggccaaacgccaaatggcgtccaggaagaggtaacagctctaaatcccaagcaacaaaacgtatctgtaagtctgatccttttccccaagaacagtacaaatctcttaatgacgaagagatgaatctctctgccaccgttaacctcaacaatattaaagaaatcatcaaaactcaggaaaacaagggagaactaaacccccctgaaaattcagcctatagcaatgttatagatattgtaaagccagctactattcaagaattgcctgccttacatatcccttcaaatgataatactcaaactgtaactactaatgaagtcagtaccaatgatcagaaccaggttccgaacaaaagaagagggtcctctagcaatcgaaattcctcttccagaaaaagttctagctcttccaaagctatagctgcttctattcaagtcccagaaaatactactccacttggctcatccccaacaacagatagtgctgttatttctatctccaatactactactaacgctacaaacaatatatcaacaattaatgaatcccccgctctttcaaaaaatgcgtttgattcaaatacagaacccaagaaaacaagttctaattcttgcaaacggagcaaggatgctattccagaacacaaaaacgacccagaatctaactgcttgttatcctctattccgccaaattccaacaaaagatcatctttatctagccaaaagggttcaaataataccacttctaaacctcaggtaaactctagaacaaggaaaagagaaaggagatcttcaacaaaaactgaagataaagagaacgcaaataatttgaataatttggatgataaaaatccaatttatgctgaaaataatgaagattattcttgggaatcgaagaagctaagtcttgttgaatacgaggttgaacaaatactcagcattcgtgaaaaacctctaactaaacaaaaggaatacttaatcaaatggaaagttcctggacaaccagtacaacctacctgggagcctgaagaaaatcttaacggttgtgaagaacttttacaagagtttctcaaaagtattaagacttctagatcaggaagaatactacttccttgtactgctattaacaagatcgtttaa

SEQ ID NO: 1951 - DNA, 789 bp, Cryptosporidium hominis
atggacgatctaaatcttgaattagaagcactacaagctatttactctgataaagagcttagtatcgaaactaaagaaaattgtcaaataattaatattcagcttatcaaagaagccaattatgaaattaatcccattagtgagaaaaatgaaagtattaaatttatcaaaattaaagtcgcttttcttatcaatcaagggtacccagaaaagtctccgcctgaaatcaacaatataaatatatgtattcttgatggaaaatattcaatgaacgaatgtcccatagacaattaccatgatgaagaaagtgatgacaatcgaattttattcgatgattcaacatgcatatatataaatacggatgaagttattaattactatgattcacttaaagaaagttatattggacgagtctgtctttttgacataatagaaaatttgcaagtatttattgacgatataacatcaaaattaatatctaatcaagaatttcaagtagaagatacaaacattggcttggattctattggaaaagatgatgatgatgaagttgtttattccagcttaactgagcgaattttgtgtccaatagaagaaagagtcagtgaagagcaatttaatctttggaaaatggcttttaaatcagaaatgattgaaaaaaaaatctggaaagatgaaaatcaagattccagccaactcactggtaaacaactttttgaaaaggacgaatcacttattaagagcgatgagaattcatctaccataattgaatccacttatttattataa

SEQ ID NO: 1952 - DNA, 747 bp, Cryptosporidium hominis
atgggtaaaagaaagacgaagaaggtggaggttaagaaaagtaaagtaccaaagcttgataaggagtttaattgcccattttgtaataatgtaaagactgtaggtgttagaatgaatcataaagagagattaggacatttgtcatgtagagtatgcggtgtggagtatacatctaggattggtaaatttgatgaagctgttgatatatattcaaattggatagataaatgctatgaggtaaatagtatggagcagtcaacttcatcatctgcggtagaacagcctatattgagtgaagattatgctttaacaggacatagtggtgacaacaagatttcccaaggcttaggcaatggtgatttagtaaataatatgatttactcaagaaaccaaaagaagatttcatttactatggacgatgatgttaatgaagatagatattcaaatgagaattcgagtagaggcttaaggaggatgaaggaagatgaagaagatgattatgatgatttacgagattttatcgtaaatgacgatgaagaagaggcaaaatataacgataatagtaaacagcagccaaagtcatcaaatgatgaaataatcgaaaagatgaagaaagatttggaaatcaataaatctaggaagatcaaagaggattcgggggtttttgatataaacaacataacaaagtcttcatcaatgccaaaatcatttactgtaaacgaagatgatggcttgtttagcgattaa

SEQ ID NO: 1953 - DNA, 618 bp, Cryptosporidium hominis
  misc_feature (595)..(595): n is a, c, g, or t
atgttatcattagatcgtcaaaataaactcccaaaggcttggtttgttgaaaatgttgcaaactttgagacttcaaatactcataaagaaatgataaaaatgctgtcaaagttaaacttttgtacatttgagtttatgctgtcgccaaccttaattggagttccaaatacgagagtcaggtattactgcgtttctgttaggaaagattctgcaaatttgatcaagcaattaaaggaattaaaaacatcaatctaccaaaaaaactgtcagtctattgcaagtaatgttcttttatcccattcaatagagaaaaacaccgaagactttaaacctgaaaaaatccctttggaatattcaaatttattatgctctcttccttatgaatataaccaaataacccaaatgatagataatataccaaactcaattagtgatgtggcaatgaaatcaaatgatatagattatgaaagctttaatttactcaaacaatttgccaaaaatattatcaaaaataacccctccttcaaatttgatatagtaaatatcaattcaaaagcttcaaccacatttacaaaaagttatatagaaaccaaanggtcgtggtggtcctctttttga

SEQ ID NO: 1954 - DNA, 1687 bp, Cryptosporidium hominis
atggtggcggataaagaagttacagagtgtggggtggagaaaaaagtagtattaaagtatcaagatgaattcttgcatgattggactcttatttgcacgagaattgagaatggcctgaagttgggggaccaactaaggcaggccttagaggaaagagcatcattggaagaaatgtattcaaacggattagaaaggatttcttcaaaatttttcccatcagcaactgaaagtacaagcatgagctttgcaataagaacattaaggaatgaaacttgtagaagatcccagcaatgtagagagctttgcgagaccttgagatccgatgtgttaaaagaaacattaaatagcatgttggacaatcacaaatctgcatatgatcatttattatcatctggaaaaagaataacatcagaacttcagaagagatatatgaattttactagattaagagataattatgggattgcaaggcataatataggtcagttaagcttgagataccacgaattgaatagatcgaaatctgcacaagaaaagataactattttaagcagagaaatacttcgaaaaatacttgaattaaatgatttagagaaggaatataacaatagtgttgacaactttgaaacttatcacaagttttatttgacggaaatgaagcacattattggtattttagaagatatggatacaaaaagaataaaatgtattttggatactttaatgaaaatgatggtttatgaaatgagttatgtaaggaatttacagtatgactcagatcatttagttaaatcgatacaagaaattgatgttgagggagatatttatgaatttgcaaatagatttggaaatagtaataagaataaatattcggaaaataattcgagtaattcaacaatttttactggaacatacaaaataaatgctgatcaagtaaagaaggagagttggagagaaatatgtaagaaaatgaataacataaaaataaatgatgatgagtttattactttatctacatctcaaatggcggagaaaaacattgctctcgataatatgatagacatacaagctataatttcaaatttggtgaatcctgcaaccgcaatcaaagctcaaaaagctgtaaaaattttactttctcagttcagtatgatagtaaatgagaatacgaagaattacatccatgaaaattattttaaagatttggaatttcaggaaaatgttcaagaagatttgataaaagacgaaaaaagtcaatcaatggagtcattttctacagcatgttcaaatgaggcaatcacatctaaaaataaggattgcaatacagataatataattaacacagatgaaagccaaactgaaaatagcattattgatgtaattgattttggaagcgtttacaaagagtttattgaaatcatagtgaagctagataaaagagataatccagaatcaaaggaaattattgaaaaagcactaaacttgatacatgatcaagattctggtttaaaagagtatgaaaattgtgatttatatttaagtaaaataatagatgaaattttaaaggcgaaaaataataaattatacttatatttgggtgatgagttgagccagatactatttaggcatatggaaatgattatggaactgattcaaaatgaaatattacttggctattcagaaaaat

SEQ ID NO: 1955 - DNA, 5412 bp, Cryptosporidium hominis
atggagcttccaagccaattgaaaaagagtaacgcatgcacaattatgaatgacaacaatgaacaaactaataaaactgatgcaaattggaaaagaagaccatcttcaaataaaggaacagagcatttcacagcaatttttgatatactattacaggataaagctccgaaattatcagaatttaataagatgaatcttaaaaaagtacaattagaaatttctaaatttgaaaaccaaatactttatgagttttgtggaagaattgaatttagcagaaattgtgaagcattattggaagaaatattgtgctcggacttaattatcgagtttggaaagagaatttcttcaaaagatagaggaaaaggctcggaaaacgttctaatagaaaacttagtaaatgtgattaatattgttgggatatttttatactttgaattggttattttcaatgaaatgacatttagtaaagaaattagaattatttctaatataataagaagcgtactgccaataatattttcggaaagcattaagaattgccatttggaagcttttaatacgtcttttattggctgcctggaaacaataaatacaattgtaagaacaaaaaatattcatgagatactttcaacacaaattattgttggtttgctttcaatttttttgatagaggattcaaatactatggttgtatttctcacgacggaaatagttgttcatttatttgtttctggatcattgaattctaatgagttcttggaaaattccttaaatttaatttttgatgtgatggaagaattacctcatactaacaaggcaatcaagaaagcgaaagtttgcattgaaatggactcatatatgcatatttatgtatatttattactgagacttatacaaagtatttgcatcccaaatggaatagtttctggcgacaacattcactcgatacaaaatatttcaatgaagcatcataatttggcgaaattcatatgcaaccagtttgcaacgttttttatcaattctatcattttaaagagaacaaaaagaaaagaaagtagcttctcaacaggaaatgacattgcaacagttgtccttacggatttactcaaagcatcatttaatccaaaatataatatatgctcaactattactcaaatcataatagtacagttaattaagatttcaaataactcattaattaatgaggctggtccaaaatcacaatcaataaatattgacttgtactcaaaagagctttgcatacacctgttaggcgcatcactttcaataatttacaagaatgtgaatgtaaaacttatgtgcattgattcatctgaaaagagcattgatgaaagtaaatcagaaataaaagatgccccaattgaaagagatgatgcagcaaacaacgttacaattgattgtatatgcgataaattgtactcaatatataccgagaaattactaagatgcgaaagctgtggtaggaactttcatcttgattgcatacgaaatggcacatatttggagatatacgaacaatggaaatgcgatagctgcaccataaatttaatatttgatgaaataaacacgaattttgggattaatggagaagaaatattatcaaaaaattcagaattaagcgttgtattaataatagtgcttgaatatctttacaggaaaactgcaatgacagtgtctcaggcttcatctgagccagttactatcgatataacacaattagttactgattctggaagttcagttgcatgctcatttattttggaaatgattgcaaaactaaagcttggaaataaaaatttagaaaaagcagatggaaaagaagaatctaaaaataaaacaaccaaaaatggaagcagaaaattgtctcaaacatgtaatgaaataagccagttatataaaatgttattaactgaatgggtttctccaattacaaaggtgcattcaccattaatagcttattcctcaaaatttccaaagttactggaagcaaacgtaattaggttttggaataaaatactagctaaagaattgaagaatgttgcgaatattatattacactgcttattatcaaatatatataattcaactattacttcaatgagaagaatatctttgaattcagtgggccaaataatttcagtaaaacccaatattttgatcactaatgaaacagttttaaacggaataatattatctctaaaggataaaactccaaaagttagagagagagccctagcaataattgaaaagtacttttctgatatattaactaatgaaacttctgattttacctttgatggagaaaattcaagaattggttttgatagagtgaccaaattactgttggagcaaatttttagaacagcatatgacatctctcctttagttaggatgacctcaataaggattctcagagctttatatcaacaagatccatcaaaattgaatattggcatcatattattaaaaagggcatctgcagttgaggaaacacaatcaataagaaggttgatttttgattcatttacttctatttggtttcacaattcgagcaaagtaaatgaaagtatggcagagtgcctagttaaacttataaactattcggagagcaatgaattccttcaatatattaaccacgaccaaaaaggcacaaactgcttgctgaaaggcgtaatatctattttacaagaaaatcaatcaataaaaaacttggaaggattaattactagatggtctaatatactcgttgatatgtttattcaaagcgataactaccgagatacgatcaaatctgaaaaattagtttctaaagaaattgggttaaaaaatgaacaattaaatgatcaaggtattgtaaacaacaattcatccagggatttttcggaaaaaaaacttcaaatattaaaaacagctgaagttattggtaaagtttatccgaaatctataaaagaaatgtattcatatatagtagtttatctaaaagatttccgtcaatttaaatcagaagtaatggttcatatttgtacagtgctatcatatattttgcctcatgttggagatttggaggttgaaactattgagtttgatttattgaaaataacaaccaattcaaggtcaccacaactgattagatcatctatattatgcctttgtaatttgcttatggaaaatgaaaagggtttgaatgaaaataacactttatctcccctaatactagataatataagagtattatgggattatagacaaaaaactttaggtatggaagttaccatggatttaaaagaagttgatcagttaagaagaagtgcttggcttctagggtgcatatttgagtttagttctccaaatatggcactagcaattgtggataataagctagaaagagcgaaggtaatccaaacagagtttggaatttcatggactctagagtcatattcaaccaataaaatgccgaagagtgaatttggagaggatttgggatttgagtatacaattttggagtcaaataaaataatttttgacttgctttgcgatttgtattatatcttggattggaatttaaataaaggggtattatttccgacattgattcaatttttgatgaaccaaaaacaatttgttaaaacactaaaattcaataatttaattaagtgcgctatcaaaggagataaatcttttgcaaacttggattgccaatcaaaactatctattcagtgctccaacatcacagtgaataacagtaaagccaattctaatttgtgtataatttgcctgcaaggaattttgtctcttttaaaaaattacgagctacaagcattaaaagagaacaaaattgctcaggaaaatgatttagagcaaacaaaaagagttaatattactgaagatatgaccaaccaatttcatgacgaaattaatcaatgtgatgattcattttcaggcaataatagtatttttatcactccaaacacaaataaaagaacttcagtacaatctgagaaaaatgaaataaattccccagtgagttcttcaagttactcaaatttagagaatatttcttcaattagaactagcgtttttggttctgtaacacataagacaagctcagtttctgcatcacagccaatcgcatcaaatttagagttgttgttaaatctatttcaagaaacaaccggatttcaggaagggaggttttcaaatcagcaaaaacaacaagtttcttcattaatactttgcattcttgagcaattaaataagcaaggcctggttaatccaacttctattatccctcaggtctctgggctattgttttcatcaaatagagaagtttcattcaagtcttatcaaattataagttctttatttgaaagatttccaaatcttatcatcaataaatataaagaaatatctctatatgggttcgtgttttgcacttcaaatttccctggactacttggggtatacaattcaaaaactgattccgaaaatgttttaagatctattatctcaaatgatattgccaatgataagatccaatcaaaaagcagacctgaagttttggaaactgtttttgaatttttcacaaggatttattctgagaaatgccgaactaaaagagtatttagagaaagcataatcagaggatgctgcaagcagcttgaattattattgtcaagtgatgaaaccgaaattctactcaaaaaacttaaacttcatttaatgctggaaaaaaaggttttattggttttatatatggagtttatttcttatatacttttagcaatgccatttcaatttgaatcagaaatactactggttctattttgtttgggagaaatctgtgtgaattgttctcagaatttacacaatgattctgagagttctgtaaaaatagatacagaacaagctttttgcagtgcgattcttgtaacagtttgtacaacagtccaattaattctcaaagaagagtacagaatctcagaaagccagatttctagcttcaacccttataattccattaataaagagaaacccaaattctctcatcaagactctgaattgaatgttggcattgttgaaaattctacaaatatagtttcattgggagcaggcacaatgtatgagttattgcagagtttgagagagaaattacatattatttggaaaatttcagaaggttgcgattccgagaagaagctagtagattattcgaatgaaattatttatttttatacacaaacaacatctgaaaaagtttcaaagcatactaggggaaaacatacaaaaagaaagcaaactaaaagaaatagggaaagagaagaagagtattcagatgcatcttctacacaaagttggagtccatcatctaggattagcaaaaactgcaagtaa

SEQ ID NO: 1956 - DNA, 6372 bp, Cryptosporidium hominis
atggacgatgaatcgttaggctcatgtaagtctttctcaaagcacatgaaggacttctcggcagttcaaaattctatgaaaaattatggagctccgagcgagatggtagacggttctgaagcaaatttttcaaaagatttagggatactacagcatttttcaaataacgactcaatacttaatgaaaagttaaatgagcttatgggtatctttaaaaaaagagaatcttcagactcccaacttgctattaaagaatcaaaacgtatgattggcgaaatcttaaagtggtattttggaatgagtcatgtttcgttgaatgatattactccagatatttctgatgctgaaaatgtctttgtaagcgcagatggattactaatcaatctatactactcctttggatttgaagttgattcaaataattctccccaaacactaccgtatatttacctttttgaaaggttcatgaactaccttattgaagcaggtacaaaaaggatcattttaatttttcttgatagctttactgatgttctagagaagattaacccaggactgccattattgagagaatccctcattcttcactcaaaattaaatccagagatatttaatgcataccattttacaagttggctatctgaggatttccaagaatttttgaaggagcttgaacccagtatattcttgattgaagatggaagttccatttctaatttggaaagcttagaagtaaaacataggcatcaatttattcaagaagtatctgatgaaaataatgaatctattgacgaatatgattttgaagatttagatgaagtcgatatatctacttcactactttcattcgctttagaaatgcttagctattcaaacattgctatctttcataagatggaacgtaaaggacaaagaattactgcatttacatattcgtctgccatcgagcctcgctttacagaagcaaacaaaggaattatgaggcaggctgcgcaatcgaaaacaagagacgaaatgaggttgttatctgatgccaatgaagattttgtaacctgtgacggagaattagataaccatctacgccttaaagattatgaatataatattgccaaagaatttaaatcttcagagaatgatttatttacccaattagttaaatcactaattcacaactcaatttcagaggaggatttggaactttccaagtcggatgatgcaattctacacaatattaagctaattcttcttttttctaaagttacactattgtctggatatctaagaagtcacaaattgagttacttagataggcactacatttccaattccatgctagagtttaaaaagtgtctagaatccaaattagaacaagatgatttcgacaatgaaggatgggaatttggagccacaattttaaaatctcttgaatcattatttatttcagaatcaattaaacagctcagattaataattaatcattttgaggagatcaagccatcgataaataaaggccaacttatctcaaatgtttgcgatctgaatgatccattattgctagagttcctgttttatattgtaggatacacaagtttgaaggaagaaaatattagagtatcactatttttggaaattattggtcttgaatcatctgatcaaagtaaattggaagatctttggaacaaaatttcattaatcagtgagccatttttcccgttatcattttcaggaaacttaaatagatatgttactgaggataatgataaaagagttttgagcctattcggagaaactgtgttatctagagaaaaattaagtacccaaagaaatacgtctgtaagcaatgtaggacttttacccattaattccaaatttgtggtcagagtaatgtccgaactaggagtaggtatatcagatatggggcaaatcaaaggtactgctttagaatctgatgacaagactgtctcccaaaatgaatatttaaaccaagtaattcaaatttctggcatcagagatgttgcatcttgggaaattgatagaccacaagagacacgtccaaactccaaacaagagtattcaggaggaaaagaaggctcatctgttaaattacctgcagaccttgaaaagaaacgtcagttacgtgataaccaaagaaagcaacaattttggttcaacttaggtcaaatattgactggaaatgataagttgcagcaaacaatcgttgtgaatccattccacgtttggaacaaactttctgcaaaagaagctgataaagaaaggaactcttcaggcccctcatcttcttcaaaagcagaagaaatcagacgaaaaaatgaagaggccaaattaaataaaatgcgtcaagacgatgaaaatcaattgaaataccatgagcagaagctatctctaattctttctaaaggcgatcctgatactttcatgctttcagtgtacgatatgttaattggaattccacgcaaaactaatgaatttgggcgtttcagaggtctatcaaaattatttaagcttccaaaatcaagaagcaaaatattgattcgaactttacaaacatgtatttcagttttgcgtagctttaaaagcagtactcttccagaagtgtcacatatggtaaaggctagattggcagtttgcatgacttttaggctcgcaattgaaacatttaaccaatattactcttatttcgataaaaccgacttattcgaagttgcaaagattttgaatagtcttgggttcatgtcttccgcctctaatttggttgagagctacaaatataagatggaattggatataagacgtattgtggataagactagctcttctaatgatgattctaaaggtaaggggtctgataaaaacaagaaatctcaaggtggaaagaagcctactcaaaagaaagacaaaaaaagtgtgtctgatcattccacttttccagaagatacaaactattccgaatatcagaatgtttatttatatgctaagaaacatcttgaggaattgaaacaatcaggcaaatcaggaaaaagtgaaaagattcacctatgtgtccaagatggctgtgaatcttccttccaattacgttacatgggagctgactttgaaagatccacaggtagcgttgcagatcccagagttccatttagcccagattattggcaaaagcaaattttagatattattgactctggcgactcagcgctagtttgcgctccaacagctagtggaaagactttcatttgttactatgcaatggaacaagttttgaggtttgacaacgaaagcgtcgttgttttcattgcgcccactaaagctcttgcagatcaagtacatgctgaaattgcctatagatttggttctaaaacatacccaaaccactcaaggatttctttactttgtaaactgagcagagattactccattaatattccaactcaatgccaaatcctaattacactaccttttatgttggaactcttattgatgagtacagcctaccaacaatgggtatcaaaaattaaatttgttatttttgatgaggtccactgtatcaatgaggctgaaggaggtgtctattgggagaggattttccagctgattccttgtccatatttatgtctttctgctacaattggtaacccacttgcattctataattggctgcaaagaattggaaagcttccctctagtaaagtccactttgttacttacagtgaaagatatgctgatctttctacattggtatatgatgaaggtaacctatatcctttaaatccgctttcttcactatcttatgatagggttttatactatggccttcctggtgatttctatcttccaccaaatgatggtcttgatttattcctttctttgaaagagctcctcaaatgtaattcagaagctacgaaggaatacttggcatggcttgatcctcaattcttcttttctggaacaccggctatcactaagagacaatatagattttacctttcaactctattggcaatgactgtaaaattagtacaaaataatgttttaaacaaagaaatgtggctaaatataacaggaaatttacttttaaatcccagcataagatttcaaaggcaaatggttgagctatccaagaaaaatgattctaatctatataagattattatgggcgtagagaatattaagagcctattaagtggaattactaattcaaatgatgaagatgctacagaaataggaagtttggctagctcaatatcacaggctaggaatgcaatcattacccccgcaagaccaacttcagcatacaaaactgctgaaaccttcttaagattggtcaggaaccttcaacaagaaaatatgctaccatgtattattttcaacatggagagaagtgttgttgagcatttggggaaatcattaatcgaaaagcttactaacgatcatcatgataaatactatgggtcagaagaggccactaatgccacaaaggccattaacaaacgtagacaagaacaatatgctaaagatattcaaagacgtgatatgttacttaaattaaaaacaatgagtcgccagcaaagagagaaacagggcattgttattgatgagagcgaattgcaagcacttgaaaacctacaagctccaggagatatagctgaagagtacgatccagagttttcattttgtgaccgaaaagttatgggaggaagagaacgtgagatccaggatactctatattcttgtgaaggcaggatttctcccattttcattgaaggtcttaaaagaggtattggaattcatcatgatggtttgagtttaagatacagaagagcagttgaaactctatatcgcatgggatatttatgtataattatttccacaagaacgttagctcttggtgtaaatatgccatgtagaacaacagtatttgtaaatgactcaatttcattgactccacttctttatcgccaagcatctggaagagcaggaagaagaggctacgatgttcagggctcagttatcttctgggatatttctgtcggaaaaagaaataggttattaacagcagagttaccaacaattaagggcaacttccctgttactccaactactgttttgagaacgtttatgctgtttgaaaatgtccttaatgagcagacgaagaataatatttctaaagaaagagcagtaattacctttaaagcgcttgtgaagttctacagagactcattatactctgttgactataatcacgatttccacaaaaagcttacagcaacacaatttagatttattgttgacctgctccgcagatttcatgtattggacaattactgtgggtgtactggttacgcaggacttgtatctcacatgtttgaatatgaaggtacaaatcttcttatttccaaactaatccactctggagtattattcaactacctatttagtgaacatgagaagaatcacattgaaaccagctcaaataatgaacttgctaatttacttaagaaagatccagttcaaagacttctaatactattggctcacgtatatttaaccaaaccaatgacaagaaattccatatatagcatcaaaaagcaaattgaaaaatcatcttttctcaatttgaagcaaaagatctcatctggaaagatccaacatctccttctttcactaccggactacatccaacgtgaaattgatgaatttaatgaaatagttttctcaaatatgagaaactccttgagtgttacatgtgcagatgttgaatttgatgtaactgagtttaacctccctctttcaaataataatgtgttatcgcaaaaatccaaattaagcaaagactctgtaatatcatcaggtattgacgagtctatagcaattgataataattcttgtatacaatcgccattcatttcaattatgggtcttgacgatgtaaaattaaagtcatctcagcagctaatttatggatcgagagttcaattaaactgtacgcacgacttactctcaatggttaaagcggataaagtcatattagataaagaaaaagagaacgtttcaataatcattatgttaatcaactcattcttaattgatttctacgagtcacaaaggttttctgaaattattaaaaataactcaattgcatcatcggaaattttcttcctcatatcagattttaaagtgcttcttgacaggtttctccattccttcaatctaatggagcttcaacaataccaaaatcttaatattactctatctaaaaaatctcttgaattctataacaacatttccagactaattgaaatcctacaagttctctataacaactatagaataattgcaagcaaaaatgatgcttaa

SEQ ID NO: 1957 - DNA, 1851 bp, Cryptosporidium hominis
atgaagttcataagatttggtttacttttcttatccttgctagcccttgcgtttggaaatggagaaaacagtatttctctgaatgatgttgttcctggaagccctcaagttgttgtttggagtccagaggagaagccagattttacttatgcaagaaaagtctttgaacttgttgtaatcagaaaacttactcttttgcactctagaggtgacttgcctagtttaagtttatgggcaaaaaaaatgaaggactctactcttgtaagatctgctgatgttattcaagagattttcaatcatttaaagtctaacagaattgatgttaatcttttaccactgggatgggaatctgtattgaataagagtattgagctcaagaagaagatgatggatttagatgacattaagagtgtttcaagaaaagcagttctttctgcagcctgggaagcatttgactattggataactgtacaagacagtgacttaccatcttctccagaagaatggtgggatcatgggccagctcaattattcaaacagctcgaatccaagatttcatatgctactgaattgaatcttgaaggtctaatggaagctgcaaaaagttattcggctcttcgttttgcatatggaaatactaaggtcgttcaatctaataactctgaagaactcaagtcgttgtctgaggaatctgcaattaatttattactaagactggttttaaagggatgcccaaatattctagatgatgttcttacttctgtaaatagaatgtttatgctcaaggacaatggaaagtattataaggaatttggactaccctacctttatgacgatattggtaatgttagatcacttctttcacctccaaattttggttttccttataatttgaattcaaaggcaggtattgaaagattgaacttacatttgaggattagaaacgccaatatagagaaggaggcaaacatcgaggcaacaaatttggagttgctacctgaatacattaagctccattatattttggagaattctatccaagcgtttaaatttattcattggtctgaaagtgatgccgagtacggttatatgtatggtcttaagtcgaacactttatttgagcctgtatcgactctctggaatgcgcttattttcaataaaatgggagaaatccacccagaagtcttatctttaaacaagtgcctcctcagttctgagttttcaacattagtttcagatattatttccaagctagaggtttcaattgaagaagtctcacttccacccatttataatatatataatggggactattctaagcttgagcgttttattatcccagaatcctcttcggaccaagttaatccacaagctgaagaagttcatggtgaggataataccaatgaggagttatttgacgaagtgggtgcatttgatagaaagcttttatcaacatccacctctgaaagagaaattttcaactcgaatcaagaagatggcttgattaaagaagctgtttctgatgagactactactactactaaaagtacaactaccactactactgccgttactactgcgtcaccatctcccagaaccccatcctcagattactcgccctcgcctttgacagaatcaccactaatcgaaacacctgaatctgaatcacaagtaataacgcccgtagtttcaccaacagtcaccgacataggtatgtcagtaattccacaagattgtatcaagagccctggagatttggatatcgtttcaactgaaaacagccatccaggaatgaaagttgactccgctctttgtttgagtcattctccccaggatggagattctgaataa

SEQ ID NO: 1958 - DNA, 2316 bp, Cryptosporidium hominis
atgtactggtggctaaatccaataccaccttgttgcgatccttctttgttggaacctgttaaacttccatttggagaaagcaatgagcttaatgatactctgtctagactggagaaaaacaagtttgttttcggaagaaaaggagattgttcaattagacttaaggatcaatcaataagtggtcaccattgtacgattcacatagataatacacacaaaggtttgttacttactgatacaagtactaatggtacatttttaaatgggaaaaggttaaacaaatctgttccaacacaaataactgatggagatatagtttcattaactagaccaaaaattatggacgacaatattgcatttcacgcagtgtttaagcttgtattttcaagcaagaatcccggattagtagaagatgagcctttagttgacgctaccgatgcaaggatgacagagtcactttttgatagcaaaatgagcaaggcaacagaaacatgtaatgaaatacctatagaggactcaacgagcaacaactctagtgaaaaacaacaagaagaaacttctggaagaaaagagtccatttgcattaccaataatgaaagaaaatctacaaggtcttcaatgagcttaaggagccaagaaaggaagggaagattgagcacaaaagacgagggtaaagcagatgaatatgctattaggcgtagtagaggcaggccaagagcaacagatcgtcctgaggcagatgaaattacaagctttgaggaggaaaatcaaatgagaattgaagaacaatccagtgaatgcgagaaaaatacagaaacagagttggataaagatgaaaagcaagtagaacgagaaaaacaaaacaaaactgaaaatagggacgataaattgaaagatgagaggaaaagagatagagaagatgcagttaaattcattacagaagttgagaaattgaatgaaaaacacaatttatctgttgaaaacatttctcagttatttgatgcagcagctagcgatatgattcaacaacctagtgaaattagaaattcaatagtttcccaaaaggtagatttgactgaaagtagagagcttgataagagatattcaatggaaggaaatttattgacattttcaggtcaaagacaacaagttgggttaactgggaagaggtctagtgacaaattaatggaaaagctagaaaacttggagttacttgttagcagaaaagaaagtttagaaaaaactttgaagagtgaacttgaggcaagggaagaagagatttctaggttaagggaggccttagaccgttcagaaattaacgagcagcagataagacaacataatatgactcttttggaagagttgcaaaaggtgcaaaaacataacttggatttggagcatgagctaatagatttccaggagagatgcagggtattgaatgcgtctggagaggcaatggatcagacaattagccaattgagcgaagatttgtcttctgtccgtcaagaactactctcgatgaatgaaaaatataatcaacaaagcttagcattgaagtcagttactcaattaacacagagaaaatgtttgtcaatcttacattcactcaaggatattcaccaacttagcaacacttatgtatctgcagggactggaataccttcttcaggaggatcaattttaggaaattccggcactatcttttcggctggaggttcgactttaactccttggagaaatggcaagcgttcattaagtacaaattatggttataatggtgctttggggattccacaaactgaacgtccatacaaaatgagatcctctcctgttagttcctctcgaagtaacgttattggaattggggacgttgctcttagcagaaaatcatctttatctggaaacaactattcatcgtttagcgatgatttggatggcatcagaagcaatgttttgggtaactcaaactctcaatgtcttccaaatagtagatttctatcaggatcgtctcaattagaggagcaactggtatcatctattaagccaagcccattcgatatgcaaaatctaggtctcaatataaataaaaatggaaatgaacaggctctactagaagaggaaccaaaaagtgccaagactattagccataacgatttagaagataagtcaattacaatttcccagccattgacgtcaaatagtgtcctttttgaacaagttcctaatgtttctagatctagaaaaagcaatgctgttgaaaactctctggaaattgaatcaattatgaacaaagaaaacactactggcaacatctaa

SEQ ID NO: 1959 - DNA, 225 bp, Cryptosporidium hominis
atgaaaggttttgaacattctgaaggtgactttattatactaatggactgcgacctatcccatcacccaaaatacattgcagattttattgaaaaacaagaaactaaagattttgatattgtttcagggtcaaggtacataaaaaatggtggagtctcggggtggacatgggacagaattttagtcagtagagtagccaatttccttggtaagttgaagatttag

SEQ ID NO: 1960 - DNA, 606 bp, Cryptosporidium hominis
atgaacattaacaatgaggcaagtaacacgagggcaatgcaactgcacacattaaataagcttgcaagcgagaagagaaatgggaatgaagcagttgaaataagtctggaatcaaatatcaatttaaatgaaagttttatgttgaattgtaaaggcgagcttggaaaggcaattagtatcttagaagaaagtaaagaaattatttacagcgatgtagacgaacagataataataaagataagctttattgagccagtttcaatcactaaatttggcattcaagcattggatattgaaaatgaatctgaggaatttggtattcatgacaaaacagaattagatctgaaaaattgcagcaaacctagactagcaaaactatacgtaaattcccctcttgctgactttggagaaattgaggacttgaccccaagttttaccaaagtttttactgaacaagaattacgagagtccttagtgtttacattaccgggatcaaaatttcacaggttaaaacatttgacaatattcatagaggaaaatcaggatcttaaggaaaaaacatacttaaacaagataaagcttttgggatatataatcccttcttga

SEQ ID NO: 1961 - DNA, 1242 bp, Cryptosporidium hominis
atgaggaattccgtaatacttaaaattattttctttagttttctggatttgatttattctcaagttaatattatgactgacgaatacagaatcaaaatattaaatatgcataacgaattaagggctaaagaagcttctagtgcaacatatatgattaagttagcctacgattactctctggagggatatgcagccaactggggaatgaagtgtatgaatggtcaattccagcattccccacaaacttggccaaacagagctagtcctggtgaaaatttgtatgcaagcagcattgatgtgtctaaattatcttcttgggatccttcaaatgtagtaaaaagttggtgggatgaaagagaacatttcaattggaaaatgggggtgcctgaaggaggatatcctgttggacattggacacaggttgtgagggcagcagcaagcactgttggctgtgctgttattgttagatgccctggatcttggaagacctatgtaatttgccattatgactttggaaacctcggctatattccttatccgaattttaaagtggacaaaagcttacctcaaaaaccatgttcccaatgtccaagtggctataactgttgtgaaaataatctttgtgttggaattattaacccaaaaattcctcctcccggagaattaccaataagatctggtaatggagcttgtgatgattatatgaaaagattgtgtagtataagaaatggggcatgccctcaatcttgccttgatttggaataccccactattaagaaaggcctaatcgttcagcagtgtacctgtattgaaggagaatctgtttctccaacaatggcatggcaatttaagctgtggtataaccgtggcaattgctctagggttaaaggaaatgatggctcttcgtattcaatgaaaggattggtggattctggagttgctaaaataggaactcatgatttagatattgacgttagcctaaaaaataggaatgagttaaagaaaataggtacaaataggtttgcgagagatttaagttttatggatgaacctcatgttgatattaagcatgggcctggattgattgctgatatttcaactgaacaagataacagagagaataatattcctacaaagggtgacatgaattctacaagtaaccttgaacattttccaagttattctaatagtctggcaaagatccgtaacttatctaatggtgaaagagaggcaattatgtga

SEQ ID NO: 1962 - DNA, 2073 bp, Cryptosporidium hominis
atggctcgcagtgttttaaataatagattgactgctttatactctaaagaaagtattacaaaaaaaacagttgagaaaagtgaacaggaaagaaaattagatgaaaaagatgactatggtgaaaaagaaaccagaaaaagaattaaaaaaagcgttagagatattcttaatgaggaatttggcgttgaatcagatggtttgggtaatttgagtcaaaatttttcttttgagaatccacctaaactttcactcaaagatattgccggaatagaaaatattattagggacatcgaagaatttgttattagaccacttaagcttccagatatttataaggctgtaggggttaactctccatgtggagttttgcttcagggtcctccaggaacagggaaaagttacctttccatgtgtatagcaggggaacttggtcttccatttttcaaactgtctgggccgaacataattaatggtgtttctggaacatctgaagcatctttaagaaaactttttgatgatgcaatagagatggcaccatgtttaattataattgatgaaattgatattgttactccaaaaagagaaggaagtaatagagaaatggaaagacgactagtatcacaatttgctaactgcttagacaaaatttcaggcaaatttattgttgttgttggaaccacaagccgtcctgattcgatagacccaataatcagaagaaatgggagaatggaccgtgaaatttcaatgcctatgcccgatgaaaatgcaaggaaggatattctacaagttttatgtaaagaagttaatctcagagatgatgttgattttagggagatttcaaggaaaacgccaggatttgtgggcgcagacttgaaaactttaataaatgaagcagctttaattagagtaaataagctgtataaaaggtttaaattggataataacgctatggattcccagagtactctatcctttgatttacaaattccagataatcaagcaatgcctgagattgtagaaactccttctgaaatgacagatggaggacaaacaaacactactttgctggaaaaacccataccaaattattcaaattttgacttgagctcatgtcttgtatctcatgaagatattttagaggctctcgaaaatgtaactccgagttcaagaagagaaggttttactacaattccagatatttcatgggagaatgttggtgccttaaacgaattgagagttgacttagagcttagaatcatttcgccaataaaaaactcgcatatatatgatagatttggtcttgaaactccgtcaggagttttactatatggcccccctggatgtggtaaaaccctcttggcgaaagcgattgctaaagaaagtggcgcaaacttcataagtattcgtggtccagaactacttaacaaatatgtaggcgagtcagaaaaggcagtgagaactgttttcgagagagctagggcttctgctccttgtattgtctttttcgatgaactagattcactatgcgcagcaagaagtagcgaaggaaatggtgcaacagaaagagttgtaaatcaactacttactgaattggatggagtgggagagagacgaaaagtatttgttgtcgctgctacgaatagaccagatattattgaccctgctatgatgcgccctggaaggctggacagagttatttatgttccactaccaaatgaaatggggagacttgatattttaatgaaagtttccaagaagactcctttggcaaaagatgttgatctaagagtaatttccaaaaatacacaagggttttctggagcagatctatcacaacttattcgagaagcaacattaaaggctttggacaaattaagaacaaatgatagctctattttttctagcaacgatgattttgagtctagaataagtaatatttctggtattgttacacaagatttactaatgagcgtaatttctggaatgaaaccttctgttagagaagaacagatcaacttctttgaaaatttaaaacttgggcagaagctaacttctaactattcaaatttttag

SEQ ID NO: 1963 - DNA, 2007 bp, Cryptosporidium hominis
atgagtgctaagcaattaggaagaacgttagcatacgatattttacctggggatatttgtaaagtaaaccaagttgcatataaccaggctaaagctagcgatgaaaagggacaaaaacatagatcaagaggcctaactagagatactagagctactgttatgcaagcgcttgatgggcggacgatgctgatgttagagaaagcgaaaaatagaggagtgttttcaaatatgtatgggacaatcagtacaggaaaggaagctaatgtctatagaggaaccacgttttttagtgatttgaagctttatggttccgaattgtttacaagaaattgtctttctaaagaagatttggatgttattgataaaattgaaaagtctgcaaatttaaattacattaatagagcaatcaaagtttttaagacttcggtacttactttcaaggatagatcaaaatatgtggagggagagttcagatttaggagagggtatctgaaatcaaaaaaccctagaaaaatggtcactcaatggtgtgaaaaagaatttagaaatttgagacgaattgttatttctggactacgatgccccattcccatttatattaaaaaacatatttttgtaatgtcatatattggagatggttctaacttagagaatattagtaaagatgttgaaaaatacgatggtgaaattaaacaagatattaacaacaatacagagaatgctgctcctagattaaaggatgtaccaataagtctcggaagaaaaagttgggttcgcctttacattgaaattattggtattatgtatattatgttcaatgaatgccatcttattcatggagatatgtctgaatataatacattattttataaggggcacgcttatgtaatcgatgtttcacaatctatggagcatgatcaccctttggggctagagtttcttaagagggattgtgtaaatgtaactcttttttttaacaaggtacttcaaagcaggaaaaatcaggataactctgtcagtttggataatctcaatgaaagtgacgtggacgatgaaatatcaatattgaatgacttatttagtactcttaacatctactctacaaatattatactatctccatcagaactctatagtttaattacaataacaaagccaaatgatcttattaagttttatgaggaaatggccaattcttcagatgatgaaataatttcaaatgttatgcgtattgtattaaacattcttgaaagtgatagccttacatggccaaacttcgatagggatgaaagagaatatgaattaaaatgttcttatttaaattctcagaaggaaattattattaaaaattcgattgaaaaccaaaagatttttctatcaatattattttttacagtatatcatcttttgtctaacggtaaatatgataatgctaagtttaaaatttttaatagcgtaactgattcaaacttggaaggctctaaaaataaagaagggaataatatatttttaaatatttggacaccacttcatttaaatcaaataatggacagaaaaactcttgaaaaggagctagaaagaaaagagtgtggacaagatttattgtacggacactttatttgcgataacaatgcaaataatgaattaagttgtagtgagtctgatgaagtaaatgaatgcaaatgcgaacaagtagatgctctaaaaaataataaagttggcgtagaaagcaattgtcttgagacgggatcagacatgagcagcggcgaagaggaagatttttatgaatgttcggaagaaggggtttgcgaaaaagaactaccatctgaccaaaatgcacaagagaaacaattgattagacagttcaatgggaaaattccagagaacatcacaaaaaaagaatggaagcatattgtgaagcaagaaaatagagaaagaaggttgaacaaagtacctaagcatattaaaaagaagaaaaagggctcaaagaaaaaacaatcaaaataa

SEQ ID NO: 1964 - DNA, 2334 bp, Cryptosporidium hominis
atggaaatatctcccaaggtgtggtttttgataccgagtaatggatctgactacagtgaatttaatgtttgcattccaaataagaagtatcatactacacttacaaaaagtcactttaaaatatatacgtgcaaaaatgtagattttattcggaatttaaaattgtgcagattaaatttggaattagaggaacttgtgagtttttccgaagataattcacaatgggaagagactaacaattttgagattattattaatgattatatgcaatatagcataattttgagcatatatataaataatacatacaatagtaaccaattatttatgcttcgtttaaaaagcgatgaccatcatatcattagtattgatgaatctcagaatgaatttattaactttagtttaagaagtcgcttaattgagattaatacatgtttaataagagattaccttttaaaagggttgaataaaatagaaataaatgggacacctggacaaatacattgctttggggaaaaaacttttggactattttgggggaaaaatcacaacaggggtagctttggctggtgctctggaataactttatatggagaaggggcgattttatcgttctctcatgaaagttttttgattgataaaaatggacatcaaatattaaatattattttagagaacttctataaattcaaaggagaaacaaaaaaagataaatgtattgggtttttaggattttctaactcagagtcatcagaatttattaatagtattagcaaaaacaattttgattattttaaaggctcatttttcgaatatgttgaattagaaagcattgaaaaaagcgtttctaataatgaactaaatattttagtaattaacggaaacaaagaaaaaaaaaatacggtaaacgagacaaaattatcttcaaaaatactcaagaattatatttgttcaggtgggttgcttattatcggattatgcccctggggatgggaatatatcagcggtgggaaagtaaattccaattcaatttcgaatgatattaataaagagatgggaatgatttttacaaacgaatatttttgcaatgaagtaagttctgtaaactccaaaaatctatcaaattatttttcaagctcaatttactattggaaaaagttattgaagtcaatgaatggcacagaaaacgacactaaattaaatcttgatgagtattttattatgacaaaagatattgaatgtcacctaaatatggatataaaaacaagcgagcaaaataaaattcttaatttaatagctcaactactaaaaaaaaggaactatttgaatttgaaacctcctttcaatatggaagaaaaaattaatatcttgtatatggcaattgcttgttcaaggttaaaagaagataaaattcatgaaatttgtgatttagaaggtgataagtacactttcgatgattttgatgattggatcagtatgaatcaattttggaaaatagaaagtaatataacaaattctttgttgagagaagagcatgcggaattaaatttatcaagaaatgaattacattgcccagtttatgatattccatttgagtggcaaaatactggagtttacattaaacacagaagttttttaaaagctgaatttattcccataaacaaatattctttaacgccaattaaatcaaagttacatgttggcagtcacagtgattttctcagatataaagaagaaaaaataatgagaagggttccgttagtaaaaaaaatttataattggagtatctctgagacaaataatataactatcgagtccccatgcgaaggaattgtgtatttcgaatatattccaaataatgaccatacaaatacaaaaggatcattaaaaaagccaaacagtaatgaaccacatgggcatttaataggatttattaagttcataccattaattggaaaagaagtgataacaactcccatttatacaattgataagttgcagcttgatacttgctcatttgataatagaacaataattacggataaatatttatgggcaagaattttttcagaggcaaacagaaagttctctaatttattacctgcttggaccgaactgcatggaaagaaaataatccttacgatcccaagcagaattttgtataggataaactgcttaattgttgatgatttacttgagttttgggataaagttattgatactcaaaatgagctttactttaattataaatggactaaggaaagaattgtttgtgatatacaaatttcagatggatatatgcatagtggtaagtttctatttttttttgattaa

SEQ ID NO: 1965 - DNA, 588 bp, Cryptosporidium hominis
atgtattcatattataaattacatcccaaattgtatccttttaacattagctatatcaaagatcaaattaatcttgcagtagaatacctaattgatatgagttccgaaagtaaatctccagaaaacatggaacgggacttcagagaaaaatggatggcaaaccatgggattgcattctgtaattatttgattttaattaatttatttggatggaacacattgaagacagttttccaagtatatgatcagctttcagaagttgatgaagaattagttcaaacacataacaatcaacaaaagatggctatgtggataattatcttttcttcagtagtcggattcaatttaaagtacttttttacacaatggggatggtggttttgcattgagcgcgcgacatcagaaattgacatccagtcattgtgtgtaagaatacaaaatcatttaataaatataaaaggaatttgtgtgaagaataaggtctcaaaggacgaaattgagcttgggtacgaagatttagctgttataaacggttggaaaatctggaagcttgattcacttgaaatattactaaatattcaatgttag

SEQ ID NO: 1966 - DNA, 2649 bp, Cryptosporidium hominis
atggaagaaagtttatctaaaaataattcagaaaaaaatacggaaaggacttattctttgaaatctgtgagatccaaaaagaatttgacaataagtgaggatgttgaagtgaataggtacgaaccagatttgaaagagaagtatgatggcttaacagatgtagaggatgaaaagttaattaagcaactttctcagaaagaaaatcccactccaaagataaacaatacaacttcaggtaatagtcaagaaaattcaagttcaattttaaataaacaagttgaattagattccggaagcgatgatttatattcaagtaaagaaagcttatctgacgaaagtattgaaagttctgatactttgagcagtgatgatctatatagtaatagacggtctcatgagaaatttgacattagggaattgcagccaatggaaacactatcgtggctaaaaaaccatggattgaataaaatggcgttaattatatcgcaagaaagagaaaacaaacgaatagaaaaggttcgagatgagacaattatggagttatacaatgctgatttaacaaagtttagccaaggatatttaaaaaatctttttttattatcattggataaaaacaaagataagataaattttgaagatggtttaactcagtttgaacaaaaagagaaaaaaaatagtttatataataatgaaataattgatgaaaaacctctacatgaaaatcaacgttcttttgcacccaatataggtgatggagatattaaaaaaaaatatattaagcctaaattaataaatagattggagatttctgaagagggcatttcaggtgagaacgctcttgcatttcaaaaatatattagagacctccaagaagaagtaaaaatgaaggatgaaaaactgaagttaagagaaatggaaagagataatgcaagacttacgcgcgatcaattaactagagctgtaaagtcgtctcttgaaatcggcagtggtgctgggaaattagacaatctatttagagatgtaataaagagaaatcaattgtatgccttccgactgctgcaataccaggcaaggatagaattaaaaggaaagataggttcagaaatctttgctggagcttctattatcaaacatatagttttaaaaagaattaaatatggattttctcaattatcaaagaatgcaatttcaaagaaagacgaaatgttttggaaaaagagtgtcgttaacaacgaagatgttgctacacatattatttcaatgtttaagaatatactttcttgttacaagttggcgtgtattgtacaacataaccacatatctgcaattaaaaaattcctttatatttggacaaaatgttcaaatcttaagagtgagatgatcaacggatcatcaaaattaggagcttactccagaataaacggagttgttacattacgcgaactaaaaatagctgctgatacagaatctaagcacctgtctcaaacggataaagataaattaaataaagcaaaaaaaggctttttctctacagagaatatcactaaaataaaaaacaatgctaatattttgggtgaagacctaagtaccaaagaaattctcaataatattaacgatactttgagttttattcctgatgaaagacttaaccacttaataatgccaatgaataagagccaagaacaaaaaaatattgatttaagtaggaacttagcactatcacatctcgcaaatgtaattaaactttcctctgaattaaacaactccaataattttaaaagcaaaagtgcacttgataatataacagatttaaattcaaatattgagaacaatttgctttcttcttttgaagagttaatattaaataaggaaagacttgatattattaacgaggttaaaaatcacgcgaatgataaatataagcagccaataaatgctcctgattggataagagaaaagcattcaaagctcttagaggacttttactcaaatccattttatcctatttttgtaaatgaatacaataaacgtcttttcatggaccatgaagaaagtagtgaggaaagtgaaagcagcgaggaatatgaaccagaaattgatgagtacgaaacagaaagtgaatatgacatatattattactcaaaggaaagccctgatccaaaatctttcactatacaaagacaattgagtaatgaaattcatattgatgcagaaaagtttgatttggaagtttctaatatcgataatgtatatatatgtgatgaagcagatcaattcgaaacaatttattattacgatgaaacttataataataatgtagaatttgatgctgacggtaatcaggtgatttatattgaccagtcaagcaacatacaggaaccttatcaaattgagaatgttcaggaagagactgaaataccatatggtgaagttatagttaaccctaatgatgggctgataaaagaaggtgagagtattgagaatattacagaaatatttgagatacagcaagctaatgaagaattttcagaaaacgtcactaatgacaactttgaaatggattatattgatgataaaaaacaagaggcaaatgaggaagaaacattgcttgaattaactgttgttgagccagaagaaacacaacagtga

SEQ ID NO: 1967 - DNA, 360 bp, Cryptosporidium hominis
atgtttttgggaagtccacagatttccattaggcaagacgagattgttaagcaagggtggctttacaaacaaagtcgatttctaaaagactggcgtagaagatggttcgtattaacaaggaactacctcgcaagctttaaagatcaaagaagcctttccactcctactgagtcattgatgctctctgaatgtctaactgtcagatccgctgacgaagatacaaataaagaaaattcatttagggttgacaccccaaacagagtcttctttttaatagctgaaaacccaattgaaaaagaagaatggattgggcaaatagggagacaaatgattagaccaactgtataccagcacgactac

SEQ ID NO: 1968 - DNA, 573 bp, Cryptosporidium hominis
atgccttctatattgtcagtaaaagcacgtgaaattttggattccagaggaaatccaactgtagaagcagaaattacaacagagcaaggagtattcagagcatgttgcccctctggtgcctcaacaggtatctatgaagccaaggaattacgtgatggtgatgagaagagatatctcggtaaaggtgtgcaaaaagctgttgaaaatgtaaataaaataattgctcctgcattgattggtaaagacccaacacatcaaacagagctcgataccatgatgacagaacagttggatggttcaaagaatgagtatggtttcacaaagtcaaagctcggtgctaatgcaacaacagcagtttctttcgcattggccagagcaggagcagcagcagcaagaggcgttccattatacaagtatattgctgaattggcaggaaatgatactaataacttcgttatgcctgttccatcatttaatgttttgaatgggggaaaacatgcaggtaatgctctcgctcctcaagagttcatgattttcccagtgggcgcacccaaatttcaaggaagcacttag

SEQ ID NO: 1969 - DNA, 879 bp, Cryptosporidium hominis
atgatttcattcatatttaaaaataaacaatttgttaaaattgttattattgcactacttccttgcctaaatgcacttttttggttgttcttcatttcaaatggctggcttgcaatgtatagcatgcattttctctgcatgttttttatcccaacttttttttatggccttcaatatcttacaagcaatttaagcgatgctcgagagtatggaaaaaattttgatatactcaagtgcatatgtgtttgtatctttacatcagtctttgggactacatgtctttttttagtatcagagctttcaaagattattccaacatttgatcttttaaatattgaagaaatcaaaaatgggttattaaaagaaggtataattaaagatccaacaaacaaaattggtttttctacgtggttttcgagcatctacttttcaatagttaatccaattatagaagaacttttttggaggtcatttgtttataaagaattaataatctcattaggagttagaaatgaaaccaacccacaatcaaggtttaacattaatgagatcggagcaaattattcagactttttaatagcaagagatcatagcagtaacttatttgaaagttatgatgttgaaagtggacaaattggctacaaagcaaatactgagcttgcgagcattatttgctcagtattatattcgctttatcatttttttgtgttaatacgcttttcctccatccactgttcaatattatcaacaatctccttagcaattataggtcgggcactactttatgtaaatagaaaattccacactatatactctatttatattcacatcgggatggacatttcaatagtaatattcttaatactatctctaaaataa

SEQ ID NO: 1970 - DNA, 333 bp, Cryptosporidium hominis
atgctaaggaaaatttggcctcaagcccacctccaccccctgcagagggagtcttcgtggtttagtggttggtttggggcatccgaaacaactcccgctcctcctcctaccccaaccataacagaaaagccaacgcaaaataatcctagtacaaacgatcttcaaattccaaatccttcaaatccaacaccaagtccgattccacaaactacagaggattcttcatggtttggggggtggctgggtgggcaatctgaacctactccacctgctccccctcctaccccatcaggagggcaagaatctagctggttctcgggtttcgggtggtaa

SEQ ID NO: 1971 - DNA, 939 bp, Cryptosporidium hominis
atgagcttttcaaggagatcatctggtggactttcatcatcttatgatgggtcattgggcaatttaactcctttcttaacacattcagacccgttggattcaaagtatttgagtaggtctatgcttgaaatcacaagagatgtgtgctataataactctttaaaaaggaattcgaaaggagttgaatcattaggaaaagagtttaactatgttcaaaaagagaaacagtattcagggagagaaaaatcaaataaattaaatgtagatttacattcttctattgatactctccatcggaacaaaaatgataccgctataggaaattctgaaaacatgagtagaagaagattcagcatttcgtacgttcaaaaccttccaaataagagtatagagaatcgatataatcaaaaggacagaaatagtaattatggaaagtgcgagaataattctgaatatttgcattgtagaaaatcttcctcgaatattaaaaataattctagctatcaaatcgaaaaaaaaagcagccaaccattagtaaataaaaagatgaatgtttatcaggcaaaccaactattatgttcactgttggaaagggacccatgcaggttaaatagtagtggcctatatagttataatagcaatgatcagtcctataaaattaatacatttcaagatggatgcaaacattggtattcaaataataatagggaaatgattgatcctttctcagacactaacaacagctatataccacaatacacaactactgctagaagggcgatgtacgaacttattggagcatctgaaacaagtagacctgaccctgacttatctgatgatgatttatcccttcgttttgttagaggaaccttggttgtttgcgacattcataacaaactacagttgaatgtagttcctccgatttttggtaagttgtaa

SEQ ID NO: 1972 - DNA, 627 bp, Cryptosporidium hominis
atggatctttctcataataaaagaagattctctatagaatttgaagatgtacaaaagtctatcgtttttcatgtctgcgacagttcaatggatagaggtctttggactggagccatacaagctcacttaaaaaaagctattgaggttagacatcgaactgggcatcatattgattggagggctcttgaatttgaagtttgtagaataagatatgaatccggtataaagggaaaattctggaggtgttcaactgaggcacataaccgcatgtatgaagtacacccaccaagacatgaaattgcaagcttcggctcgctaaatagcgttatatggggaagcgatggatataaaaggaataattctgtattgtctactgggtcggttattgagcctggaacaggaacggcaacatctggatgttggaatcgtaggcggaccggctcgatagcatcttcaactgctggcgcttttgggaacaaatatcgtgcaccttcaatctctgggctttcagattgtaatttgttacgaaaggactccgtaaacattgttggtgttactacttgttctggagctagtggtacctatcctggaaacagcagaagacatagtactgaaagacagtattaa

SEQ ID NO: 1973 - DNA, 270 bp, Cryptosporidium hominis
atgctgaacagtaacttatctaagccagttcagcttaacagaaaaactatatctggaacaaaaagcagtgcaaaaaaggggatattaattgatgaacctacaaagcctaacacacaattaaaaagaagaccaagtgtagatataatcaatgaagaattactcaatcaacagcctaaagcaataaataaggaaaaatcaaaccttgcaacaaggccagagcctatttcaaaggctcttttggaagaagcaaggggcaaaaagagccaataa

SEQ ID NO: 1974 - DNA, 633 bp, Cryptosporidium hominis
atggctggaagtggaaagacttcttttgttagtgctttatatcatcatttaacaaatgagaagaaacaagtatatacaattaatttggacccagcagttctatcttgcccatatcctgtgaatattaatattaagagcacttttaactataaaaaaataatgaatgattatggattaggaccaaatggagcaataatgacatgcctaagtctttttgcagtcaaatttgaccaagtattgaatattcttgaatctaaatctgatattgactacgtaatacttgatactcccgggcaaatagaagtttttaattggtccgcgagtgggtccattatattggaaggcctttctatttcttttccaacaatagtggcatatgtagttgatactgttagatctcaaaaaccagtaacattcatgtccaatatgctttattcatgcagcgtgatgtataggtgtaaactaccttttattttgatttttaacaaaattgacgttacagatcatcttttatgtactaaatggatgaaggactacgatttgttttcggattctgtactttcaaatgacgattcttatatggcaagtttaagtagatcatccgcattagcgttgtatgagttttataagtaa

SEQ ID NO: 1975 - DNA, 372 bp, Cryptosporidium hominis
atgtccaatagtttcctcagagatttgaagtttgttggtgtatcttccttcttaggaacaggaatgaaaagcttccttgaaaaattagacgaagcaactaaggagttcgaaacacagtataagaagtggattaatgacagaagagaggcaataaaaaagcaaagagaaaacgagaagttacaaaagtggaatgaaataagcaatatatttaaatctgatggtgttgaattaaacagagatgcacaaactccgtgcattcccgaacatcttgtagaaggttttgaagaaagtaacgaaagcgaagacttaagcgaaattgatcaaattgaacaagtaatgttgaacccaaaggggaggctcaattttgtctag

SEQ ID NO: 1976 - DNA, 966 bp, Cryptosporidium hominis
atgtttttttctcaaactaatggtggaaacgtaagcactgcaggtctaggattatttggttctactgtgcctggggcagggtcaaactcactaaatttgtccgcgaatattactcagactgggcaatcaatcactccgcctgctattcctgggaactcgttatttcaattatcaaattcgcaatctggaatatctaattcatcaaatttattcggaacttcaaatttaaataattcctcaataggaatacttggtagtactggatctaatgtatctctatttgggccatctcagacacaaaatcaaccccaaacacaaattaatccacaagctcaatatctccctttaaaccctactattggccagttaaccaactatattcaaagctggaaggctgaatttgatgaaattgaaaatcaactacgtgggaatgataaacatattgaatatttgaccaacaataaacttattgaaattactcgcttatgtagtacatacaagaaaggtgtagaaagacgaaatgaggaaatcgaaaatatcaaatctcttcagttcagggcgcaggattcaattgaatcagtgatatctgaaatcacaactgtacaacagctgagtcatgacattacccatatttacgaccgtattaaagatattgaccaaaacaactcctcaagacaaattcaaccgttaagattccctttacctatatttgagtttttctgtgagaatatggcgaaaaagtgtaagggtattgaagagattattagtaatttagatagagccgtttcttcgttaagagaggaactgaccaatgcaactgcagaagatgtgcttaaatatattgcagaaataattaataacaactatgaggcattttatgatttagttactaagtgctcccaacttcatgataagacagagtctgttgtaaatatatctaaattacacgacgcaagtcggaattaa

SEQ ID NO: 1977 - DNA, 1611 bp, Cryptosporidium hominis
atggtatctgaaaatttgagtcgaaacgaaagaagtaggacaactcgtcatgaaaatattgtcgcagcaaaggtaatttccgagattattaggactagtttgggtcctaagggaatggataaaatgattgagaaaggagaggttattattacaaatgatggtgctacaattttgaaagagatggcagtagtacatccgtgcgcaaaaatgcttgttgaattatccaaggctcaagacgttgaagttggggatggtaccagctcagtagttgtattagcagggagtttacttggagccgctgagacgctactagataaaggtattcatccacaactaatttctcagtattttatggaaggttgtagcatgattgagaagatacttagaggcatgtctatcaaggttgatttaacggataaaaacacactgatcaagtctgcatgcacatctttaagctctaaagttgtgagccatagcgctcaacacttggcaagcattgcggtggatgcagttttaggaatttcaaggacttaccaaaagaattcgattgtttctgattatgaacatgaggtgcaagatatgagaaaaacagttgatttaaagaatattcgtattgtgaaaaagcttggtggtactgttgaggacactgaacttgttgatggcttgatacttcatcaacagaaagtttccagaactgccggaggcccaactagaattcaaaacgctcgtattggcctaattcagttctgtctctcagctccaaagacagatattgagaataatattgtagttaaggactatacagctatggatcgattgctcagggaagagagacttttgattgccgaaatgattaaacagatagcggcaacaggctgcaacgtattacttatccaaaagagtatattgagagaggcgataagtactttggcattagattattgcgctaaggcaaaaattcttgttgtcaaagatattgagagggatgaaattgaatttttaagtagagctctgaactgctctcctattgcttcacttgaccattttacttcagacaaacttggcgctgccaacagcgtttctgatgaggatctagatggcaatgggcgtatttgcagaattacagggataccaggaaaagacatgatgacaatatttgtgagggcatctaatatgttgatgctagatgagacagaacgttgcattcacgatgcattatgcgttgttaggagcattattaaagaacaagctttagttcctgggggtggggcatgcgaaagccaaatttacacagaactctctaactgggcaaagtcactttcgggagtaaagcagatgtgtattcgcgcatatgcacaagcatttgaaatcattccatatacgcttgcagaaaatgcaggcctaaatcccattgaaattgttacgcaactacgaaagaaacattttgatggggaaatttatgcgggaatcaatgttaggaaggcagctgtcactgacattcttaaggagaatgtacttcagccgctgcttgttaacctttcttctgtaaagttagctactgagacagtgatgatgatattaaagatagatgatattatcccatgctattaa

SEQ ID NO: 1978 - DNA, 912 bp, Cryptosporidium hominis
atgattagatttaagagggtggttgaaggaataccaagaaattcatatttgagaggttttaatcatgcattgaaagaaggctttaattggagtgtttgcggatttagacattttttttataatttaaaatacacgaattcattaatacaaaaaagaatattgggtaatgggctaacttttaatgaaaagcaattggtgaaaacaactattaaggataccattaaaatcattccattttctttttttatcattgttccttttgcggagtttggtcttccttttgtaataaaactattcccaaatatgctaccttcaacttttgcacttaaaagcataaaagaaagagatgataatatacttaataaaagaaaaattgaacttttggaatttcactcacttatccaaaacattatttcaaatttaaagaaatctgataattcagatattatttcaggggtgaacagcttagaaaaaattcacttagaattattggaaaaaaacaagttggatcaagaagagctaggtaaagtaatttctggtccaataaaggaagagtttaaactagaaaatttagatattgaaactcttcagtcaatctcaagagttatgggcataccctcaacaagaagcaaactctttttaatattgagaataaggtatagaatattgaaactcaagaatgaagataaagatattctttgggatggaacagatcaaatgaacaagcaacagctacagaaagcactaatttcaaggtttatagatcgtaataaaaaagaatatagcattgaagaatacaaaaaattgcttatgaattgggtaagattatcttctatgaaacagttgcctttatctttaatgttatggattcaagcaacaagattaatcagcgataatattgataaattatga

SEQ ID NO: 1979 - DNA, 1272 bp, Cryptosporidium hominis
  misc_feature (1271)..(1271): n is a, c, g, or t
atgacatttgttattaattcaaatgaaagatccgtaccttggtatagtaagaatgagttctttgaagtgtttttttggataattgattcagaattaaactcaaaacaattggcacttaacaggctaaaaatatgggaagaaagaagtcatgggattacgaaacaatgtccaatcgcgataattggcacttcatatattttacatacaatgcttcaagataaaatatgggattggaattctattagtgaaggaatcaagtctggatcaataaataaaagtttcaaaattttatcggaaaaaattttgaatggagaaatgaaagtttacaaaaacgatataattgacaaaaacgaatctctagaaacttattattcgggtatatattgctctattcagaatcaatactgtatgacaataatacgaataatcaatttatttgtagatcaatgccaattacaactttatgccagatcaataagttccatatcagctgaattaggaattcctcaaattttggttgaaatcagacatcaggcaactcatggctctgagttaccttctttggaaatttgtagagttggtggaattttaatatttttctatttaatatctaactattggaagaatcaatatgattatctaacacattcaataatggcatttaatgaaaacgtttctgaacgctttaaacaattagttctgctattatcaactatgcgttttgattgggatactcattattatttagttgatgagatcccacaaagagaaaacgaaactttattagattcattcaataaatacaatgagatttatcataactctctaacgaaagttgtgcttgaatatatttccattgatattcctataagaaacaaaattttgaaattttttgaaaaaagatcgagaacaacaattaaaaatgaaagaaaggatgcaaataaaatgataaaaattttaactaagttcggacaattaaataataatagtaaaattaaactagggaaattaaaaaaatgggtaaaaaaatgttactcactattacctttattttatagtctaattgagaaaattatgaaaacaattaaaaataatgaagctgatgaaatcattattaaagagtttatatttaatgaattaatgaatatttgcccattatgctgcccaatttctgaaaaggcagtattatttttattaagtttggtgagtaataatacaaaaatagaaatcctttctatgataatatcaatattacttgagaacaaaaactna

SEQ ID NO: 1980 - DNA, 2013 bp, Cryptosporidium hominis
atgataactaaagactatacaacgcaactatctcttctattccctaagagtctaatagataatatatcagagaaatcagaaaactgctactttgtattaggaaagtactacaaattgaaaaaatcagttggaatattcgcagctgaatcgctttgcccagttaaagaccattattcattaaatctctatgataacactaaggttattggaatatttaggtttttttgtgagaaaattgactttcaatcagattctgattcttttaatcttcaatatgtttcaaagcacttaagcgatattgtatttactgcaatttcaggcattgggccagaatgcaaagaaatttgtttaaaaattttaagtatcagcgattgcaattttaatttaattacaactgataaagttaatattattttattttcagatcaaagaactcgaattattaatttatcaaagatgctcaataacgctaatcattttcttgataatgttatttattcaattgaaaacgatttaaaagttgatgattatattacttctgttggtctggcagatgaaaatgtggatgatgattcattatttgaacatttcaagactattatggatgactatattgattttaaatatttagacacactttcaacatttaatactaaccaacaaagtgagtttgatccttttttcttacaaatattcaggtatttgctattttattctctaacattgttatcgttttcttcatcagttatttggtcttgtatttcaaattttccctttattcaaactttgatacaaaaaaacatttgcgcaacgatttctcaggcagcgtatagaattaaaaatcagagaaattggataattttgaatcacatattgaaacattcaaaagttaaactaaataaaaaacttcacaattccttaaggcttttatttttatcttcaattaccactgtaattgttgattatttattgggagtattgtttgcacttggcatcgacacattttcaagagaacttgttattcttatggaaaagtcgtttttctatatttaccacgatgcaatacatactcaagttaaatggttaatgtcatttcctgctgggttcaaactcaatcaaaatcttacaacagttatgggtaatctcacattagcagcattgaaattttggtgcgaccttacaagccaacatttttctgatttgaatcataacatgatatttttgatcaaatttgtctctattacttgcggtatgtcagtatcagtagcacttatttgggatatacttaatatttattcatttttattattttttatctatacaattatggcaaagttatataatttaaatctgaaagcaattaaaacatttttttatattttcagaggcttaaagagcaatattttttcgaatatagatcataattcacactattctgaacagcttttaattggtacgatattatttacaatttttgttttaatccttcctacaataactgctttttacattaatttcctattcatttggagttgcgtatatatttctttggtattattgttttttacaatttcaactattaatacattcccattttacctaatttcaatgcatattattgctcccaatacatttagctctggtatatttattaaaaaattctcgcacaatacgagcaatcagcttattataattttttctcacaaaagccttaatataaactcaatttgcaagccattttccgattcattaaaccatctatttagagttcaccttaatattgttcaaataataaaatcaatattatcaggaaatattcttcatattctaaatttacaagggtcaaagattcaccactttaagtcgacttttgctacgcttagtgacgatgagaaaaacatggaaagcaacagttgttccattagaagtaaaagtagttatttaaatggcgaaaattttcaccattatatttttgataatattacacctgcccaattgtataatctcaaatag

SEQ ID NO: 1981 - DNA, 363 bp, Cryptosporidium hominis
atgaagaaaatatcattgattgaaaggtccggagaaaagatcaaatcaaaaagaagaaaagaactcatttcaaatgcattaaaagaatcaactcaaaataatttcttgggcgctattaacgacccaagaatatcaaagatatttacagatgcagattttgcaatagatcccacaaaccctatttataaacccactgaattcaacaaaaagttattattagaaaagagaacacagaaattgaagaggaatttgctatcaataaacaaatctaagcagaataataataagaattgtgccgttttaagtgagttagaagatgactcatttaatctattagctacaaagaaaatgaaaagatattaa

SEQ ID NO: 1982 - DNA, 1038 bp, Cryptosporidium hominis
atgaataatgcaaaaacagcgtttgaattaaatacatgtattgaaaccgtaaattgtattagtaatcaaaagtcaataaattgctatcttaaagacggcccatcagtaataaatatttcatataaagaaccattaagcgaaaaaatggacgaaattaaagccaagtcatacagaaaggaattttctcgctccaatattttaaccaaagaacagctaaataactttaggacagtgttatgtaacgaccaccttaattcaaactgtctagatcctgagacatgtttctactcgcattgcactgcatggcaacgtaggaaccctacaaaatataaatattcatcaaatatttgtcctgatatcgaattttcgagaaaaggaactaaaggaaggatgtcattaaattgcagatgtaaaaaaggaaagttttgcgaattcgctcatacaaaagaagaggaattatatcatccagatgcttataaaacaaaaaaatgtaataccttcccaaactgcaagagattctattgtccattcattcacgatagtgaaacaaatttaataaattttaatgaaaaaaacttaaaagaaaaaataagtaatgatatgatacctatcatttctaaaaatgaaaaatctgatgaaaagaaaattatgaatatctttagtccgtattctcaagataaatttaaaagaaccagagaaataaattttggtgagctgaagcatgaattactaattaaactggtcaattgccagaaactagtgcttgaagaaaaatattcatcagcacagaatttagccgaagattttacctcaatgataacatatttatgtagaagctgttttcttcctgaaatattttcaacaaattcaaaattgagtaattttcaacatgaatttctttatccggaaaatattacaaatcaactcaataataatcacatgaaggatgtatttaatttttcgtttgactttaaacattttttaaaggatgaagaattaaaaagaaattatttgttagaagatttattcactcattag

SEQ ID NO: 1983 - DNA, 297 bp, Cryptosporidium hominis
atggttgataaactaaaaataaatatttactcggcaaacaaacagaatattaaagaagtttccacaaaatgtgttgaatttttaaaaagtgtaagtttcctgccacaacaaattttggaaacgaatctaactgatttgcaatttaagggagaaaatagaacggttgtgttgatagcgaaatcatctgcaataccaaaagctatttctatttcggagatcataaagatggaagttccaaacgtttctcaattaaattcattagtaaacttagaggtaagtcttatattctctaaatag

SEQ ID NO: 1984 - DNA, 567 bp, Cryptosporidium hominis
atgataattgataggcacgttgggtgttgtatgagcggacttgttgcagacgcaaaaacgatgatagatcatgctagggtggaatctcagaattattttttcacatataatgagaatattccaactcagtctgtagtccaatctatcagcgatttagcattggatttctccgatattaaagaaaaaggcaagaaaaagtcgatgtctcgcccttttggagtagcaatgttaatagctggagcagatagcgacggaagttcaagtttgtggatgacggacccttcagggacatatactcaatattcggcagcagctataggcacagctcaagaaggtgcagagaccattctattagaaaactacaattcaaatatgtcattgaaagaagcagaggatttagcgctcattgttcttagacaagttatggaagagaaaatcaattcagtgaacgtagaagttgctgctgttaaagaaaaaaaattcattatttatgacaacaaagagatccaaagagttttagaccgtcttcctccacctacacacattgtgccttctcaactttcataa

SEQ ID NO: 1985 - DNA, 615 bp, Cryptosporidium hominis
atggaaaatatatataatgaggagaaacaagattctggtaaacaagagattgcggaattgcaaaataaatgcaagaaggcattaaaaaatactctaaaaattgctgcagacgcaaatgaaatttccatgtacagtgcaacaaaattaaatgagcaaacagaacaactttacaagattgaggatgaaactgaaaaaataaaagacaatctagataagacagagcatgcaataaattcattaaaaaatccactcttattttggtttaagggattatttcgacaaaatgagccaactcatataaggccagcatttcctaactttcaaaagaataaagagattcaaaatgagagtaagtcccaaataatatcagagttgccaaaagagcgtaactctgatattaaaaatgatggcttatttcagtttaatgaagaaattgacgaaggtctggaccaaattggcgatatgttgaaagaaatgcacaacagagcaattaatatgaatactgcactaaaaaatcaggggggaatacttaataatattgatacaaatattaatagcaacaattcgagaatgaaggatcaaagaacaaagttggagagattcattgggaaataa

SEQ ID NO: 1986 - DNA, 2133 bp, Cryptosporidium hominis
atgaatattcaatcacaaataaaagaaattaactctattgataaaaatagtttgtcatatttaataaactcgaaaagtactttgaatggtatatatcatggtattgaaagtaattactttgctggcaatgaaagtatattgaataataattcaattcaaatgagacagtgccaaaatatagaaggacgatgtggaaatgaggtttggctcacattaccactattttttccaagcgcgactttacataatgtaactcatcaacgcagagacctgttttgtgaatcaaatggtggtagcttatgtttttctcctgaagaaactaatacctccaggttattttcaactattcaaggactctcagatattggtgcaggtttttttcagattgtaattgcaaaacttaaaggagttgttgctgaaaatgttgaagcgataaagagtgagtttgaaagaatatttaagaatgaagattcagcatttaatggatttattcctttaaagcctattggatggaggaaaagaagcttctctaaagaaaattccacaatcctaatagagactaatgaaataataattgacacttttgcaaaacaaaaatcatattataatgcaattttgatatctgaaaattattcagaaagctgcaaagaaaatattatcaagttgggaaaactatcaaataatttcctagaaaaaattaaatttatatatccatcattagagattgtcaaagtttcggatttggaaaaagataatttttttgaggtaactatacgaataaaacccatgccttcatatgtctcctctgaaggagaggattttgattcaaaggataaaaaattttctatgtttcaaaatttatcgcaagtaaacaatttaacatcaatatatttaggcgatattcgcctaatagatccttataaaactgaagtggatctaagaattccttgtggattattcaaaacttttgcgttaatttcaagccattctattttcgtacaatctaggtgctttatggcaacatatattccattttcccaaagtcgtaaaaaaaaacttactcaaatgagtcatgaaaatggtactgaaacagctaccattaattcaaagtcagtcaactcatcacaaatttttgataggattcaatacaaaatatctacaccaaaactattaacttttggaaataacaaagaaacaagcataaaaactccgcctccgagtaactttcccacaaacaattctaactgcgtttcaaatatatctacttgtgacctgagttataacgctatattcaatagcaactggggagggaaaagctattcgtgcaccccaacaacaaaggagtctcttaacaagatttcatataccccattttcttcgattgaaatggattcttcgccatggttgagcgctgacttcaatatagagcctaattccatattttcttttgagcaagatagccagcaattgattcctccaaggatctcatctctgaattatatggataacctttgctataacgagactaataatcattcaaataataacttactcgataccaactttattactgaaaggcaattatcatatgattcaattaaaaactttgaccaaaatcatttacaggttactcaaaaactttcaaataagaatcagatcagtttcgtaaaaagagctgaggagtgtgataatattgaagttaaagagcctgtttttggaattgaacataatttgaagaaaaatcaaacaatagaaattgatgataaaatcgagcttttggaatatgaatgctctcaatatttggaaagcaaagactttgatatttttaacatgttagaaaatattttttcagataattcagctacaaactttgaagattctcaagttggatatagtgatcaattcagtgaaaatgaaaatattaacagaaatagcgaattagttgaatcaaaagttaatcaatcacttagtaaaaactatagtgagaaatttggcttgtggagttttgaattatacaaaaattcaaacgcttgtattactaaaccaaactcgaatctacatcataaagataaaatttctgaatttgtgccaaatgaattaaactatctaaatgagaaaatactttttggttaa

SEQ ID NO: 1987 - DNA, 504 bp, Cryptosporidium hominis
atggaagaaatatcgaatcttgccaagaaactaagagattgtacaatgagtgatgaaaatgaagttaggcatttaaattctggtattaactcacttctaaaggaaaagtacaaatgggagtgtaggattgtagagttaggtggaccaaattatagaagtaggcatggccagtatattgaatcattaggaggtatttctatgccaaattcatctctaaagatttttggagttgctatttcattaccagaatacaaagaattgctcaattctgacgacaaaacggagataagttcaaaaatagtctccaagcctccagaggttactgtatgcgacgcctactacgaagagataaataagaaagaagaagatcgaattaaaacgcttgaaagagaaaaggaaattgaatttaagaaaaaaaaacgattccttgaaaaagaaatctcagttgaataccttctgaaactaattgatgataaaaagaaggagattgagcaatttaattaa

SEQ ID NO: 1988 - DNA, 4128 bp, Cryptosporidium hominis
atggttaagagtcgtatgacttctgtcgatatctgtgctatggtgcatggcatttcaaaagatttaaagggtcagaaactgataaacatttatgatatcaatagccgaacatacttatttaaatttggaggagaagaaaaaaaatttttattggtagaatctggaattcgattccacactactcaatggaaacgcgaaaatgaacacaaaacttctgtttcaagtatttcatttttcaatagtaagcttcgacgctatatccgtaataaaaagttggatgatatttctcaaatgggtatggacagaatagttaaacttacgtttggatttggagataatactttttatcttatttttgagttttttgttgcaggcaatataattttgacagactgcaattataaaatcttagtgattcttagagacacaaatgatttttcgattgggaaatattataattggaaagactgtgaggctgttttgtctccttctcgttccatttcatctccaataaagtcttcgtttacaaagaattttaatgatcctttacgattgctgagtaatttgaaaaattacaataatatgaaagaagagctcagaaaaatatttagtgagctagagcatattgattcaaacaaggaggaatcagaaatttcatattcaaaaaagcgaaagcaggctgaaaaaaataattctggggttactattttagatgtatttagccgggttatgaagtcttttcatctttcaatacttgaaaagctattagaatcagaaggcatcgttgcgaacgagctatttactttttctatgattgatgagatttcagagaagttcattaattgcattaataaagcttcagacgcattatcacatatatttaaccataattataaaggcatcctcattattgaagttccttccgaaaaagaaatactacagggtgataccattttgaataatcagacatcatgtactaggaataatgagcatgaatctaaggaaaaagtttatatttcttatagtccctatattgaagggcatagctggatatccggagcgcagactattccaaaaggaataataattagtagaattttggataacttttgcaaatgcgttgatgaattttacagttcgattgacattgtgaaagagtccaaatttgctactcaagaacacaaaactatatatagcaaagttgataaagtgaaaattgaccaagaaaggcgtcttgaaggcctgtcttctgaaaaggaagcatgcatagttcgtgcaaagttcatggagtctcatcaagaaatactggaaaaaattctacaattaattaggcacttaattgcaactggcgctcaatggcaagatatttggaatgaaattcaacagcaaaagaaaaacaatcatccacttgcaagacatattaagtcattaaaccttaaggatgataaagttaagattttgttttcccaaagggatttaggctcggaaattacaccagtagttgatcaaataggaaagagtatcgaatttgacttaataatctcaaaatctatccagtcgaatattagatttcagtacatggaaagcaaggctcttgcagaaaaatttgagaaaacgcagcacgcatataaaatagcgcttaaaaaagtcactaatattgcaaagaaagatgcagaaaaggcatctaagggtttagtatcaaatgttccaagaattaaaaagttaagggcacaatattggtttgagaaattttattggtttatatcatctgatggatatttaattattggtgggcatgacgctagtcaaaacgaactccttttcagaagatatttagaaaaaaatgacagatatattcatgcagatattcatggcgcaactacatgtattgtgaaaaatcccaacaatgtgcaagatataccattaaacacattatgtgaggcaggacaaatgagtatatgctatagtaaggcttgggttaataaaactgtaatttctgcatggtgggtttacccagatcaagtaagcaaaaatgctccaagtggagaatatttaagtaccggaagctttgttattcgtggtaagaaaaattttttacctcctttaaaacttgaaatgggttgtgcattatactttataaaaagcaaacaaaatttcaaccaagttgatagtaattataacaaaataacacctttaagcatacaaccaaataataacacagaagaatccaaagctgatgatagtaatcaaggtgatttagcaaaaatatccaaattaaaagttgagagcgattcaggagatgatgcagatgaagaatcagattttgagtccaatttattagaaaggtttgccgaagggaaacatcataattctgcgcatgtaaggttttcggtcggagatgtaagcgatattattcctccaattaaaatagaacaccgcgtacagtttgatgaattaccacctgaattattgctttcaagaccatttaatcctttgtcaattgatgaagcaagtaaccagacctcttcagtaaatagtcttgaaagcttaagcaaactagcaagcaaagtttctatcgatactagctcgtcagatagtgaaagtgagaaatctgctacaacttttttaagagtcaatagttcatgcgcagacgaaagcaatcatttgaaaaccgaaattaaatcgccaaatcttttatgcactcccaaaaactcaagtagaagatcttccgttgatgagggaccacctcctttaggattttcagcttcaactttgccaacacctgcagagttactttctcataaagtggaatttcctgtagcaatttcttcctcttcttctgaggaagtcttagataatacgggttttacaaataaagcaaatagagatagttctgaagttgatagcaataaaaatacaagcatcgaatctaatattgattggatgaaaaatcttgactcatctcctcaacaaagcttcaatagggaaaatgtaattaaagctacagatgctcatgatcaatttaataataagctacgtgaaaactatagaagaagatcaattgacggaggtccaaccccaaggggatttataccagatcatgttcctagtgctcgtgagctccttcagaagattagatttgatccagttgatttagaacttgagcacctttctcacatgcgtgaaagggggagatttatttctgatgcagtaccttatttacctgaggaattacaaagactgataatggtatcaaatcaaaattcaaataaaaagcacagatttaccattgacacaaatgcaggcttattttcaagaattgactacaaaaatttaccagagttggatttaaataagtcaattcccaaaaatcgagattttgatgaagaatctcaaagaattcaaaaaaattcatcggaaagactacctaaaacctcggaagaagctacctcgacaaaaaataataccaaccccacgaataataagcagaaaaacagcgctcttcctcgtgggaaaaagtcaaagcttaaaaaagtggcagacaagtacggggagcaagatgatgaagaacgaaaaataaaaatgatgttatttggaagtaaagagatgaaaaaagctaatgatgactgttcaagcaataagactaaaaactctaatgaatttttaaataatcaaaataggcaacttcatatttcccagcaagaaaaaagaagaaaagaacaggagaagatggaaaaggtttacaaaaatagaattgtagacaattctacagagaatcgtgaattccaatactttaaagacagcctcttacctacaaataaagatgaggattcagaaataattgcagtaataccaacatttgcgccatttacatgtataaaggatttcaagtactgcgctagacttactcctggaggagtaataaaaagatcaaaagttgcccaagatattattaatcacttttcaaatattagttataaagaaaaggaccaaaatcctaattcttatgaacacattaaggccttgaagatagacgacctaataaaaaacctgatgaatcctgttaaggttcagttttcaaatgaaaagagcaagttacaggtagatgataggaatgatagaaattag

SEQ ID NO: 1989 - DNA, 558 bp, Cryptosporidium hominis
atgtttaattatagagtttactatcgaactgtaagacttcctccggaagattcggaaattggcgaccctatttcattgtgcttagaaattgaagaccttccaggaatagaatcaagttatataaatgatcaatttatcaatagatatttcaatatggcccgaagagaattattcatcccacctgggacaaaagatataattccatttaaaatatggagacctcccaaagttcctcttgctgcaggccaaaaatatttacctttgactcagggaagaatggggttcatttttgtgtgcgatataaatgatattgattcaattaaggcaatcgagttgctgtaccagaaatttcaatctatttcggaattatccatatcatctattaaacctgttgtttttttatgcgcaaataaagtcgataaagatacagaaacgaaaaattttgagctaaacttattcaggattgaagactttgctagcagaatgttcattcgtctttggaaaacttcagcactaactggaaaaaatatcaggcatgtaagtgataaaatacattaa

SEQ ID NO: 1990 - DNA, 549 bp, Cryptosporidium hominis
atgtcagcaagaggtagccgtggaaactttcgtgctggtcgaggtagctcacgtggcaaaggcggtgtaccttcaaatggcagaccctcattttcaggtcctccatcctcaataactgaattgggagaggtgctgcattcaagcgagcacgagttagtatgcaaaagcttccttaacgaccaagttccatacttcaatggaagaatattcctggagaataaagaagaaataggaaaggttgacgaaatccttggccctattaatacctatttcttttctattaaaatgaacaatggagttaaagctgagtctttcgttacagggaccaaaatttttatcgatcctcaacaattattgccaatgtcgagattcttaccaaagacatctgctcaaaaaactaccaagaaaactggggaggccgcaataggaaaaaaaagaggttttaatagctctccaggccgtggtggtcaaagtagaggtgtaagaggaagaggatttgcaagaggggcatctcccagaggttttagaggaagaggaactagctcataa

SEQ ID NO: 1991 - DNA, 1158 bp, Cryptosporidium hominis
atgatgagaaatacaattagaaccgcagtatcttcagttgcgtatttgagaaatttgttcgatgaagaggcatttgaagataaaaatgtttctggattgcaacttaaagttttgaggcctttcaaccaagaatctaaattaattttaaattggctagaagatggagtatttgacgctttagaaaaacaatatttaaagttactagtttttggaatacatggtgagtgcgatgagctcattgaaagctaccacttccacttcaactattctgaaaaagggacaaatattaatttaaaacgtaaatctaaggagaaagagacatcaaattcgcaagagattaataattttggatgttgcaccaaagaatatgctagacaacaaacggtccaattattgcgtgcgttgattttattaacgcagtcattatccccactacctgaatctagatatatgtctatgaagctttggtattacgaagaccgtgttccaaatgattatgaaccaaatcactttagacccgcgaggtcatctgatatattatcattcaatgaaattccaattgatactgttgttggtaatgttgataccaaatttcataccttatctgtaaaagttaaaagcgctgttgagaattataatgatagctctgaactgaatttatacacgaatttgagtgcaagtcaattaaaaaaaaaagaaaaaataccagaaaagcaagagttattgaaaattcaaacttttagcaatgataaaataaaagaaagaactgatgaggagttaacagcaggctcgtcaactgaatctaaacaaataaaattaaacgaattaattccaaaccaaaacggttcgcctaccgatgataggactattaaaacaattaattcagttgaactacttgagaaggccactgaagtagtaaaattccttaaattcgtaaacaaaggaaaccttgctatggctcttgatattgaaaaagagagggctagtaatcttattgaaatattactagataatggccatttattaaacaaagttgtaaaagggaaaggatatcccgtaaaagaaagagaaattggtgaaagaagagttaaaaataaaggtatttgcaaaaagagaatgacaaaaagaaagattgatgataaaaataccatgaattaa

SEQ ID NO: 1992 - DNA, 1362 bp, Cryptosporidium hominis
atgtttgaaattaaaaataatgaattgttatcaaataaaagtgaggctgcgcaactaaattcaagtcatgatgataaactgcttttagaaaaagcaaagaaagctcttgcaatacaaagtagaatcgaaaagaatttatcaatattacattcaaaagctgataatgttaacgaactaattataaagacaactgaaaatgggcacttgaatttggaaaacaattacactcttgtttcgtctaaacccacatcaaatagtgagcataaattttcttgcatcgaagctttaaatgtgaaagaacctaagttaaactcaattgctcaaaagagatgtacagaatttactgatccacgattaattgtcaaacagaaatcaaaaaaagctttaagatttattaggaaaggagtattttctagagcagagattgaactaaatgatcctgatcttgtttctaggaaaaaaaggaggcaagtagaagagttattttttttgaatgatgaaagtgttttttctaaagttttaattccggaacttgagcattgggatatgccttttgttaagccaaaagagaatgttttagaaggtgaattcccatttgaaatattagtttctaagataagtaatctaattgagcatcctgttcctttagaaccttactttgatcctgacgaaaatatttcatctgttattttcctaacaaaaaaggaaaaagcacggcttcgtagaatgaatagacaagaaaaagaaatggaaaggcaagatcgaattcgaatgggtattgaatctcctcttagacccatacttaaactctcaaatttacataacattttaaacgaaaaagcagtcgctgaaccttcaaatattgagcttgaaataaagagacagaaagaagagaggataaagctgcacgaagatagaaatgcgtcattaaaacataatcaggaagataagtgcaaaaagaaagaaaataaatggaagttggatcaaaataatccaatagtacatgctgcaatatttaaaattggtagtcttaagaacaaaaggtatattttcaagattgatagaaatgcacatgactgccatttaacaggttgctgtgttattagttctattgacccatgcattattttagtggaaggctcaaaaaaatcgataaagttctataaaaacttacttctaaatcgcattaaatgggatcaaccgattgaaacaacaactagctgtagtttaatatgggaaggcgtaaggccttcaaggattttttttaaatggaagatttactattgccattcaaaagaagatgcatatagattttttttagataataactctcttgatctctggaatatttctcaaaattag

SEQ ID NO: 1993 - DNA, 1116 bp, Cryptosporidium hominis
atgttaatttcaaatctctgtggaaagtttggatggatagcgtatcacgaatatttatttaccaaagaacgtcttcacaagtctctattgcctgccttatcagctagtccacaccacattgcagttgtaaaccaatttgattcaagtaaggcacacttaatagaaataaacgggaaaatctataaaaggtgggtatttccctttacatactatttgacttacgaaaatgaattcaatttattagaaaatgagccattgattgttcctgaaaaatgtatatattttatggacgcagcaagtatcattgtaagctatttattagatattgacagattttctacagtattggatctgtgctccgctccaggaggtaaagctttaatcattattaaaagaatcttagaagacattaacaaacatggtgaaaaagataaaatgtgtcatataacttgtaacgaatatgataaaggtcggttcagcagacttaataaagttttgcaaagtcatattggtaactttgatctaaatagagtaaatgcagttactatttcaaatgatgcgacaagttcttcgctattgtattcactacgtaagcagagccgatttttgaaaattttagtcgacgctccttgctcatctgaccgtcacttgattctatcaaatgattttaaacattggtcaataaagcttgcaaaaagaaattccgaacgtcaaactgaaataataaacaatgcgataggattgttgcaagacgacgggataatcttatactgtacgtgcactttaaatgaaattgaaaacgattacactgtggaacgcatatgcaataatttagagataagtacgaatgattgttttaagttaatgttaaatattataaaagagttcaataacaggtataaccaagtaaaaataatcttaaaacccattagaaatgaattaaagaaagaagagtttgatgaaaaatctaatgaaaaattgtattttaacatagaaggaaatgagaagaatataatagtttttgagtatacaaaattcggctcttacatccttccagattcaaataatggaattgggcctctgtatctagcgttcattaaaaaaaaaagaaaataa

SEQ ID NO: 1994 - DNA, 336 bp, Cryptosporidium hominis
atgaataatggcatgataataggcgtaaacatgattgaaagcgaacaaattagagatagcgaatacgtttttaaagaagttaaaatagttgatatgaatacaatatctgacgttgatcctgttacttcggctactagcgaaattgagattcaaaaaactactaaaactgaatcatcatttttaaggaaatattggtggctaatcgcaataggatttattacttattctgtattgactacagatcaaagtttaactgagcacacggaaatcaattcggccaatggacaaatacacgaagggaaaaacagtagaaaagcaaataaaaagaatttgtaa

SEQ ID NO: 1995 - DNA, 2013 bp, Cryptosporidium hominis
atgatagttaaatcaaaacaagaatcaggccgtattaagtcaccaaaactaacaactagctctgtaaatcatttagcagatgatcgagtgataaaatatattgttgttacaggtggtactttgagcggactaggtaaaggaatagctataagctcacttggcttatgccttaaaagcagaggatataatgtaacagcgataaaaatagatccttatttgaatattgatgcagggactatgtctccctttgagcatggagaggtttttgtattggatgatggagaggaagtcgatttggatttgggaaattatgaaaggttcttgggattaaatttgaccaatatcaattctattacaacagggaaggttttctctgaagttattagtcgcgaaagaaggggagagtacttaggaaagactgttcaagttgtgccgcatttgactgattatattcaagaacgaattaagcttgctggcatttcaggatattatgatagttccgataattacattttaccagatatttgtatgatagaagttggtggaactgtaggagatattgaaagttctgtttatttagaagcattacaacaatttatatttaatattggttctgaaaatatagcatttattcatgtatgctatttgccctatgttggaaatcaactaaaaaagaagccaactcaacatagcgtatctagattacgagaagtcggattaaagccagattttttgtttggaaggtgcgaagttcctattgatgatttatgcagagaacagttaaaggtatttactcaagtgaaaaaagagcatattatttcggtacacacagtcgaacatccaagcgctgtagtaaaattgttagaatctcaagaacttgcggacaaggtgtgcaggcgtcttggtttatctatacgagaaccaggaaagctattagctgattggtttaatattatagatttgtcaatattaactgataaacttcaccgtggggaaagcattccctctggaatgccgaacccatttataaatggaaaatcaagaattggaattgtaggaaagtatattgcatctgatgacacttacctaagtgtaattgaagctcttaagcatgcggcattacatgttaagattcaattagaagttgtttggattgaagccactcaattggaggcagaaacggaaattatgtcgaataattcagctttaaaaacctcgaaatctacttgggatttattaaaatctgtcaatggcattcttgttcctggaggatttggaaaaagaggaataaacggaaagatcgaggcaattaattattctcgagtaaataacattcctttcttaggtatttgtcttggaatgcagctgtcagtagtcgagttttgcaaaaatgttttaaaattaccgcttgcaacatcacaagagttcgaagatgatttagctttagacttaaagccaatctctagtatggatgaactgaaccttgctcacgcctgcaatggtacgttgagcgttggcgaggaaatacttagccctaatacagatattgaactttcatccaggtccgttcatgttgtcgttaccatgagcgaatttactagtagtgataaaggtggtacaatgagattaggaggttggaacactatgatacacgataagaactcactcgcttatagaatctataactcatgtaagttccagtcatttacaactctttgtacagagacgggtgaagagatttacactattagggagaggcacagacatcgttacgaaataaatcctgaatttgtgcctctgatggagaaaaatggcatgaagtttgttggaaaggacgtggatgttagcaagaatgaaattctagagttaccatcccatccatttttcattgctgctcaatatcaccctgagttcacttcaaggccaatgagcccaaatccattattttacggccttattctcgcatcaatagggaaaattaaacataacgaggccctctacgaattcatttaa

SEQ ID NO: 1996 - DNA, 459 bp, Cryptosporidium hominis
atgattgaagttccaatcgttggaagagttaatagttgctataatgaaaaatggggcactcctagacaaggtaaatatggcctatccagcttagcaacaattgaattgaataccaatattgtatgtagagacaaattaaaagctcttgaagaacattcacatactatcctaatatttatttttaatttgaacaaaataaaaaactctcaaaaaaaaaaatttttatatattaataatacaaatgtatattttgttcatcagaatgcaaaagtaactcctccgaaaatagatagtggtgaaaaaagaggatgtctagctaccagatctcctcataggccagttccaattgggttaactatttgtaatattgtgaatattgatttatttagtatgaaaattcaagttggaggtgttgatattattgatggtacacctattgttgagatttttccatattct

SEQ ID NO: 1997 - DNA, 1647 bp, Cryptosporidium hominis
atggaaatttcaaatgaaatagaatttgaaaagaaattgcaactaaaaagatgtagagaaagtagagagtcgataataaaggacataggctactctgacgagttcaacccatttggtgataataatttatcccttccatttatttgggaaaagaagttcgagcaagaaaagaaaagcagttctttcaaacaaaaatgtaatgcttatccttggtaccaatttggagtttgtccaataaatactgcggaaattattgaaataaaaaagagaagagaaaactttgaggaaaaactgcaaactagaaatgtttctaataatcactttgattatggcaaatggattgaaaatgaaaaaaattttgaaaaactacaattacaaagctcatcaattatcagaataagagaacatagggaaaatttatttgatactttcttctggaaacttttaatttattcatattttaaattgaattcaacattatcgccaatatcatcattaatcaaaacaggactatcagcctctatttcctatttgatttctctaaaagataaaaaattatttaaattacttgatgaaatctttataactcatccaaatgagtctaacgattgtatttcgcttttaattcagatagttagtaagcacaagcagctaagtagcacgaatacagatcttttgttaattcctgagtggcaagatatactagatggtttagagatattattaaaagcaaaaatagatgaacttaataaaaatgctaatttttatcaaagtgacgatcaggaaatcaatgaaatattgaataacaaagaaattaatgaattaaaagatattatgtttcaatctcaggaattagcagatgaagattattggaaaagagtcgctgttatcacaaaagttagaatatgtaaattaaatgttgagattgtagaaaaaacttattatgaatgttttgaaaaatgggcgagcttacttatttccaagtacaacatcattattcaagatgataataactgcgcaaatgagaaaattatcaattctgctgatcgtatctcaaatacagaagaaatatataaccaatatgacgatcatgaaaaagttgatcaacttattgatctacctttaatagaattttcccaatcaaacgaaagatactttagtaacagatcaggataccaaataacagagctaatattaccatgcgtatactcgatgataaaagcaagatactattggaaccaatataataaaaactactattctaatgaaactcttcctccaaaaataattcaaggatacaagtttaaaattaaatatcctcttttaggcaaagcagaaaattctggtattattcctagatggtatattactacaaaagataaatatcttaagaaaaataagttactagtaacgaacgaagaggtcttactaaaagttcatgaggatataatattttgtgaaaatgaaatttctgtcatgaataaattattgatcatcacatgcgatcataaaatttataaagatgttgggttttcaatcattgataaagagtgggatttaaatcccagaagcgggtttaaaagctatttcgagaactctaccctatacttgaatttcaattttaagcagacgaaatataaaagataa

SEQ ID NO: 1998 - DNA, 3843 bp, Cryptosporidium hominis
atgaagagtgatggagaaattattccgatggtacttgattctaattctaattgcgagattccagagtattcctctgagagtagtgacatctttaatggcattgaattatcttcaattcctttaaattctctgattactagtagtgagtggcaaatgagaatgtatggttacaaaaaaggaataaaagaaatagaatcggtaaatattagtgatgttgaaaacctatttatcaaaagtattgttaatgataaaaatatttcatcacaaaatttaggaatacaatttttgacaatatatattgagcaatttgggttgaaaatcaataatttgccaactatttggagagacagcatttctgaaatgctaattaagaagacactgattaatccaaagacatcaagttcgtcaatgaatttaacattttcattctttgaacagtcattattacttgaaagtggtaatttaaataagactgattatttgtgggatgagatgatagatttcattaataataataagaaatcaaaaggaattgtagtaaagcaaatttttgggattgtaaaattattttctagctttattgataactatggaattgagttttctcctattgcaaaatggttgaaggttatagttcctttggttgttgattgcagcgacaaaagtacgaaggagtgcatttatgaaatcctttctatgattaatcaggagtcatctttaatggaatcaatatcttcttcgttaacacctttacaattaaaggaggtgcaaaagcgatcaattgaagcggaagaaaaaaaaaaaaagaaaccaatcagaaatcattttgttgacaaaataaaagttagatttcattcaaatgtaatgaatggatctgtagctgttaataataacgagagctcagttgatagctttgatttgattgaacccgtagatgtaatgaaaatgcttccctctaactggcttgatgttatttctgataaagaaattaagtggaatgaaagaaaaatgataattgaccatttctgtaagttatgtgagactcacaagaagttattgatcaatcaaaatgatgttaagtccaatattactcactccaacaaaaagaatttttttccaactattagtgattatcagaatttgttcaatattttacaaagaataatcaaatgtgagggaaatactgctttgattttatctgttattagactttgctcaaatcttgtaaaatgcctcagagaaaaaattgcatcaatagttcgtcctttaacaacacaaataatgattaaaattaaggatcagaataaaattgtttgtacagagtcaataaactttataaatactgttttaaaattttcattgaacttggaccaaatttttgatgatttgtgtcagtacggttataaagagaaagttaccactgcaaaatgctcagctatctctatttgtaacagtttaatagatgaaatcattgaaaagaataatattatggaaaggcattcaaaaggtttaaaacaattgattaatattattccttcctgttttgatgacgcttcaatacatgttagatcttctgcttgcgttttacttataaagcttaaagatccatgctttggagaggagattagttcaattctacagaagataatatttggactacatattagcaaacaaaaactgatcattgaaacagaaagaaaattgggaattaaatcatctacagtaagaaatacaaacactacaagcgacaaaaatattcattcaaaagctctttcattatctattaaagccacgcatcctcctccaaactcaaccaattcaacaccaaataatgagtcaacacaatcaaacagaaattctctgtcaaatattgggctttacaagcaaattgaaacacaaaataaaggctcagttggtgttgaagtgactgaaaatactagtattaatcgtttattgcctatcaaaaataagaatggagattctaattcaagtgtgagactaaattctaataccaaattgattggaagttcaactaatttagttaatgaaagccatcttcataattcagaagcttttccaactattttaaactcaatttcatcaaaaagtgatcaaaaaattaatttctttgaaaggctgtcgaataaagaacaagtaaatttacaagttttatcttgctctgaaaagaaaaatttttattatgttgacccaacagatgatagaaatttcatttttaatcttccagagtcagaaataatttttgaaacttgtggatcagatttaatttctttaaaagaatatattaagccctttatttcagatcacctatttattaatatgttttcgagtgaacaaattcaattagacttttctataaatttttgggaaagattttgtaattttttaagaaaatcaataaacaaaaaatttactcttttttattttttcttcagatggattacatactacgttgaaatggaaatagcagcgaattatgaacgtataattatctccttaataaatattttttcattgcaaggaagagaatataatgcaaaatttaactataatattatttataatataattctaattgttattaatattattgtcaaggacctacagatcttcgataaatcaaatattctttcaaattatgaaatttctaaatatgaaaggattattttcctcataatggaagaaggcttgacattaaatacttattttgaaactgaagagaaacaagggtcgtttaatcaattgaataatacatcatttatattgaatacagccattaactcttcattaggaaaccttgagaatcctgaaaagaaactaaacctgattaataactatttaaatatatttactgactgctctaacttcctaaaaaattttggtatttctaacattcactcattgattggttttgccgaacgcaataaatcaaatatagaaatttgcgaatctgtaaataacatactttcaagaatttctaatattattggagaaaaaatatggaacactattttaatatcttttccagatatcccaattgataaatactataattcaaacatctctgaatcattaaatgacgacataaattccaatttaatatttgtcaatacattagagtacgagactattaaactcttcaatattattggttccacaggaaaccctaaggacactggagtttttctcaataacgttacatcaattattttgaaaaaaattgggactaatttgggaataataaataataaattgaactatactttagaaagaatagatgaaataacaaaaatacttgataacagtttcatgaatacgctattgatagaaaatatcacatacttttcagaaatatcaatacatttgtacttttcattaaccaaattaggagcaagtaaatttaaagtaataaatgaaatattcagtgatgagcaaacagaaaatctatttttcagggcaattgaatatttagataagtttacaaatacatttcagtctattctggtaaaggaggagtttccaataaaagagttaatggccaatacattattcataatgagcaattacttgatttggaaagaatacataaaagatgaaaatcaaaaaatcaagctagtcaattcacttaacaatataatgggagttaatataatttcatcttttcaacaagaattgccaagattaattaaaattatcatagaagtaattttgtttggaatgaagccaaataatcagacaatttttgaccatgatttattgaatagattgctaccaaagctattaaggaggacgaaagtttatttatctaaaaataatattggatga

SEQ ID NO: 1999 - DNA, 474 bp, Cryptosporidium hominis
atggacagtggccaacctagcgttccaaccattcctgcttcatcaagcattttacctgtttcaggcgccccttcaattccaacattatatgctcaacctaaaacttttgtgccagtggattgcagagtaatgccaggatacccatttgcgagtctggcaggagttccatgcgtgattccaccccttcctgaagattttgttacacaaaagtcagataaggaaggaccccaaaatactcagaatcttccagaaccacaccgtttccacaatgggcaaccacttaacccgtatatatctccaacggaccaaacagttattgtcaatgcgccataccaccttgcgcaatttaatccagttagtggttctagtatgtattcgccttgcaatccatttgttgcatatccttatggtattcctgcaaggggcccaactccaggttctcaaccaaaaaaaacaggattttatgcatattag

SEQ ID NO: 2000 - DNA, 273 bp, Cryptosporidium hominis
atgaatggcccattatcttttatagacgacattcagcaacattctaatgaaaatactgcataccaaattgagaacgtcaaagatttggaagaaagtgaaggcgataaaaaagaaaatttacataaccataaaaatacaaatgaagctattaaaattgagacaaaaaaagaagaggaaataattgatgcaccatcagatgaaaaaagatcctcaggcttggtggaaagattaaaacgttcgctgggagtttcagcggaagaagaggtaagttag

SEQ ID NO: 2001 - DNA, 951 bp, Cryptosporidium hominis
atgaaattttttgtaagcataaaactacttttttgttgtatttatttagtagcagctataaatgggaccaaaagaaagagaaagtctatagggttgacctttcagaaatctagctacacaaattctttttgttcattattaggctgcaaagatggtagaggctatgctggctcaggcgatggcgaatgttattcagtgactcgttgtacaaaatgtaagacaactaatgtatctgaatcatcaatagcatactgttcagtgattccggcaatccaaaatgaagttacagtttttcaaggttttcttaaagcttcaaaaagtggacaagagattttaagttcaagtgtatttatggatgaaaattcagatatgtctgaaaatgatgaacaaaaaacagatgattctgagggcagtcaagactatgatgataatgatgatgatgatgatgatgatgatgatgatgatggtgatagtgatagagaagatgctgctggcataaatagaagttactccaataaacatatttcaacgagcacttcaaacttaaaagtcaaatcagaatattctttattagaactcgtttctcaaatgacagaatctgaatctgaagaggaaaatgagaatctaagtaatttacctaaatctaataaatcacgttcaaaaagtttattaggcaggatttttagcaggaaaaaaaaaaataaaccagacgaaaatcaggcaacacaatttaaaaaaacgaataggttttcttttaatttaaatagtttgaaaaataagtttcgcgataagaatggatctaataaattaaatttatcttcaaaagaatctgataaaagtacagttaatcaaaaattgaagagcgcacaaatttcgaaaggaaccactatagagtgggaagcctccgggagcatactaagcgaaagattaaacaaatgcacagtaagttaa

SEQ ID NO: 2002 - DNA, 558 bp, Cryptosporidium hominis
atggcaaaaaaggttttagttgctctcgcaaatggattcgaagaaattgaattcgtaactccagttgatattctgagaagggcggacctgaatgttacaatagcagtttcaggagattgcaaaaaagttatgggggcacacgggataactattatgggtgacaagttgttggatgaggtattgtctgaagactacgatttagtcatgtgccctggtggaatggattgcgcaattaagcttgggagtgatcaaaatttgttgaaaatattgcgtgaaacgaaaaaaaaaggtggaataatagcttctatttgtgcttctcctgttattgtatttgagaaaaatggtctactttcagatgttgaaaaagcagttagttatccatctatgatgaatgaacttgataagccagatagctcaaatgcagcagtttgcgtgagctctaatgtggtaacctcacagggaccaggaacttctgttttatttggtttaaagcttgtagaaatgttgtgtggagtggaaaaatcgaagttaattgcagatacaatagttgcagcttga

SEQ ID NO: 2003 - DNA, 930 bp, Cryptosporidium hominis
atgtcaggagttagtcgtagagcagtaattacagatccaaatggtgtatatgagggcgatgttaacgaaaagggcctcaaacatggaaatggagtttataaagtcaatactggagatgtttatgaaggtgagtattccaacggtcttaagaacggctatggggtttatacatgggcgaatggagataaatttgaaggctattacaaagatgatataaaatggggccatgggatctatagatggtctaatggcgaggtttttgagggagagtatgtaagaggcgttaagtgtggtcatggcatctatacctggccaaatggtgacagatttgagggtgaatacaaagatggagttaaggaagggtttggcgtttacaagcttgcaacgggaagaatatatgaaggccagtactcgagagacatgagaaatggacaaggtacatccagatatacggatggatcagtgtacactggagaatggttcgacggtaaagaacatggtcatggtctcttgaagttcagtgacagtagttcatatgagggagatttccagaatggcgcacccaatgggcagggaaagtatacttattcaaatggaaactactatgttggtggattcaaaaatggtcttacagatgggccaggctcactcacatttgcagaagataatcgcgtgctaaaggcaaattggaaggatggccaggtcgatggtgatgctgcaattatttaccctgacggtggaaagtacactggagaagttgtaaatgggataagacagggtaaaggtgtcatgacagagtctaatggtgatatttttgatggcgaattttttagggatttccgtcatggtgaaggaatacttactgtaaatggcaagcaaaagagagtcaaatataatatgggtaaaaaggttggattatgttcttgctag

SEQ ID NO: 2004 - DNA, 1647 bp, Cryptosporidium hominis
atgagcatacttaggaaagattcgttcttttcaatatgcttcctgttgattagtgcagctacaggcatgggagtattaactcttccatgggcatttcgacagacaggactgtttttgggaatagttgtgttgttatattggagcattttatgcagcacaacaatatattttttaataatgggaggattacactacaaagtctctaatattactgaattaatgtattatagtattcttggtgaagcaaaaattgaaaatacctcaattgaagccgaattgagttcagttggaagcaaaaaaagagtgaagatagcgtcaaaagccgcagtattgtgcgatgtactcattttatttgattgtttgttcattgttccttgcttattaatttttctttcagattttcttatcccaattaatattcttgttcaacaagagctgcccaagttgtcaattcgttatccaggtcttgaaaaatcttctctggcgaagctgttttataatctgtttttttctatttcacttttttttacagaaaaatatcgatgcataatattcttttgcgtaatcgtttttttgttatgcataccgaataatttctctgctgtaaaattggtatcagttttgtctgtattttcatctgtttctactgccatcatcataatttattttggattgagttcaaatcaaccaccagaatgccaaagtgggattatggctacaaacaccaacttttgcagaaaaggaaaaatagagctatttaattacaactctattaaggagttttggaaaataacgagcgtttcaaatattattttgttttctcatttctgccacctgatattaatccctacaacaaaaaatattcatcacatgtcaacaagaaaaataaaaggaattgtaataacatttgtatctgctatttttatttttaattgttcggtcggaatatctggttattcaatctttaggtcgaacacattaccaaatattatcagcaacttcgcatacaatgaccctttaattgttcttgtaagggtctatttgacactatcattaactgtcacagtatgtatggaaataataccattaatagatagtttttcctcgactattatgtttttattcaagtcaattggtagtttaatcgataaaagaaaatccgaaatagagataactagttccattaaaaattcagagccaaatttaacagcagatgaagaaacgaactccaatcaatgcacatctacattggcgtctactgttaatctgactccatattttggaattaacgaacaaaaagaaaaaaataatgaacaggcggattccattgcgaaaaaatgtcgatgtaatcgttcaaatttcatgtttttgtcaaaagataagctagttaaaatattgaacttaattattgtccttacattctcaggtattatggcagtcgggttcagctccgttgccaagttaattcaggtcacagggggaacacttgatgggatatttgtgtttattattcctgcatggatatactattcaacatacttcaagcatcgtaacaagatatttgggataacattgttatctttatattttgtgaatttcgttgtagcctctctttcgggaattgtagggctatttaaagtggaatag

SEQ ID NO: 2005 - DNA, 2154 bp, Cryptosporidium hominis
atggaagtctcttcagatttggtagattgggctcaatgcgagctttgtaagaaatggagaaagctaccgttaggaatgaatcctaatactttacctgaagaatgggtgtgtacaatgaacacatgggataaattatatagttcttgtgacgcagcagaggaggttgttggaattcctcctgaaaatttatattcaaacatacctaatcaagccgttttatcttctgattttcataatcgctcacttaaagggcggaaaaaaaattttagtacttgcataaataataattcacctatacaaactatcaacccaaaacaaataagtaatcaaagcacaaacttgatcgaagatgttaaaaaagattttaacgatattactattcctgatggttcgcttaacaaatcattaattgatagtttgagtcaatggagcaaagagcttaagctaagctatacaagtttatcttcaggcaacctaagcaaaagtttcccttcatgctggccattagaatatcaaaatttgaataatattcctttatttagaaatagattttttgaaaattttgagaaatcaagatcaaaaaacaacggtttttctggaaatcacgaattactttcaaatctaaaagattcacaaaatttcccattatgtattttcaaaagtaacataattagttcaaaaaatcatccgcttgaaggaaggtcaattattacaggtacagatattccgattgtttttaaattaatcggtagatttatcaacggtatctttccaattatttcaaagaatcagccaattaaatattctaataatcaatatacaaacaatcctatttcattatctaatacccaaaagagtcaaggcactatatcaagcatccacacaaattctattgaattaattccagccacgagatctgactgggattctccattcattgatttatcaaactctctatttatttcgaattgcgctaactataagttaagcaaacgcgatgacagctggagtaaatgcagattttcatactctaaattattccctgaagaagattacttttcattaacaccaaattatctaaaagaaacaaattttgatttaaaggcagttaattctaaaattataacggacgaatttaatgaacaaacaaatattgatattttagatttatttccaatcttttcttggttggaaaatccaaataattttaaccatcctatgcattctaaagttacacaatctaatttaacaactcaagtaattaaaatttcgaaaaagtgtaaaatgaacaaaaacaatattcgtaataggacgaagcaaatagatccagaccaggctgaaatcacacataaattgagaaggtcgtcacggaattctaacaaagttcagagttctgagagaaataatgctgaaagtgaattgtccattaaagacgattttgcaatggagatgaataattctgtcttacaatctatagatgactttaataacggagaattaaactcatcaagcatttctagcgaacaggtagatgagcttagcaagaggattgatgaagttggtttttcaactgagagcagcaataataatatttcgaaagatgttagcagcagcgatctaaatattaagaaaagggatttaaacgaacagttggagttgaataattcttcagaaattgaagagaaaaaattagattcagaaattaataataatgaaatagatactatcaatgaatccaatattctagatgagatgaattttaataatacccagaatttgtctatggataacgagcttccatttctcgattcaaaagtagactctaaaaaattgtttgaggatgatgaatacaatctttcagaattgggaagctataaaagaaaaaataagtctttagcagaatatagtgaaagctgtgattctattaaaactgaagaaataaatcatgacatatttgaaggcaggaatagaactaataaaaaaagattaagaaaaaaatctttaatttcagatgaaattagtgataaacatatcacaaacagcatcaatggaaattgtaatactgaatttaagttattactgaatgaaacagctccggctacatatcaggagtctgaacgaaaacttgtaactaacattgattctgaaactttt

SEQ ID NO: 2006 - DNA, 966 bp, Cryptosporidium hominis
atgcttaattcttccccggaaattaagtgtcttgttaaaatacatgcttgcagttttctaaagaatactgctcattctctgaaggatttgagtaaatttttaaacatttcattcgtgagaataatcaaggtggtgacgaacaatgacaacattcttaaaccaagtttgtattcaatttatatccccgaaaatcctcatattaagccaatggtgaatgaacaactatgggtttcttcaagaaatctattaattaatgaatatcttcaaagccataaaattgatctaataaatgcagggattgaattattaaaattactaacatggtatctttcctggaataaaattttagaatatccaagtgcaagtttcagtattcaacatagttctccgtttcaggtatgcgtttttgctcctaatttactattaggctgtgtaatgacatacccttatttgattgaagatattcccgtgacagttttactttgtgcaaatgcagaatattatttaaatgagcatggattaagcgaaaaatgtttaagtctattgaatataattaatttttctgatttcacttccactactaagaaaatgttaaactatacccgagacctaggatttcgtacaattataatatgcccaaatatagagctagaagaagaaattgtaatccgtttagcattagtagggatatcagaaaacggggaaatagtggtttcaggacaagttgagcagttaagcagtattgaatgttcaatattatttcaaaaaaggtgtacattatcgttccgtaatcaaaattttgacccggccaactggatatcaaatttcgtaaacaaccatatgtttattgataataagactgatatattaaataatgaaatatcaaaaatgaatatcgatggtgagtgcgtaaccaaaatagaaaataaattatcatttgccctcgtttcaaatgttcaaaattag

SEQ ID NO: 2007 - DNA, 1137 bp, Cryptosporidium hominis
atggacgaaatcccgattgtattatttactgttaaggaaaaaggaagcactttattcttcgatgcatattctcaaactgactcggtgaaacaaaattctggtattacgccacgtgaatattccaactattatcgtttttatgtgaacaagtacaaaaactacaattctatcaatatccactccgttcaatcaaataatgattatcttaagcaacaacttggctcttcaaatgaaagaaatgatcattatatttttagtccaaataaatattctggattcgaagttaatcagttaaatcaaagcacgactattctaccctctgcattttgtgggaacggaataagtactaatctgaaagattacgaattacgaaacaaacatttaattagttttgcggacaaacaagatccaagctttgaatctcctctcataagttctggtattcataatattcatttatataatgatccatacttatataacagaaaaatttatactagatttccattaaatcaaactaatatagttggagagtgtaatttcaaagaagaattgtgcagaacctgtcaatattcttccttgaaaaacattgatttatatattgaacaacctccaaaatataattttgtttcaaatacaattccagaagctttatcaatgggtattatgataggaattaatgcaattgttgaagttattgctagtattgcaataaaattttgtgcaaagattccagacaaagatgaattacatccgggaactggatgtgtattaatggactatttaaacgaaagaattgatcgcctattcaacgatcaaattgaaattcttgataattcaactgaatgtgaacaatctaaaaatgaaacagaaagctcaaatatgaactttgaagcatggatcaacaataagctcgatgagatcataaaccctacaaatcatgaaagcagtgagagcaggtctacatttaaatataccagtctatacgatgcactcatcaagaattgctatcacaaggcagatgactcgaggttcgatccgattaaatattcggatagtctgccatacgcccttccattagctggtactaaggcccaaacactgaagagaggattcctagactattctaaaaactaa

SEQ ID NO: 2008 - DNA, 918 bp, Cryptosporidium hominis
atgatatgcgttggttttgtcggctatattgaaacaccaaatggtctaagagctttaaccaccgtgtttgcaggatatttgagtgaggaatgcaagaggcgtttctataagaattattataggagcaagcgtaaggcatttactaaatatgctagaaattacgctgaaaaccagaggatggaggcagaaattgccagatgcaagcaatactgtactgtaattcgtgctctgtgccacactcaggttagcaagacaggactaaacaaaaaaaaggctgacataatggaaatacaagtaaatggtggaacagtatcagataagattgacttctgcgtcagatgcttcgaacaaccgattccagtgtccacgatatttaatgagaacgagatgatcgatattatcggtatttctaagggtaaaggttacaagggtgtaatttctagatggggcgtcacgaagcttccaagaaagacgcgtagaggcgtgagaaaagtttcctgtattggtgcttggcatcctgcccgagttcagttccaagttccaagagctggtcagaagggatatggccaacgcactgaaactaacaagaagatttatcgtattgggcgtggcgacgatccacgaaatgcatcaacttctgctgatttaactgaaaaaacaatcactccaatgggtgggttcccaagatatggtgtagttaatcaagatttcctgatgcttaagggctgtactgttggatgcaagaagagattattgacgttgcgcaagtctttagtgccacctgtgacaagatcagcattggaggtcgtaaatttaaagttcattgatacatcatcaaagtttggtcacggcagattccagacatcagctgaaaaggcaaagtactatggaccgtgtaaaagatcagtcgataactag

SEQ ID NO: 2009 - DNA, 225 bp, Cryptosporidium hominis
atgtcacaccgtaaatttgaaagaccaagatctggatccctcggtttccttccaagaaagagatgttctaggagccgtgggaaagtcaaggcttttccaaaggatgactcaaaccagccaccacatttgactgcttttatgggatacaaagcaggtatgacccatattgttagagatgttgacaaacccggatcaagtaagtttatttgcttcgacgtggtataa

SEQ ID NO: 2010 - DNA, 642 bp, Cryptosporidium hominis
atggaaatccacttttttttttttttttttttaatgagcgaaattgataaagatatatttgttgttagtggagatatatataatggagaggaatctggaggaacgctaaacgagccgataatgaaaacggtcaagagggatgtatttctcatttacaataagttacattattttatcactgctggaaagaacgagttcgatcgcgaatataatttgaagatgctatataattgggacttatggggaccttgcattatattgctagtattatcctcttgtctatatataaaagctccagttgaaaataaggataagattttctcagttttgcattttttctcgatttacggcacagtagccattgctttaaatgcgcggatcttaggcattaattgttcattctttgccatattaagcatagttgggtactgcatattcccatttacagtaatatcattaatttcattaattattccttatttctttgtaaagctaattttcacaatattatcaattactcatatttacaaggttatgcaattatctatgaacgagattgctcccgaagagaaaaaggttttgattttatatccaatttcattgttttttttttcggtagcattcctagtgctaattaattag

SEQ ID NO: 2011 - DNA, 699 bp, Cryptosporidium hominis
atggatgttaacccttctacgaatagtgtcgaggccggaaggtgcctggatcttctagttaatcaactcatttcatcacaatactggcaagggaccgttcgatcccatcaaatcagaaactgtgtctcactgtttaacagatatttgcgcttatcaaatcagcaaaatttaggaattctgactcaagaaataagagatagagttgcaaatgatactatttataatgaattcctcagtcaattagacgcggaatgcatttctcatcattctttttggcaaacttacaaggagaaatttgtccaaattttcaaaaaactgtttaattttcatttgataattttggaccacgctaaaataatggaaacaaaagtctttaatctgttgccagatgtcttaaaaaactcaattattccctcgtataggagaccactgatttttatttatttactgaacgttattctttttattctgaggctaactgtttttaactcgaagcctatatttcataattatacaaaaattggtcgatattcagcaaataataatattaatatattggatgaatataactacccgacattcttagaaatagtatatgaggtattaatgttctttctaaatatcctaacatcaattattccattagcactccctattattacgttacatttcataaataggcaacatatccaaaggtag

SEQ ID NO: 2012 - DNA, 207 bp, Cryptosporidium hominis
atgacgccattaatttcaacatttgataaaaagacatcaaggaactacactgactgtatcagggagattgtaaaatgcgcaaatatgtttggtgcgcatggatcaaataatattcagttaattagacttcattttaagagccaaattgtcttaattgctccagataaaaattttacatttctagcggtacaagatacaaatatataa

SEQ ID NO: 2013 - DNA, 1392 bp, Cryptosporidium hominis
atgaagtttatgctttacgcattagtaatttttttgagttatggctctatccattctgcaaataatcaaactgaacaatctattttcaatgagccatgcgaatatactacttctaaagaagtgaaaagtatgttcagtgtatttgctttcaatcagaaacgatttggcaagaaaaaaggcaaagtcgaacaaatagtagcaaagtttgtatgcaaaaaaaaaccattaatcattgcaaatgattggtctcaagaagattatatggtcatatcatttatcatttttttatcaaaaagattagatctcgcaacaaaaacttttgaaataaaaaaatataataattggatttttgggaatgttccacccttggaagaactttcaagaggaatcacccatttcaaccctcttcctgaatggagaagttggtgggaaaaagaaggggacagtaaaaaaatattaaaacaaataaatgaaatttatttatcaattacaaacactccagatacattcagattttctgataaatcagcatcaaataaaatcactaaaccattcctttcacttgcatatattttctcaagagaaatgataaaagataaagcacttataaaaaacatatctagaaatagctatagagaagaagtaattaaaaaccttgaaactaagaaaaatgaatttaattcggaacttaatttggagaatcctaatataattaatgaacaatcgctcaaacttgaaaaagatctatacaaaagcgatcacatatctttatttaaaaaagcatacaatcatgttttatttgtcaaaaaaaaaagaaatttcaattctgaaaatggtgacaataatattgaacttttaccaaattggtgggaaaaggagctagatatagtaactgcaatcatattaactattttcaaataccaatataggcacagaatgcaaatcattgaagccgaaaacaaaattaaaaatgacaatttaaactggaagaaaattcacaattgcataaaacaggctattttttgtacttcaaatggctcatcaaataattcattagagcatattccgatttggcacagatttggcgagaagtggcaaagcttcccacaaggagcaatgataagaatattggacaatgtatcaaaactttccctaaagactagtggttgggatgtatatgactatgtcatttgtttatgcttctactatttaataaaaagagaaagaattaggattgattggttcactttaggaccattgtcaggttctccaagaaccagattttggcgaagatttaaaagatacgtaataaatatgttttcatcaaacaaaggtatgtttgacatgaataataagtggtatagctcgcccgtagaattagaattggaataa

SEQ ID NO: 2014 - DNA, 732 bp, Cryptosporidium hominis
atgaaacttttactgtcatcgatatttctgatcctgtgtgtatttacatcgggtactccaattccaaccccaaatgaaattgttttagcaattaataataacgtaaaacacaagtatccaaatattgaggtcccactagattggcaaagccgtgtttttatcaaatattacccagaagaaagttcaattaaagtacattgtccagttgaaaatgatgccccttttggacgcacgctaataagaaatttattcagaatatacaaacgcaactttccaagcgacaaacgtattaagaaaatgaaactttctttccaatcaccatcgggtgaatttattactgccgaaaaattatctatcaaaggatatttatctgctttgaatgaacttgtcgaagatttaattgaagaagatatcgaaaatgaagtagcaagctcaggctcgccaatattgccaaatacaaaactatcaatttcatctctatcttctttgtcagattcaaatgtacaaaactacccagtttatgttttttttacaaatgaagaagaacgacttaaacaagaaggtatggttcagcttcttgtacaattaggttttaatgttgctcacacatttggaaatgctacatgtaatgttgattcaactaattattcagtgaaaatcccagaaatactctcaccgacaatcgacaagaatattaatactacatttgttgaagagaacccaaatcactaa

SEQ ID NO: 2015 - DNA, 336 bp, Cryptosporidium hominis
atgaagttaaatttagaaattgcagctaacattcatagtattgagcaagagcttgaacagtctaacctgaatagcactcttaattcaatcaacaatacagcttcagagaaattgactaaaggaatgcttgggtatgttagtaagcatacgctcaataactttaaaaatcctaaggattcggaaaaaaatgtattagagcacagaaatagctcagatttagaaatcaattcctataatacgacgaataacaattctacttctgaaatcgaaatgagtcttacaaatgaaaatgaaattaaaaaaaaaataattgaaatacctctgctccaggcatag

SEQ ID NO: 2016 - DNA, 1005 bp, Cryptosporidium hominis
atgactaaagaaccgacacgcattaaagattatggtccagtaaaagaagaaatttcaaatatttctaataatcacaatttacaaagttttacattgaatgaaataaaaaataataaaaatattgcaggaacagaatataataatagtgttgaagaaaattctaacattggtattagatcatttgaaaaattgattccatttattgatgatcctgaagcaagcaatgattattcaagcaattttgaaaaaagtgagaaatttaaattttctccacaaaaaaaattaataaactcgctcactgatattaaacaaccaaataatagattaactgagtttagtcaaagaacacttgaaaaattgaatgggagcttacctattgtagagtctgatccacaattagcacagctattcgcttctgctcaaatccgaattgaagatataaataatcaaaaggaatccattgaaaataaacatgctgaagagtgtgatccaattgatttaatagttaagtttttagataacccatcaaaatataaagattcaatttgctgggcaactataaaggctgttaaagaagtttatgaaccacaagtcaaatacgccaaaaaagaacttgatagatggatgaatagtgaaaacaattcagatgaaagtaaagagaatatggaatattataacaatctaatatctgaattacaaggaaaaattatgttggcagaaaaggcaagagaattacttttaacaagatataagagcgatgaaattcaatttatgcttcaaaatgaaaaaaattcccttgaagaaatcaagaaaaaaatgaacaaagaaagtgaggagttaaaatctattgaagaacaatatttgaatggatgcataaatcttaaagaggatgtcagggctagtagaattaagataagaaattttgaaaatgaaatcaagagtaaattatcagaaatacataaactagaagaattattaaggatccatgaaattgctaaattctaa

SEQ ID NO: 2017 - DNA, 408 bp, Cryptosporidium hominis
atgctcaactggttttggttaaccgctattctgcttatgaccctatggattgaatctatcaaatcaatttcttcgataatatatattacatacctgttattatttatcattgaaaattggcttcccaaaatagttactacacttatttcagttattttgttgataataacatgtttattctcatacttttctattcaaatagtttattcgttgtatctggttcaattagcaggaggaagaggtgatgaatatgttccgtactacaagctaaggagattaatccaaaattccagaattgaaaactccaacaaattgtcaaattcagtcatggagaaaaatttaataaggaatacggatgaaaatctatcattaattcgagttagtcaagactcacactcgaatgtataa

SEQ ID NO: 2018 - DNA, 7782 bp, Cryptosporidium hominis
atgttgtttatccgactgttacttacctattctcttttattcacttttcttaaaagtgtaatattttgccaggaaattgacaagagtaggattattttggaaaacattctgaacgaattgcatggtttagggtattcacaaattaaacaggacaacctactagatcctattcaagaaatttataatggagatttggaccactttaattcattttgtgtaaattcgcttttaaattactactgtaattcgcccagtgaaatatgggtaaatgagcaggttggtcaactctcaattgataagattattcaaaactttatattggtttgcagagaactaccagaatggcaaaatgtttgtcaaaatcaaccttctatagatagtttaattgcaactgacattcatttagcagcattattaacgatgaatgaaaaccatgagctaaggaatgttccaattgatacattttgtaacttgaatttaaatttgtttaatgaagatcattcaaattataaccatttatgcgtagaaaagctaatatctaatcaagtaaattttgaaaaaaaacttacttttaaaattagggaagctttaacaatttgctcaatgacaacattttggtcaaaaatttgtattaaaaataactcaaataactatgattttccagagttgcatttgcttgcatcttcactattctttgagatttctaagcatgataaatatttatctagttcaaatggtttagaaggattaacacctatagacttttgtgggttatctgagaaaatgatcctaaaaggagatgtattgaactactttaatattatttgcgttgatgaattatcaatatcttctaagcttgttttgggaagatcttggctaccttcgacaaagaacataattgatatatgcagaaataatcctttatggataacatgcgaccttaatttagattataaaaacttcgatactattaattcactctcagataataaagaatctggttatatatccattattgataaaactagtttacttgccacagcattgttacaacagatacacctgctaccaacttatatgtttagctcattatattatcaattcgcggatattgataatttatgctatataacaagcataattcaaaaagacataagtctaatacaaaacgaagaaccttctactcattcacaattaaactttggacagtttttcaactcaatatgctggcgaattctctctacttatcctatcacttttaaaacgagtatcggaatcatttctcagccaataaaaactcttgaagcagtttcagtgtgtagttcttccgtactattttgggttaacgattgtgtaactgaaagctctgaagacttaatttatctacctcaaataagcatcttatcacaggagcttttgatttcatcaaaaaaatattataatttgcctgtgaacacattttgtattgctgctaaaaacataatttcaaacctgaataaattaaatagtgggctcggatcttctgctaaaagacttgaagattattcaatcagttgggttctaaataatattagtaaaatagattcatacgcccaatttaatggaataacgtcgggatactttaacagagaatgtgtaagagaacttataggaagtaatgaaagtaacagtgagtatattccaatgaattttgcgatttttatctgtagtagttcattaagatgggaaagatgtgcggtaaaaggcagtattaaaagtaagtttttgacagaatttgtagcatccgaattctactatggattattagcagaagtggatttcaatttccaattcaattggaatgatatttgcttgatatcagaatcaaccatacctgaagagtatgataatttggactcaatccctaatattccttatttcaaccatttttgttctttaagttttatcaaaaacttaaaacttataagaaaaaacgcaaatatttcatttagtgaaaacaaacaatatatatttactaattttattagagtttgtgttcacaattatttttggagggtgccatgtggagaaattgttgaatcagatttgcttgcaaacagtttactttttggctcacatcaatttgcatctatgcaaaatatatctgaacctcaattttgtaaagcagcaaacaatttattagaagtggacccaacaaaatttgaaattgagtgtatgagggaattaatgaaaattggtactcaattcacttcagaaatagctcaaggggcttgtgcagtaacgcaccgttctcaaatatgccatgggtacccagaagaatattctcatattgctggtacgctattctcagctatgtatcaatatttcccaatttctgaaattccgagttttattgaattttgtgaaattgtccattcgatatttacagataatgaaataaacgattcaccatattattttaatgctatatgcgcaagacacattcacaattctaacttgaatgcatcatttttgactatatctgttctttgcagtcatatatctccaaacaacatttctaatgaagattatacggaatctcttttggtttctgaattttttaaaaaaagtaaaagcataaattcactaagaaagtgggaattacattatttctatccattggccaaacaaattttagaaagtatagaaaaagatccaaaggatatttctaatttcaattataagtgtgttgcaataacaaggagtataatatctaccgattcatttacattaaaattagatgatgcaatttcattatgcagcggttcaattgcgtttaaaatttactgcaaaaatcaaaatcaaagtattcaacacttagtatctgaaataattcaagggataatgttaaattatgggttagacataattgaatattctgaagttcaatcaatttgtagtgctgcaaaattgattcatgatgggtcagtagaaaaacaaccgatctcgagaaatttacctggaataacaaaatatccatatttcttaaattcttgtattgaggtgttaacttcaggaataatactacctaccaaatttgtcgaaatttctacagacaatgctatttcaatatgcactcaatctttgcgctcttcaacaccatgtaagaacgagaaagctattgtatctgctattgctgtggggctttattcagaaatgcaaaatttccctgaaatggccaaattacaagtaactgaattatgcatttttgcctcaaaacttgccgaaagtagtacagaagactatttagaaacatgctctaaatatttaagtaattttaagtcatatattccaacaattgaagacctaaatgtaaatcttactgaaattcaaaagcaaagaatttgtacgaagccgtttatgtggcccaaatgcaatgttgatgaaaatttggtgcgtggagttcactcagttcaaatagaaaagctcgcttcaaagctaaaagcaatattcaaatcaaatgatattaatatttggaagttcgaaaggtattgtgtttttgcagaaaaacttctgaatgataatggcgaaaatgattttataaaatgtaataatttgcttaaagaattcgaatatattgaaataatcaaacaaagttcgaatatagtggaaaatcctctgtttttattttacaagcttgaagataaaactattaacaaagtttgcagtataatctcttctcattcaaattgtctcaattccagaaatgggctatcaggcctacttgcatcaaactttttttctatttcaacaaaatatttggatttgaattcaataaagagctcagacttttgtataatttcggaattattactacagagaggaagtttaaaggagattaaggagagttgcccttatttattgttacaaataactaatttggaacactggcctaaaataatgttaacaccggagctcagccaagtaatctgtgatagcttaagtattacaaatttgaattgcattacgcccaacataaatcagggtattacaattgaaatttcgtctgctatcaatgatatagcaatcgaattgtttttcattagaaaaaaatatgttccaagttttaatcctgaatcgagctgcataatggcagaatcattaattcagtttggaataaaaaatgagtatttcaatcgcctttgcataaacttaatttcatacgacatttggaatttttcaggaaattttgacaaaaaatatagtcaatattggagtattagccgtgaagatcccgtgactttcattagttttattaagggtgaggcttcacgattttgtgaagaattagaagggagactttccgaaatatatataaaaagccataattttattttaaaaaaaaaacgtgataataagctagacaataaaatttactatcaaaaggtcctcagaagaacctttaatccattaaattttggtaaaactaatgaacatgatctttcgaataaacttacgaaaaaagaagaaagaatcgaactgaaaaagaagttgagaattatttctaaagctaaagggtatgttgcattaaacgacgaggctgtcaaggaatattccccagaaatggtggattataagttagcaaaaaagtactatgccgacttccctaaagatatttacaaatctatagataattcaaattttgtatttaagatgccagaatttaactggaatttgttctcagaaaagcttgtgtttacttcaaagaattttcttggaatttcaataaaggtttctgatccaaaatacggtggtattgcagggctaattcaaaagtggggatatacgcctcaaggcacagtgcaaggtgcgcagtatatttatcgagtgtctagatatataaacaaatatatgataagcccaaaaaaagcatatttaatttggaaagagacccttatagcaatgaatttcgctattctcccgaaatggcgtgattcatggcaagatgaaattaggaaaccaagtccattagatgagcaacctttgccttcatgtgaaggagttaaatcgagcaaagtattaaaacagttgggaatggataagaagaaaataaatatggtggcacttgcaaatattgactccttcgtcgcacagatgacggaggcagctcatgatttgaagttatataatgtcaaatttaatgatttttgccttgtcgggattatattgtttaatactaaatcttattcaagaactgaatcttttaactatcagtgtactaaatgggttaaagagattgggtatgttgaaaagtatgttgaaaatgttaattttgctgaaaatgagcacaaactttcaaaaaaaatcgtaaatcgtcttaaaaataatgttagaaagcaaatacctgctattttagctagaaaaatatgtgcaagtacaagccgttggatgagttgtaacagtggaattggaatcgatgaaaaactaaacattgataatctcgcgaccgagttagtcaggctttcaagaattgctggacttgagtttcgtgatatgtgtgaagtcgcaattcaaatcgctaatgctcaagacttcaatcagaaatgtccagtcatacttcagcaggtaattggtaattataataggtcatatcaagtttgtaggtccactagttcttggaaatcgtgccaatattcaaaggtagtattggatccaaagttaaaagaacatttggatacattaacaactgaattaacaattggactaaatgaagttttcccaaatgtctttactttcgaagaaatatgctacttaagtgaaaagtttgttgcttctgaatactttaaaaccgattgtactagatcattatttgattttttggttgcccaaaggtttattaaaccaacattaaatatttatggagacgtaaaaccttcaaagtcctttaagcatattgtatcagttgcgcttgcaatttgctatgacacattaaggtggcaacaagcaacttgtgtcttagaaagtgaaggttattactcacttcatgaaaagcaatgggttgatttagtttcagaagaaatattaaaagaaatgatggagttaagtaaactcgattcacaaatatccatattttttaagaatgcagaaagagagcagcttttggagcgttttaatcttgagaataatagcaaatttaaaataaaacttcctcctgtaatcaagtatcatgatatttgtaatcatgtggctaaaataacaaaaacaagatactttaatattaattgtgtccaagtaaccactgacatttttcaaactcaattaacaaagatcaagctagaaaatgaacgtgctaataattttgaagaaattaatttatatggaggcatcataaaaattccaaattcaagcataattgagggtatttgtaaaggaagcattttttgggaaacttgctcaaataaacatttgcagccactctttaagtttgatttggaaaatgcaaaaaaagaggatgtcgacattattgtcaatgacatcatggtctctattttacaacttaatcaaaatgggtttgaaagtctcgttgatattaagaaagaactccatgatttagacaatatacacaaactagcttcaaagacggttgattcactagactatcttgatttttgcaagattgggatttggtattcgaaggaaatatcaaatttagaacaaaaagagcattctgagctacagaatcttctttcaacaaagattctcttcctcattcttgaaagtatgtaccctaatcgtaagctagaaaaggatcaagtaaccgacgaatctgaaaatgaggagcttggtacacttgatcaatacattgaacaatcaataatcaaacttccaacaacagctccaaaactagttaaaccacccagttctatgttcagaaatataacaagtattgagacagtattattacatcaaagcgatgactactcaagcaatatttttgcggtgaatctatccggttttcctatgtttcaagatttttatgtgaaaagaaatatttcaaccattgatagagatatctatgggaatactctatatgttaagcctaaagctggacttgtgctttcaaattatcaactgcccgatggatcgcagaagctctctaaatacgtaaatttagaaaaaggtaaaaatatagttgaacctaagatcaatcaactcgaaacggaacgaatattacacataataaagcagaacccaaataattttcattcttcaattttacctcatgctacaaaagaaatcattggtaaaaagaaaccaaatccttccgaaaagaaaataaaaaaagaatggtacagaaatattaaaaaagagtactattacaagaaaggaagagaaattgcaaagaaagaatgggaatcgaggcaaattgcgtttagtaacaacaatggaaccggagaaattatatgggaaactgaaaagaagaagattccaaaccttatccatgcgttatttaactctgaattgagaaagcaaagaaaagaaggaaaattatttaataaaggtttatataaggcaagagttcatcaatttcttcttgaaaaatttgacaatgacttgaaattgagaaaagaaaacgagaaaacaggaaagattataatcaaatcaaaatataaaaacactatccagacaaaaaatagcgaaattaacaaccttgaaaaaatttatagtgaacaagaaatcaatgttgttacaaatatagcagcattaataggttataaccaaattgcagttgatttgctttag

SEQ ID NO: 2019 - DNA, 3702 bp, Cryptosporidium hominis
atgcattctataacaattacagtattattttgtttactaattctatgctttaatagtgttctaatcttctgtaatagttcattggaatccattcccagatttcagcttgaagatttacaacttaatccagaaaatttatctgaaaattttattcgaactcaaaatggttggaataatggaggtgaaaagctgaaagatgaacaactaagtgttcttcctggatatatgagagaaattaccggctctagttcgtcttgtcctgcttctagatcatgtaatgttaataggagtgatgtagatgaattagctgaacgtgtatttattctccaatcagaaatatctgaactttcagtcgatttatcttggtataaagtttgtgcattttctatttcaattattgatacgaaaacatcttttatgaaccattgcagaagttctggaatttcatttttgctttcaagacctgtcactaaactgttggagcaatcaattgtcaggttatgccgcaatatgcctcaatattctacgtgcaatggagctgacttagcacttgactctttaactgaagagttgtttacagcaacaatgccccatgtcttgccaattgcaaaaaaatctctcgcatttacacacttttgttttgtttcatcaagaagtataagagcaagaactcgcgaggaatatttagaaatttgccaagatagtatacttttacttctaaatttgcatgaaatgtcgggatcacaaattactccctctattgctgaacaaatttgtaaatctacatggatatttaatacagaatgtaatgggtttagcaatacaaaattgatatctgaaatcgcgtttgaaatgtttgtcttaataagaaaagaaggaattccgaacgttgatatgaataatgtttgtcaattgctgacaaaaatttctcccaccctgcgtataccatccgatacaaaaattccaatttcaagtaaaaagagatatctgtatgagtgcacaatgtaccttacttcaatgatagaacatgagaagttgaccagtaattctgacaataaatatgaatcagtggagaaattttattctcgtggggaaattgttaaacgctttcacgatattgcaacttcaatttgtacttctgtttcattttatcaaaaaaagagtaaaaagatttttattccgggatttaaaaaaaagaagatagtggaaaaaaaacagggtgagtcgattctggaactatttatgaatttgatgcaatcagttaaagctacgtctaggagagtgcttggttggacaattgagctaccttttcccggtagcgacgaatcaaaagcaatgctcatgttgggttattcattaaatactgtagatgttagatctatccaaaatccacaatatattaggatgttagccattctgcattcgaaaaaatacatcttaccaaaaactgcatacaatatttggagagattctgtactgtcaataggaattgaaattttaccaccattcactccaagtctcacacctggaattattgcaaggccggagaaagatatagttgacttaaaattaaattgcggaagcaataacgaggatgttgacgcacttgcgcttgaattattaagtgtttcgcatgaaaacaatttaacaaatctaaggttttatcaattttgtaagccatctgaatctcttgttggtgttaggagtgaggatttctattcatcatgtatcgaggcattaaagcatataccagaacttgatattcatacaaacaaaattacaggaaaatacttggcaattccactttacaaaatttcaaaactatgtcaagatactcccagatgggagtcaacttcatcaggtctgtcttatgcttctttaataattcaggataatttgaggaagaaagacgagtttaataaaacaatgaaaccttattcaaaattaagtatgttaacagacagagatatacactcatatgtaataaagacagcagccagatctgctctagagcgttcagctgcatctgaacaaatttgtaaacagttaaaaccagtatattctgaagaagataatagtttccagttcaatacccaaatagatccagataatcttcaaaacattgcaaatatattgtttaggaaagcagtatcgctattagacgaagataaacaacttgccctttctctgtctggaaatatagtaaaagggtcgaacccagtcacattcgaatcattctgctcccttgtgcttgctctctcaaaagttgaaaaaaagtatttcaattctgaatgcgccagaaatctgagattgatgttcagacaaaaggtgattattaatggaaatgtaagacttgcgacaattaaaactagaaccattaccaaaatatgtatgtcttcaccactgtttgaaaaatgtggaaattacaaaaataatgagatagatgaaatatcgtatgatctattgctgggtgcccaaaaactaagatttacttcaattacttatcgtcatatatgcagtgtcgtgaagaacataaggagaggagaaattaagggtttaattcccaaggggcaaacaaataatacaaatattagtagcttttttaatagcgattgtatttatgggttaagaacgctttcgatcggtgctagacatgctgaaataatatgcagtgcaacaaggttttgggttatgtgtgggagctatatggactcagaagttgatgcactggcatcacaaatatactctgaggttgttcaaaatactggccttgcaaggttcataacagtatcgttatttgagttggtggacttttgcccaattgctgaagctctattacatgaagtggatttaaggtttttcaatcgtgaatgtgtaaatgcgctcgcagctatgtcgataagtaaggaatatggaatgtcaatttgtcaaagttcaagacattggcagggtacatgtattggaactttagatgaacattcatcaataattgaacagatagatccaattgcaggtgcactatacaaatcctcacaagatttgggatacttggatattttatttagcgacttttgcgattctgcaaaagagctattttctatcaaagaagttacagaaacaggaaaagttttggaaggtcatgaaacatcaatgtttcatactgactgtccaaaaatagtcagtaatatgctacattcattatcagaagaacattcaattggggtaagaaagttcaaaataaatagtaggaccatcagatctatttcttctgaaaacttcgagaaggccgaaatgatttgtcagaacttctttaattattttgaccctaactatggtgcatctcaagtagaggaatacgatgaagcagactttaggagaaatgaaatagaaaggtttagtgtgagaaatcctggggaaaatgtcaaccccaatactgttttctttcaaggcaagtcatataaccaaagaatggctggaaataactattatggtaggcactatagatacaattgggctaatttactgggccaaaaattctttatacctggcaacagaattaatgacgaatttcgtgaagaaattcttgaaaataataatcgaggagaaagacacaaaggtttagaatatctaccctatggaacaaatcttgaacagattcaaaatactgtatataagggaaaggactacaattcagggacctga

SEQ ID NO: 2020 - DNA, 666 bp, Cryptosporidium hominis
atgcagaagagtttgttgtttttaacattcttgtacttactttgctcaatttttgttggaagctctcactcagaagaagttcctgcccctagcaattcgactgaattggtatcaagtgaagatccagtttctgatactcaagaacaaacatctactaatgaaactgttgtagaagccgtagtggaaactagcccacaatccacgaatccatttgctgagagaactttggtgctattcaaaccagaagttactcatagaggtctcattggagagatcctctcccaaatcgagcgcaaaggctttaagattgttgcaatgaaatttttggttgctactgctcagcagatcgaagctcattattccgatcatgcaggaaagccgttttttgaaagtttggtttctagaacaaccaatcaaccaattgttgcaatggtgcttgaaggtttgaacgtaataacagagttccgtagatttatgggttctacagatccaaagaaatcagagatggggaccttacgggcacaatttggaatgcaaactgagagaaatcttattcacgcatccgattcagttgataatgccaatcttgaaatcttcctctggttcagcccagatgaaatttactcatatcaaagagcaatagaccagtttgtgtattttgagtag

SEQ ID NO: 2021 - DNA, 2154 bp, Cryptosporidium hominis
atgaaaaataatgtgaggatactattattaactacatgcattaaatttttattatctatttatcttggagaatctttaaaagtactacctacaaataccaccgatgaaagagatacttcaaaaaaaagttctactctattgctcctatatgatgttgacaatgtcatcctaaaacatgtgagcccaggaaaaacctatattaatccggaaatagtgccattgcttgtatccatgtacaatttacgtaaatcgaatgatcccagaatacttttacctaggattttttcccatggatgcggtactgcagcaaaactttccgaaagcaaattagccaagccaagaatatttgattccaaccagagcttagataacaattatgattttcatagcttttcaaccaaaatctatgatattggagatgcatacttatttaatgaagtttattaccttaaaaaatatggacagtcagaaactattcaccatccaatcgatatatttaaaatcttttttgcagatgaaaatgaattggagacagggatcccatctattatcccattcaatcgggttttagagagaaaatcaatatactttgatagtataacttcagggcttaatagccaagaatcattattttttaaaaagtatatccaaaaggccaaaagaacaatcgagggacggcctttccttttagatttcattcataatggtatggatgaagcacagggaaaaacttttttaaaaaaactattcacaaaaatttcttctttccccaaagtttggccacttcatctaagaagtgaagaactaccttttatcaaagaccttgttaaatatcgtagttatataaatgggaagattcaattcgggactactatcttgctacttgatgatttggtagctcactttaattttgggtgtgttcatgaacactttactgaagaatacaaagtattcataattgttatcaaaaaattcattccaaatagcgaccaagaaaatttatcacgcgaatttcaaaaatcaatccccgttcctattggtacaactccatacagcccatttgatatcagagaagtaaatgtaaaaatgaataaaatacttcaacactttccagttgatactcatccagatcatttctatagagagattcgaaatgagtttgtttatgatagccctacttaccctaaatgtggctatgatatttcgaagccctttccgttttattttttagtcatagtggagtgtgatatcttgtacaatttaataaaactatttatagatgatcggatggcagaagaagttacgtatttattaaatatagcgtcatatattgcagtgattactggtagaaaatcctgcgaatatgcattttcaatggttaaacatctcattacatcaggatttcatcagtggtccgataaaatcatgccacttgcaatgataaaaggaagaaatacagatgatagcagcgaattctcaccaccattttctcaatatcgaaaaaaaagcattaaagactccattcagaattcaaaccaggacagacacattttcatgtcaaaactctattccaggatgccaagaagtagaacgatggtcctaagacttgattatcacggagatccaagtgcaattcagtattctgattatacgtgtttcctgaatgcacctcctaatagaaaagagctcatcaactttccatcaaaatctaccaaatataggcaactactaaaccttcaatctgactctaagctatcaaagttttttggagtaccgccaaatggggagataaagaccatcatcatactccagaaactaataacagtattcaataaggtggatggcgtgttggaatcaaccatgaaagcattaaggaatacggcaggtaacgcagaaaatagctaccagcctccaaacgccatacaattcgacgaagagtacgtaaaccccacagatgaaggtatagatgcagaggacattcttacacagattactccaccaaagacaagtgggcacagacacccagcgcccgcgccccctaccgtatacccccaggcctcgtattcattcctgtcaattttttatactatcgtagaagctttaaaagaccaattcccaaaagaatataagttctgtgtaggctcagtaaactaa

SEQ ID NO: 2022 - DNA, 1149 bp, Cryptosporidium hominis
atggaatttgctaaatttgtgtttttgtgttactgtattttgggaacgaatagagtttttggagcaaatgatctctcaaacttcatagaatccccaaatattcttgatagtcgcactttcggtttgtatgagcaaaataaaaacgaataccaaagtacaatattgagttcagaagcaagtagtagttttattaatagtggcttactaaacagcattgaagatagcataaatataaaccaagaaacgaatgagcgttcaaactttaatcttacagatcctccacactacgatggtagttcagagttaagtgaaaatctagttacattttcaaatttattgatctcgccaataatgggtaaaagcacagcgatattgggagaactatcatttaaatactctcttgatggaatcagaagtgggatcattgattctgaaaatcattattcacctgcaaatctagttaataaactcttcggccccaatggtacaaaaaataatgcaataggattattaagatatggatttttatatgcattaataaacgaaattaataatcaatttcagaagaaaataggctttaagctcaaattacatccgaagttactaattgacccactaaagtatgatgagtgtgtaaacctctttacagaagcaaatatacacgatactcctttcttaacccaaaaaaatagcaagggaatatttgaaataatctgcaaaaacgtaataaaaaataattattttattgaaatgcaatcttgggatcatcatatatcacaaattattagttttattaaagaaaaaattcaatccatacggagaaattcagatattctaccaaaaacaattcagataactgatctacctaaagttcctgaaattaaagtaagcggtacagaaatcaaaattaggtatttgaacattgtgaaaagtattgatacaattaagaaaaaagagtatccattgttcaacagccttattttcaccaagaagatggcggtaaagatctcaacccaatatttaccaaacggaagagagttagttcaaaaatgtatagaaataataaaatctgagaatcctgcgctaatgagggaagtttatcaaagagagaaaatagaacagatatgtaaaatatcaatgggcagttaa

SEQ ID NO: 2023 - DNA, 4809 bp, Cryptosporidium hominis
atgaagattacgttccttgttttatttttcggttgcgtttttgtgtcggtctattctggtgaagaaaaaacatttgataacacaaaaacgcaatgggatttcatattatctgcaataaagtcgtgcctaaatattaaatgtaaaaatttaccaaacgaagtacctggtggattttattcacatggtgaaactaaattcgttcctgaaacgaatgagaagattagaattatgacagaaaattgtgttggagcactttcaagcctacttgagctccatttacctagaaaccaaagaaaatattcatttaaattttcagacatcaatggagtagataaaacattgaaatcattttgcagcgatactgcaagtaagtacttcaatttttctggttttattcagtcaattaaaacagaaaacccgattggaactaaaagaatgagtgggaggggggcagatcgaagtttattaaattcaagtgaagattcattcagtaagtgcgaaggtataaataatcaaattcctttgcaaaaaaaaaaaattttttttcaaggaaagacaacaaaggaaaagaaatgcagtgcagaccaattgggtttttcaaaaactccatccgaactcacaactgagggattggagtatagtgcgtctgaatatgaacaatttgaaagtgaaagcactccaatttccaaatataaaactccaaaagttttaaccacaatattgaaatcagttttagatgaaaataaggaggatttaccagcattagaaataacaatttctcaacttcctaaacaggtacaaaacagagtccttacgttctttagatcaaaagacgtggatggaattgttgaaattttaaataaattgcctagacaaattgtggagtcattcataaatagtatagaacttgagaaaaaacaaataaaatttcaactaggatcaaattctgaacaattggaatattccattcctttgtttgaggatgaatggagggcaattattgattttatgagtgacccatcatcacctattcagtatgaaaaaaagacaaatccttacgagcaaattaaaattccaaaagagttcaagtatagtaatggaattttaaaaaaatttattcagtattgtagaagaggaattaggagtttagcatatgaaaggtatatttccgaggacggcgtaacttattatagttataatgaaaataatttgaatggaatattaattgcaggaaatgattctgatcatagaaaagaacaagttgaagctttttgttatatggttttcgagaaattgtacgggaagaaagaaaaagaaatgatgaataaaagacatttaaaagcattagaaataaagaaatcatgggaggatggcggagtaaagggggcagtaatagaccaactgctaaaaggtttctctgatgaaatcaatgatgaaagattgcaatggctatttttggtagaaagcgctagcattcctaatcctctagtttacagcactgagttaccaaaacatacaataccgatctcttttacaagcaaacctacagatgctgcaactgaaattacagggaagatcagatcatttgtatacaattgtagaagtgctctgatgacattaggagtagaaaagttcccgggaacaaagtcacccctcaacaaagtacatctgggtgttgataaagttcaagggttaataaaattttgtaaatcagtcgcacatagatatatgggaagacttgttgaatggtttaacataattcaagcctctttagatgatgacatcattaaattaattgatatgaagaatcctgaatttcgctgcccagattattatgaatatgaagacgaatcaaagctagcggataactgttcaaaaaccatattaatgatgataaatgaaaacaaaaaagcagaagaaaataggagagccaaagtttggaaaggattaaagataaattctcaaccaaacaatgtaaatcatcaaatacgcttattttgtaattccgttgcaaatgaaagacccgaaattaggatagcatcagttgatgaactttcagagcagggaattggaggtgaacttagttcagttgaggaaatacaaggttataaaaaggagcaacaggcattagaaatcgtagaagaaagattaaagacaattgagagcaagcaaatagaagaaaaagctaactctgcatataaactagataaatggaatcagcttcaggattacatggttgaaaatcggagaattagagaaaaacttgacaaatactccaggagacagtttcagaagttatttgaaatagaggatgcacaaaaggacttattattatcattgttgagtgaagatataattaatgagaaaaaaagggagaatattagagatcttatagataaatactcttctgatctattatcaatgagaacagaatgggctgatttgttatttcagataagtaataataatagaaaaattacagaagcggaaatagaaattatgaattttgttcatcaagctttagattatatcgcaatttcacatagaattgaacttgtaaattcatcaacaatggcgaatatgatacattgggaagagacacttatagaaaaagaaagagcatatataaactctaagatgttggaatatagtagtcgtctagactctgatcaaaaaattcaaaaactaaaagatatacattataaacgacggcagttatttgaaaaaaacttatatagaattcttccccgtaagctctggaacagaatacatagcttagctgctaagggtcttcatcctttgatacttacaaaaatcagtgaaaaagaattaaaggaaagaaagagtttaatagttaagcttcatgaagagaaaaataatataattgcaaaatatgattctgaaggtcaaaaattggcgagacaactgattgttatagagaaggttgttgataaacgacttgcagatttaaatgaaatgtgggatagtacctactcgattgaatattcaattcaatgggagctaagaataaaggatatgcaagacacttatctatatttaaacaatgaatataataaaaatgcagaatttattgcaagacaacagcttcgccaatctcagcttcaaataggtaatcctcagtatcaacagttattaagtgaaacaaatcagtcaatagagattgctactgatgaaatgaaaaatttattgaaattaatgaacgacctgaggcagaaaagaaatgaactagatacacttgttgaatcagatttatcaagaaattatgcggaaaaaataaatactctaaggagaaattcaaaattattagaggacaatataagcaacgatattagtattttgcagaaaaaaaatgaaatttctcaattacaacttaatagggacataaagtattttgagattacaaatatgagatcagctctttctgaaaggcagaaaaagagcgaggggctcattgaggcaaatatgtggctaaataccaagaatgagcaattattttctgactatgaatctaagttaaatgacgatttgagttctttgacatactcatttgaaaagcctgaaaaacatggaacatatttagcttcagaagaaattccaaacgaagcattatcggagcttaataaatataaagagcaactcaagattagtttatttaacgtaatgttctataatgagaacataagtgataatgacatgcaacatataagtcaatttgaatcaatggattcaaatatattggcttataaagagatatttgaatcagaaggtgaaatagatgatggaacattgtatggtgaattgagtactctggagtggaatatcattcaatctagatgggagctacttaagatgaaacatttttatatagaaaaaaaagaaaaaatactgatggagtgcgcagaaatgagaaactccttagacgaattaatgctgcaaaagtatgggatgatacctattacgaagtcaaaaaatgttcctaacaaagcaagcattttggctatgaaaggaataggtattaatctaagcgatgagctgggagtttctgatgagaacaataaccttagctatgatagtaaagttcttaaacttgtgcaaaaaagactcgaagatgcaaactcagtattcgaacaagagctttcgaatagattgagtattctagatgaaaaaataagagaagggagaataagattacatgaagccgcaagagaagttgtctcaaattgggagttacaacagttaacagcttcatttagatttgcttctcctcaaaataaagacagaatgagagaagcatttgtaagagagcgtgataaggtgacaaaagatgaaattaaaaaaacgataccgttaaaactagaaaaacatatattgcttcagcaacaaaaggatcgtgcgttacaattcaaacgtgacatagattggatacatacgcctggaagggtagcgagccaattaatgaaatttgaacaaaaaattagaattttccagaaaaaaagacatgatcactatgagcggaccttgaggtttcttacatttcaagcagagcaagtcgatcgaatcaaacaaatcgatgaagaactgaatgccgatgaaacaaatagttcaaggtccaatggacttggtattccacaaatcaatattcaagaactaaggagagaaagagacaaactggaatcagatcttgctcaaaaaaggagagagtatcaactgcaactttctagttttcaaaatgaaagagatgcactttacgacgtgtcaaaaaaccttaaagatgaagaaaatagttag

SEQ ID NO: 2024 - DNA, 2208 bp, Cryptosporidium hominis
atgattaatatgtttaaaattccaaaaaaagtgaatgatctacagataattgaaagttgtgaatttgatattgattctcttttgttcaagttagaggataacccaacgagtgtcattaaccattttgaatacagctccccaacagaaattgctctaaaaatttcattccactcaagttatacaagagaactttattatacatcattactttctaaacagaattttccattgatacctgtaaagacatatggtcgtggaaaaataagaattactcctaggacttactgtttacaaattgaaaaaaatatcgtgcttaatagaatactaattactgaaaaaataaatggtgttacaatgcaagtattagtaagatggctaacttcaatcgattatctcaattggatttcctcagctaaaacaattaaagaattacaaaaaaggctagataatcgtgccgaaattatttggatactagttcattcatttttttcgaccctaacatcattatacatacattcagattttggttatattcttcattgtgatttaaatactggtaatattcaggttgctaatacaaagttcaatttgaagggctcaaactatcaagaaaatgttgattctctacttaaagttacgccaaataatataaaaatactcgactttggaactacaagaagtactttggaaatgagcgtgcgttcattaaaatgtaacgttcctaatgatatttggagaattaaattaattatttctaggctttttaagattgatagtacaactcatccaaacttattcggttggacaattgacttccaaaagaataactctgatttgaattatataaaaagaagtcgaatattaaatcacataaactctttggaccttttcagggaagaacttttgaataacaatgactttaaaaatgctatggaacttaatagcacttttgagtcaatcatagacggtttagattccatttgcgatattactgtcaatcatatttcaaaatttaaggaattcgcaacaaacatcgtcaacaatgaacgattttatgcttcgtgtagccctcttgatccaagcaatgctaggggtatgccaattaaattattcaaaccagagatacttggccaacttcaaataccattatttcctgacaaatctgccatgattaagaaaacaattagggaggagaggaaaaaggcactaaaccaaaaaagcaataaaagcaacgaaagtaataataaagttaaggattctcaagataacttagatcagccaaataagggaattttagatgcgaatattaaagaaaaaaacgcagtgcaaggtggtgtttcaccaggaggaatacatggtattggagttggaagcacaagtaattctaaaattccaattaaagatttacaatacattaaaaataacaaggcagctaggccagatacaaatattgttgcaagcagcattggagtagttgttgaagcgaacgcagacgggaataatcaatttgagatgcctaaaatgatccaaaactttgaattggaacaggaaaaaatatcaaaaatatcttctttaaaacaagtttgtaattacgttgagcaatcaaaatcaagagatgcgaggaagctactcaacaaattaaagatgaaaaactctgtccttagagacattaccatggatattgaccattttgtaaaaagagcagataaaatattgttagaaataaccgaaaatattaagaaaaaaccccaaaaggtaacatctgatcaagacaggttaaagatgtttgaagtaagccgttcaaaattaagatatattgcaaagtcgtgcccagttacactaagtaaaattaacgaggaaaatagcgaagcagcagaaaaggttaacattggtattgttgcatttgaaaatgaaagacaaagaattttaaaaagatgtaatgatttaagaaattttattccaaggaatgaaaacgatactgtaaaggcaaaaatgaaaacaaaagaaataattgaaagaggtaaaacattacttcaatatagatttcatataaatgactcaatgaagtgcgcatttgattttttgtttagaggtattaggagagttcaacgcctagtagagttatctcaagaatcaatgaagggcgatttattattggaagagaatttagaactattattagataagatagcagagtacaaagtttaa

SEQ ID NO: 2025 - DNA, 633 bp, Cryptosporidium hominis
atggtttcaaaacagtttaaaaggttactcgaagaaaaaaaagaattggaactaaacactgaaggtttgaataatgactcatttgatcatttctccaattttagttgcggaaattcctttaacgcactagtttctcacgacgacgaagttgttttaagtgatgattatgttcaacctaaaaaaaatctgactcaagaaaatgtagaatattacaaaaaacaaaaaaaaaaaaacgagaagaagagggaaaagaaaaaactagtcaatgaacgttttgaatcatctgttccaaataacgattctagatgctgtttaattatgaacaaaaaatattttaattgtgaaaatgaaatttgctcgatatttggaaatgaagcagttaaattcgagaagaaaactaattcgagaaattttaacccaaaaaacagtcatttaaacattagacattatttcatttcatgcgattcgcaatggccgcatttaaatcgagaggaatctggactaatcatgaagtttattgaaaaaaaaaatgaattctcaatatcatttgatattgaatatatcaaaaataaagaaatattggatattttgattgattcgatgcttgtggatgaaatttatatctttatggaa

SEQ ID NO: 2026 - DNA, 1017 bp, Cryptosporidium hominis
atgatgaaacgaaaatttccacataattttcaaactgggcaaattgataatatagtaaaaaacagtggcaaaactaaggctagaagtaattattcaaatgttaatggcaattcttctccttatcaatatttaccaaaaatagatagaaataaaagtactcattgctacttaaacagtagttcaacgttaccgaataatttgaattccaaaaatactaagaaggttgaaaatacgacaaaaaaactttcgaacagtttatatcagaaaatacaaaatgaaaatcaatcaaaaaggccaattgattcaaaaaaagaaaaaaacgaaagcggatattcttctacaaaaattaatccccaacaatgccaagaatatttgaataaaaaggaaattaactcaagtacaggtcaattagatgagaggaaaaaaatcgtcggcttgaaaaagagtcatgttgaagtgggcaagaatgctttttcagttgaagaaagcattactgtaggaattaaaatgcaattaatttatagcttactttgcaaatctgagtttcaatctttaactcaattaatatttcatttactaagtgaaaagcctgttggattagttaataaaacagataaatcaaagtgtatactttttcttgactatttaattttaagaacgaaaaaattgagttacatagtcgactcgttaattcaagataggtcaatacttttaaaagcattggaaaaagataaacaagatcttagattatttataaaaaatatcaaaaacactatctatgaaaaaattgtagactcaaaaaatattcaatctttctggcacaaatgtgatgttctttctgaagagttaaatttgataaagaataagaagaatattcaaaacgagatagaagaagaatatgagagttacaacgagataaagtctttaacaaaggagaaaagaataaatttaaacggaaaaaaaaaatcaatttatgacatttgtttattattatctagattaatttctaaatattga

SEQ ID NO: 2027 - DNA, 687 bp, Cryptosporidium hominis
atggtttttttttcgaaaaaacatctgtacccattttcctgggaaaatgtagtaaatgcattttggaataagtatcctaatgatcttcaatctcacgtcagaagagtagacattgttaatatttatttcgatgaaaaagataaaatattatatacaaaaagattattttcccttaaatataatttaccaaaacttttagagcgaattattggaagtagcttaagtgggcttgcaattgaagagtcaaagtgtgacttcaatgaaaaaagacttatttctaatggagctaatcactcattcaataatttctttttaatccgggaaacttgtggtttttcatcgaataatgaatgcccagaatcaacattgtatatgcaaaatatggcatttaaattatttggggaaaaaaataagttcaaccgcatgaacaagttatttgaaaatacaatagtgaatttacttaatgaaaagtcacaaagtggtattaaggcaatgtataataaaattgatcaaattaaatcaatgttgaataataaatatgagataaaaggaagtgaaaataaatcaactagttataaacttaatggtttatctaaaacctttgaaaaaaaatgtttaaagttttttgaaaaaatcaataaaatactgttagtaccctacaaagttattttccataataaaaattga

SEQ ID NO: 2028 - DNA, 1056 bp, Cryptosporidium hominis
atggcaaacgcattattgagtattgaagagcttactagatttcggactaagttatgtcgtagaagtcttagggaaggttgcgatttcggcccattaagatgccaatattctcataatgtttactggccaagaagatgcccattttacttatccgaccgatctgcattaagatacctacctgatatttgcccagatattacaattttagataatgaaactggaaaagttgcaaacttttgcaacaggggagggtattgtccatattctcattcgatggaagaagtgatttaccatccattaatttataagtcagaattatgcacagcatttcaaaaaggcgaatgcaaaacttactactgtcatttaattcatggacttgcagaaagaaggcaggagagaatatatacgcttcctttcacgagaggaattaatttaaacaaatatcctaatgtaaaattagttgaaaaaacaacttctgaatgtgaaaacacagctaaaagctcaatgttttctagcaataaaaatggcgaaattactcatttggaaataatcacatcgcatgacagaaacaatggggtaaccaaacaaaaaagtttggaatgcatacatgattctgaaaatacgaaaaactttttaattcaacctcaattagaaaacgaacctttgcttgggaagggttttaatattaataaatcaaatttacgttgggaagaatctaataatttatcttgtttttctaataatatggatcttgaccctagcacagaaattaaacatttattgaataaatggaggaaagttgcagaatatccagaattatacattagtgaaataaacttggcaagattggagtattggcaatatattaatagttatcttcatgagatctcaagcatcattcacgagcttggaaaagtttattgcaataaaacgatttatcataaagaaagtttgcataatttaggtaggggtcagattaataacatcgaatttaaagaatgtattgaattttcttctgtttttgctgaagcgaattccgactcatttttaccttaa

SEQ ID NO: 2029 - DNA, 534 bp, Cryptosporidium hominis
atggcacttttttcttctaatttaatggacttaattagttcgcttccatccataaatttagaaaaaattaatatattcattgatcatttggcaggatttttcagctgtacaaaatccatatttaacaggacgataaatcgatcaattgattttataagaaagcattgtttctcaaactgtgccgaactatattcaaaattcgtgacaaattttaaaaatctgggatgtttgctttcttcaattaccagaaaatttactgaagcgtccaaaaatattagcaacaagctccaaactttacttgaaaatattagtaggctaagcaaagatacaattgaaaaaactaatctttgcggtaaagaattgtgtgtctttggaaaagaaatattcattaaagtcaaatcagccatattggctataaaagaaggatcggcaggtaagttttcagaagtatatttggaacaatttaccttttttaggtttcaacttagagactatcccgctattaccaaagtagtatgcaaactagtctgttaa

SEQ ID NO: 2030 - DNA, 312 bp, Cryptosporidium hominis
  misc_feature (50)..(50): n is a, c, g, or t
atgtgcatgcattcctttttattttcattttcaaataaattgataggtanttattttgtgcagatagcaaagatgttttttaaagagaaatctgtaaaagaagtcccaactgctccggctagtccttcgatattaccgttgagagatgctaatctccctgaaaccgtaataaaggaagtcagcaaaatattatattttggctttggaggttttttaaccacttcaataatttcgcttgcagtgcttcaggttaatacaaatgcagtttgtgatcgggtaagttctaataaagagtttaatcggcaattttaa

SEQ ID NO: 2031 - DNA, 1191 bp, Cryptosporidium hominis
atgttatttcatcattttgcatataggtttttttcagaaaaaaaaattgtatggtcccctatcatgtttacgattatgcagccaagtttaaatatgcaaaatttagattctgatgagctaacccacgattggaatactatttgttttcaattatttaagaattcagaagatctaagtttagatatttttcctaatactgagttcaatttagattcaaccttttattttgaaataattattaatatatttgggccactatatgaagaatctattaaggataaagttaaaaaaagaaaaaattggagcgaattaatttcaaaaagcaatatagtggtttctaatacaaatatttctattaaatgcttggaaaaatcattttatactcctgctttattcgatttaaaaacaaataagctgtatgttaagcatcaaaataaattaggtggtgatgagattgaagaggcacttttatctatcctcacatttattacttctttctttccaaaatattatcccaacttaaaaagcatcatggtaacaaaacttatattcaaagatgcaattaagaaattcgaatcttcgagaaatgaaatggcttgggataaatttataattaattggattaagaagatagaaatagaaattggaattaaaattgatctaaagtattttctattatctgattatgtggataatgttgctcttgaattgagcaatgatgttcaattaaacgaagaacttcaaatagaatataatactaactgtccaaaaaagattattttagaaataggtaagatgggagaaaaactagcctttgattccttgaaagaaaagtttagtaacgagcttggaattgattatttcaatataacttgggttaatgaaacagcagaatcgggtcttccttacgacattattttagttttcatggataaaacaagaggaacaaaggaggaaatattcgttgaagttaaatcatcatcaaaaaaagaaaagaacttctttcgtatttctttcaatgaatggaagctcgcagaaagattgcagaataattattggttgtttcacattctaggcgttaatcttaatgcaccaaatttaagtttaaatgacattgaatttagaataatcagaaatccgtatgaatcttggaaggatggacgcctaaaaatgatattatcagaaaattaa

SEQ ID NO: 2032 - DNA, 822 bp, Cryptosporidium hominis
atgcaagaaactgattacaagttggtgaatggaactcatagtctcttgacaacttactttctcgtctcgactgttgctgtaattttttctagcgtggtccggtttgctaatttggtcacgactcacggtaaacttcgcaagaagaatttagcctcagaaaatattggaaatacctcatctgacaaggtaatttatttaatattggggttgagcgtgaacaaagggtggtttcgttatttctatctagttggcgtattcacaacatcaatttgcgtatatttaagctatccaaattgctacagactacttttttttttaatacatgtgattagaaggctatatgaagaagtctttatttcatatcataacacaaattatagtagaatgagtatttttgtatttttatttggtatatcatactatattataatgcctataacattattggctacccaagatttctatgggaagtttgtagttttgcaatatatatctttcgcagccttttctttagttcagcataaaagtcatgttaaactttcaaacattaggagagcaaattccgaggagtatggtattccttatggtggtatgtttaaatttgttagttgcccacactatttcagcgagattggaatatatctatcattattttttgatgctatttttaattcaaataatttgcatattgcgaccgctctattatatattattagttgtatgtatgtaaatgcaatacgtgcacataaatggtatattaactattacaaggagtcatacctatctctaaatcgcaaagcaattattccatatattgtttaa

SEQ ID NO: 2033 - DNA, 765 bp, Cryptosporidium hominis
atgccagaggcaaaaaaacggggaagaaaaccaatttttcgaaaaatggaggaggataattctgagccacaaacattccaagttgaagaaggcaatagccaaacccaacatgaattggaacaggctgagccaattcaagaagctacaaatgcggagtcagatgagaagaaccaagtagcccctcagattgaacgaagtaatgatccttcatgtacactttatgtttgcaggctttctttaaaaacaaaagaagatgacttacgccggctatttgaggattatggtgaagtaactgattgtcatttagttacaaatccattatctggtgaaagcaggtgttttgggttcgtaactatgggtaacgaggaggaagcggcgcgtgcaaaagatgcactggatgggaaagaatatcaagatgcaagtttgaaggttgagacagcaagacgcgctaagccatatgatcccaccccaggagaatataaagggccccaatatcgatcaattaaatataattcaagaactgggtattattctcgttcttcacatcgtggcaattcatttagacattctactaggagtagatatgactatccacccccatctcattcgaggggtgatcaatacaatagacacaatgatgactattacaacagatactatgatagcagatatcctagaccggatgattatcactcctctaggtaccactccccgccacgttattctagagcagatccgtacgactcaagatatagcagacgataa

SEQ ID NO: 2034 - DNA, 942 bp, Cryptosporidium hominis
atggaaaatgatatttgggaatatatttttaataaaatgaatatttctccaaaggatattggtttattaatcaccgagccatttctaaatccatcctcacttcagcattctcttttcgaaataatctttgagcaatttggttttaataaggcaatagttacaaatcctcctgcaatatcacagtttgcattcaatccacagctaattcccaatactgagcagcaaataataaatccttgttatttgattttagactgtggctatcagtgttgttttagtgtcccattttttcaaggctcaccaatttacaaagcttgtagaagattggatattggcggatatcacttggatcttgcattaaaaaattttctttcactcagacaagttgatttatctagaagctctttaattgtctcaaaaattaaagaaagttgctgctatatttctaaaaattttgatcttgatattagcaggtcgccaggaaatattcctgataatttagtggagcagatatatcaactccctgaattaaaatcaagcagtaagaattcaaacttctactcccaggagtgtatatctccagataatattgaacttgagaatttcaatttaaaaatggaatctgaatctagcgtgaattgcgaccccagcagaatcattaaactttattctgaaaggattgctgttccggaacttttatttagtccttcaaacggaggttataactttgcaggaattgccgacatggtatcagagtcaatcttatcatccccaaagcatctccaagagcttctagcaaataatatattgttaataggaggctctactaaattcagaaatttcgaggcgagattaaataaggagctttcctctctactaccttcggtaagtttaaaacttaaacactataattcaactaacttaaaaagtcatgggaaataa

SEQ ID NO: 2035 - DNA, 816 bp, Cryptosporidium hominis
atgctaacttactttttctctttgtttctaattgtattcctaggtagctttactttctgtgaacagctagggcataataacacatctatctttgctagttctcaaactgaagcagatgcaatagagatatttgaaaaattaacaagaaatataattgcagatgatttaaatacttcaatttcgagaggttggtggatactctcaaggaaattaattattaaaacgcatgagcagggtattgatttaagtccagttgttcgttctgccgaactctcaattagaagagagctaaatgaactaactagattattaaacaaaaaacatagtgagattgcaacattatcccctgcatttcaatgggcacaatcatctgatcaagtatatctgaacataaagtttacttacagatggaatgctccgggtgcattgaaaatagaaaatgaaactgtctcgattcgcgataatatattttttttttctgcaatgggatcgcattcacacgaaaaaaaaaaatatgttcttaaactcgagctattcgataatattgattcagatttatctgaatggtcatttggatctgttggaaagctatcctgcactctagttaagaaggagcctaataatatttggccaagattattgaaggaccaaaaactaaaaattccaaatatgcacgtttggtgggaaatgaaggaaaaacatgaaaatttgacagcaaattcaagcatatctaatggaacaaagacatcaaacattcttaataataccaacagcttcgaaaatgatgtaatctcaacagttagagaagaactttaa

SEQ ID NO: 2036 - DNA, 694 bp, Cryptosporidium hominis
atgttaatccggtacaacctttctgatttaatttttcaacatataaaaaatcttaatactttgaagcaagatcattcatcacctggtattgagattaaaaatattgataagtatattattcacgacattaataatttttttggtttcaaaaaaggtgtccagttattttcgaatcatgaaaataataaaatttcaattatcctgttaaagtttttgaatgaatattataaaatttgtagcaaatcattaatagagttagcaattcaagttatacgcattatgaacataaatatattgagaagcaaatatatatccattaatcatctctcagagattataattattgttttatctgtaattaatatttgcttggatatatttttctatatttttaattggaaatctataccaaaaataggcatggctatagaaatgatccatttgattttaacaactctatacttttatggcagtgagggcctaactaaagaattttttaatatttatgctcaacttttatattattcatatatttatcgtattattttcattcttcagtgcaaatttactaacaagtataataaatttcaagttacggaaattatcaggactcagctcaagcaaattttttattctattggcaatgatataagttcaatgatttcatcttccgaattcgaaaatatttgtgcaa

SEQ ID NO: 2037 - DNA, 621 bp, Cryptosporidium hominis
atggctgttaaaaaccattcagcagctgcggtagctgcgtctttaaaaatgaaaaagcaattaaaattaaaatctagatcttttggaaataactacattccagaaattaacattaagtgtggaattcatacagatcacgtcctaattgggaatattggatgcagtaaaagaatgaagtacggaattatgggtgatggagttaatttggccagtagaatcgaatctttaactaggcgttattctgcagacataataataagtaacaatgtcttcgtaaataaagaagtgcagaaaaggtttgtaatatgcccattagatgttgttgttgtgcaagggaaaagcaaccctacagtaatttatcatgtattgaatactgtaaatgattccgatccgatttcgcttttaaaatctaaatttcatactaaagcattgatatttttcattaacaaagattttaagagatccctattttacattgaaaaaattaataagttggaaccattcaaaaatgacttaagtactatcagtctttccaataagtgcaaacaattccaagatacaaaattagacttcaactggtcttgcgcagaagtattgaaaaaaaaatattttaatgaatga

SEQ ID NO: 2038 - DNA, 2802 bp, Cryptosporidium hominis
atgaatacaattcatccaactacatcttcacttagcaatggaattggcgatgatgaacaaaatatattagagctgccatacatgggcgaattattaaaatttggtgattctgggcttaaaaatggtcaaagttcaaatattttaagccaattttttgataatttttctgaagacgaatctgattctgagaacatgctttcacttgaattcagcacttcaaaatattcaaatgaaagaaaaagaaaaagagaattaagccatcgaaaaaaaactaagtcacaacaaaatatttcaactgaaatcgagaaattattgcaacgagctaatgatgcttatttagaaaaaaaattcatcttagcaatcgaaatactcgaagaaatcgttgtcaaagccccaggattacatgaccctttccatatgctggggcttatatatgaacaagaactagatgataaagaaaaggcaattggattttacttagttgctgctcacctagtaagcaccgatttttttttatggagaagaataggacaaatgagtgctgaaattcaagattggaacagagcaatatactgttactctaaatgtattaaaaacatagaatactctgagaatttaggtgggcaagaatcggctgcacaattagaagatgaaatacggtttgaacttagtaatgcatattattcagtaaatgatattaataggtgtatacaacagctaaaaatattattttggaggcaccctggcgacccacttttggggaaagagcttgctagatgctatcataaaattggaaagttgagcttagcagcggaaactcttgaaagctgtgtagattattgtgatgacataaatatcgttaatatgttatgcgaagtttatattgatttgaaattataccagaagtgtgtcgatctaattcacaattattttggaaaaatgaatactaaatcaaatgattttaattcaatatttaatcaaccaactcgacataatactaatgaaataattgataatcaatttttgaaaaacgttccaattgatattgcaaccaaatatgcagtggcaaatcttaattttggaaattacactcccgcactccaagtttctaaaattataaatgaatataacagcctagaagattttattgatttacatttgacattaggagatgcatattttcaaattggtaaatacgaaaatgcaaatatccattttgtaactgtatataattcaaaatcattcgaatctaatgttccttttaatattaaatatgcttattctcttcataaactcaatttaaatgaagatgcagcatcagtacttaaaaaattattagagaaaaataaagatgtttctggtgattttaatatttccagagcaaaaacgcttttagcctccatatattcgaaaatgggttacgatagtctaagcgaagagttgatctacacaatgaaatatgatgaaattatacagtctaaagatatatcaattccaattccgcaagaaatgagaataacaatcgtccttgatttgttttctgacatgaaaaaagaaattgcaaaaactacaaataatattgaaattcaaccatatttggagactgcaattaccacaaatatatactttgaacctgataacatttctatttatttatttgcagatcgatttgccaatgtaattaatgaatttataattgacataaagcgtataaaccaattgatatattcaaggaaatataatggaaataataaaaaaaatagtttagaatgcattgaaaaggatatatctagtacttccaactattctaaacattcaaatgaaacgtctacattaaatacaagtaaaaggctgcaaagagcaaatatccaattggcaaaagtaaggaatgagcttggtttaattacattagaaggtattttagcctctgaaagtgaattttggcattttctatcgctaggtgcaatttttctaaaatattcaaaaaaaaatagcattgctgtagaattatttgaaaagcttcttaacaaccttaagttgttatgccctgaaatgaacggagattcattaaatagaggaaaacactcattgcaaaaactactacttacattttcatttgaaggtggtatctggcgtgtactactcggacttttgagagaagaattcaacaagaaatccaataagaaaagtgtttgcaaagtgttaggcagcctaattttaatgccaaatttatttgcatcaaaattaaataaattaaataaccatttcattctcgaaaaagaaacgattggtgaaacaagatcgtggatacaaagacagattttaaattcgagagataatctagagcttcaaattattactgcccatctttacgttttttccaaccgtctaaaccaagcttcatccgaatacttaaaaatccacagattaattcctttcgatgatcttatttctctttgtcttggcgtttcattggtgggagtagcaacaagcaaagagtccaagaatcggatttttgcaataataaaagggttttcatttattatgagatattcaaaaggaaggcagagtatctatattaatgatgaaatttataaggcggaatgcctttataatctcggacgcgcattccatcaaattaatttgaaatcaaacgcaataaactgttacataaaatgtataaattccctaagctctatcactgatgttcgaagctatgattttatcaaacttaaaaaaatggcatgctacaatctatcgcttttatcaaaggcagatatatttggaggaatactctggtaa

SEQ ID NO: 2039 - DNA, 1128 bp, Cryptosporidium hominis
atgaaaatggcagagcaagttgatcaagaattaatgtacacaaaatttgtaagacttttattaggctcaaagactggtgtacgaactaaaggcgcaatcgaagttggaagaagagcagttgattattttcgtggtattgagtttatcaggtggatgagaaaaaatgaagatcatattaaagaaagttatccagaagttgtcaaaaatatctcttttgaatctattaatgatttgaatcaagttggaaccgagttgattagacgttcatttatcgtcagggcggaatataaaccggtgggaaccaacactggtgatttgaaaattcctaagtggccaaagagactttgcgtaacaagcaatcaaaattttgatgaacactcattctacattattactttcgatagtaataaaacaatgtcaaatattttaatgatatcaattttggtttcagttgtcgcgttattcatgttccctgcttggcctttggcaataaaaatatcggtttggtacatttccgtcgtatttttatcggcgatgttgattgtcttttttggaagattgatagtgttcgcttttctatggttctttggctttgatttttggatccttcctaatttatttgatgaagatactggagtaattgattcgtttaaaccactctattctataatcagaagaggagacgattggtttatgctgtctatacgagtgttctgtgcaatatttcttgcaggggcaatttatcagttaagtaagacgcacacagcatcagatgtaggacaattcgcaagacaatcatttttggatgtgctggattgggggcatagaaagatctctcctccggaagattttacacctacgttacataactcaaacatgggaagtaatgaacacattggagaaagaaatctttctaacgaggagcacatttgtattacgagatgtttgaggtttgaatctaaggatgcaatattagatgaatgcgcaacagattgtcactgcttaagcgaattactaagtctaccatgtctaaagtctagatcaatttgtccttctgaatttgaagaagagcttaataatgcaatggcaaaaaactgtcaaagtaatcaagaaaaaaatgagttataa

SEQ ID NO: 2040 - DNA, 897 bp, Cryptosporidium hominis
atgctcgttaaatcaatccttaaacaatctccttcactatttacatttattataatagttttaattaattgctacacaatttttaactttatagcttgtctcaaagtttatcaatcaagtttactttattacctttggagcggaatactagcttggtatactatcttgaccctcttgaccatttattcgtttgctatacttattattaaggacccaggctctttggaatcactaaaatgcgacaataatcctccgagcgagtttaagtctacaattagatactgtaataaatgctcaggaagaaaatggaaacccccgagagcgcatcattgtacaacgtgtaatatttgcattttcaaaatggaccatcattgcatgcttataaacaattgcattggatattctaatcaaaaaatttatattctttttttattttatttggcttgctcctcttctttaacgatagtctcgtcgttcttcctcttaactaagttaattacattttctttagagaatggaatcaaggaaatgagacacgctttaatcattaatttgataattcatatcataatttttttaactacgataatatttttatttgatcaaatagattatatttcttcaaattccactctcgtagaatcaataacaaataaacgtggtaagaaaataaaacttttcaacaactttaaaatgatattcggtgaaagcaagtacttgtggtttctacctttaagaaatataataaggcctaattttaacgaagaactatatgaaataattgaataccctaactatatgcacttttctgaaattagatttgcggacaacaatgaacaattaaaatctttttgtgagctttcaaaaataaacaaaaaaataccgaagagtagataa

SEQ ID NO: 2041 - DNA, 2367 bp, Cryptosporidium hominis
atgtgtgaatgtgtaataattattgccgcaagattcattttagtaaatatgggttcatccatttctaaagataaggatacttccttaccacaaaactacctaaagtttattgaaccatttttacaaaaagaaagtgttagaactaatttatctcttttgaatgagttacaaaagtcaattattactccaatcgaagataattcattcgcagatcaatttatatttgaacatatttcttcaaaactatttgtaagaaatgcaactagtggaaattttcgttctttaactctatttttcattgaaatattacttgaaaaagagagagaattatacatttctattgaaagcaatagatttcaatacgatcgtctaataactagtataaatcacttaattggtttgggtatagtaattaagtttataattatacactatttaaagaatttcggaatagatgaactaataaaatcagtagaacatacacaatatattaatttcgtcaatgattcgaattttacaagtgaccaattaagtgaactcgaaaaatttattttgtttaaatacaacgaagtagaaggaaacaatagtaacaaggttaacttaatcaaatatgtatctaagtcgtcgaaatttttaagagaaaatgagcatttattggcatcatttgaagatctttctgtatttgaacaaatttttttaaatataccttcattcctagtatgctctcaaaagtacattgatcaaagtaattcacttagcgagatttgcaatctattaattagccttcagaatactttaatggatattatgctagtattattcttgcccaatgttgaaaatcatgagcatatagataatggcgacatttacacatttattacatgctttcaagttcactcatcgataaaatctgtaaaattaatatattgtgaagacgattctgacttgcttcaagataataggtacctatttttgcaatatttaattaaaaaatctctcaattttgaacaaaaatgtcaattatttgaattaaataaaaaaaagtcaattatattgctttcaactattctttttaatccaccagaattaaaattcaatatatattcagaatggattaatcatttttctgatccaagatttattccagataaccttattttatcagattctaacacagactcagatgtggatgccaacaaaactgactttgtagattttccttactttgagcaagcctatcgttcggtaacttttaatggagttctcgtaaaacacaatctttttgtttttttcctatattctttggtgcattcaaactcttattttatttcctattgcttatcaagagctgacccagatgccttaatacttgctttattggaacccgtttatattatctcaaaagacatagatgaaactaatttatgccagctgattgctctgctctctattattctcagattaacaaatgatttaaatatgtccaaagctctgagctatacttatattgaaagcctcccactttggctagaggatgactctcttaaaaaagtgattcataaatgtagcagtaataaggaaaaaagtgggtttgaattgtcagaaaatcattcaatatctattggtaatattttaattgttgtattgctaagagcaatgttttataactacaaatttggtaaggatatttatttatgtagcattatttattctattattgaaaatatttcaatttacatgaaaaatttccattggcatgttgcagaaaaaattactcattatttaatttttttaagtagtcaaatatactgttcgctaaatacctataatggagatagatctaacttgagattctttaacagattctactgtggaattttaatgcataaatcattactcaaactaattattgaaagtttaaaagatgaaaatttgttatcaaatttcgaacttatctacattataattaagttttcattaattactgaaattcaaaagttaaatgtttttctcaaaagatgtattagtaacaatgaaatatctttttttaaatccaacctagagggcaaaatatccgctcctcctgtcgcagaaattcttaattcaattatagagttttatgagcccattaaaattacaattaactgttttgaaaatgagttaacaggcattgacggtattgtagcgacagaaaatattcgtaatatttttcaaactattcgaaatatcattctatcaaaaaagcactcgaatcaaatcttttgctacactagtaaacgtacagtatttcgacgagactactactctgaatttaaattctatttcaaaaccatttattctgaatactggataaatttccccaaatga

SEQ ID NO: 2042 - DNA, 2256 bp, Cryptosporidium hominis
atgcatcgtcataaaccaatattaaaacagtccaacaatttttttaaaggtaaatcgtccatacgcaagaaatcaagtcaaagacttagaaagtgtaatgaaagttcttttttaaagccactttctgggaaaaatagagaaaatcaaaaaaatcaactcagaaaaaataaaataatttctaataacttaaggaaagaggaaaaggcgtgtcagttaggaactccaatactatgcacaattattccgttcaactcttattgcgaccctatttcagttgtcaaagtattatctaattatatttatcttcattatcctggaaactctgaatctgagattcattttcaaaataactctaatagtgtattcacatttaatataggcaagcataaactatctatttgtattgcagaatataacaaaatttttgatacgttagacttaatcaaatgctcggattttatcatagccttattcgggtttaacgatgaatttcaagcattcgatgaaattggatataaattactaaaatcgataaaacttcaaggtcaaaccgataccatagggctttttttccataatgggagtcataatttcggcaataagattttagattgcgaaaaagtatttaagaaatcattcgaaatggaatttgagaagaatatgaaatttttctctctacagaaggaaaatgatattcgaaacttgttatcttcaattcctaatatgggttattcaaaaatatgtttaagagaaggaagaggctacatgctttcggaatcatctagcattgtagtaaataattattctaatgaagaaaaacgtcagctcgtcattagaggttttgtacgtggaataggattatccatgaactttcctgtccatataactaatattggtgatttcgttattgacgaaattcgtcccatagatgatcctctgtatagatcttctactcctccttccagccataatgaatttattcctagtggtttaaaaaacaatgaaattttagataaagaacttgttggaattattggaatggaaaattccatttctcttgatgatagctcacatgaaaacttcggtaaatatggtgagtctatgcacattgatactcctaataatttatctgctaatggtattgaacactatgaagacaatttagatttagaatcagaaattgacagtatgcacgaaattctgactgatgaatccgaagatgagtctgagatttcttctgatgaaaagagagttgaaatagaaactatttgccgtactcgttttaaaaaatatcgaggattagaatctctgagaacttccaactgggatccgtttgaaaatcttccaagtgaatattccaaaatatttgaaattgactcatttaaaaagacaggagaaatctccaggaaaatctatgttgataattgcaatcaagaaaattttaaaggtaaatattgcgagattaaattatcccctgtatcttcggaagcacaaagagcattaaaagataagaatgtttcaaatcgaataataattctatcatctattttaccttttgaaagaaaagttggggttatgaattttaggataaaaaggacagctgagaataatgatttaatcaagaataaaacaccattggttttacaagcagggtttaggagattttacatatgtcctatagtaagtaattgccctcgtatttcatctgcaactaaaatagaaaggactcagatactgaagcaatgcaaagtcttgttacatggagattattacattatttcatgctacagtacaatcgtttttcccccatgccctattttacttttttcacttcatgatataaactctaattatcaaaataaaattacttataaaaacttcaagcctggcaattttacattaaatgattggcctctcgcatggggtgatgtccttgatgcagacccatatcgtgttattgttaaaagaatagtgctagttggcaacctatttaaagtaagaaaatcgaaagctgttgtaagaaatatgtttaacaatcctgaagacgtcaagtggttcaaatctgttggattgagaactaggagtggcattagaggaataataagagagcctttgggcatgcatggatatatgaaatgcttattcagcagaccaatacagcaaaacgaagtagtaggaatgccattatataaacgagtattccctaagtggtttccaattacatggttcgaagataataacattagaattaattaa

SEQ ID NO: 2043 - DNA, 753 bp, Cryptosporidium hominis
atgaggagactacaatcattcaagacaccatcaaggttaaatgaaaagttaaagttctcaaacaagagcaataacattaacgatgctacgataaacaacggcaccaaatttgttccaaatataagtgcgttcgattctaacgaagttttaaataacagctctcaaacaaatgatatttcattgagaaatataaagtttgacgagaagtctgacctggaagaggttgaacggactaatagtttgcaaagctttgatttaccttcaataaaggttattaaaagatttgaagccttaaataaatcaggaaaacagattttaatttacgatcagtccaataatatttctgctgagccaataattgacaaccgaaccgtaggtgtctgcaatcatattgctgaatctaggatcgaaaatattcacagcaaattggaaggctggtctgtgtttcaattacccaaatatatgcctgaaagtaaaaaaaactgctacgagattagcaaaaattctattcctactttactacacgacactccctcaggttctattggtaagctaatatttaggcgagatggtaatatggatttatatttaaattcaagcaaagacgaagaatgtacctcgttcaaaatagactgtatatcgaaagacaattcagagcaatttattgctgcattttcaaaaataaatgaactaattaacctcgggaaatgtgattcattattaattgctacccctaaaatacaaaaatattag

SEQ ID NO: 2044 - DNA, 648 bp, Cryptosporidium hominis
atgcttttatctcaaaataataatagattacaacctattaacacccagttaaatgatgactcaaatttaattatttcagcccaaaaaaagttattaaatacttctcctgaagcgactaaggaaacgaataaaacttacgataacaactctgatgcaaaaaatagaatcaatcaatctaagaatgcgacagataaaagatcagaaaagcaagcagacttattacaaaatcaacacatcttcaaaaagtacactacaactacaactacaccaactaacgttataaataatgtctcaaactcaagtaaatcacaatacaacggaaccaatatcaattcattaaattcaactgaatctaatcctacttatataaaagataaatccgatcagcttgatgaagcgcctggaagctcaaatacaatgaatcaaactacaaatttaaataatgaaagatacattagttcaagtttaatactcacaaatggtacttctcaaggcaaattcgctttatcccccttaaatggtacggaagttgcgcctttattctctaagtttgttcctaacgaagatacttccgactccgtcaaatttggttattcttcaccgccctcattaaacaatgataaaaatagttctcaatctaatgagtga

SEQ ID NO: 2045 - DNA, 1962 bp, Cryptosporidium hominis
atgaattcaagtagtcagcttgaaagagatgtaccaacaaactctagtgaatttggcaaagccccagacactactggaggagctgtatttacaagcattaacattgcaaatagtaaacaaagcggcaatagcgatattctcaatgatgatcatgatgagattgtaccatgctcatattgtaatcaacctacttatgaagaatcttatatgttactttcctgtctgcatagatatcattactcctgcgttttaaataatattagcgctgttacacctagtggggattttatgatgtgcaaagtttgtggatttaaatcagctgttttgggtaaaactgggctcccagtagcccgtgacctaggtttaatatcttcaaaaaatagtctaggttccattccaaaggccccgtgttcaacttgccaatttagaacttctaccgtatattgtattgattgttgtgaaggattttgctcaaagtgcgtcagggagttccataatagtgtctctacactacagagccacgtaataagacaactcgacaccagtaatgatagcgaggcagttcagatcaattctgccattgaacttgttaaggctgcaaaagaagaaaagattttatcaggaataaatggtactgaaagcaatatgaatacaaaactgattcagaaaaaaaaaaaacaatcagcagaggaatattgtattgtacataaacaaacagaggcgaagtacttttgtttaacatgcgaacataattgtttttgcgaagtttgcgcaactgtaggtatgcaccgcgatcataaagttttaatggcgaatgaagcaatagactgcataagagatattttggggaagtttcaacattttgcaattaaacgtatttctgaactggattcagtacaagactcaacatctgaatggaagaaacaacagcaattatttcttgaagaagtaaaaccacagctcgaaactaactcatcccaagcctgccaaatattgaatgaaaacataagcaaatttaaaaatgagctactaaaggaatggtttgacaacgaggatattatattgaaggaaattaatgacgcaaagaaaaaacatgacgaaattaaacaactaattacctcattgcatgcttgtttggataaaaatgacgattatttcatgatgaatttccttcatgataagtataaggaagtttacatgtggctggacaaaccatttaatgaaagtgaattttccaactttacagatcctgtaatttgctatgaacgcatatataacatgacagatagaatgaatagagaaacagctaatttgatatcacaacagattgcattgaacaggttgagctgtatatttcaacccagaaagttccaatgtaactttgagagtgatatcattacctttgatgatgatggaattgcaattcctgtattatcaagtgaaaaaataagttactcaggaggaagtggtgttgatgaaaataattacagcgataaatccatcattaaaattagaggagaattgtttaatgacagtatttttagtaggaaaaagcaagacatccagattgagaagtcagtttcattggaaatcattcataaagaaggagaagaagacgaatttgaagataattcatacgatgctctttatgagaaaatggtatggctgcatccaagcaatcagtcaattaatgaagcccattcagagattaatgatgtggtaactgaagagataccatctagctctgaaaatgatatgaggtcctcgttagataacattacagaatttaccaaaaatacttataattataaagccttatccaacacattttttacggatttttcagaagacgaatcttttgtttcaaatctctgtattgatttgagaaatgaatgtattaatgtgctacccagatttgatgttttatattctagaaaaaacaacccatttatctgcaaataa

SEQ ID NO: 2046 - DNA, 1152 bp, Cryptosporidium hominis
atggttgaaaaaacatttcgtaagatttcagatgatacagatgagggaaagactatattcctaagaaatgtcccatttgaaatgtctgaattttctcttaaggaattgattgagggaaaatttggagaaacgctttatgtaaaaatcgttttttcaaagctaacccaattaccgaaaggggttgctttcgttaaattcaaaaatattgaatcagttgaaaaagttttagaaggagagaaggttgcagatagattttataatgactatatttttagatataagagaaagcctatttctgattctgggaattttagtgcgattattttacctccggaaattggtattcaatttaatggaagaagaatttttgcccgtttagctctgaatagaacagaaattgcaaatattgaaaatagcaaattatctgaaagttcagataagtttagtaaaaatttggatttgcttaaaaaaggattaattctacctggaatgaaagaagctgaaggtattagcaaccatgatttgaggctacgcgaaaattcatggaaagaaatgaaaattaaaatgaacaaccccaactatgaggtcaacaaatacaggctctgcattcgtaatattccaacaaaaataaagtcaagtgaattaaatgatattttaattcgagaaatttcaaagatgcgcgacattgaggttcagaatttgggacatgaaatagtttctgagtttgagaaatctgaaaattccaactttaaaaaaattttgatggcattgaggcgaaacattaactctcccaaaaagtgtaagctaatatttaaaaggttaataaacaaagtaaacatagttagagaaacttcatcaaaatcgagcaagtccagaggatttgcatttgtaaatactagttcattttctctctcgaaatcaattttggaaactttaaacaacaatccaaaaatatttacttcagaaaaaaggcctatagtagaatttgcaattgaagataaaagggcattgtttattcaaaaaaagagaatagaaaactttaaacggcgtgaaaagaagagcagcgagatatgtgatgaaaaaccacgtaaagcgtataatattagcaaagtaggccgagggagaaggcaacgaataaaaaatgctgcttag

SEQ ID NO: 2047 - DNA, 789 bp, Cryptosporidium hominis
atggataagaacggtatcgggactgatgctacaatgcacgagcacattgagaagatacaagtcagacaatatgttaagaaaaattcaaaatcattactttctccaacggcattaggagttgctttatataatggatttgaactaatttctagaaaaatggaatcaaagatagataaagctaaacttattggcgaaacaaagtcattttatttaaataatatactggcttggaacctaatgcattttaaaattagacaaataattgaaagaagtatcgagaaaataacttccggtgaatattctagaagttatgttgttgagcagatagctgggttcatgaaaaatatatacgaaaaaatgctcgaatttattagctatttggattcagcactaaatgcttattttcctaaatgggatgcaagcatcgtgatgattaatggaaagatggttagacaaaatatatctgaatgcggattttgcggctctagcataaatgtatacgaaattgaaaggagcttgaatgggcttccgcctattactgaagcagaaggtgatactatcattcgcatttctaaagatgcaaaattagcaatttgtaaaaatcaatcaaaaatagagtgtaataggcctttatttattccagattttaaatcaattaatattacaaatgaatactgtcaattttgtagattcaaaaagattaaaattgaaataaagaactcaaaaaaagttagcttatgcttatattgcttcagtaatctagaaaagtgcatatatgctaaatgctga

SEQ ID NO: 2048 - DNA, 1497 bp, Cryptosporidium hominis
atgcagaaaaaggataatactaatttgtttagttacaaaaaaattagaaggaggaagacttttaaaaaagaaaacaatggctgtaattacaagcccacaaaatttttaccaaatagctgtattagaggtgataggaaaacaattctatgcgttgcagaaaaaaattctgttgcaaaagaaattgctaatattctctgcccagaatttcaatcaccaaatagattgaagagtaaaagtacgacaaatgttgcgttatacttcccttataaattttgtggggaagagtgtaacatgatagttacatcagtaagaggccatttgaaacaactaggatttgcatcaaaatattcagactggggttcggtaaaccctgttgtgctgttggatttatctacgccagttattagttcaattttacctgactgtatgggaattgcagataacttaacatatttttcaaaaatatcatcttatttgattctatggttagattgcgatagggagggcgagaatattgcattcgaagtactaagtatttgtttaaactcaaacaaaaacctgattacttttagggctcatttttcagcgattactaaatttgagattaataatgcaatgaaaaaactatcatttcccaatcgtgcattaagcgatgctgtcgaagctagaaaagaaatagacttaagagtagggtcttcctttacgaggtttttgacactaaggtatagtaggctattcccaattccagaacgcacacttagctatggaacatgccaattccctactcttggattcgttgtaagtagatataaaaagattataaatttcagggaggaggatgagtggacgatcacattggaagttaagatgaagatttacgaagggaataacaaagaaatgtcaaacgtaatttttgaatgggaaagaggtaaactttttgataacttatttacatttattatatatgaaacttgcatagaaaattcaaatgcaagagttaaagaaatagttaataacaggatcttgaaaagaaaacccttaccacttaatacagttgaaatgacaaaaattgcatctgataagttaaaaatttctcctattaaatgcattaatattgcagaaaatctttatagaaaaggttacatttcatatccaagaacagaaacaaatagtttttcggacagcattgatatatcaaaatatataaaagagcaagaaaaaagtagcatattcggatcatttgcaaacgagttgttgtatttaaacagtttttcagtaccgagaaaaggctgtaaagatgatggttctcacccaccaatccatcctgtaaaatgtttgaataaggaacaagcttcttcaaatgaagagtggttattatacgagcttattacacgtcattttttgtcctcatgctcagaagatgctgtaattatggaaacaatcgttaaaattgatatttctggcgagactttcaagactaaaggaaccgtaagttaa

SEQ ID NO: 2049 - DNA, 2253 bp, Cryptosporidium hominis
atggcaatttcaattataccactaggcgcaggtcaagatgtaggaagatcatgtataatagcaaaaatcggatcaaaaacagtcatgtttgattgcggaatgcatatgggttttaaagatgaaagaaagtatcctgattttagattaattagtgccactctagaccctttaattataaatgaatatatcgatttggtcattatatctcactatcatttagatcactgcggtgcactacctttttttacagagaaaataggttataaagggccaatagtaatgacttatcctacaaaatctgtttcatctgttttactttctgactgctgcaaaattatggaacaaaaattattattgcaaaaaacaaacgctgacgtggttcccccaaatgaaacagtttataataatgaatatggtttttttactgtttctgacgtatggagctgcatggaaaaggtaaaggctattcagcttcatcaaaccatagttatttcggggataaaaattactccatattatgcaggtcatgttttgggggcttctatgtttcacgtacaggttagtgacgaatcaattgtttatacaggtgatttcaatatggttagagataggcatctaggaccagcattaatacctaagctgctaccaagcttattaatttcagaaagcacatatgcaacatacattcggccttcaaggcgttcaactgagagaaccttttgtgaaatggtatactcttgcttaaagagaggtggtaaagtattgatacctgtatttgcaattggtcgagcgcaagaactatgtatactattggaaatttactggcgtagaatgcaaataaggttcccaatttttttcggaggctcaatgacggaaaaagccaattcatattatcaattatttactaactggactaacacgccgctcgctgataatatttttacttttccacatgtactgccatatgacaaatctattctgacactttcaggccctgcagtactttttgcaacacctgggatgcttcatactgggctttctcttcaagcctttaaaatgtgggcaccggactccaacaatcttactattattcccggcttttgcgtatctggcaccattggctcaaagataattaatggtgcaaaaagagtttacatcgaccaaaaagatcctactacatgtattgaagtaaggtgcaatgtaaagtatctcagcttttcatcacacgcagattctatcggaatacaatcccttatttctcactcagagccacagtctatagcattcgttcacggagaaagacatggtatgctaaacttagcatcgttcataaattctgaatttaaaattcctacattctgcccacataatggttcaattaccactttgcccactaaagagaactgcaaatatgtttgctacctttcaataaagtattcattgataaacgctataaattcaatacaaaattcatttgtgaataaattaaaagccagaaacattatcgaaaagtttcggattagacagcttaataatccgtctattagtttattagaaaatagtgcccattcaatttgccatttacgttcattgttaattgaatattatggaataccaaagctatttccaatatacatttttacttcaaaatatactgatcataaacattcatttattttgataaaaaatgaattatatacatatttgagaggaaagtcaaagattttccaaaagaaactattgaaaatgaaaaaacattcaaagaaaaataaagatatttcagaaacgaatatcacaatatatcaatataaaagattccaaattaaaaaaacatttcacagcatcaataaatttaatttgacattttattcaaatatatatgatatcgaaattatcaagatattaattgcaattggaaatttgttaagtaatgtatttcgcaaacaatatatcatcaggaaaaaaaattgcagtttaagaaaaccgcacttaaacgaaaaaattaatcgattaataaagtcatatttttatgataatctgactattattacttataaaagtttaattgttaaaattactgctgagagctatcaactagatgtcattaataaatacctttctgaagcagttattgaccaacccaacattgacatcaaaaaaagtgttgtaaataaaatagtaatttcttggtcttttattgataataagaacgttgaaatttcagattttgttaacactttagaaaataaatag

SEQ ID NO: 2050 - DNA, 1290 bp, Cryptosporidium hominis
atgcctgttattaattgcagttcaacacgtttgagaactgacttaatagattatatttggacgattgaagattttcctttactaagaacactcgcaatgcagcgtgcattgcctaatcacgacagaataataagtgaaaaatttggtgatcagcataatggaacttggtttctaaccatatttcctgcaggagtaaactgcgatggtgatatgctatcaatttatttattttcatactcagaacaaatcaggattgcacaatttgaaatttctttattagatgataagttaaatatcattgaaggtacaacagtctcgctttctcaacctcgagttttcaatgttcatgattcaagttggggatgggaggattatatgcgaattaatataatcgacgatactagtttaaatgatgagagtattaaaaattctccaagtcaagcaattccctccccatttgagaataaccagggaagaacgctatcaccagatgaattaatttatttttcggatgaaggcttagacacatatagcgttcaaaaccattcattaggtggaagcagtgaaataaaatcttctgaagataacattctgaattgggagagaactgtacttaaatattttatttttggtggtgcaatccgtgtaaaaataaatatcaagtcatttaaagattttattcattcagatgggagcgtaattgttcctaattttttatcaaacagaattgctactcaagattatttatggcttgcaaacgacatttccagactttctaaagagtgctcagataaattatgtgaaaaagttacactaaattgcggtactgagctctttcatgtccccaagtttgcacttgctgctagatcgaagtacttccagaatttttttttatcaaacttctcagattcaaatgctaagtatttttcaattccagttggcgatgcatcaccatatattttaagaaatgcattagattatattttaactggagattgcagattattgagtgatgaaaacattaaaaactggaaggagataatagatttattcagattttcagacaagtatggaattaaatcgttatacaatgcatgcgtgcccgctattattgcaaatatcaattcagaatccgtatgggctactatgataattgcaaaacaatgtaattcagataaaattcttaaatcagtggaacatttttttaagacaagcggggatttttctttaattgtaaatgctctagttggccacatattagaatataaaaactcgatagttaaaggctaa

SEQ ID NO: 2051 - DNA, 1161 bp, Cryptosporidium hominis
atggttgaaactaacgaattcgactccggaatatccaacaatagaacgaacagaattggtgaatcaattatagatgttgaattagtaacttcagagcaatttaattccaacatttttccggaaaaagaacaagaaaccaaaaacttaaatgaagttaaaaggaaaaaaagaaagattaaaaaacatttcactcaaattcatgtaaatgatgaaaaaaataacaaatttgttcttcctaataacgatgatttgcgtgttgatgactttatagttgaagacgggtcttctgattttgatgtggatgatattattcgagtagagggaggaattaaatcatcagacgatgagtacgatgagaaaattagcaatgactttattgaagacacaagtttgaatgttcacaaaaattctcttggaaggaaattttctgaaacggaagtccgtgctgaaattagggaatttattcaactaatgaaagatgcagctaataaggatgaaattgcttattctgatggaaaagttgcaatttcaaaactgaaaatgattgatgaagtttgtaaaagagtatcaatgaataacctatcgaattactttatttccgagggggtgctcgatgttctaagtcaatggctttcgccttttaaagacggcacccttccaaacctatcaatacgaaataaaattttaaaactaataagcaacattcctttgggagaagaagatgtaacctctacagaattaggaaaaactttatgtaaactttggaaaaattctgctgagaccattgagaatagacaaattataagaacgctaatacaacgctgggtgagacttatttctaaagatagacccccatccttggaaacaattgataaagttccaattacacctgaaagcctgaagtcacaaattaaatctaacaataacgaatcaacttctaaaaaaagttcattccatattgaacccagaacggcgagaatcccaattaatactggctataacttcaaaataatcccgcaaaacgatagctcaagtatagagcacaatgcaagcacatttacagataagtcgattggcaatattagcattaacagaagtagccgcactaggaacagatctaagcatgcaatgaaaattagccttgaaggcaaaggactctag

SEQ ID NO: 2052 - DNA, 1335 bp, Cryptosporidium hominis
atgacagaaaatcaaggatataagcaagaaattttgagtagtagtattccaaatatgtctaaagaaaataaaaatgaaaagataaacgctacttttgacgtaaatcaagatattagcacaaaaccaattattgaaaaaattccattacacacagaagctgaatacaattgctgtgaagatgttaaagttaaacataatgttgactacccaatcagagagcataatggcgtaaataactctcataatatttcagagtatgcagttcaaggagaagtttattcttgcatggaaccattggtttacgataaaaacaacaacaacactattgttcttgttactggagcaacaggatttattgcatcacatattgtggagcgattgttgcttagaggatataaagttcgtgcaacaacaagatcgaaaaatagccaaaattctgactctttattaaatttccattttgctgatgagaatttaatgctttatgaagcagatttattaaatagtgaatgctggaaagagttggttaagggatgtagaattgtgattcattgcgcgtctccatataaaatggattgtaaggatccatatgaaattatagatcctgcaattattggaacaaaaaatgttattcatgcatgctgtatgtgtgatgatgtaaagactgttgttctaacttcatcaattgccgcggttgtaggtgcttataaagatggaaaagtatattctgagattgattggaatgaagattgtaatcctttgatacacccatatttgtacagcaaggttgaagcagagaaaatagcttataaggtagtggatgaatgccgtaagtcactaaatctaatagttgtgaacccgggtatggtaattggtccttcttatagaagtgatgtaaatcaatcggttcaatggatttacaatatgattaccggtagaatgccactgactgtagacttacagacagggtgggttgatgtaagagatgtcgcagaaatacatattaggcttttcgagtctggcaaattttccgggagatttatttgtatcgaaggaatgtatacatttctcgatatttctagaatgataaaacacatctcacctcagctaaacccacctaatcattcccttcctaatttcatagccaaaattattcttcccttattcacttcaaaaaatgagaaagattttttgaaaacatcattaggaaaaagaatattacttagcaatggtaggttattatcgcatctacctaattacaaatttttgtcgacattcgaatcggtaagagatacatgtaatgatttaacaaacaagtttgacatcaagaaataa

SEQ ID NO: 2053 - DNA, 1320 bp, Cryptosporidium hominis
atgaattacatatttatcaactcagctgtttctacaaatgatgaaattgtaaaacttcaacttcgcgaacttggagaaccgatatgctactttggagaagaccagtatagaagaagagaaaggctatccaatttaattgaaaggcaaaaaaactccactgaagtaattaaggattctgtcaagcccttggcaaaagagacatttttttcagaaggaacagatgaattgatatcttttaggaaggaaattctcgcattatcgattaagaaatcatattacagattaaaatatactagagagttttctgaaaaaatcttaacaaaagaaaaggatgattttttaacccgtttcacgctgaatatcagacaaaacgtttgtgaaatgtgtgatactagatatatattgggatgcagcatttctccgttggaagacaaaattgccacatatggcttgagtggagatttgaaagtttgggattcaaaagaattaattcaggacttttccctaaaatctcataagcatagcattacagatgtaaactggattgttacagacgagggaaattcaaaactattttcttgcgatttaaatgcaaacatatttttatggaataacagtcaagtggaaaataaatacatcggacatgaagatcaggtaaataaaatcgttatacatccattttcgaaacatttattttctgctagcagtgacgaaacatggagaatctgggacattgaaactttaaatcaagttcaagttcaggaaggccactctagaccaatcttcgggttagatgtgcatccagatggagctctcgttgttagtggagattctggaggggcattcaggatttgggatatccgaacgggaaggtcaatattatcccagctggctcactcaaagaaaatcattacctctcagttttctccaaactgtgacgctacattcattacatcctctcaagataattatattaagatttgggatttaagaagatttgacaaacctttgttatctagccttttggggcattcgaaacagatttcaaaagttcagtacgaaccaaaaaaagggagatacattgcctctgcgtctttagacgaaagcatcaaaatttggtcaacttcaaagcttaagaatgagtctacaactgactttacttcaaactttagcagtataacttattcatgcataaagcatgtagatactaattcacataaaattacaggtatggatatttcttcaaatggacaaagaattatcacagttgggttagaccgcaccattagagtatggtcttcagaaagtgaaaattcgtaa

SEQ ID NO: 2054 - DNA, 1731 bp, Cryptosporidium hominis
atggggcccatcattcgtgatattttgggcgtcactcccaatataaaaatagtttcccagatgaatgagaagctgaagaatgatgattcacctggtaattatggaaagaaagcacttaaaagtccaaatttagagatggttagcattcctattaatacttcaattggaatttcatcaaaacaaaaacctatatctaattgggaatgggttaaatttcggaacagcgcacgaaatgattctcttaaattatatcactggtcaaaagtacaaagttcaaacaagcaagaggtttgcattagcggaaataaagaattgaatttaaaagataaattaacgaaagaaaataactctgttcttactcccacagatgatactttgcaaaaagatagccatacgagtacttattatttttcgaagtttaataagcatccaaccatttatagcattcaatcagaccaatacaacaaatttatcaaggatatagatcctgattggacagaagatgatacctatttactatttgacttgtgtaaggaattcgacttaagatttatcgttattcacgacagatatattccaccatctgggaaacaacgtacactggaacaacttaaacaaagatattactctgtttcaaaaaagttggttgaactcagcttcgactctagaaggagagctcttggaaattctcctgacccatcaattcttgcttctctcaaggaggaacgtagccggcatccatatattagatattcgtataattttgagcaagatagaaatagaagaattgctttgattgaaagttttaatgatcgaaatacaaggaaaaatgccaagaaaattatttctgatattcagccaaagcctaatcaacacaataacaagaaagggagtatgcatatacaaaaatgcgtaggggatttggttgaaattgaaaatgaaattgagcaagagtttaagttcatctcaaagctcaaattacatgattcattcggcccaaagaaaagtggcgttacgactgtaggggcattatgctttcaatatatttccaatcttcctaggaaattctcttcagatgtagagaattttttaaaacatttcaaacttgatattttcccattgccatttttaaatattgaagttgcagaacaatactgcgcaatgaggtgcgatttattaattttactttcaacaagaaaaaaactacaacgtctaaattcgttcagacatgcttggcaagaaaaattgaggaatgcaattattcaaaatgacgagtttgggcatgcaaatcaagttgagcaagatgaaaaaaatagaagctctttagttaattcttcaggaagacaatatcatgcctccgttccatcacctgctctcaataattcaagaagtttttcttcgaaaactagaggcaaatccattagaatgcaagagcaaacatcaggccaaattgtcattcctgatataaataatatttcaatcgctacacaatttaatcaaaataatgaagcagtgaagagagatacggaattaatcgaaaaacccaggaaaaggtctaaatcaaatgtttcaaggtttttaactcaacaaaatgggttttctaatcaacatggaactcatttgagctccatacaaatattaaatggacaagctgttgctacacccacaaattctgcacaaaacgaacaatttttgctacataacgactcaataattagaaatgatatttaa

SEQ ID NO: 2055 - DNA, 756 bp, Cryptosporidium hominis
atgccgtattcaaataattcatttttttcgcatgaacaggtagaaaatataattcaggaaaataaacagttaatttacggaatcaactcatttaaaaaaaatgatagacatgaagaatttttgagagtattactttcaaggctacaaaaaaatttgttcttgcttgcacacttaagtaaccagcctaaggctccaaatcacctaaccgttaatgatcttctaagaccagtattttcctgtgattattcatcagaaaataagagggcaactccccaacaaacaatttccaatagagcaccaaacatagctttaaattcgcctattttatcatcaaacacttctcaaccaatttattttgaagctaataatgtagattttaggataaacgaccaaaaaatttctgaccaacaaaatttacaatcgtgtgaaaacccaaatatcatttcaaatcctcaattatcaaaattgtgttatgaacctatcgcatcaatatcaccagaatttgatcctcaaaacggtataggaatattaataggaaactcctcctcaagtcctaattatattcagactcagaacaatgaacatttcatatgtagatactgccaacgaaaatgcagaaatcaaagtggacttacacagcatacgatgaaagttcaccccgatgcacctgaagtgcaacatcttttaaagcaagcgcaatcaaggtcaagtcctaacccactttctataattaatattagctcatcaacatactaa

SEQ ID NO: 2056 - DNA, 1491 bp, Cryptosporidium hominis
atgaaaaatcattatgagaatagtggtttatttcaatcatgtttagaaaaggtagaagattatttcactcttgacttgattaagttgtcttcaaatggctgctataatgatttagaatgtttaggtggtcagttaaaattttcatgtttaacactgccacctaaaggcttgaatgcatcaagtgaagatattattgtaggcattcctgttggaacgttcaactcgagtcagctaagaaagttagcaaaaattgtggaaaatcttgttatattagaggaattgaagtttttcagatttttcgacttttttatttcgttttcaaataaagatccaacaaaaaaagaatattttttgttagatcttgccaaaagtgatggactaaaatctgatttcaaagaatcaaacgttttgatcgagacaatatataaaaaaaatttggataatttagagttaagtgagacactaaaaccactaattcatggtactctaaagaaaaaaataaatgttatgcagagtttattagaccattttactaaaaatacaaatttattaattgaccaagtcatggataaatttgatgaaaaatcaataaacttgaacaggaaactcgagacagcacaaaacaaaatattgttacaggaggcaaaagtaaatcgtcttaatgaagtagcttggaaaattattaggcaatttggtgaattaaaagaactggatttttcagaaagtgaaacaattttttgtgtggatataagtaaggaacaactagaagaaaaaccttatagagaagtactgacgttacaagaagcacttcaaataagaagatcacatggaggggaaggattgccagaagattttgaatcacctgacaaattattacagtttggaagagttgaaggtggagctccaaataactttgaagatgaaattagtccacaggaaaaagaagtaatttcgaaaaatctccaagagggtatttgggatccaatgaaaaacaatacaaacttaaatcatatgcacttccgtaaaattgactggatgcaaactgacaccatacaccctgcatttatacaattattgaaattaaaaacaaacagtgaattaaaagatgaaataaaaaataaaatagaaacgtgctcaagaaataaaatttatgatccaatttatgattataaaattaagaaattaaatatgataggtaacataactgaaaataataaacattcaactgtatttagttatctaggtaggccaattccaaatttacgtcatcaagaaatgccatgcattccaagacaaaaaattattgaaagcatacaacactccatgaatacagaagtttcaaagaataagaaatggaagagctatggaagaccaatagtaaaaagagatatgaaacttaaaaattctgaagggttaaagattgaaccactaaataccaaagttagtgactttgaaatttctagtaaagatgtttataatatactgctttag

SEQ ID NO: 2057 - DNA, 1086 bp, Cryptosporidium hominis
atggctattttatttttatcttctttttcatgttgtaaatcgaatgagatggatcacaagaaaggaaacatttcaaatctaatatttccatttcttaaaatttataaaaagtcatttttaaatattgtaaacataaatgatttaagaaattcaaaatctgtattaaatgtctattgcaaaaacaaaaataacgatatatacttcatcattaaactattaaaatatgtttacattaaggaaaaaaatatacaaaaaaaaaaatggatatccaaccaattaaaaaaaattatgttttataaagaatataataatgaatcgagctctagtttacaatcagaaatttttaacgaaagaagtgaaatatcagaaaatcatttattaaattggagatttgatatgatgcctatgcataaagtaattattccaaagagaaacagtatatcaagaaatcatttggcattcccaattacacaagaaagaaaatttgttcctttcaattcaagattaggtactaatcaattttgtttgcctaaattatgcaggaatggattccttaaagacataatcaaaataaatgatataaaaaatgattatcgaaataattattgtgtatggaatcctggcaagttattgctttcaaaaagttcaaatatattagctcagaagcctataagaaataatttaatttttatgaaaccaattattaaaggtataaaaagagaagattatataggaagcaacaatgcatttttaataaatctcaccaactcaaaaattccaattattcctacaatctccagtagtaatcccattaattacaagttaagggcagcgtcttcagtgcaaaaaaagagtgaatccatcccaattcagataaaaaaggcagcaaatatatttccagaagattcagtgggaaatacagaatggaacaaatacggtgacggaagagaccgtataagtaggaacgcaagagaaacaaataccaaatatcccctatatgatagaaactgtcaaaatgaaggaatatttggaaaagacatacgagaaagggttaggttaaaaggaccacttggatacaaaaaataa

SEQ ID NO: 2058 - DNA, 1332 bp, Cryptosporidium hominis
atgtcattgcatactctactcgaaaatatttcatttgttttcaaaatttatgccggcctatcagcattctcagtactttggtttacatactcatacaatgtttatattaaacgcagtccaaataagttgaaaaatattaaccaatcaaaatttagtttctgcgaaagattagaccatgaaaatatttctttattgtattctgtacttggatcaattctttactgcccacttcgaatatttgtattatgtcttacaacaattgtagtaataacgattttactttctttaaagttaattggaagtatatttccttggataaatgaagctcatttatacaattatattcatatactaattgttaaatttgtagggttttttacgcttcgacttttgggcgtcctagaagtggatcactttgtattagaaaagaatggcattgatgattctgggaaaataatatacagttatcaaaaatcagacggcttacctgcaattgatgatattgtaaccattgtttctaatcatatttcaattttagatatttccttttttatgagatatgtttcatgcggatttgttgctcaaaaagaaattcgtgaaaactatatttttggaactgttgcagacattataggatgtatctatgttgatagaagctgtatggaaactaggtcgaaggcaaaacatttaattcaagataggcaacttcgaagatttgaattagttcaatctagagcatccgaaactattatttgttcagaaaaagccaaagactccaaatgttcattattcaggagtgaaataaataaacatcttaattctctagaaaagaccccacttgtgatatttcctgaaggaacaacaacaaatggcagtagcattattccctttaagctaggcgcatttgaatcccttacaccagtaacaccagttgttcttctatacaaatattctgcatactcgccggcatttgacattatcccattttgggtacttatatgtttacttttttgcaactacggcaaaataacactatctgcatattggctgccgcaaatgcatgcaatcgagctgaataataaggaaatttcaactaaagaatttgccgatcgagtaaggaaacttatgattgaggtacttcgcgaagctgaggaatttaaaagtgaaggttacctatggatttcccagaaaaaaaactctcatatagatacaaaaaagaacttcagaaaaaggtttgaaatatctactagtaaaaatttggatagtagcaacttaactgcgactggttcacttaggttgaagcaagagtatattaggatgctcaataattaa

SEQ ID NO: 2059 - DNA, 762 bp, Cryptosporidium hominis
atgaatatactagcattatctcggattatgtctaaaaccccagaggatgataagatgattaaaaaaaaaattactaagaagttaggttttgcatcacataaaccaaataggcttcagttatgtacttattttattaaaggaaggtgtaaaaatggaagttcttgtcaattcaaacattcgactattcctattacgaagaagaagctttgctggtattttatatcgggaaaatgttcaaagagcgattgccagtatagtcatgaaatatcgaagtttccttgtagatacttaaatactgttgggttttgtaggaatcttaaagactgccgctttagtcacgaactaataaagactgagcaacaaagagaagagtttgtcagagaaaataaggattatttgctccttcctcataaagatggcggaccgagtgaaattcatgtaaaccatatgtggtgggtacctttattaaaaaagattatcaaagaagatgaagaaatagcagctaagcgttcgttcattaaaagactttataacgaatcagagacttccgttccaaaggggatttgtagttcaattgaacccaggtttgccataaatataagtagtcgctctgaaaatatttgtctaacaaatactacctctgaggatagttcgaaagagtataattataatacttctaattcatttaaccgaattttcgagagaaaagaatttaatattaaaaaactatactcgaatttgtttggtaactcaaataactaa

SEQ ID NO: 2060 - DNA, 660 bp, Cryptosporidium hominis
atgcacacaaatttgtttacaaacaaaagagttagcgcagataataagaatgtaaatgttcaacgtcttaggaatgaaaaggaaaaaataaaagagtggaatgaaaatttgactaatttagttacaaatatcaaccgaagagcaaacaatccaacagacaaattgattaatgccaactccaggcacaataagtaccatgataattccccaaaaaatattccatttaatgggcgtttaaagggcgaacaaaaaaaagcaaatgaacatctagaaaataaatttaattttacgaatcaaaaaaacaacaaaagcaattctcttgaagatcaatacacgttagcgcttattgaaaaacagaatattgaagagtcatgcaatgaactcaaaaagaggtataatcaacttgttctcagatttgaagaggccatcgagcaaaaggaatcatttagagaagggctaaaaaacaaaataaatgaatatcaaaaactacaagagcttcataatggtacccaaagtctacttgctgtggggaataaagctcaagaagaactttatcaaactcagaaacaatttcaaataattctcggtaagcgaaatgttgaattctctaatgtgaaagatgaactcgaggcaaaaaagacggaattcgaagtaagttaa

SEQ ID NO: 2061 - DNA, 1086 bp, Cryptosporidium hominis
atgaagaataatcaggatctgaaaaaagaaagagatcaaatgaagagagaattgaaaatttatgaacctttatcacggtcgaaagaaatggtcgacaaaatggcagcatatctagaaacgctattaataaaaagaaatgaagtaatttcagaaattactgaggatttatcaaaaaatacaggaaacctcacggaggaaatttcaaatattcgaaaggatattgttggaattgagaacagtattcaaaagttttcgagtataatttctcattttaaaaacgatataattacaaatgaaaatcgaagaattcaagactcatatatgcttgtgaatagcttaaaaacacaactgacaaattctaaagaaaagattattaatcttaaaagattgctatttaatagtgttggccggccaggtaacgctcttgaacctagtttaacatttgaagttagaaatggctcaattttacataaattacaaggtagtcatggcaataccttaaagtgttattgcagaattgttggcacaacatttgaatacacaacttcaagcaacgttgtgaaaaccatacctttggaaaaagtgataggtattgattatggaaataactctaactcatttcgaagaattaatcaacctaaaggcttctttcacgagctgtttaaacgccagacaaaaagcgaagcagaagaagacaagaatgaagtaataaattctccgtggttgttttttagcattcgaattcttgatggatatgatacattttgttcggatttcattgccagttcattagaatctgcaatgtcatgggttgttactattggccgttacgcaacatatatacaaagatcagtaggtttgttcacatataatttcatccaaacaaagcaagaattttatagtgtatcattaaggatgaaagttatgcatttatgcagacaaaaggagctaaacatatcacaactatacattattgcaatacatacaagctgtcttaagaacccacaacttattagaaaccaagccgcatggaacaatttgaagaatattatgaggagaattaccaataagaaatttccaaagtaa

SEQ ID NO: 2062 - DNA, 648 bp, Cryptosporidium hominis
atgaatatttcaaatttaattaatgctaatgtagacgaaaaagggtttgtttccgataaactcagagataatttcttccaaattgtgagaaataggccggaaaatcgaacttgttttgattgcgaatccaggaatcccacatggctttcattatcatttgctgtattcatttgcctaaattgttcctctgatcataggaagatgggagtgcatattagttttgtaagatcatctgatcttgataaatttactccaattcagctagtgaggatggatattggtggaaatggtcgagcaagaaattatttcaaacaagttttaggagttaatttttctccaaaaactaaagaatacgccagttccatatgtgggagacaatacaagcagatactagattcagagatttctgaatttgacaacttaggtcctaaaaatccaagtgagtttgaactcattgatagagataactatacagcaaaccctgaaaaggtagatactcaatctactggaaatgttcagacaataaagttcaaatcaatgcctagtactgttggcaaatataataacattcaaaagcaaggcagtctaataaaccaaaagggccgaaggttagatgaaaattttgattttgattctttggtttcatag

SEQ ID NO: 2063 - DNA, 243 bp, Cryptosporidium hominis
atgaattcctcaagttgtaaaacagatgaaattgctgaatattttgatgaaggcgattttggaaatgaaaaacagcttattttgaatacagatagaccaggaagctgcttttttggaagatttagcgtacctactcatgcccaaagtatggtaggtgctgtttttgtcgattatgtgactcctgtaagagtaagttatttcaaatcatcctatgtttcatgcctatatgtttcaggatattga

SEQ ID NO: 2064 - DNA, 1218 bp, Cryptosporidium hominis
atgtttcatgcctatatgtttcaggatattgattctttaagcgtaaaatatgaaccgtctatttcccccaataatatagctgatccaaaccagataaatataaggattagagatagcaattcaaaacattgtataggaaggcagttatcacaaaaaaattccaattatgcagctataattgacaaaggaacccactatgaatttaaatttttggacggactattcgtatttgaccctagcattaagggaaagaacgaaagtaattcagatgttgcagaaaatttaaagcgtgactacatttctagagaggctgctgtgaccgctcgtatacaagaatcgtctaataaaatgagaattaaacttgaaaacgacgctgaagacgatcaaacacctgaaagcgatacaaataaagatctaggcacttttaatagctcttgcgaaaataatgtaattcctggagtaatgagaggaatattggatgatatctacgataaagattttggtcttaaacgacaagaaaaaaaaagaaaaatttctgcgatgctaaacaaagagaattcagatgactcacgtatcgttgtatctgctctttcattaactacgttaaagagtggtgattactgggactatgatggagacggaaaaatgagtgatgatgagggttatatagaaaaaaatgaaatggatgaaaagttcgaggaagagcacaacccaaatttagttaacggaaatgattactctaattcagaagacgatgaaggcccagatggaattttaacagaatatggacaaactcttaagacaatgatagctaatcaacaagatatggaagctgatgaagaactgaatctgtattctgatgagattgatgacgatgttgaaagtaaaagtaatattagtagttccgctccggttacagttaacacgaatatacaatttgaaatacaaaaaaagacagtaaagtctccaacagcattatcctcttcaattaatggtttttcaaggagtcttgaggcagaagttattcgtaaacttagccttgcaggaggcaggatgcaaatcaagcctttccttgatgcaatgaaggttaagaagaaaaataaatactttgaggaaatacaggaaatcattaaaaaggttgcagatactcacaccgaataccattcaaatatgaaaataagctacattactcttaaaagcaattatcgtcagaggtga

SEQ ID NO: 2065 - DNA, 1521 bp, Cryptosporidium hominis
atgtccctcttcaaagatgaaaatatggaggaaaattatttttttgtgctaatcacaaactttccagtgcttagtttgacgattggaattgtgcttactattgtggggtcttgctttatggcatttggaaatgcatatatgaagaaaggtcttcatatccaacagcaaaaatgtatcaacaattctcaaactaacgtttatagtatggcttataatgaagttacatggtggataggtgttatttcatatgcttttggggcaattgttcatattattgcactcgggtttgcgccagcctcaattttagcgccaatgaatagttttggtttagttgctaatgcattcgctgcagcaactctgcttgatgaacagtttggaatttttgaattgatttccacagtaggggtcatttttggaatttgtctatgtgcaattgcatcagttattccgaccgaagccccaacgactaaatattcagggattgaatcttggtcagatccgtattatttaatttatataattttttgttttatttgtgcattggctgtcttgatcgtaatcaataatgaagaggcaaaatacaatgagcaaaaagaaattcaaacaagaagggcaatactgaaatctctggacgaagattcgcttggtatcattccaactgggaaagtatctccaaacaattcactaaatttgaacaatcacgcaaaaataaaaattactcttcctaaatatcctaaatatataagtatgttatatggttttttggcaggtctaataggtgcccaatgtgtcctcgaaataaaagaaatggttgcttggggtgaatttgctttgcagcatactaaagattggatgtataacatacaaccgtacctcgcatttatatttttctccacttcaacttggcttcagatgcattttcttaatctgggtctcgctatgggagatgcaactttggttgtgcctgcatattacgtattttggacactttttagtacttttggagggttcactaaatttcacgaatttgaaggatttacattcataatgacaataatattttcctttggaattattattaccacatcattcgtaatcgtgatgtcaatcagagaaattctagcatttaaaaaggcggttgacgaaagtgtaactgataacgatgggataacggaagaagttccaaaattagatggaatgaaaggaaatatgcttgacactcagctcccccttgcaatgggagttctaactatgataaatgcaggaaagctcgcaggaaaatactttatgaatgcgtctggtcaactaagaaaaacgagaagtgcatctgatttaataggcgaaaaaagaggatctattgagattacaactagacaaaaagatatttggactttaccaagcaacgtaaattattcaaatgcaaacgaccctaattcgtccacttatcagaattctgtttggagaccaaagcctattaacgaattagttttcgaagatgtcgaatacaaagaaataccctag

SEQ ID NO: 2066 - DNA, 2316 bp, Cryptosporidium hominis
atgtcggattttcactgtaattcagtggacagtgatataatttatgagtatgaaaatatttcagtgaatcaaataattggaattaggaatgggtttcgaagccaggataatatacatcgaaacgaggtagaattaagtaaacaaggttacaatggcttaaaagatgggatagtaagcaattcatcagaagtcaacgcgtataatagaaatgtgaatcccaataggcgtggaggcaagttgaagccaagacatgttcctgatttcgtattaatatcgcctgaagatgtcgatagattactctctacagtaacgactttagatgaaagaaagacaataatgaacaattatgaacttggaactattgtattaagaaggctatgcataagcgaaagtagcgaaatcaaagcttttatggactcgattcaaatgagaacaacaggaaaagcactagaaagtcatgaacggaatataatttgtttgacttttagagggcagcctaagaggtgggtgttttgtccatgcagaagctgtttatttaaaggtaaggcgcatgataaattaatgggccattttaaaattatggagcatgatactcagacaaacacatttcaaatttctaagaacgtttatgattcatatggcgttttcatggcttcttgtggctattttgctgccacgttttgcccccaacaaaattattcttcgcataaagtatttgtcggccctacaatttcagatttgaaaggcaggattcatgatcgatatatattattcatcaatgactcaaaagttatacaaatggcatggagaagaaaacagaattattcctttgaatgcgaggaattacttagtaatgtaatgtccaagttgatagtttgcgggaaatcaggtcatgtacaaatgataaatcagttgagtaaaggatactctggattaatatctcttccacttaaattacgtttccattgcgaaaacttagaaaaacagcctaattcgattggttcggtaaatgaatttagcaaagggggagttggcttagtcaataaaaagaacaagagaaaaatgagcaagagaaatatggaagattgggatgttataaattcagataaatttttgaatgatgcaaatgaacttcagaatgcttatagcaaaggtatggatcagaatctgacatccaaatcttattcttttccaaattctccaatagtaagggttcaaaataaccaatattataactcagacagcaattctttaactccaagatgtacaaaacagtacatttcagaatcagggcatgatattgatggtgagactctaacttctaatagatatggctgtattgttggcgatgtatctactgcatcagcaacacctattgcagaaagtgcagattgcattattaacaagcagtttaataattataattcaaagattttggattgcattcaaacaataaataaaagcgggttatcattgaacgatatgagtagaggcatttatgcaagtagcccattggatccaaattccttcattccaaaagttccaattccatcttccttcttcagcaatataagccaaaataagattctgatgaataacattgacgcaaataaggcagatagatacgggaataaatcaaatagcaaaaactggcttggatcattagaaaatgaaaatgaaaacccaaatataaaacaattaaaagagaattatttgtatggggatttttcacagggtaatggaattttcaggtcacattttcaacagaatttcataaatgaaggagctcacctcaattttaatcctttggcattttcttcggattccgcaaccaactcaattctacagaatgagacaattgaagaggaatccataaacaagcaaaattttaatggtggatttataataaatggtatcgctgcaaatcaatcaatctctttatataggcaagttttttctacgaatgaaatcacgactccaaattctacgcttgaaatttcatcacctatacaacagattcaacactcatttatttcggatggaatgggtcaagaacagaacagccaaattaatattattcaacaaacgcaaaatattgttaaccctggaacatatagcgatgtatttggagaagatgttacacaatgcgcttcatgcgagcattgctcaattggtgggtatccttattattgcaattgctataaaatgccatctgaatcagcagctagctctaatgttatcgatgttaatgatactgcaggagtctttcagttgaataatcaatttattcatgcttcacatgaggtggatacatag

SEQ ID NO: 2067 - DNA, 5937 bp, Cryptosporidium hominis
atggatgtaattttttcaagaattacacttgaagagctatcatttctcggctggagtggaagctctatcgatgagttatttattaaagttatttcgagaatattaagtgggccatatagaaattttgcatttttgtttagaaatccttcttataaaggaaaaataatagaaataattgcttcccacaaacacacctttgtaaaggataaattaaatggaattgtgcattctttcaagaatggtacagattattattcttcagaaaatctactgtttgaagcaaatgattgtataaagaatcatatattagacttgaatattttctcaaatatatctgaagttgaaggaaggctttctgtatatatggcaattgcaagtaaaggatttaatgggtgttggcaatatgaaatttcaagattacttaaaatggatcccaaaatggtgtttcaacacctcaagtatctatataagtacgacaatattgttaggttctctattccaatgccgacaaatcataaaaaaagattatttcccaatgaggactcaaactcatcttcaggaggtcatctttctgcaattatttggttaactcggttctttgacattaatcttattcctagagaaatttcccagttaatttggtatcaacacattcaacccctgagcactgagattgtaagaattttagaatataaagcgcctggaaaaatagcatgggaaaaagatattagagctctttgcgcaggatttatgatcgttcatgacgagaattcagcagatcacctaatctgctcacagagaactgccaataaggtttttaacaaattgagagattttttattaacgaaaaatgttagaagagtattcgcatggcatccactaactaaatcatactctccttgtctgtgcttaaaggatgcctttccatctacaaccattgacttatcgtctgaaattactgttaaggcagagactcatgtttctgaattaaatattaccaataatgaagactctaattgtcaaagaaataacctgaataatgaagataaagctaatacaaataatggtttttttcatgacttatatcaagaagaaactcaagtttccactggaaataaaatatttgaaattaccgaggcagcgcaagtcttatggttaataagagccagcggaagagttggtttagtctctctagatatagtaaaagtatttggtataagcatgaaaaggctcggaaaactgctatcagatttgtgcaaaataaagataattaataagattccgcaaaggtataatcggacattcatgtatagatattattttaataatattatcttctctttgaagacagtaacaaataataaaactgacaaatttactatagatctggataattatgataaaaataaagtagacgtaaaatctgaaataaaaaatattgcaataatgtttagtgaggcttttccagataaaaaaatggaattatccggggttactgaacaatttgtcaaaagactagtcctaatgaaaaaatggatagatgagtcaaaaattcttacgatccctgaaattgcgaagcttttttcagaagctgaaaatactcaaaacggacctgacagaaaaactattaaaagaatattatctaaaattttggaattagatgagtattcgaaggaatcaagcattattccatgcaaaaataataatgcattatcttcttccggagaagtcacgatttttttttccttgaaatgttacaaagaagacgaagcgagggatttaaaagctactgaattaaaaaacaaaagatcatctacaactaaatctgcaattgaaagaaggaaaaaggaactttcacaggttgctgcaataattgatgcatccaattcgttatccccaaacaaacaaaaagaagtttcggttattaatcaatcaaatcattcttctaacgctattttgtctcaaattggtacaaaagcaatatgtgacgatccgaatcaagcaaatataccgagattactaacaaataaaataggagatgctacagttatgttaaataccccagattttatggttgcatcgttaaacatagaaattaatggagatgataattccgtgaatgatttgagttctaaaataaacaattctgattcaaaactcgatattcctgggacagagtttaataaaaaaataagttttgatccttcaaaaagaattagccttggattttcaaatttatctaagggtggaataaaaattcagtcaagccaaggaaaactaggatttttatcttttagccaaaaaattcttgcgcactatggatttgtatttccaattatgatacgtttaaagattttacatcatcacttgctttttttatgcaaagaaggtggatttaaatgtgatttgctgtcttctaaagaaattctagacaatatgacaatagatacatttcttagagtaataggatttggacatagatcaagatttattgaagaatacctgctatatggcactagtgagactttcaaatttggtcaaaatacacgtataaaagaacttccatccaatctttatgaaacacttacaaggaattatccaaaaaaaaacttttttggatatgggaaaaaaaaacacatgaagaattatgtgaaaggtaggaaagcaatagctgtcttatacaaacttttatttctactttgcaaacttaatttcattaatttttcgatagacgattctaaagaaattgataaatctaattttaaaatttcaaatattaatcaaatgaatatagagagcgttccaatatcatcgccaatatggaaattggaatataacttgaagattcctattcttattgatgctgggaagaatgaaatagagaggctaactgaatacattaaacatacaaatgtttcatatagtttaaaaaataatgatcaatttgaacaattttgggcaattttaaacagggagtctattgatacacataactatattatagagtttaaaccatataactatattgcagttttcccagacatattgttgaaaagaaattggaaaattaatccattattatcaataaatataagaaaccagctggaaaagtacgctagacaattgttatctgacaatgcaaattcatcaaatacattcgatgaaccgaaagataaaactcatattgtattatcattagcctcaccagaaataaaaaatatttccaatgagctggcaataagccctttaacaacattgaaatacttaatacgtgttgttgattcgttgtcattagaagaattcaatttttcaaataatccagactctactaaaagaattagttttcatccaattcgtgatccccgttatcaatgtcatatatgccatgctttatattcaacacatccagcaatgatttctcattataagacaattcacaatatttactcgattacaaactcttcgatgtatactataaaaaaagacaattcattgatctccaaaaataaaaatattaactttaattctacaattagaactcaaatacttagtgaaaattatattccaaatacgctaaaacatttgttggaaacaaaagaaactgataataattgcaatgagattgaaagaacagataagattgaattactcagagcattcttgagattaagtaaggaagatataattttgctatacattatactatttatcaataataaagtaaatatgaagaataaaaaattagtctctaacaattacttatttagaatactttcgttttgcaaagaaaaaaaaattgaaggtaatttatttagccttcagtttttgcgaattaagtcattgatccaagaaataagtgtaatatcaggaaacaactcaatttatattattgaatttattttttcttgtttaaaaacaatttaccctttgaactcaaagttgctggaagcaataaaattgaaagaaaaacaaaggatttgttggagtcatttactagaagttaattcattttctaataggtggagagtatttgctaccaaagaatcaaactcatctataatagcttctaacatcatacctctattaaattattcagtaaataatgaatatcataatttctatagttctggtggtaaagattcaaatatttcattttcaaaaatagattatttacttgttattaatcttattaaatcagagttgcttacacaaaaaaaaataatgcttaagccaatttttaggttagctaatcataatatattaaccgaagaacaaattaaaaagtactttgaggactctattaacaaaaatattttgaaacagattcatcgtaattcagatttatcaaaatttgaagaatccctccataattattcaaataggtttgcaccaactaggagaatgttactaaactgctttggcaagacaattgtttggcgtgaaatttttaatctttgctttgctttcctacagattaattattcaaaaggtacaaaatttaatgttaacgctcaaaataccaatggagcatttgtgttaaatcatttaaataacttgatagagaataattgtactttagaaatagaatggaatgatcacaatttttatgaaaaggtatcaaataaaaacgatgaagaattattcagattattaaatgaggtagttgatcaacagaattcacttgaagatttctctgaggaattgaatctgaatactgaaaagtcgatggtagattctcaatttttaaaaaataaaatgaatctgaatgttacaaaagaggatgaagcgatttcgaacaagacagataatctcggaaattcagaatattttgaagatagcaataataaaaacccaaaaatatccaacattacagcaatttatttaaataagcatactagcaacaagtatctccccaatttcatggaagtagaatactcattaataaatattccatttttaggtgcaatggattctgatcccttggaatttagcaaattgccttctattttttcaatttctgagattctattgaatttttctgaaacaaaactaaaaaattcaagtagagagaccattgacccaatttttaaaattattaaagctgtttcgagatttataattgactccagctcaaatgagcataatctaataatgaaatcaatttcaattattatatatacattgaagaacagtccctggttaacaataaacgaaattgaagagatattttttttaaaattttctgatttaatttctgaattattaataatagggtcaaaatttgttgattcgggaattcttttctatgaatttaggttacctattatttatcatattatttatttattggaaatacttagaatatgtataagaataccgacagaaggaaattggttattttcattattttgttctataaataataagttaattgaatttaacattgataatcttaataataatgataataaattaacgaaaaataatggaaatatcttaataccaattaatgttccaacaagaatatggctactttggtcgaatgaagtcgttttacaattatttaacgaaaaagagttaaatttgatcgttagcaatattaaaaaatctctatttgaagtttttgaattaaattttattgtacctccagaaatttacttgaatagaccacaaatcaattgttttgtttctgttgatggacaaataaatttgccactttgcggattattgatttatttcatctcttcattaattcacagatcgccaatatttaatttgtcagaattcacctcgcgtttctctttctttagctcctgcgagattgaattaattttggaatctatgcttgctgagaattgtctttacaaagataacacaaaaattattttttcaaagcctatacaagatatttttaaagtttatgaaggatatctataa

SEQ ID NO: 2068 - DNA, 801 bp, Cryptosporidium hominis
atggatgcaaatatactagaaatgattgatttagaagagctgattatgattgagggcagattaaaaaatagtattcttgatttaaataagttggtattcgaactttacaacgaaaattgtagaatattacagcataatttagaactaaatagtttgaaaaacaagtcttcaaatgctagagaaagaatgggaaaattacttaaaaacgcattttttcctaaatttaataaactggaggaatttgattcattatcgttgacatataattctaaaaatgatgtttgtttatcaaagtacgataaaaatgataaagcgttattcaatcattgtgaggaaacaaaaaactttataggtaaaaaacctgatttaaataatcattttaaacaatcaaaagtgatgaaatatggtcaaaatcctcctctatttaaagaagttcagtcttctgataatcatactagccaagattccaatcaatgcgatctgaatcctgaatctagttcaaaaaataacgaggggcaagccgtaaatgtcgaatatggtgatgtgacaaagcacgtaataaacttgttaataaatgaaaacaattacgtcaagattcagttttctgagtttgaaaatgatcaaattagagaagattttgcaaaagaaataattaaaagtattggtctgaagccaatatattttgattgcataaaaaatttattaaaacatattgaaagtaagagcgaacatgttgaaaacttaattgatattgcaaatttagatccatgggaaaatgatcataaattcctcaagaactag

SEQ ID NO: 2069 - DNA, 609 bp, Cryptosporidium hominis
atgatgaaagagaagattgtgattgattgccgtggctcattattggggcgtttagcatctgtgatcgcgaaggaattattaaacggccagaaaatagtcgcagtaagatgcgaaggaataaatatatcgggatcactctatagaaaccgtatgaagtaccaagactttttacgtaaacgaatgaacacaaatccaagaaagggacctttccatcatcgtgctccttcgaagattctatttagagctgttcgcggaatgataccacataagactccaagaggtgctgctgcactagctaggttaactacaatagatggctgtcctgctccctttgacaaagttaagcgtgtcgttgttccatcatcacttcgtgtattgcgtttaaaaccccagagaaagtacactacgcttggaacattgtcatctttagttgggtacaacaaatgtaagactattaatgcattagaggaaaagagaaaggagagatctcatgcgttctttgttaagaaggttgccaaagataaggctctaagagctgcccaaaaatccgtatttagcaaattatctactgaggaacagacgatcttaagattggcaggtcaaaactaa

SEQ ID NO: 2070 - DNA, 2013 bp, Cryptosporidium hominis
atgtggctcacaagtttcaaagttccagagggagcaaaaaaaatactaaatgaaggtatggttgatgaaattacatcttatttgcctattgttctagctctcagaaggtggcaactttcattctgttcaaagctacatggggtatcttttggttctttttatagaagagtttcaaataaaggtccaagcatcttagttgtgcgtgataccaacggcgttgtattcggtgcatttatttccgagtcaataagaaattcaactaattattatggaacaggtgagatgtttgtttttacatacaagcaactatctgctattgatacaaaaaacccaacagaaaaaaccgaatttaactatttagaaccaagtaaaagtaattgcgacctcaggacatcgatgaaagattgctttacagaatttgcagttagtgaatatagacttgcacgagaagaaagcaactttagaaaaaatggagacaatataaaggaatcatcaaaatctatttcacgaataagcgtttttccatggagtggcaaaaattgcttttacatatatactgataactcaaggattgcaataggaggtggtggctcatattcattaacaatcgatggagagttttttagaggttggtcatctccatgttcaacatatgattctccaactctatcaagccacgaggacttccttgttaatgcattccaggtctggacattagtggatgattatcaataaatggtttcttcaaatgaatataagaacatcctggagtggatcgcatctgtacatttatctgtttcaaatagagatgggagaaatctgtcgaacctatttaatttgaggaattttagaaatactattaaaggcgatctctgttctttttatacccaggacatcaaactgctcacccaaaaatatttccaaaataaaaaaaatctattttctgggtctctttcagtaattatcgaaaactttttagaattatataaggaattaatgaaaaaaaattgccaatgggccaatattcttattaatgggactgtaattctgaattcttggattgaaatatatcgagaccaagaagcatttccctgtcactgggtggttccagtattatcatcaacgtgcatattaatatcaaagataggtattatggcagatacgatgcttaattctggagatttagatgatgacgaaaatgaagattatcaaaataaatatcaaatttcagtcctaaattcgatcaggcagcaaattgggaaatttagaggtgacgatgatagacaagctgggtatgtaattttgatgactgaaagcattaagtgttgcatgcaattaagaaatatgcaaatggcttcaacatttttaaaacatatagaatcatccaatattaatcggaatagagttccaaaaggcccaatggtattattttgttattttctagggaaattgtatatgcaacaagatagatttgttcttgctgaagaacaactaatctgggcatttggaaacagcggaaagaacaatcaattaaaaagaaatatacttgaatgtttgatacctgtaaaatttaggttaggatttatccctaatatttcactgcttaaaaagtacaacctagaacactattttgagatatcaaaagctatattacaaggtaatattaaacgatttgacgctgcaattgaaaaatactcatcgttatttataaatcatggaactatactttgcattgaaaaagttaagtttattttatataggaatttaatgaggagaattcgcaattggtgtcgtaaaaatcttaaaggcgatccaaataaactcacattttctgtttttgatgcaggcttcaagtggcagtcagatgaattatttgaccaacaggaaatggcatgtatttgtgcaaacctaataaaattaggttatattaaaggctacatttcttgggagcatcaagtgatagtattttctgttaatgatcctttcccaaaattaagtaacgttaaaccatag

SEQ ID NO: 2071 - DNA, 459 bp, Cryptosporidium hominis
atggatggcgcaacctcatcaggtaaaataggtggtaaagttggtggcaaggttggtggaaaaggaaaagcaggttctggtaagggaagtaagaagcaaccgacttccagagcagctcgtgcagggcttcagtttccagtcggccgtattcaacgtatgctaaagcatcgtattccaggagattgtcgtgtaggttcaactgcctctgtttacgcagctgcaattttggaatacttgaccgctgaagtactcgaattggctggtaatgcttcaaaggatcttaaagtcaagcgtattacgcctagacatcttcaacttgccattagaggtgacgaagagctggattcccttattaaggccacaattgcaggtggtggtgtaatacctcacatagaaaagtctcttatgggtaaggctttaatagggaaaaaaggtaaaaagggtaatatgagtccatga

SEQ ID NO: 2072 - DNA, 258 bp, Cryptosporidium hominis
atgatttctgatcttataattaaagaagaagttgggccaggaaatgtccctaaggctctatttatttcatcaatagaagaatttgttggcgatagaccagtttatggtatattagaaaatattcagttacttaatagaaaatataaaataatggaaagttcaataaagactcaacaagaatctcttattgccaagattccagatattgaattggcaatagaatcggtttttcaaagaaaaaaattgctggtacgttaa

SEQ ID NO: 2073 - DNA, 2772 bp, Cryptosporidium hominis
atgaataattcttatacatatcctcttggaataagttcttcagatctacagatttcaaaaaaacataatatttttggcgagccaccgccagactatgttcctggaaaaggccgtggtgctattgggtttgcaagcggagtcagtagagatgatcaaacaattacaattgaggctgatgttggtgattattctgataccaaatttgataaattttctggctttaatgaacatctattcaatgatattaaatacgatgatgatgatctgcaagcagattcaatatatgaaatgattgaagagaaattatctatcagaagaaaaaaacaaaaagaaaggaaacttagagaggaaattcttaaggtaagagaacataggccgactttacaagagcagttttcaggtcttaagaaatctttgggggacgtaaaaattgaagaatgggatcaaattcctgagccaggggactattatattaagaacaagaaaccaaaacttttcttgcccgtaccagatgaaattgtacaatcttcacataagaacttgtttgaagctctaacccaaaaagactgttctaattcagaattaaacactgaacttactactgaattgaatgaacttggaacagctaagggtaatatcctttctttgaaattagatgaggcaatgggcagcgtttctggacaatctgttattgacccatcaaaatatctcagttctttaaacacagctggtattaaattaaatggagatctatctgatattaaaaaagcaagactattacttaaatcagtagtaaatacaaaccctaaacattctccaggttggatagctgcagccagattcgaagagttcgtaggtagaatttcccatgcaagagaaattattgcaaaaggttgtgaaatgtgtccaaagaatgaagatatttggctggaggctattagattaggaaagccagaacaaatagacaaaataattgtgaaatcaataaaatttatcccaaactcaactaaagtttggatggtggcagctaatagagagacaaataaaaataaaaagttactaataattaaaaaagctcttgaatttattccaaattcaattaaactttggaaagaagcaatatcacttgttgataatgaatctgaaaaaactctattatcaaaggctgtaaagtgtgtacctcaatctgaggagctttggctaagatatgcaagattaagcgaatactgcgatgcgcaaaagatactgaatgaagcaagaaaagtattgcctacatttcctggtatttgggtagaagcagcaaagttagaagagcgaaatggaaaagttgagaaagttgacttaattgttaaacgctgtatttcaaatttatccgctaaaagatttgtacactcaagagatgattggttaaatagggcaggggaatgcgaaaaagagggttattcaaatacatgtatttcaataataaaaaatacatggaatcttggaattgatgatgacgtagttaatgatcaagttttttcctatatagataacttcataaaatcaaataatataatatctgcacgtgctatgtttgaatcatctgcagatatgtttaagtcaaaggaatatttttggataaaatgggctaattttgaagaaaagtatggtaattttgaaaaggtagatcatgttttacaaaaatcacttaagaattgtccggaaaaacaaatactttggttgaaagccgcacaaaatcaatcagcaaatgggaatgccgaaattgcacgattaattctgtcgaaaggatattcttcgagcttaaacgataaagaagaaatagtattagaggcagcaagattagaactatctcagggtgaaatagaacgtgccaggattattctagaaagagaaagaactaactctccatcggtacaaatttgggttgaatcaatcaagctagaaaatgaccaaaaaaactatgacttgtgtatactctattgctctgagtctgtgaaagaatacccaagctctccaaatttatggcttttatacggatttatttatcgaaaagcctttcctgatcgggtcaatgaaaccttgaaaatatacgaagaaggattaaacttttgcagcgattcaatggaattgtggttttctactattgaattattaatgcttttgcaaaattggaagaaagctagaacatttctagatttggcccgttcaaaaaacaaaaatcaaccagaattgtggatgcaaacaattaaattggaaaaaaatgcaggcaacaatgagtttatcccacaaattttatctaaagcattaaaagaatgcccaaaatctggattgttatacgcagaaagcattttcactgaacaaaagcaaaaacaaaaatccaaatctttaattgctttagaacagtgtggaaatgatccttatgtattggttgctattgcaatatcattttggaaagaaaatgatttccataagtcaagaaaatggttcaaaagtgcactggaaattgataaaaagataggtgatacatggatacattatattgcatttgagttgttaaatggggattttcaatctcaaagagacgctttaaatgactttattaatgctgctccaaataaagggtttgaatggaacaatattaggagaactcattttttctgggatcagaaaagcaataagatattaatcatttgtctagagttaatatatggcattgaaaaatcttttattgtttcaaatgaaatcaaacaacttttaggattaatttaa

SEQ ID NO: 2074 - DNA, 1086 bp, Cryptosporidium hominis
atgcaaaaagcaagtgagcgaagtaaattatttgatttttatgaacaaatctttataaataataatttatatagtgaaaaaaaaacttcaaattcggcaaatattttgaatcttaaatataaaattgatgaaaaatcatctcaaaaaaattttaatctgtcaaaaggttgtcaatgtatcaataatacagatcaattaattgaattgctcaacctaaaaagctatttagactttgaaaaaaaaacttgttgtcgtgatcattgtaaaattaataaaagtgatcctaattcaggtgtagaactcaatggatggtcaagataccctttaaaaataagtaaattcgaagaggaaaatgttaaaaattgggacttgtcttatcatggaacaactcataaagcaataaaaagtatattaaaagacaagagactagtgattccaaataataaaacagttcatattaggaaaggacatatcccaaaccaatattttatttttacttcaccctcgcttttatatgcaagctttggattgtattctgcaccgttcaaaatcaaggagtccaaaaagtggtggcaaatagttgttgaaattgtccaaaaacccaactcttatgttaaagaatgggaaacaagtggtctgggtaattatgaatttgataaatatataggtaattatgaactcgaatggaaatctgatcaagaaacgggaaatttaattaaagctgttttagtgagagaaataaaaaatgtagaacctccaatttgtcaatatcctgttggaacatactttttgcatgatgacagttggtggtatcaaccatatgatgggagtgctcccttttgtcctaatgaaatatcttctaattgcgattgttatttgaaacgaggggctcgaattaaaggaggaacttgtccagtagttaattatagatttagtcaattaaagaaaagacagatttgtacatcggtagaaaaatatttgagatcgctttcattattaaaatcaaatgaaaatgaatcattgaataatttcgaaaaagaaatatcgcaaaagatccctattaaaacaagtcaagcctatatttaa

SEQ ID NO: 2075 - DNA, 1116 bp, Cryptosporidium hominis
atggaatcaaatacggtattttacaaaaaacctagcaatgagacagaagaaataaggaccaaagtaaacaaaagaggactttctaagacaaataatacaataataccaaataacaatttgagagagggctttattcctcttatctataaaggcgtgcaattaattagctattcttatttacttaatacgagaagtgattcaaatagttcaagtaaggtttcaagtattttgagaggaccaattgcaggttcaattgttacacaactaattactggaactgtttgggacgatcttgattacttagttcttgatttcccaccaggtacgggcgatattcaactttcaattgcacaatcaatagcaattgatggagcgataatagttacaacccctcaagatttaagtatcgcagatgtggaaagaggaatacatttatttaataaattgaatatcccaattttaacagttgttgaaaatatgtcttacttcatctgcgatggatgcgaaaagagacacgaaatattttctaaaggtgatttttccttaataactgagaaatatgggctcgagccaaacttcaattttcctttattttcaaacctttcgaaatgtaaatttcattccaattcaaatgaggttgactttccatatgttattgctgcaaaaaaaaatgacagtgtatatttagagtttgtaaaattatcagaatttatagcaagaaaattgtctaagaatagatacagtgactataagccaaattttgaatttgataataatagaaagatagttatctgtcaaataccgaaagatattaaggaaatttttgtacaagaaaatacaattgatccattggtcaaatttaatgtttcatatattgatattaggaaattatgtagatgcgcaatatgttatgatcctgggaaggctcaatttaatgagacatatgaaccatctacattattaattaaccaaatcgaaactatgggctcatatgctattatgattaattggtcagacgatcacacaagcatcatttcatataacaatcttataaaaatatttgtaaataaagaggacgaagttaagctatgccaaaatgaattgttaacttggtga

SEQ ID NO: 2076 - DNA, 1224 bp, Cryptosporidium hominis
atggtaacatgtgaaacaatcattcaaccagaaggaggaataattgctcatttagaaataaccgaaagccaatccaatcacaattttcttattgaaagtaatgatttaaatattaaaaaaagattaccttccccaactcaatcccacatcataaatgcaaatatttctataatcgcagcaattttatcgattgaagtcaagaaaatttatgaagttgaatttatagacaatgttgatattattgaaagggacagaataattgagttacttaaatcattacaatataaatccgttggaaagtggttttcgcatacgtccttagcaattttagaattaaacattacaattaactacaataaaagcaattccagatcagaaataaaagacaatagattaaaaattagccaatattttcttacgctttcgcaagaaatagtaactaatttcatacaaaattgggctcctctattatataatcatgatttttggagtaaatgttacgtgttattttgcagaaatataataatcatttttttggttaactttactttaagaagcgaattggacgaagagaattgttttgaaatagctgaagaaattgtttctcttcaatctattatatcccattttatttccgataataatatcaaaaatctattgtctaatgatatcaagatgatccaagatttccgaagagttcttttttcagatgtaaaatcgattagggaagcaattaacttttctattaatacgaaaaatagagagccagacaacaatgagttattatggaagtctatcaatgatttggacaatatgctatttaccgttcacattcttaatcgaatattatatatctttaataagtcgaattatttttcaattcaaagttttactgagcaatctaaaatttcaaaccctcaattatcaactatcttaaattatttattatttattaaatttaataaatacccaacgtgtgaatcagatacagacttatttattattttcaatgtatttaagcaaaatgtaactagcgaatatattagtgatccaaaaatattgccatcaaaaattcgaaactatatcgatacaattaaaggagaattgaaaacctgtcattcatgtttagatggttttatagatatagaggatttagaagtgatattaaattatatcgaggaaaattgtcagagttacaattgccgctcatattgctctaattaa

SEQ ID NO: 2077 - DNA, 498 bp, Cryptosporidium hominis
atgaatgggaaatcaaccggagtatattccactaggacaccacatagacttaatagaataggcatctctaatgtgaagattgagtcaatttctggaaatcgcatatatatatctgggatagatttacttaatgggacacctattatcgatattaaaccttatcatatatgcgatatcattgataaggaagaattattgtgcccaagatgggtcttggataatatcgaaggccaatttaaagtttctatcccaaatgaaattttgaataagctagataaaataacagaaaaaaatggtttgctttcacaagaaaaaattaacatgcacgaaaaaaagcttaatgaactgaggtcttttgggggcaaatggccatttatattttttaaatcaaggatagaatttctcgagactgtaactcaatctctatcctatgatgtaagatgcagacaaaggaaaataaatgaggtaagtatatttgctttaaagattactcattaa

SEQ ID NO: 2078 - DNA, 576 bp, Cryptosporidium hominis
atgaaaagcaataatttaccacctttttgggttgacttacaccttgaggcacaggaggagctaacgagagcaaaagaattaatatcacttttacaaaaaactcaacaaaagaggctcatgtgcgtcctgaaggataatacaatgagattatttgaaattgaggtggattcattgacatattctatttgtaaattatttaaacgaattgaaaatctagcccaatctatttcaaactcacctgctgaaagcaaagaaaatttaccttgcaataaaagtttaattaactatatgattttgaggaaaaatgctgaaataagtattgcaaatgaactaaatcctttatctcagcagttcaaatttatacaaaaaaattatatgtcagaattacaaaaaaattatattaaccgtctagatggagttcaaacaaattttgaagattctgtcgtaggagaacaagaattcactaaaactagttattcttgttctcaaacaaataatcagagcaaggaattcatttttaaagatgcaaatggttttaatatcgaggtaagttgtgaatataataatgacgattaa

SEQ ID NO: 2079 - DNA, 597 bp, Cryptosporidium hominis
atggactctggaatttcagagaacaatttatttttacctgaattgattaatatgatggggcctttacttagcggaacactttttccctacaataataatacagagaaagcaaatgcaaatttgctttttaattcaattaaagaaaaaagtaaaacaatgataaattgcttttcaagcgttccttcacatcaagtaaagaattttttaatgaattttgaagatgataaaccgaagatttatttagataataagcagtttgttttgagcttcaacagaagagatgatcctaattcatggatattctcagataacaactcaaacggtaactctaagaaacatatattaattagcgacttaataaaagatattcaagacgataaccattggctaggggagatactccattcagaatctaaaaggattcaaaatagagtcaacaaatgcaaaactagatacggcgcaatcttgaactttttaatcgcaaattcttctgctataccaattcttgttcaaaataaaaataggaaagagaacacattaaatgtctgtaaaagagtatatcagggtaattattgctataatacagaaaataattaa

SEQ ID NO: 2080 - DNA, 597 bp, Cryptosporidium hominis; identical to SEQ ID NO: 2079

SEQ ID NO: 2081 - DNA, 378 bp, Cryptosporidium hominis
atgtcaggtcagagagcaaatacactgcataacctgaaggtatatatcattggcgatgaggacaccgttgctggatttctgctaacaggtattggagccagggatcctcaagggaaaacgaattttttaatagttgactcaaaaactcctcaatctcaaattgaggaaactttcaaagactttataagccaacaggactgtggaatactgatgattaatcaaactattgctgaagaaattcgataccttgttaatactcatgacaaaatcattcctacaatattagaagttccaagtaaagacaaaccatatgacgcagctaaagattctgtaatgcaaagaattaagctattttacggcggttctcttccagagtaa

SEQ ID NO: 2082 - DNA, 636 bp, Cryptosporidium hominis
atggtaaccacatttaaaaaagctgatagtatacttattgagaagtgcaaagccgaagagaaacattattcttcttgcacgggagttgtattattgtttattaaagatatactagtgaatgcacatattggtgactcacgctctgttgcgtgtacttattcgaactctatcaacttggcacagtttctaacaattgatcacaaacctgaccaaccgctggaatatcgaagaattgtagaaaatggtggttcagttgaatacctacaaaaccacaataacaaaccatttcttaggggtggagactttacccggagaagagcaagaggtgaaactccaatgcaactacaatattctagagcgtttggaggtaaagaccttaagccatatgggctcagttgtgttcctgatatttctattattggtttaaatcaaaataatagactatttattatcgcaaccgatggaatttgggatttgctttcagcccaacaaagctgtgacttgtctttttactcgcaagaacttggaatacaacctgcgaggtaccttgtaaacgcagtgcttgaagaaacacgcaatagaaatacaaattgcgacaacctcacagcaatatgtattatgtacataaaaagttga

SEQ ID NO: 2083 - DNA, 858 bp, Cryptosporidium hominis
atgtttaagtatgcatctcaatggttgtccgggtttttaacaaataatgacattatccaaaacggagatcctctctacagaagatttgttgtctcaagctcgatatcaacatctaccaatttttcagttgactatgcagcattttatgacttcttcgaggatggaaatttggatattatttcagtttcttacccagaaaaaagtggtaaagccaaagtttcattgaatattgcgtcatcagataaccctaatctttttgttaaagtttctgtattaaacttcccagttatatcgaaacaactctctggaaattcaaaaaaagtaggaactacattttttggtgctacagtcaaaatcagaatgactggattggtaggagacgatattttaatgactgcaactcaaatgtctcattctacggggagagttcttcaaactccttttgtactatttggtttgggaaagacgaacaattatatagaagagctatatgtaggaacgaactatatcaacagaaaattgctttcaggaagtgattcaattttagaatatagacaactatttagtgatggagtttcaagatggaatactggaagtgctcagtttacttactccaatatttggacaggtctcattccaaacactcaaataattgcgcaacttaacccaatagatgctccacactactggacacttgttctttctgttagcccacaaaagactataagaggtgttctgattgtgtgtacgcttgcgctgctcattattggcataataatcattatactggatagaaaagaaaaggctgaagatatgaaagaacatcagggcttcaaaagtaactttatttccgcatag

SEQ ID NO: 2084 - DNA, 1548 bp, Cryptosporidium hominis
atgggttgtactccttctaaagggaaagttgaatttacttcgcggaagcgtgaggaaaacgaaaaggaagtagaaattaaatcagtagaaattaaaaatgacctacaagcaactcctggaatgttcattacatcaaaaaaaggccatctatcagaaatgtatcaaagagttaaaaaactaggttctggagcttatggagaagtgttattgtgcagagacaaggtaactcatgtagagagagccataaaaattatccgaaaaacttcagttagtacctcttcaaattctaagttattggaggaggttgcagtattaaaattgttagatcatccaaatattatgaagctatacgatttttttgaagataaaagaaattattatcttgttatggaatgttacaagggtggagagttatttgatgaaattattcataggatgaaatttaatgaagttgatgcagcagtcattatcaagcaagtattgagtggcgttacatatttacataaacacaacatagttcatagagatttaaagcctgaaaatcttttattggaatcaaaggaaaaagacgcattgattaaaattgttgactttggtctttcagccgtttttgaaaaccagaaaaaaatgaaagaacgcctaggcactgcatactatattgctcctgaagtcctcaggaaaaaatatgatgaaaaatgtgatgtttggtcaattggtgtaatattattcattctattagcaggttatcctccatttggggggcaaacagatcaagagatactcaggaaagtcgaaaagggtaaatacacatttgattcacccgaatggaagaatgtttctgaaggtgcaaaggatttaattaaacagatgcttcaatttgactctcaaagaagaatttccgctcagcaagccctagaacatccatggatcaaggagatgtgcagtaagaaagaatcaggtattgagctaccaagccttgctaatgctattgagaatatgcgtaaattccagaattcccaaaagcttgcgcaggcagctctactttatatggcttcaaaactaacttctcaagaggaaacaaaagagctaacagatatttttagacatatagacaaaaatggcgatgggcagcttgatcgtcaagaactaattgatgggtattcaaagttatctggagaagaggttgcagtatttgatttacctcagattgaaagtgaagtagatacaattctaggcgctgcagactttgatagaaatggttacatcgactattcagagtttgttactgttgcaatggatcgaaaatctttattaagtaaagataagttggagtcagcttttcaaaaattcgatcaagacgggaatggtaagataagtgtagatgaacttgcctcagtttttggattagatcatttggaaagtaaaacatggaaagaaatgatatctggaatagattcaaacaatgatggcgatgttgattttgaggaattctgtaaaatgatacagaagctctgttctaataatgaaccccagctcaaaaaaaattag

SEQ ID NO: 2085 - DNA, 5613 bp, Cryptosporidium hominis
atgcaagtacaaaagaaaacgacagaatatgtgaccgaactttccaagtatgagtttcgtgaactccttggcgaagggtggaaatacaaaagtcataaggttttagattttagtggtcaaaattttaaactgacaactcttagaggtacatcagatggtttgatgaacaaatacctaaatttgagtgaaattgagaccatagacttaagtaataatgatttggttagcttagagggcatgtttagtatggacgactctttgaggttttattccttaatcaacttaaatttgatgggaaacaaaatttcggaatttgagaacccaatttctctaccatatttaattaatctcaatttaagctcaaacaatttgtctgaattacctgatttaacatgtttagaaaatcttatgtatcttaatctttccaataacaatattcaaattaattgttctggtaaggaagcttggaagaacataagtaattgtaataagttaagacggttagatttgtcatataacaacataaatatattgccaagtaccttaggaaggctagctttgatgtttaaagattctataagagaattttccattcaaggaaatccattttgtagtattttcccggaataccaatcattaataatctcttgcttgcctaatttaagatatctcaatggtcgtgagctgacagctttgcaaaggaagagaaatatgaattttgacttcagccttattaataactatgatgatgtttatgaattaagacaagggagtagatatgatgctacaaagatcctagaacttggaaatgtaagtagcactaattatgggcgtattgacatactaatagagttacttgaatatttaattgatgaggggccaactatccagctttgtgccaatattcttcaagggtcagagagtatttacaatgaaaccatgaagccatggacaactgactacggaggtgacttaggtgatatcgatccttttgaagcaagaaggtttatcaaagtattcagtccttctgcgagactacctagtgatagagccagagaaactgaaagatttttggaactttttgcattagcaattgaccggcaggaagaaaacccaattactcaaagttctgacttttgcagaatttggctattaactgcattagtcagactaattcatataccatcaggaggccttgcaattggagtttccaggctacttggaggtcttatgaataagaaagatgttcaaagtgaagttagttatataataagtactttagttttcccagctcttaaaggtcggcatttttcagatcctatagtgcaaacagtatttgcatctatgtcgattcttccacacagcaggctattagcaatggcactaaatgaccacatgggattgatactggattatacctcatcttatgttagaacggagtttcatagaccattaatgtctattttggcactagtttctctttacaaagataatgcaatcatattatcaggttatggagttcccatggatcttgctggaacactaattactttatatctttattcaactcctgcaaacataaataaaggtggatatggagagatgggaaaccaaggtcaatcattaacagtaaatataccaaaaaatgagcaatttttcagatggtcatcaactgaacatatattgtctgaccaggcacttgattatatttctcgtgagatttctgcatctggtcagcttggaagaggagactcattttcaatccacaagattgctaaattactttcaaaaaaacgcaataaacagcagactatttacaaaggcaagcagaaagagactttgagctcaaacattctaccagattttgtcaaatttacagacttccagcagacattaattattttctacctaaaaataatccggaattgttgtttagcttctgaaaaggcgtcaaaagcctgtgttgatttaggattgcactcaaattttctaatgccaatactgtctgaatttttatccagtggactcacatcaaaatttgatgaaaagacatcgatattatgttcagaggtgattcaaactgtaaattgctttgttgaatctagcaaagtggctttaatgcaaatgattgtcaattttcatcttattgattggatgttaataccaataaaagaaattccatttggtgatccggatgttgtatttgcttgtatggccacgttattaagtatctgcaatagaaatgagcaagttgaatctatacaatatatcccaatatctgaaagttcatcgctgatagggaaagctctcaacatatacaatggaaacatgccacttggaactcaatttagaatatttggtaatggcgaatcatttcaagttctcaactacattatccaacaaatggattttttaaatcctcagttagaatttctaaacggaaaccaatattttagagaaatggtttcattttacagttcaaatattgaaggttcaaacagttcttcagaaggtatattggagatattaaaaaatgcaaactcagaaaaagtccaaaaaagtattcaagcaatactgaacatgattgtgtttcttttcaagaataagacaatagggatttgctcaaaagtaattgaagagatttataaaagaggatattgtattctttttatgagactacttgagattccgggtgaatcggttcctatttcagcaatccagatactctctatgatagatatcacagaaatggatgcaatatctataaatgaattactaagacttttaaagatagagtcgcttaataaggatggaataaaaaaagatgaaaacggagatgatattactttgtctgaaaataaagatgtttctagttctgaaaacgatctaacatttagtattttgggacctctttggacgcatatacttaattatattcgcaggctaataaacaataaagatagtagtaattggcatattttcaaagaaacatttgcaaaagacattggtttaatcatattcctaggtctcaaatattcctggaatcaatttattttgaattccccctttaaacttgtagttaaccacttaagcaatgtaaatgaggttcagacgcatgatatgttctcaattctttcttcttctagagttataagagcattatctagatataaaggctttagagaatacttaagaacttctgaaatacagtccctattcgaatattctctgaaaaaagaggaaaagcatttcgctgcttttgatcccgatactgcgttggaaatttcatggccagggaggtctgttaatatattgttgggtacattgaaaggtcaaaaccgactttcatcttcaaaaaaggttgtagtcagagttttatgtagattggctgatgtattaactggggtctctgatgaagaattatttgagcttgaaaagtcacagcttgattacgcattgcaatttcagaaagagaccacctcgcctattgaaggaatctctacattggagagtatttttatgaatattatttcaagggaatcaagtatgtgggatttaactttagaaccttttattgaacaacttttatttttggatgaaatggagttttctgataaattaattcaggacgaaatgtttgttgaagctgatggaattattagagtttacttatttttatcaaatttaattgatatttttttcaaggatatcaaagaatcttcaaatggtttaattgaaaattttgatcacaaaaaatctgtaatttcaacagcaaatacttgggcaggaatattaaaagggtccattttatcaaaagaaaaacgcgtttcagaaaaaattgaagaggaggaagatgatgattcaacaaattacaatgaaagagatagagagaacaaaggatggagaaatatccttaacttccaaggcagtaaagtagtaggcgaagaattagaagatgaaattgaaaatgaaactaatttgcccttgctttcaggaagcgatgatcaaggaagcatgttatcattatcagattctgatattgaaattgaagaagttgcagatttggattatgaagcaaatcctaacgaggaaacagttattatccatccaagagcaaggaatattctacatggcgtctacaacaaatatgggccgctaactactggatctatagaaagtgatttaaaagtttctaattctttaagttttgataatattggaggtgcaaactccagtaactcaattagtttaacttctgcatctttaagttcatctgaaacggtaaaagctcaaaataaattggaaggatctggctctgtttggaagaacattatttctgcaacagtgaatattcatctcgctgtagcaccatttttgagaataatatttgtatgcataaaatcaaatacgagcttgaaactgagaagttatgcaaagaaagtcatgctgaaaccttacattttggatggaactgcaaagctggtactaagttgtggattattagaatcccacgtagcttcaaagttcctaataattttaagtgatatttttgagcttgaaacaaatactaatgcagcatctatggatttattaatacctctatatattggattttggtttattaactcaattttggatgccattgtctatatattacagcaagcaacaagaaggcacttaaaaccagaagagcaactactttgcacttgcttatgtaaagcaatatattcaatgttggaattattgggaaatattcaattttctagagttgaatcaataaatgaatatggactagaaaagtctattcgatattttattagtcctctacttttaaactgtctacaacagatggtattatttgatattcagatttctattggtagtagtcatggtacatacatggctcatattccgctaatgttttctagaaaatacatacaagaaaagaaggaggaaatgccagaaaccatgattaaattaagagagtcaatgagacaatatagttctaagtcgctatctctgcttatggaaaaatcttccagatatagatattatgtagtagagggttttacatttcagacaatttttagacattttcctttgagacgctcttttgtctttgagttaatggatcatgttaataccttacatttttcaaagggagtggagctctttttatcatattattacgaaagaaatgaaagaattattggggtttatccttgctatgtatttatacagactaaagagctaagagattatgtgaagaaggaaagaagcaaaaaaaatgatgaatcgaataaaaaaggcaatgatatatcttcaagtatttccgaattaacagggatcaatttatccgggattttaagtgggagtaattccgataatgaagaccctgggcctcctcaaagtataagaagcgttttaatattaactacaaacgcttattatatttttgaaagacccaaaaccgtgagaaatgtagtggcaaacgaacaatttaagtataaagaggatccaattgcgataattaaaagggaatactcggatctaaagagaattgttagaagtttattgggcgagcaaacagcaatgcttggatggaacctataa

SEQ ID NO: 2086 - DNA, 1281 bp, Cryptosporidium hominis
atgcttaatcgaatcagaaaaaagtctgccgagtttttgagtattccgttgaatatatataatgattttgtgagtagaatttgtttgagccatttattaaggattgacaatgttagaacaatacaatttgctttaggtgaaaaattaaagccagaagaaataaacaatccaaaaatagataagttatattctttaaggcccccagatttgaaaaaaaagaagttcttcattgatgaaatgatagatacagtttctgatttaatttttcctccaaagcggaagagtagatttcccatttctgcgtatccaagggctgcaatgctacatgacgcagaaaaggcacaactaaagttatatgtagtaacaattaatagtgtatatgagtttcttgtagattggagattttggttttgtcctgattcaaatatgctggaaactggtgaggatttatattttagaagagaaatggtaataccaccaagcgttgaaatttctaatttaaaggaagtaagcgatagcatttctggagctcaaaagcatggactaatgaattttttgggaatattggataaaataccgaaccaaaatgtagatatatctgaagataaatttcaagggaatgatgaatcaatcgacaaaaataatgaagagaataaaagctcaaaaccgggagccaatacaagaaaattagagaataaatccattgggatttctttaaagaatttcagatctgaatttgctgcttggtatgaaacaaggctaaagcttgcaaaggaaaatttgttccaaaaattgcgtgtatttaggattcaccgcttaagaattgcacaatttggcccactagaagaaccagaagtcaaactagtttatcaattatgcccaaaaaagaaaaagaagaaaaagaagaaaaagaatcaatgggagaaatccaaaggtgatgcggaaaataatgcaaaagctaaactttttaaaccaacaagtagtgatgaagatcccctactaggatctgacgaaagcgatggagatgtcagcgattcaaaggatgctactagtaaagaaagaaagaagctgtctaggctgacttctcttcagctcatttttctcgatgactcagcgagagaaagattcaagataggtattgcgatagtcattaatgagcttgaaaattccaatgattggaagagaagaatggttcctgtactcaatcctccaaatctcaataaagtcaatcaaaagaactacaaaaatgataaatcagtattttcctcattcttactttaa

SEQ ID NO: 2087 - DNA, 1614 bp, Cryptosporidium hominis
atggatacacctaaagtaaataattacttagaaggcaaaattatagcaggtagccaatttaataataatttttcacccaatgagagaacaaactattcaaatatagcatcaaatagaacaaactttactagcagagcagaaagaaggggatggagatcttctaaatggcgtagcactaaatttagttcagaagcatccgaattctcaaatagaaatggctcaataaatccaatagagagtaaatctcctaaatttcaatacccagagttatcagaaagctttaatgtaattcgagggttttgtttgtgtgaaggatacaatttagagagtattagatccgcccttgacaaacataactattgtcactggtacgtggataaggaaaaaagtatattagtctttgatttaaacccatattttgataaaattgaaattacttgggcaactcaagggcgactaggaaaggttctttttcctgctggtatatatccgtcaattaaaatgatactcggaaggtctggtagaaggcgtacaattgaggataatcctgaaaactacatggttggttgtgatgaaatgaccaactggaaagggtctaaaaaaaaattctcgaatattgaagatagagcaaaattattagattccagatatgcaaaacaatactccagttatgaagaatattctctatttcagaatgaaaatccatcaaaaccagtcatttcttctaaacttgaagatatttacaatgacgaaataatagaacgaggggagtgctattcaaacgatgaaaattattggaaaaggcttgaaaatcctatttttatatttaaaaatggagtaatcgtcgcttggagcaatgaagaagttacatcagactctctaacgcatttgaactctccaaagcattcagatgaaaggtttgaagatattattacattcctctctctatattcatttggggggtttgttggaaaatactccaaaaattgtcagtactacactatgctttttaattatggcaattttgcatacagcagattttatagaaataaccggaaagtaatttctgatattgttactttgaaaactagaagctcagaggagaaacttgcagcctcccttgcaattggtcagagtataagactttctttgtttgaagacttcattgaggattgtgttgaaaacatcaagtatttgccactaaaacttgcccaagttggagcttctagcgttattgaagaggaatttaaggtagaggttcctcaagtaaggaaaagattttctgaattgtactcttatcaaatttcagttaatttagttgaggattttcttgatatacctgaaattttttggcataattataaatttcattcagtttggaggaatctccaagaatacttggaaatttccgaaaggcttcaagtccttaacagacgaatagtaatgatgcaagaactcttgaaggttattaccgaagagtatcaaactacacatgctaaccgattgacttggattgtaatcattctgttagctattgattgcttcttttccttttttagacacatcttattgaaccatccacataatgtttcagaactagaaaaacaaaattaa

SEQ ID NO: 2088 - DNA, 1647 bp, Cryptosporidium hominis
atgcaaagtaaagtcatttttaggatcttggtattgaccatttcggttattggatccttatactcaataattcaattaatgctaaaagagctatcaagcaacaaaaatattccagaggttagttattcaaggaggctaataagtgaaccttacagtgaaagtattaatgaagaaaatgatcaagattggaaagaactaaagctaataattccaaatcattctcaaattgatcagcaggaaaaaaatggtgatttgattgagtttaaagtttatatatactcagcatattatgattggagaatagataggatacgaataaattcacttatcccattgaatttttatgatcgaatagaaatggaatgcgcaataatcaagaacaaaaatatttacacaggaactattaaaaaagtgattcataaggagcaccataataaagaatatgtatcatcgactttactctgcgaaattacaaaaaatgaaattgaatttgaggatatttcagggaaagttttgatagcaattttggaaaatggtgacagcacaaataaatcagaaatatggataactctaaaaaaaattccaaaaaatagctctaataatcatgagctgagtgtttgtgtgagaccttggtggggagagccaatacagaatggaaacttgggaaataaacaaaaatttaacaattcagggttaatgcttgaatttattaattcatatttattcttaggagcaaataaattttatttatatcagaattacttggacattgacgaagatgtaagaaatataataaattattattctaatatcaaaaatgttttggaaattattccatacgcattaccaataattccatttaaacaagtttgggatttcgcacaaacaacaatgatacaggattgcctactaagaaatattggaaaaacaaaatacttgttattcgtagatactgatgaatttgtatttccaaacttgaaaaattacaacttaatggattttttaaatttattggaagcaaacaatccttattataaaaataaagtcggggcaatgtggattccaatgtattttcattttttagagtgggaatctgataaaaataatttgaagaaatattcaacaattgagaaaaaaattaagaaaaagatggaaaatattgagtttgttctatatcgtaaaacatgtagaatgttaagttctggaacaaaaaaaagtgataagacgagaagaaaagttattattaaacctgaaagagttttgtatatgggaatacatgaaacagaagagatgctaagcaaaaaatttcatttcattagagctcctgtaattaatgtgggtggaggaaacgaactaagtatatatttacatcattatagaaaagcaaagggtattgtaaacaatgatcccaaacaaagagaacttgtgaatatgtatttagaaaatgcttgtttagataagctgttagattcagagggagattccattcaagatggggtaattgtcgacaatactgtttgggagatatttggaacacacttataccagataatttttgagcatattaaagaaatccaaaatatgtacacaaataaggaaatgattagtggaaataaaagtttaagtgttgaagaattacataattaa

SEQ ID NO: 2089 - DNA, 828 bp, Cryptosporidium hominis
atggggcaggatattgaaatggaaaaaaaacatgactcagatgatgaacgcgaagattcagaagcttttgatgctgctgcggaagacgattttgatgaatatgatgttgagcaacaaaaagttgatgaatccagatttctgcaaaaacgatttgaatttgaggttgattatatgaagaaacttagagtatgggaagcttctttttttattcatactagtgaaaatctagaaaacacaccacaagaattcttctatgttattgaatttgggcatgttaatccagagagaaactacgaaggaactttaaagagaatgatggtttacacagctgcaactttattaaaaccaggagaagtaaaagtattaactttcccgattatcgtttggccaaaaaagatcttatatatatcatattctgaattagagatgtttcaaatatccattaagctctggacaattggaacgtttactttcaaccaactgcttgcttcagtcaaacttacactcaaagatgtactggaaaacgatccagaaacccatttaatgtttaaaaagcatcttcctgcacctttgggaaaggatggcaaacctcgtaaagattttaaccaaaaaagttttgaagtgcatagaagcagagtaactttacagttacaagaaatttttgattttgatatttccttggagaattggagttttattcctaataagaaacttcctattgaaattaagaaagcacccaaatttttgagactaaaggtacctttaaataatgatataacttcaggaatgtcttctaggagtaagttgaaatgtaataaatttctttaa

SEQ ID NO: 2090 - DNA, 864 bp, Cryptosporidium hominis
atgaacaactttggaaataatacccaaaaatttgtcaaaaatcctgtaaataagtcagcaaacccaaataaaatgagttcttatcattcgtttttcgataactcatatacaattcaaactaatgaaaataagacccaagctttaactaaatctctgaaaggagagcaaaaattcaatgtttcaaatattcccccaaatattcattcgggtgcaaatataatttcaaaatcgaaaaataatgagaataatagctcatcatttttcttaggagaaattccttcaaagaaaaataatttggaaactgatattaaacaaaatatggagaatgaaataattgaccttgaagaaaaaaaattgttagaaaacgaaaaagaagatttagaaaagatagaaaatgacataaagtattggaatgctctagttgatgatgaaatggcagataatttggaaattgaaccagaattgccggaagaaggggtaaatttgtctaaaattgggatgagggcaaaaatctctaattggaaaaaaccagaaaaggaaaaggatagggcaaataaagattctcaaaaagaaaatattccggagcaagaatcagaaagtaaaactaccataaaagagggcgaaaaatcaaaaaataatactcaagccaaccctgaatcacaagatattgatgaggatgaagatattgaacctcctccttggaggaaattgaatagacccttaaaatacattaatgaccagattttaaagtggaactggtattacagaatggaacagctttattacgattggcaaggctatttttttcccaacatttcctatgtcaacatttactggattccctattcatttttctacagctga

SEQ ID NO: 2091 - DNA, 639 bp, Cryptosporidium hominis
atgaaattatttttgaaatgtaaaaaacatttaattttgtattttaatttaataattttttccataaaatctgacaaaagtctatcaaataataacaattttactccaacaaaagactttggtacattattcaattataaaaactttcaagaacttaataaaaatataccaaattcgggagaactaaatttatttgctgaaaacattcaagcaaatagaatttatgaaaaaaatgatttcgagaagaaatttaaaaccaaagaaaagaatagtgtaaatcgtacaagaggatctcgtacaaatgaactacataaatttagcaaatattggttgaagaagctcggaataccaaaagaagtaccaccttcagcatggtgtaatgaagatggtgtaattgtgggtataccaattactaaaaatgtttctaagatattgaatgaaaaaattaaatcaattaatggtagggaggttccagttattaccgaggattttctagacaatttttttgagcaaaattataatgggcaactctattctaaaggtttaagtattgcatgcagcggaaaggctgtaatttcgaattcattttacgaaataagtggtaagtttgagggaaaaaataacaattccaaaaaataa

SEQ ID NO: 2092 - DNA, 1479 bp, Cryptosporidium hominis
atgtttggtatgttgctatcatcaatcttcacagctggcataaaaaataatataaatgtcccaaatgatgaagatgaacatatttttttcaataaattggatgtgaaagataatggagaaaatacagattatattagaaaaatttatctttggccaagctattgcgaatacaaaacaaatttaactcagcaaaatgataatcaatcagttaatacaaacgaaaaaaccgggatgagaacaattgaaaatgaatttgaaagaatgtctattatagataatttcaatatcatagtaaaaaacgggtgtcctgtgcagggagtcaagttaaatatacttgtgaatattgaaactcttctaatattttcactatcagatgagaaatggagccttcttccaaatatttccaatcaaaacataacaatgagatgtgcaattaagttatacagacaaaagcaaacattagaatctcaaggatgtttgccttctaaattagatgaccccaatacaaataaaaatttatatattaattcagaaccaaaaaagagatggacggattttaacagggaatttaacaataaagttgaaagggaagagatcaaaacaaaccataaagaatggtcagagaggaaatggagtgattattttaatacaccaacaagaagaatgcttatggaggggcgatggagttttgatcctaattcaagactagatcaaactgaggttattaacattcaacctaatactgttggcttgcgttctgaaatcactggtaaatcaattttgaacactccgaaaattggaagagaaagtatcagtggaggatcaggtaataaatcatatttgttattcaatagggaaaatgctgaaagtttgaatgaccaaaacttacaaaaaaattttcctgaaagtcttggtaatggagaaaatgaccaatttgtgtcaaaatcggattcaaacttgtatagtagaagattgcctagcgagccaatgatacattcagttttccaaaacattttatggagagattggttgataagatatgcaccacttgtcggaaataatggtaactttgtgagagttggaaccaattttgcttttgcttttttaggagaatcttacgttgaagaagctgctactctggggttttcctacgatagggcaattttatcgtatttatcaggaaaaaggttagcccaacttggcagatttttaacttttggatatacccaaggtttatacggagtaagagttgatagatcttcaacaattaacgcatggggagttgatttacaagctagatactttatttcatcaacattggtttcttttggtttaagagaatatgcacaacatatttctgttagagaaataggtctatctttgagacatagtttctcgcaaaaagaggtagttgtgggacagcaattttcaacagaggtaagtttaatggtttattgtttgctatcaaaatttcaataa

SEQ ID NO: 2093 - DNA, 1689 bp, Cryptosporidium hominis
atggctccttcgctcagaaaaaaaccaattgaattaaaaggcattgaattattaagaaaccccttctataataaggggttaagcttcactatggaggaaagaaaggaatacggacttgaaggtttgcttcctgcgaagtatgaaactatcgatgagcaagtttccagactatggactgcaataaacaaaattgactcgaatattggcaagtacacttttcttgagaatatcagaagttcatcctttattcttttccactctcttcttgataaatattttaaagacttggctcctttggtatacacacctactgttggtgaaggttgcatcgaattttcaaggaatccaaccattaggaattggctaggttctggcctttacttgaataaatctcataaaggacgcatttatgaaattttaaaagactttaaaagcgatgacatagaaatcattgtattaactgatggtgggagaattttgggattaggcgaccttggtcttaatggtatgggtattccaatgggtaaattatcattatatattacattgggtggaatagacccttctaaagtattaccaatttccttagatatcggtacaaatactaatgatattttaaacgataaatattatttaggtatttgcgaaaaaaggatagataatgatgaatattttccattgatggatgagatcactaaagcaatttttaaaaggtggcctagcactgttcttcaatgggaagaccttacaacttcaagagcaattgatattttggatatctaccaagataaatttcgttgttttaatgatgatatccaaggtactgcaagtattgttttagcaggtttagttagttcacttaaaattgccgggaaggatttcgaagatcaaagaattctcatctgtggagctggctctgcatcaattggtattgttaatttaattattaaatctatggaaattaagggaataccttatcagtctgcattggagaaattttggcttgttgattctaaaggattaataaccaattcaagagatttaaatagtttagacaaattcaaagtgccttttatcaggaaaaatattgacaagagtataactgacttggtagaaattgttgaattggttaaaccaacaattttattgggtgtttctggccaagggggaatttttaatgaacaagtaatcaagactatggcatcaaatgttgaaagaccaattgttttcgctctaagcaaccctaccaataaagcagagtgtaatgcctctgacgcgtataaatggacgaatggtaaagttatttttgctagtgggagtccaatgaatcctatcaaggcaattgatggcactgagtttattccatctcagtgtaacaatatgtatgtgtttcccggaattggtcttgctgctcaaatcggccagctttcccacattcccgatgtttgctttattgaagcggcatactcagtttctaactttattcatatagattccaattctaatattttattcccaccgcttactgcttctgttggaagagaaatctctgcatcaattgcagctgatattattcttagagcaaaagaaatgaacatcatcaataagagtgtatgcccagatttacctttggataatagggaaaacatcctcaattatattaaagatagaatgtggcttccttattaa

SEQ ID NO: 2094 - DNA, 273 bp, Cryptosporidium hominis
atgtcaaaaacaacaactccaagtccaaaaacaagagaagcattaaacaaaattgataattataattcattcattaggtggaaaagagaagaaccattcagagtttatgatatgtggtatgatgcggtaaaagaaagaaaagatgggagaaattcaatcagaagagaagcaatcaagcaaagagatagagtattagaagaaaaaatgaacaaacaaagagcattttattcacctgcaaaagaaaaatttgatgatataggaaatgtaagttaa

SEQ ID NO: 2095 - DNA, 1413 bp, Cryptosporidium hominis
atgcaagcattaacgagcaacgaaggacccacgacacttaataacaatgtagatgatgatattcaatacatttggagaaggaattgtccatatctatatgatacaatgctatcttatacattggaatggccaacattgactattgattggctcccaaattcttataaatcagcagatggcagttattctgttcacaaaatcatctatggaactcatactagcgaccaagaacctaattatttgataattgctgaagttcatattggtgacttggaagctaatgatgatttaatgaatgttgaaagctttgctgaatattcatataatccagaaaacacaaacatgaatattgttcaatttgaggtaaaggcaaaattaaatcacccagaagaagttaataaggcattacatatgccagaacatccatttattattgctagtagagttgttaatggtgatattttagtttttgattattctaagcatgagtcattcccaactgatgaatttgtgcatccccaacttcttctaaaaggtcactcaaaggaagggtatgcaatggattggggaaatagtacttcaaatgattatttgatctcaggtggaagcgatcgcattatcaatctttgggattttaataacaataccaatgggattctgaactcaagtgcaaaaaaccattttatctataataataaagctgatccagattcacaagaatcatctgaatattctccacccattttggagccaatcaaaagtatctcctggcacaattctgatgttaatgacttaaaatggcatccttcttctctatcagtatttgggtctgtgtcagatgatggaacttttgccctttgggatctaagaagttcatccgaaaattctccaagcctatttaaaaatacaatatccggaatcaacactctttcttttaaccaatttgttcctaccatggtttctactggtaatttggatggaattgttcaaatctgggattttaggaatcttaatgaagaactattttcatttaactttcattctaaaaagcctatcatttgcatggaatggtctaaatggactccaaatatcttaatgacaggaggagttgataacaaggtagttgtatgggatttatataaaaaccacaatcctagtgaaaataacgcatatttacaaaatggtctcgaaaatatcaaccagaacaaccaatcatatgaagatcctaacaaggctcattctcaagaggattcccttgatccaaatgctatttttattcattatggacacacagctcctattacaagtatttcatggaatccaaatgagcacggagaccctcttctagtagcatccgcttcagaagacaacactattcaattctggcaattttctgacactttccttagttaa

SEQ ID NO: 2096 - DNA, 1419 bp, Cryptosporidium hominis
atgtacacaatttcatctataagaagtagcaaattttccaaccaagacaatgatgagacagacgaatttgtttcaaaatacgtcttgggacacaatagtgatcgaaacattgggattttcaaaggtgctttgaactcgatgattcaaaaaggcaacttttcttttggaggaggaggaggaggagaaggagaattaggacaatatgaagatgattttgatggagggtctcggtctgatcgcaaaaaagaaccaaagagtgaggatgacagtggaaataatactaaaaaggaagaaattgatgatgcagataatgatatgaataatgaaatggatggagatgataaagataaaaacgatgatgatgataattcatcggtagaatcttcatcatcaacttccgaggaggaaaatggtaaagatgatagtgatgaagaaactgaaatgaataatggaaaatttactgaagaggctaatgagaatgatgagtctggaagtgaagaagatggagatttagttaggaggagtttaaatggaaggaataattttactggtgaaaatctaacggagaatgattcaaaaataccatgcataaacttaaaaatcttgactaaagatgtattaaaacatgtcattgattttaacattggtagaaaaaccaatattttgagtattaaattggggtggccagttataagatgcccacattatattgatttcttacctgtcttaaaaaattgtattttaaggacaaatatccagtcaatttcatgtttgaaaaatgcaagaattactaggaaccagaaagaaacttcagacaaaagtttgtctcagtttgaagttactgtggagggaaccaatgtagggcatgtttttaagatttcgccacgttacattaatcacgataaaattagattcaatgatattcaaacagtatataaatattatggtgttgaagctgccaggcattgtattatcaacgagttaaggaacgtattttcagtatatggaattaatgttgattatagacatttgactttgattagtgattcaattacagcaagtggaaaattaagagtattcaatagaatgggaacaatttcatacaatatttcaccattcttgcagatgtcatttgaaactagtatgaaatttttgacagaagcatgcttaaggggagctttagataatttaaaaagcccagcaagctcaatttcagttgggaaaatggttagtgttggtacagggatttctcgtacatatactaatttctaccaaaatagttttggtggaaaaagaaaagataaagatggatccattcaaaaaaagatcaaggataaaaaagaaaagaatgatgatgagacaaagaaaggtaaaaaaacaagtaagaaggaaatagaaagctattttaagtttctttaa

SEQ ID NO: 2097 - DNA, 897 bp, Cryptosporidium hominis
atgactgtcaattcattactccctacaatcttaaatggaggatctgtttcagaattattccttaatagcttatctgagacaaatatccaaaaacttactagaatttcaagtgattcaaaatattattcagacaacaattattctttcaaaggaaaaagaaaatcaagaaactcgttagttaataataaatatagtgctgaagaatacgaatccatgttaaacatggagaaattgcttcgtctaaagtatatgaaaactcaaatttctccaggagaagctgtaggttgtcttgctgctcaatctattggagaaccggccacacaaatgactcttaatacttttcacttggcaggtcatggtgctgctaatgtcactttgggtattccaagacttaaagaattacttcagacaggaggagattcaaaaactccatacatttttatcccattattgaaagatattaatttaaagaaagataaatcatccaaatttgctgatgaagaaaatgacaataaagattttattaattatgcagaaaaggttttggactgtttcaaatcaatcccattgtcagatattattgaaaatgttggagttgaaagttcaatagtatatgatgaagatggaaaatttaaatcatcccacaaaaaatctgcatattgttggaattacgaaatctctatccaattttcagatttggaagtattttgtcaatctttacctcattacaatatgtcatctttaatgaatttgactctttcaaaatgtattaaaccttttttgagaaatgtaagtttaattctgggagatattttaaataattattattggaagttattgttatttattataattcggaggcattcgttacttttttttataataattaaactttaa

SEQ ID NO: 2098 - DNA, 1335 bp, Cryptosporidium hominis
atgacttggaatactaatttgttagaaagtaagctaaaggaggctgaaagagtgtcatggaagctcttcaaaactggaatatgtaaatgttgcgatcctaataagctaattaagtccaaaattctgacaggtggtttatctaatattttggttttaatttcaatttcaatagattcgttttgtgaagatatgaaaagaataaataagaatattttgattcccaaccttaaagttagattttattctgaagaaagaaaaatctttgtaaatgaaaaacgtgaacaattaattcagaatttacttgcaaatgcaggaatcattaaaccaatactacaatattttcaaggagggcaaatagaagaatttgttgaaggcaggactttagaagtagaggatcttagaaatcgaaaaacatatattcaggttgcaaaaaaaattgcaagtttacactcaacaaaaatttctcaagatattttggaaaatatttgtttggaatataattccgaaattcatcaaggcttgggagacgtaccgtattctgaatctaacaacaagtctatatccattttatggcccactctggataaatgggcatctctttcggaagaatcttttaaactaaatcatggcaaataccaaacttgtattaattttgaaaaattaagaattcttatctgtaaattaaagaaaagcctatattctgacactctttccaaattaacttgctcaattgttgtttctcattccgacttactcccaggaaatattattgaaaccttgaataataattacacttttattgattacgagttttctggtacaatggaatgtgtgtttgatataggaaatcatttatgtgaatgggcaggatttacttgtaattgggaatatctgccaaatgacgaaacaatttctgaatttttaaagtattatattgcaggtctatcaagtaataaatttaaagaaaacagatttgaatcaaagaaagatgaagctgttagtaatactaatttaggtattaagaaagacgaattagaaaataattaccaatgtattaatcatgaaaaaaaagaagcttttgaatttgaaaattctgactcatctttaaccattaaatcttacgtaaaggctgtaaaaacttgtatggttatttcgaatatcttttgggggttgtggggaatttgcaaatctgacattagatcaaataactcttctaactcagttttcgactacaggtcttatgcatacagaaaacttgagtcaataaatacccaaccgtatttccgagatatattaaaagggattgatcaagatattgaattccctgtattttaa

SEQ ID NO: 2099 - DNA, 1200 bp, Cryptosporidium hominis
atgaacggaattagaaaagtaaacaatacatcagagcatatgcacaactatggaggcgataaaccattaaataatcctttcggagcacgcgctaatgtttctggttttcctgagaacaattattatagcaataacccctctatgagttatagccaaaatggacatctaagtggccaacagatggatttttataactgggatagtaacaccaataatagtttcaacgttggatctggagcattttcattaaatacaaatgatgcggattcaaatactttcaatacattcaacaatggcaaccaacaattccctgcctttagtaatgataactatcagaattacaatgctccagaaatgaacagtaatggattaaatggtggatttggaggagtgaataacggaggctctatcccaggcaataatatgcttaatttcgggaataatacatcccagcttgtgatgggtattgtgtcaaataccgttaaagagacaactggattaaattctgagaagatcagtcaactccagctttggtttccacaaacaattgcttcactaaggtcccattttgcagtaagccatgagtatgtaataaagaaaatacttttgattatctgcccttacatcacattttttactcaaaataaaagaaaatcattttcttacgaaaaccatactatttcctctaatgcaaatgatggaggagtgtgccttccaacacttttctccgatctttatattccattaatgggatttataacatatattttggcagacggtgtaattaatggtgtgttttctcaattcaatccccagatgcttggttcaactgcgacattttcaatagtgctattaataacggagataattcttttccaattagtcgcctatatttttgccgcaagggttttatcaactttggacctaattagtactttgggatacaagtatacttcgattgttctgtgtgatttcgcactcttatccacaggtggaataaaaacttatctcttttgggcactttttatatacttttccatttcatcttctttattagtttatatgatgctcaaagtaatatctacacgaagctttagcaatcaattcagcatgattcaacagtcgggccttacgattgtaatcattatttcatcgttagtccagattccgctttgctggattcttttaccttctatttag

SEQ ID NO: 2100 - DNA, 1509 bp, Cryptosporidium hominis
atgacgacacttcaaacagagggtggtagcagtggaggtcctacggtacctgctaagatattttgtggaggattaagtgatgtcacaacaaatgcttcattgaggactcatttttctccatatggtgagatagtggactcagtggtgttaacagagaagactacaggcagatcacgtggatttggttttatcacttttgcctcagaggaatctgttgatgcagttttatcttctcctcagattgttgatggaaaagagatagattgcaagagagcagtcccgagaggtgtaattcaagcaaatgaagcagatgaatctgcagatagcaataatcaggctagtaataattcaggcaatactaacgcgaataatgcaaatatcagtggaaatagtggaagtaatactgcaaatagcaattctaatgtaactggaagatcccatattgggggtgcaggaggttcttcaggaggttttagtgcaaccaagatatttgttggaggacttcctcagagttgtactgatgagaaacttagagagcattttgggaaatacggtactattaagaatcttagtgttatggtagatagagatactaatagacataggggttttggatttgttgagtatgaatcaccggatgcagtagaggaggttatgaggcattattatgatcatcaaattgataataaatgggttgagtgtaaaaaagctcttcctagagaaattatggcaggaaactcaaatcaatctaattcagggggtcacgccccctcattaggaaatcctagagttaggacgaaccctgcacttgctgcagcatctaccacagccaattcaaattatgctgactattacagaaacccgtacttacctgtgcatgctggcggtgttccaagccagcaaatttatggaagatacggcaggcatgaccctaggtatatgtacacagggtatgcttctggatactcatcaaatatttatgccactgggggctacggccaaattgcccctcctatacaccatgcaactgcgcctggacctcagtcttctgcaagtgtatcggtgtctatgcctccagtaattccaaatttaggctcccattatggagacgtttcgccagagcaaactggcaatctccaggtccaaactgctggatcagcgggggcttctaatgcatctaatttgaacgcaagtaatgtaagtaataataattccagttccgctccaaattacgacaatcaggaagactacctctcggagcaacaaggggtatctgattcaaatgttcatccatatcatcatcctgcaacatcaacagcaagcacttcatcagctgccgcacctggagctcatccacctagacctgctataccccctccacatatgtatgctccaaatatggcacgccctggaccatatgctcaaggaaggtatgcaccttcaggagctctcccatattcggtacccggtgctgttccaacccatggaaggctacgaggtatgtattga

SEQ ID NO: 2101 - DNA, 2199 bp, Cryptosporidium hominis
atgagccaagcaaatatatttcgaagatttttcagaaggatacattaccagcttggaagtacattcgtatgtaggaataagctcctctatttagtgctagcaattattttactctgggcattatctttcacaatagtacaccagctagttatatcaagtacaggtaattatatgtcttcttcggttagcaagagtttaaggggtattagtgggagaagcatgaaagtttttagatgcttaattaagggtaattgcattaatactactaatgaagacattaatgtagattttatgaagctagttggtgagtctgattcaagacatcaaagctacattattaaattaagaacaatgccagataaatataatcttacaaattatggtaatgttaggaacttaacagaaagcactgcaattactagatattttgataatttagcatttgcatccccagaggatactggaatagattacaacactgatttggggcttactcttgtaaagcgatatgacctcggctcaaaattacttccttatattgaacacaaagaatattcagcgttgttttcaaatacttcaagtcaatatttaaattcacttgcagtatttgcaggttataacgatttaagacaacatggtatccttggtatttttccgaatggtactactccttttgcttttattgaaaagcctccagaaatcaataaaaacaacgaggaggattttttagcaaaaggaggcggtttcaacagacaattatccgattttctttctttggatagagttccattggaagttagagaccctatttgcagaaatatgatttacccgataaaagatcttgatgatgcgtccatcataattactttttacaatgaacctctttctactttattaagatcagttcattccgttttaaacaatacaccaccaccgctactacgtgagattattcttgtcaatgacggatcagatatgattgatttagttccgggcggttttcttgacgattatattcgacttcttcctaaagtccgagttgtccatttaactgaacgtaaaggtatcgtaggtgctagactaagcggtgtcagggctgcttctgctcctgtgattgtaatactagatagccatattgagacttcgagacagtggctcgaacctcaacttttaaggcttaaagaatcaccgaaatccgtggtaatgccacaaattgattcaatagacccggttaactttgcatttagcaatttttcgggtattggatgcaggctcgggttcaaatactcaattttagaacaggctacattaactggtcctataaatgatactactccgataaaatctccaatgatggcagggggtcttttcgcaatgaaaagagactatttttggcatttgggtggttatgatgagaaatttaggcactggggtgccgaaaatgttgaaataagttttaggatatggatgtgtgggggccaaattgaatgcactccttgctctagagtattccatattttcagaaagaaaggcgttgggtacagttcacctccggaaagcttatggcacaatagacttcgcacagctagagtatggatggacgaattctaccaaataactgaaatgcttgcacctaatcctaatattaaacttggttcatttgatgacatgctacatcttaagaaaaaacttaaatgcaaaccatttagatggttcttggataatgttgctccagaaacttacataactcaattggaccatctacttttcgtgggggaaattaggaacaagaaactaaataatatttgcttagactctatgggagggcaaaccgatggtgacaagattggagtgttccattgtcatgggaaaaaaggtactcaagcatttatgatgtctaatcatacacaacaaattcgtattgtttctaaggagagctattgcataggatctaatttgaagtatgctgcatgctctaatagtgaaataacaaacatttggaggctagaaaatgaaatgattaaggctaatgttgagcccaataagtatgtatgtctttcattgactgaagacaatgattcctcgacaaagcataaggcagaactattggactgtgatccaaatgatccaagccagcattggaatgtaaacaaattcaaacctaaaaaatatattcctttaaagctatcatatatgtag

SEQ ID NO: 2102 - DNA, 786 bp, Cryptosporidium hominis
atgtcttcagcagaccagaaatgcgtgagctttgatattgaaagagcagagataatctcctcttatcctatgagcggtacttgccgttttgttgagttcaatagaaagtatgataatcaagacaagtttgttgttgctgtagaccaattctatccagagcctcgtcagttacttataaaaaaagtcggtgacccaaatatggagggcgttagaattacaggaatcaacagcagaatcacacgagctcactggggtatgtttgatcaaaatattatttctggtcatgaagatggaggtatttacatttgggatatcaggcaaagttcggaaccatatgaggttcttagagcccattctaagttactcacatgctgttcattctctgaggatagaaccttaatgttaacatgtagtcatgatatgacagcaaagttatgggatatggtaaacttgaaggaaattagaaagtatacaactaatcgtcttttgaatggctgttctatatctccaaactttaacaaagaaaaagacccaaaaagacacattttacttggaggtggccaactcgcacaagatgtcacaacaaccggtactcaagaaggtaaatttcagactctaattatgcacatgatttatggtactgagcttggcgctattaaaggtcatttcggtactatgaatgccttagtctatgcccctgatggtatgagttttactactggtggagaggatggctttgtgcgtattaatcatttcgatgatgaatatttaaaactagacccttaa

SEQ ID NO: 2103 - DNA, 1440 bp, Cryptosporidium hominis
atgattgaaccaaaaatagcagaaattaaagagtttcaaagactggaaagaattggggcacattcccatattagaggcctaggtttaaatgatgcattggatgcaaggtattcatcagatggaatggtgggtcaaaagttggccagaagagctgcaggaataattgtaagaatggtcaaacagggcaagattgcaggaagagcaattttattatcaggtcagccaggaactggaaaaacagcaattgctatggcaattgcaaaagcaataggaagcgatacgccatttacacatatttcagcttctgaagtgttctcactagaaatgaataagactgaagctctgagacaagctttgagaagatccataggtgtaagaattaaagaagaaatagacgttattgagggagaagtagcagaattagagattgatcgttcgaatacaacaggagttaaagttggcagaatggctttaagaagcactgatatggagacagtttatgatattggtagtaaaatgattgagtcacttcaagctgaaaatattgttgctggagatgtaatttcaattaataagtcaagtgggaaaattactaaattaggacgttcttttacaaggtctaaagattacgatgctgttggatatcaaactagatttattgcatgcccagaaggtgaacttcagaaaaaaagagaagtagtacataacgtcactttacacgatattgatgtaattaatagccgaactcaaggatttttagcactgtttgctggtgacaccggcgaaattaagccagaagttagagctcaaatagatgaaaaggttgctgaatggaaagaggaaagcagagcagaaattgttcatggagttttgtttatagatgaggttcatatgttagatgttgaatgctttagctttcttaacaaggcgctagaggaagaaacaagtccaatcttgattatggcatcaaatagaggtattacaaagattagaggaactgactataagtcgccacatggtatacctattgatcttttagatagatgtttaattattccaacagtaccctatagtgaagaagatgttaagaaaattattcaggaaagagcaagtgaggaggatcttaaattaactgatagtgcttatcaaatcctcactagaatagcgatggacacgagcttgcgatactcactacacttattaacagtttctcaagttcttgcaaatagaaaaaaaaaagaagagattgatttagacgagattaaaaaagcctattcactttttattgatgttaagagaagtactcaatatcttattgattaccaacaagagtatctattttctgagattgaagattcaaataatgacgtgaaagataaagataatagcaatgatacaatggaagacactgcagttcaggagaaaatgacattaatgtag

SEQ ID NO: 2104 - DNA, 603 bp, Cryptosporidium hominis
atgataatatgtttgggaccattttgtattccagtatggaacatttttctgtttctatttgctctcatcgtcccagtaacaaattttttgaaaaggatatttctcggaaaaaagtcaaatataaaaaataggggtgagctaactattggtaatcacgagaaaatcttagaagagaaagatttagctgaaatcggtatagaatcgcacctttttagggaaaattacgagaaaatcttgaaattagtagaatcacgaaatgttttggaacttgaaaatattaatgattgggaaatatgtaagcttttaggaaagaatttggagcttcccattctggtagattactatgcagattggtgtaacccatgcaaaaagatctccaccacttttaagagactatgtaaagaatataatggtatatttataaaaattgactacgaaactcatactaatttttgctatgatatgggcgttttcagccttccaacttttcacttttggatactggacaacaactcctatattctagtagacaaattggaaagatcagattctaaagaattagagaacctcttggtaaaaaataaattcaaaattataaaataa

SEQ ID NO: 2105 - DNA, 1965 bp, Cryptosporidium hominis
atgctaagcaatgagaataatataaaaacaaaatcaaaaatctccaatatgttcaaaaaaccaattaattcgaatatagaaatccaaacatcttcaaatgattctgaattgaataatacttttgaaagtaaaatatatcatcagattaaaacatggaaagataataaaatatctaataaagacttagaagatttggatggaaagtacttggtatgcaatcttgagtttgatgagaagaaaaatattgaatttgatagtaaagaacaaattaatagaagaatgaaaggaagtatattaaatccattgatgttcagcttttcagatacagaaactccaaaatttgaacttaaagaacttcctggtgataatttgaataatataattcaagataatgttaaaaaatctcaactaaaacaaatcaatcacgtgaatttaaaggtaaaactttcagtagaaaatctactaaaattaaatgaaatactcagaataaatctagaaagcgaaacaccaactgttgtgtcatcttctgaaactcagcttgaattggatcaaagtgctttggatgaattattttgcgatcaatatgatggtaactcttcaaaaattgattttattgaaaagttggcagaccaaattgtatctagtattaaaagcctaataatgggagaagctttattaggagctgataatgcaagacaaatacttgtcttcgagttgaaatcgcttcagaaattgtttattgaagataaaaaagaagagatttctaaatctattgaatctttattattgcaaactagttctgatgacgatattcagatgttaatttttaagatagaccaaatccgttctgcattgaaacattttaacctttcaaataggtttcaggattttaatttcggatataacaattcatccaatgaaatagaagatggagaacggacactacaaaccaatcaagcaaataacttttttgcaaagcataaacttctaaagtttaataaatggtgcaagcaattgaatacttcatcagagaataatggaagcaatattgcaagtggtgaaagtaattcaaacaatcatcgtctcactcatcatcatgatgggcattctcatcaccatcatattctttcacactataagcaccaccagcatcgcaatattagtaatagcaatgaaaaaaatagagacattgtaaaaagagaagaagagtttgattctcctcatgcggaaaattgtgtccaactgttttctcctgacaattatgatggctggaatacagaaaattcaaaaggtgtttcattatcatacaaaatagattcatcatcaaatgaacatttgtctataaatgtagtaataaagagtgatattaattgtaagttactgaacttacttacaatattgaatgaagttgaactttcaaatatgtgggtaccatatatctcttattcaaaatgcttttacaactttagtcgtgtaagcaagttggtacaacaagtatatgatcttccatggccaataggacaaagagaaaatatcatgttctgctttggagtagatacattaaaagaacatgactgcattatgatttcatgtggggatcctcaaacttcaaataataaattctttggagctaatattcccgatccacctccaaaagtaccaagagagaaatgcagttatcttctgtttatcctaactccttcagagaatagtaaggacctcactactctggaaatgttttctagtttctctgtgacaaagtatgttccgattaaacttacatcatttttgattaaaagaatgactaggaaaatgtatactgatattacagccttagcttcgaatattaatggctccccttatgagactgcatataataataacttacaactctactcgtggctagatatgaagctatcacaatatgaatcgaagcaaagaaaaaatgacaaagatttcatatag

SEQ ID NO: 2106 - DNA, 303 bp, Cryptosporidium hominis
atggaaaagatcttagaaataccacaaatacaagaagaaattgtgtggaaagatgtggttgttccaaacatccagccaagatatattgaaactgaaaaaatcgtagaaattcccgttgtacaaacaatagaaaaattggtacatgcgtcagttcctcagtataaaatgattaaacaagatatcaatgtcccaatcgtagatatcaaaacagttccaaaagattgtgtattagaaaaattgaaatatgtgcctgttcctgttgatagatatcaagaaagtacaggtgccaaaatatgtacttaa

SEQ ID NO: 2107 - DNA, 1308 bp, Cryptosporidium hominis
atgggagagttagtgagttttgaaagtagccgtctaatagagtccattcgacgggatggtgtacaggcaacattggatctgatagatacattagatagtagtgaattatcgaaaaaatgttcagttacgaatgctaatgcaatattttatgcagttcaaagaacgaacgatgatgaagcacttcaggtttgtaagaagattttggagaagtgcccagaactagatgttgcatccacagattttagcttacaaactgcattgttttttgcttgcagggatggaaatgtaaagacagctgaatttttgatagataatggctgcaacgtcaatcatactgatagagtaaatcagacagctttgttttatgcagctagggatggtaggtttgaagctgtaaaacttttattggataaaggcgcagaaccaaatctttctgacaatgttggccaaaccgctttattttatgcagcaagagatgggagatctcaaacatgtatgttattattggataatggagctgatgcagggattaaggataagaatagacaagcagcacattcttatgcattaaaaagtgggaataaacaattggcgaatatattaaaaaataggatggctagttctggggtagcgggaatgggtgctaatgcatttgaaggctcaggtaacttagaaaaggatgccagccttgatagagtatctttgtgtaattctattgtgggtgagggaggaattaaagactctgaaataagacagtgttatagattacaatttaaggggagcgacggaaagtggtatttcgctccaaaaataaaaattgaggaatttgaagaaaaatttccaaacattgcagtttggtcaaaagagtcaccagtcgcaagtttgaagccaaattctgatcctttcagagcatcgtggtataaaactatcagtgaatgtgttgaagagctcagaaaacaagagggtgcctggatttttgataagccagttgatgagaaagcttggaactgttcagattattataagattattacaaagccaatggactttagtctaatacgcaagaaacttagaaatggtgagtacgaactttgtagggaaacaatagcagatatacagcaaatattttctaattgttatctttacaataagccagattcaagtgtttcaattctttgtaaagcgatcgaacaacatttcaatagtttgaaatctagtaaagatattgattcgattcttaataaagaagctgagctatttaatttaaagagcgaagtgaatataaaggaagataccaaagtagaatga

SEQ ID NO: 2108 - DNA, 717 bp, Cryptosporidium hominis
atgtcagaaaatgaagttattgataactatatgaaaattaagaaccaaattaaagagctttgctcagattttgaaagttttcccgaactattggttgtaagtaagtaccagagtgaggaaaatatcaagttactgcatgagaaaaccgaccaaaagatatttggagaaaattatgtacaggagttgatggaaaaatctaggaatttacccaaatcaattaaatggcattttataggtcacttgcaaagtaataaagttaaaactttattatctattgacaacttggaagttatagaaacagttgattcaataaaacttgcgcaagtgttaaataaagaatgtcagttacaaggaagatcagttttgaaagtaatgatacaggtaaagacttcaaatgaagtcaacaaatcaggagctaaaatctctgaagctttaaatatttttgaatatataatttctgagtgtaggaatctcaaatttcaaggtttaatgacaatgggagattcagatgttaaccttactagtgaatgttttaataagatggtaaatttgagaaatattatcaatgaaaagatttcaaagaatggtaactatgatcagtctattgaatgtaggctcagtatgggaactacaagagatatggaaatagcaataaaaaatcatacgaatgaaataagaattggaagtgcaatttttggagataaaaagaaaggttaa

SEQ ID NO: 2109 - DNA, 681 bp, Cryptosporidium hominis
atgagtacaaaagccaatgattctggaaatactggaggttcaagacaaagaagggataaattactttcggtacagcatcaggttcagaaactctgggaagagagtcaaatatatgaggcagatgtagatccatctcgtgaaaaatatatgattacatttccatatccatatatgaatggaaggttacatttggggcatgcctttacgttgacaaaagcagattttcaagcaagattccaaagaatgaataataaaaatgtattatttccatttggttttcattgtacaggaatgccaatttgtgcaagcgcagataagttaaagatggagttgaattcaccaaagttagctgaaactgatgatgataaagaacaagagacaagccaagtacaacttaaaagtaaggttgcagctaaaactgggggagcaaaaacccaatcagaaattcttaaagcaatgggtattcctgaagaagaaattagtaaatttactgacccaatttattggacagaatattttcccccgcttacaaagaaagatttaaagaattttggaactgctgttgattggaggagatcatttattacaactgatattaatccttactatgatgcttttgttaaatggcagttcagaactttgaaggtaagttttaaatcaacacttggattttttttttaa

SEQ ID NO: 2110 - DNA, 1875 bp, Cryptosporidium hominis
  misc_feature (1665)..(1667): n is a, c, g, or t
  misc_feature (1683)..(1685): n is a, c, g, or t
  misc_feature (1694)..(1694): n is a, c, g, or t
  misc_feature (1698)..(1699): n is a, c, g, or t
  misc_feature (1701)..(1701): n is a, c, g, or t
  misc_feature (1705)..(1705): n is a, c, g, or t
  misc_feature (1708)..(1708): n is a, c, g, or t
  misc_feature (1712)..(1713): n is a, c, g, or t
  misc_feature (1717)..(1717): n is a, c, g, or t
  misc_feature (1729)..(1730): n is a, c, g, or t
  misc_feature (1733)..(1734): n is a, c, g, or t
  misc_feature (1739)..(1739): n is a, c, g, or t
  misc_feature (1741)..(1742): n is a, c, g, or t
  misc_feature (1746)..(1746): n is a, c, g, or t
  misc_feature (1748)..(1748): n is a, c, g, or t
  misc_feature (1753)..(1754): n is a, c, g, or t
  misc_feature (1761)..(1761): n is a, c, g, or t
  misc_feature (1763)..(1763): n is a, c, g, or t
  misc_feature (1765)..(1765): n is a, c, g, or t
  misc_feature (1767)..(1767): n is a, c, g, or t
  misc_feature (1769)..(1769): n is a, c, g, or t
  misc_feature (1777)..(1778): n is a, c, g, or t
  misc_feature (1781)..(1782): n is a, c, g, or t
  misc_feature (1785)..(1787): n is a, c, g, or t
  misc_feature (1793)..(1793): n is a, c, g, or t
  misc_feature (1795)..(1795): n is a, c, g, or t
  misc_feature (1800)..(1801): n is a, c, g, or t
  misc_feature (1818)..(1821): n is a, c, g, or t
  misc_feature (1824)..(1824): n is a, c, g, or t
  misc_feature (1827)..(1827): n is a, c, g, or t
  misc_feature (1830)..(1830): n is a, c, g, or t
  misc_feature (1833)..(1833): n is a, c, g, or t
  misc_feature (1836)..(1836): n is a, c, g, or t
  misc_feature (1839)..(1841): n is a, c, g, or t
  misc_feature (1846)..(1847): n is a, c, g, or t
  misc_feature (1862)..(1862): n is a, c, g, or t
  misc_feature (1864)..(1868): n is a, c, g, or t
  misc_feature (1871)..(1871): n is a, c, g, or t
atgtatggccaaactaactgttggatattacccactggggaatacgatttaattttagcatttgactctccaatttgcaaatcatcagaaactactgatggtgttttgaggaaagtttatgatagcaaagaagaagcacttgctgattgtaacacagtatttatatgttctaagaaaagcgcttataatatggcatatcaaggaatagtaccacttgttagtgaaaaatcaatacccacaggtaaaagtgttaattcattacctgaggttatctctttttcaaaaattagtggagaaaaactaattggaactccattaatgcctcctaatgcatactattctaagatttataccttaccaatgttttcaatttcaatggataaaggtactggagtagtttcatcagtaccttccgattctccagatgattatgctgcttggaatgatattaaatcgaaagtaggaattagagaaaaatataatattcaagaagattggttattagatttggttccaattattgatactccagaactgggaactttggctggagaggctgtatatttaaaatataagattcaaagccaaaatgattcagctaaattaaagcaagctaaggaagaggtttacaaaaaaggcttttacgacggagtaatgatatcaggtgactttaagggtatgaaagtttcggagattaaggatcaagctaaacaaaaattaatagatgataaaaatgctctcgtttacttggagcctgaaaataccgtaattagtagaacaggagaatcttgcattattgctttatgtaaacaatggtatattgaatatggaggagaaaaatggagaaaagatgtttatgactgggttaatgatgaaaaatcatttgaaacattctatccacaagtaagaacttcattcttggaagttattaattggttaagggagtgggcatgctctagatcttatggtttagggacttatcttccatgggatactgaaaataaccaaaaggtcttaattgagtctttatccgattctacaatttatatggcttattatacaatttgccatttcttccattctgactttgaggggagatcaaagggattgatggatattcctattgaatatgttaatgatgatctttttaactatgtcttttgtttaacagatgaaccatctgaagatttaattaagaatattggtagagggcaacttgatagaatgagaaatgagttttcatatttctatcctctggattgcagagtttcaggaaaagatttaatatttaaccatctaacaatgtgtttatataatcatgctgctatttgggaggataggaaagatttatggccaagaagtttctattgtaatggtcatgttatgatcgattccatgaaaatgagtaaatccactggaaattggattacactagaggatggaattaatgaatattctgcagatgcttgtagaattgctttagctgatgctggtgatactattgatgatgcaaacttttgccgagatattgctaattctgctattatgagactttactctataattcaatctgctcaattttatgttgagaataaagataaactgagatgtggatctcaggaaatgtccaattctgaattgcaaactttccttaaagaaaatccnnncgcaataaaaaaattnnntcgggctgntccnntntttnccngtgnngttnttcgtcttgctnntgnngcttntnnttcntnttggnnttttgcntntngngntgcttccnngtnntcnnnttcctncngcccnncggtgcctcttgttctnnnncgnccnccnccncgntgnnnctccnncttttgttgcttttntnnnnntcnttag

SEQ ID NO: 2111 - DNA, 123 bp, Cryptosporidium hominis
atgattcagcattcagcacatgccttccatttgatgaatttgaacttttctcaactcaataatcaagcttatcgataccgtcgacctcgaggggggggcccggtacccaattcgcaactatag

SEQ ID NO: 2112 - DNA, 855 bp, Cryptosporidium hominis
atgaaaacaataatttttgaaccagggagaaccatttgtaaaggagggaatagtgaaaacttattaccaactgttgaagtcccatcagtttgtttcctaaaaaattttgaaaaagaaggaaatgaaaataaactttcagagtttaataatttacaagaaacaaataaaaatatccacaatttaaagagtaatattttgtcaaaagatgaattaaaaagaattgttctggttggaaatgaagcaattaagagcttggaatcaacaaatggaaatttaatatatcctcttcatagaaacttagtaatgagcgattggttactctgtgagttagtttgggagcaggtattactggaattaggagtaaagactaaaattgaaaaatttaaaaataaaaagttatcatctgaatctgaaaatcaagtattaatggttatattgccttctacaggaggaattctcatcaaagagaaagttaatgaatggctcaaagaaaattatgattttaatcaagtaacttttattccagcatatttactaactttatattcatatggtaaagaaactggaatagttgttgatattggatcattttggactaatattactccagtaattgaaggagtttctgatgataattattctttaagcattccaattggaggaagaagtttggaggaatatatgaaaatcttattatctagaagaggattaaaattctctggaaaaaaagataccaaatttattgaggaaacaaaagatgacttgctagttagaaatatattaagcgaaaattgttttgtttctacaaatgaaaaaaatactagagaaattatttcatacacaacttcatatttg

SEQ ID NO: 2113 - DNA, 627 bp, Cryptosporidium hominis
atgatatttggcaataaattattttttagttcatcaatgttgaaaaaagtatcaaagacaataaatttaacatacaaaaattcaatatttatcccaatttcttccttttgtagttccagactcttatttaacagatcaagtacctttaatcaatatttttctcctttcagaaatgataattccttcaagaatttaaattatagtttatctggaagtcgaagactttacccatattattatcacagtctgaaaaaccaatttagtaaaattaatatcagtgatttggataaaaagtctaggctattagacggatttggaaaaatgaagaatttgtgggataagtacggatatgccagcatattcacatattttacaatatatttagcaacatttattttattctggattttagcaatgaataacattataaatgcagcaaaattgataaaattgatttcagtattaaagttagataatcacattaattcttctaaaattgaacaaagaatggaaactccatttggtaaactatttatagcttggatatcaacaaaaattgttgaaccatttagattattttctactattacactcactccttatatttataagatacttaaaaggtaa

SEQ ID NO: 2114 - DNA, 2016 bp, Cryptosporidium hominis
atgttaatattcgagttgattaacaatataaaatctaaatttacttcagaaaataacttcgaaaaaataattctacaaaaccaagatagggaagtattaccagaagaaattaaagatatcaagaatagtttgccacaaattaatgaaagctcttcattatcaagagaaacaaataaaaaaaccagcttattattaaaaagtactaaaacacatttaaactcttcaagttgtgaaaataaatacaaaaacatgaaaaatcactcaaatcaaagaaagcaacaatcatccagagatataagcaagaccagaataaagtatttgaatgatataattcgtacaaaaataacaagtaagaatggaattcaagaaatatttgataatgccgcagatactaaatcaattcaagaaaagaattcatatttatctttttttgccaaaacaatacaaatatttaaaaagattatcatttttttaaaggacttgataattaatatatttattgaaaaaattgtgggttctatattttacttactattcaaagattgtagaggaatagtattaagttcatttgatcattacaaaataaataaatatattcaagaaagtaagatcccaatggaattaaaagaagagttacttagaagcatgacactttgttacacaaatattggaaatccacaaattattagatcgatcaatatttcaaaaaaagatttaatacaagatttagagaatttgaagatcattttaccaaatacactggtaatggaaaaattaaaatcaattcaagacaaatcatctttaagtcaaattgaaacaatattgcagccattttccgggattaattcacttgaggaaaagattaatgcagaaattcagtattacttaatattaaattcaattaatatattatcagatagttgtgaagccattaaagaatcatgtaaagcaattattaattctgaaagccttattgaattaattaataatattacaaatcatgatttagataagattaatttacttttaaatacaaatattgattacaatattatttcaagcattattaaatctgtagtattaatggatgaaaataaagcaggtatttggaatagattttcactaataactaattcaataagtaaagttcatttagaacttgtatgtaaattaaataaattaaaagatattgagattaatgaaatatttattcaatggaatatattaagagcaggattgaaatatattttgcatcagataaaaaataatcgtaaatcttatgaagatatttatatgggaggattacccttacatacgttacaaatggcattacattatttaaatacttcagcaagaaaaacatctgacctagttcaagaatctattatagcttgtagtgaattctgtttatactttaatttaaaaaccattgaagaattacacgaattaaatagaacttctttaggtcaatcaaagttatttgaattatgcaagagagattgtaatgatatattaagattaattcaaacaataaaaagtgtattaggagaattatgtgaaaataaaataagaattgatggaaaagaaattgatattagttatttatcatcaatgttacctgctgtaacattaaattcggagcataagtgttgtagaaaggaaacagaatccagttgtaagctacatggtaaaggattacatgacacatttagattgtatgctgaaggaaattttcctgctgttacaaacactattcagcctatccaatctaaaagagaggcttcaaaatttattccagaaaggccaagaagttcaattccaagggaagcctcagggaataaagaaggaaactcaagtattaacacggaggaaaaaattcacattggtaaaaataatgagtcatttttaaatcaaacaggattaagaaaaccaaaagaaattattagaaacgaaggaattaataataatgaagagaatttaccttttttaccatcaaccccggatgagttgatttaa

SEQ ID NO: 2115 - DNA, 1041 bp, Cryptosporidium hominis
atgcttttatctgtggttaaatataaatttactaatccaaatttttgggcatcagttgtgcatgagttatggctttttattattgtttcacaacataataatttgaaagttggggatcaatcaactgaaaaaataattaaaagtctaaatacttctaatcaatcagaaagtaatttgcaaagaaatcaaatttttccagattattttattgctatcaattatttactttcaggaatggttgacaccaaaattcctggcgtgcttagattattggttagattaaatatgatgtattattatgaatgcagaattaatacattaatattattttgcaacaatccaatggaattatgggttgattacattaaaatttcatctctacttaacaatattgattcattaagaaccttattgacttcattatcggaatcgaaagatgtggatattcagcagctggctattagagtcttttcgagtaatttgacttcaataatattctttcatctgatcaactctccaattagtttggtacatgatagaaacaatcttaagttaattacttgctatattgaatttttgaatgaatgtttattaattgggcattcaaaggaattattaagttatgtttcaacggatgaattcgtaaataaatatattgtttactcaacttttggccaaggatacaaattttattcagaattggatgcagataatatatatttagataaaagtggtgaaaatattaacagaagtaatcgagaacgaaaagaagagtattcagttgttgggtatgatagaaatcagactaacataaatttaagatataataatgagaaatataatatttgggatatattttcaattgtttgcgatccgaaatataaagaatcaatattatatccaatagtattatttttagctgatgcaatatatttttcttttgtatacgaggtcaattgggaatatgatagtttaaagaatttattaatttcaattattcagttaaacaaacatttcaaaaaagctttaatagtaagttaa

SEQ ID NO: 2116 - DNA, 147 bp, Cryptosporidium hominis
atgcaaattggtgatccaagaatgtggaattcatttgtaaaacataataagaaagaaaaagttaaagtaaccgaaaagaaaaaaaaaatatgtttaacgagagcttttgctaatacatataatattccagtgattaaacagaaatga

SEQ ID NO: 2117 - DNA, 774 bp, Cryptosporidium hominis
atgcagcttcgggagaatattattccatattttaatcaaaaccaacaaaaatttaacttcatcataccaaatattaataaaatggatactatattattaaacaatcaacttttgaaagatgaaaattttataatttttcagaattatattaaattaattccaattacgaataaaattatatataataataataataagatttttgatattactggtgattggattcctgtcagtttatcatctgatatagcaaataatttagaattcaaacaaatctatccaaattcatttgttggtaaaactgaagcttttttaaattatgagcaaggtcaattattaattgaggaaaaaatgaataaaaattccaatatttcaaataaagataattctcaagttgagaaaaatgactctgaaactgaattcattccaaataattttaatccagctgatattgttactaaagttgataatattgatgatctttttgaagatgactttgattttgaatacgatttatataacgatcaaccagttctttttggtagcattaccattaagaatttaattaatgagttgaaagaaagaaaactggatgaaattactgttaattataatgatttattccaagaagaaaaagttatatctatttcaatacaatcaattaattgtgaaattattattttttcttcaaataactttttaattaattcaaacaatcgcaaatcaagagaattaatttatgaaattatatcgtcattactcatttctgtttaa

SEQ ID NO: 2118 - DNA, 639 bp, Cryptosporidium hominis
atgttaaaagaaattgttgaaacaaaacgttcaataggtaatgatattaaagaagcatcatttgcattggcaaaggcaacatgggcagctggtgatttcaaagatagaatcatagaatcatgtaaaagaccaacagtaacaatggaggttggcactgagaatattgcaggtgttagattaccaatttttgagatgaatgttgataataattcatctacagaaacatgccatattggcgtagcaagtggaggtcaagtaattcaatcaacaagagaaatttacatgaaagtattaagggatttagttaagttagccagtttacagactgcattcttttctttagatgaagagattaagatgacaaatcgtcgtgtaaatgcattacagaatgtagttttaccaaaattggaggatggtatgaattacattttgagagaattggatgaaattgagagagaagaattctttagattgaagaagattcaagagaagaagaaggaatgggcagaagctgaacttcaagagaaactaaagaaggatagaaataactctaaagaaaacgattcttctttatacgatacaatcaagaactctggtgattcaattttggagcaaaaaaatgaaggaattttattttaa

SEQ ID NO: 2119 - DNA, 921 bp, Cryptosporidium hominis
atgaaatacagaatgtttaaaagaggaaatagagttggagtatgtatttcaggaggaaaggattcaagtgttttattaaatgtattatatgaactaaataaaagaaaagattacggtatagaattggaattaattgcggtggatgaaggaattaagggatatagggatgactctctagaagttgtcaaatatcagcaggaatactacaattgtcccttaactattctatcctttaaagatatgtttaatacaacaatggacgaaattcaaagtaaatcaagtaaatcaaattcgtgcacatattgtggtgtatttagaagaaaagcattagatattggaagctataaagttaatgctgatgttatttgtacaggtcatagttgcgatgatacatgtgaaactttattattaaatatactacgtggcgattttaatagattacgaagatgtattaacccaataacaaataatgagatcactaaaactaaagatcaaatgcaaaatcatgattctcaaaatgaagctttcttaaatataaagcctagagttaagcctttaatgtattgttatgaaaaagaaattgtattatatgcgcattatcttaacctcaaatatttctcaacagaatgtacttattctgtggatgcatatagaggagtttcacgtgaattcatacgtaagattcaaagctttgattacaaatactctttcaatatgatacttgcagctcaagaacttaatcttgaacagtctaattctagtcccaactatatagctagaaaatgtactatttgcggatacatttcatcatctactatttgtaatggatgcaaccttgttaacgctcttaaacatgataatccaaacttaattcttaaaaatcaaagacagaaaaagaaaattttattacaagaaagttaa

SEQ ID NO: 2120 - DNA, 1206 bp, Cryptosporidium hominis
atggtaatagatcaaaatcaaggtagtgatactttaatggaaacaatgaatttagagaatattgaaaataatagccaaaatattgaaaaaatatatttaagttatgttgaagatttattttctcgttcttgtttattatttaaatactattgtctacgatatccatgtttgataaattatttgtttaaattatattcaagaattgttgatgaaataaataaaaatcaacaaatcaaaagaaatgataataatcataatagtgatcataacatacttacattgttaaataaaattaaagatttgtttaataatctatttatggaaattattttactatttaaacatcattatacaagtgaaaatggtaatttggatattttaataaaagaatatttaagaatattggatatatattcaagcgatcatataaaatataattatttatttgattttattattcaaatactcggaaatattaatttcagtaatttggaactttgcttaaaagtatataatatatttaaagatacacaaaatattaacataataataccgataattggttattatgatttacaaaagattaaagaattattacctgtaataattagtaaatcagataaaccaatgattaaagaatgtatcaagaatattgttacaaatccatttgcccaaaaagataaagttatttcatcctctgatttattattattattaatatcatacagttatcctgatgtaaattatgttgataagaaaaagactgtggacataatagactgttgctttgaattaacacagagtaatccaccaatatttgattcagaaattattgcatcagtaattggtaagattgttcaagatgaaaaatcagtattcccaagaacacttggaaggactcttgtattatcagtaatgtacttaccaacagttcgttcatttatttcatcatttgttatttcttctttgataagaaactacaaagtatgggaggatactttaacttggagaggagtaaagcattgtattcaaaaactttggtgtgattataaagcttcaatatttccaagtttaattttacttccccaaatagaatttcaaggaatattcaatgaattaattgaaacaaattctgatttaagagttgattgtatggatattattaaaaaaacggtaagtttagtaaaatattatattttacattga

SEQ ID NO: 2121 - DNA, 741 bp, Cryptosporidium hominis
  misc_feature (62)..(62): n is a, c, g, or t
atggagtttgaaatatcttcagcaaacattaatgatcatgtaaagtgtcaaataaagaaganaactagtgataataggaaaaatagaaatttcaaaagcaatcaagattatttaaataatattgggcttggaccaacgcttatcattgattgtgactatgatgataagctttcggatcgaaatctcaaaagtttggttgtacaacttagtatttcttattcttgtataagaaaatctaaaatccctttaaaaatgattatatgtggtgtttctcaaagacttaaacaaggattatataaaacattggcagaatcatggcttggagttgaaatatcaagtgataaagttaataaaatagtttctgatagatattctgataaaaattcaaactatgagataatttatttatcagcagattcaaacaatgtattaacttctaagcaagaccaagatgaatatgggaattcatcaaatcaaggatttaataacaagcaaatatttattataggtggaataattgacagaaacaaatataaaaatattagtaaacttagagctgaggagtttaatattaaaactgccaaactaccaattatagaatctggaatgactttatgctcaaatcaagtgcttacagttaatcatgtaattgaatgtattgttaaatacaatgagacttgtaactggtatacaacttttgattcaattctaccaaaaagaaaaaaagataatactaattaa

SEQ ID NO: 2122 - DNA, 840 bp, Cryptosporidium hominis
atgttggaaatagatgtttggctaacaaaagataatttattagtagtattgcatgatgagaacttattaaatatttgcaacgttgataaattagttggagaatttaattatgcagatcttccaatgacaaaagattcagaatcattaacaccgtcttcagattttctcaaccgtaatgaatggaaatgttatccaaaaaagttttcatcacaaaagttaataacattagaagagttatttcaacgatatcctgatacactaatttccgtggatgttaaaaatcatgatagtagactagcagtatctaaaacagttggattagttagaagatttaaaagagagaataaaacaatgttatgttcattttctaatgagaatattgattatttaaatgagtataataagaataaaaatgaaccagaattagtaatatgtattggtaaagataaattattaaagatcttactagcatattttacaggatttttaccttggattcatatagaagaacatgtattatcttttccaatgagttatatattcttttcaacatatggaagaaagtttgcagataagatttcaaaatatttgaaattgagtaaataccaattaaaatatattgaagatgagttggtaccaaatattctagtttggttatttagtaggaagttattaataaggcatttacaaaaaagaggaataaggtgttttgcttgggtatgtaataatgaaaaagaaatgaatatatgtaaagagttagaattggatggaataatgtcagataggccaaatttactgagagaatattatataaagaataaaataaagccttttaaatag

SEQ ID NO: 2123 - DNA, 723 bp, Cryptosporidium hominis
atgcaagaatcaatacacgtaattaaagaatataaagtgggtaaaatgacgtgggatggtaaaatagtgaaagcatgtactgataaaggaaaattacaatttattaaagaatcggatggaaataaacataaaatcagatggtataatatagataaacaaattaatgaagatgaaataatagtagaaaatgaaattaattttgatataattaaggaaagtaagagtaataatgtttttgtattaaaaaaaaactccaagccattaagtatttactggatacaagatagcaagttaattttagatgatcttataaatgatttgaatactcagataaagttaataactaataatttaaatgaaactataaggagtgtacttgaacaaatgaacaataataataataataaaagaagaatctcaatatcggaaatattaacaagtgaaattattaatgagcttaagcaagaccaagatttaattgaagaacttaaagaacatatgccttcaaatcaaagaaatcttcaagatattaactcagtgattaattgtccacaagttaaatatactatgagactattggacgaatcaatatattctgaacaaatatttacactctcaactgctcttggattagatatcaattttgactcattaatcaataaaaatccaatgcaagtttttattaatgctttaaataaaaaatataatccagaaaaaaaataa

SEQ ID NO: 2124 - DNA, 84 bp, Cryptosporidium hominis
aaatatttattctattcattttattttcagttaattgaacttgatattaatttgaatattaatagagaatcagtatcagcatta

SEQ ID NO: 2125 - DNA, 639 bp, Cryptosporidium hominis
atgtatgatattgaaacaatagtagaatatttttctaatatattatttaaaaattcaaaattaataatgattggtataagtacaggtgcatttctaacattttcttattcaactaattatacaagaaaagatataaaatgtgaaaatgaatactttatttcaaataataatttaattggtataatatgtattgcatgtgtagataatattccagaaagttatatattagattttagtaatgaacaattaaatgaatttaacgaattaggatatacaaaaattaatacaaaaataccaattgttaaaattaatcacataaataaagtaaaagatgatttaaaattaatttcaagaaattatttggaatcatacaatatatttccaacatataattttctattagaaaataaagaaaaagtggttaattatccaatattattaatacatggtactgatgatcaatcggtaccttttcaaatgtcattaaatttattaaatttaaataataattttagtaataaaaacaacagatatttaagacttttgaaaattaataatggaaatcatttattatctaattcaaaacatataaaaaaagcacaaaatgaaatttcaaattttgtgtttgaaatattataa

SEQ ID NO: 2126 - DNA, 912 bp, Cryptosporidium hominis
  misc_feature (584)..(584): n is a, c, g, or t
atgactgaaaacaacaataacattattattttgagctcaagttcaagttctgaaagtgaaggcgaacaaaaaagaactggaaaaatcagaaaaatcaagaaaattattcaaaataaaacaacgatagaagaaggtcacacagaaaatggtgacaatattggatattattctaatttaagccaacataagaatcacaacgtagcattaacagcatcatcatcatcatcctcttcttcttcttcttcttttcaaaacaatttgttagaagatgtttatttggtaaatgaagaaaataatagaacaagcattgaacaattgatagaaaacaagaatgacgatagtgatgataatgagcaagttattgaagtaattgattgcaatagtaacagtattaaaagagcaaatactaatactagcagaagaaataatagaatatcaacccgtacaaatccatattcaacatcatcatcatcatcatcatcatcatcatcaagaggattattcaatatatcattaaatgaattatcagaaaatactacaaataactttcctttatttggagtatattccaatattattaattntttaaataacacaatgaattcttgtaatatgaataatcatcaaaatacgaatcaagtaatagaaaaacctgtcgaattaactcaagaagaaaaagagaaagctgcaaaattcacatgccctatttgtttagaagattgggataacattatgtcaagaacattaacaattaatcagttttttcccaatattcgcactcctgttgttattacgcgttgtgggcatcacttctgtcttaattgtgcaggaaatcttgttcaaagaaaacaaaaatgtccaaggtgtagaagaaatcttactaagaaagattttattaatttttatgtttaa

SEQ ID NO: 2127 - DNA, 519 bp, Cryptosporidium hominis
atgaaagcagcaagacaagtagttacaaatggtagtccaaaggtggaattacaaaaggatacatattttgtagaaaatcatgtaaattgcgctgatcctattacattatcagaaggaagtattaaaaacaaggtttcagttagatgctctcaaaatagcagaattattgttgaacaaaaagtcaacagtatttttattgaaaattgtgttggatgtatctttctagtaaatggtgtaatttcatccatagaaattgttaattgtgatgatattaaattacaaatgacaggcattgttccaactatttctcttgatcaatcaaataaagttaatatctacacatccaaagaaggaaagaatgttgaggtttatagcagtaaatcaagtgaaatgaatttactctttccaggagaagaagaaggtgactggaaagaacttgcaattcctgaacaatttgtcactaaatacaatgaaagtaagggtaaattagaaagtgtggtttctccattatatggataa

SEQ ID NO: 2128 - DNA, 3354 bp, Cryptosporidium hominis
atggaggcagtcttggatgaaataaaccatgaaaaaattacagagaaagtaattattttgaataatggtaataataaagaattgaatggaccaattgaaactaataatatttataattataatgaacaacttccgaaaggagattacgatgaaattatctcaagacattactcagtaaatggtaatgcaaatattagtgacaatgttttgcatccacaatttaaaaataataagaacgatatggctgagaattatttgtccagttactgtaccggagaaaatataactttgaattataacttaaatcagaatcaaaataccaatattggaactagcatttataatgggaaaattatttgtaatcactgcaattatccggtgaataaagggaataatgtttcaaataaagatggtaggacttgtaattgtatgataaatgaaaatatattaatatattataacgaaaaaggaatgcaaagtaaaggaaatcagattaataatggctgccatgaaagcattacagatccagaaaatttaatgggagcctcatcacctcaatctatagtaactacaatgtctatagcgactccaatatattctacaggtatgaataaagatattattaatatgcgaaaagatgatgaaattatttcagatatgaatggaagttttattataggtaataaatcaaatgaatcagaaaataatcaaaatatcaaaggaataaacccaaattcaacatctagctcaaatttattagctttgaatccaaaaacaggaattttaaataatattattgtgaatggggcaggaaatattaataataataataataataataataataacaataataataatagtaataacagtggtaataataatagcaataataacaataataatttggggaattctgtgggaaattacacaaatacaggagttagtgttggaaatataattcaaaatagctcgttattattatcaggatatcttagtggaactccagcacaatcaaatagtagaaagatattagcaagagtaagagaattgtggttaagcaatatagtggagggtttacccaggaagattgctgcgttcatattgcaacgacatgggaatcaaattccatatgatagacaattttggtcgtatgcttataagacaggaagattgcatccagcagaagaacaagtacaaagacaattaaatgaaggtgtacaatgtttaaatagatttattcaacaacttattaagtcctgtaatattatgagggatcatatgttgagaaaacaaaacaattcagtagggtatagtggaagaagatcaaatggagcaagaggatattgtaatcgtcgtgtttctagtagaatgaataatcatcatatgatgattagtaattcaaatatcaataataataataataataataataataataataataataataatagtggaattgaaagtatggaaatgaatagaaaagaaattaagtataatacaaatattggagaaattggaatgaaaaactgcgcaatgccaatattgcctacaatgaatgaaggagtaattggagaaatcccgaatggagatgaaattgatgaagcagaaatatcaggatttatgaatggaagtgtgggaatgacaggagaaggtataataacagtaaacgaacaaaatatattgttgtcaggtaatatattagattttaataatggtaaatctaaacatatagaaaaaagaataaatggtaatataccattaatggcaaatgaaagaaagaatgaaatcttggataatcatctattactaggtatgaattgtaataacaatacaggtaataataacatgatccatgacgaaagtaatgttgataataatttattattaaatatggatagagaagactgtaataatcgaattggagaaggtataggtagtattggtaatattgttggaagtgataacaatacaggaaatggtaatttattggttgattatacagaaggaatagaaggagatgatgatgatgatgatgatgatgatgatggacagattgctgagattccactggatttaacagatgaatatttagcaaaatggttggatggtaaaaatgcattaattattcgaaaattagttaatggtgataaagatatgcaaactatagatttaccaacatgtttaaatagtgataatttatacagagcattaagatttggtggactattagttagaataccaccatataatcaaaaaagttatgaacattttaatttactatcaccaggaagaggggatacaagacatacacaattagtaataccagatggagaaagagatattgatgtaaagaaaagcagaacatctttagcacttccagaatttcttgttgaggatattcctttaccaaaagtatgtgtttttcaaattgaagccaaattagagttactattattatatagaggttgttcttcaaaaagaccacatacaaaaagaggtcgtagtacagctaatacatcaaattcatcaaatcaatcaattcatttaaatcttggtaataacaataatactgctaatgttaataataatatcaccactaccaatacaaccagtagtaatattaataataatccaggtattcatccaaatattaatattgcaattcctattggtaattctgttgtaaatcatgtttcctctgttggtgaatctaatagtaatataagtaataatcatcatattaataatagtagcataatgaatactaattcatcatctttattagtatctgaaaataatggactgaatactgtcatgcattctggaatttcaagtcatgaaaataatattaatatcatggatcagttggcacaatctcagatgattataaataagttaattgaaaatggtcataatattaatgatgtattgtgtaacaataatattattgaaagtaatgcaaatattcataataatacacagccagtaaatgatcagatttcaataaatatgattaatgaaaatgaattattttccagaatgaattctttgaataataataatacaagtattgatacaaattcttctacaacagatacaagtactattaatagtaatagtaacggggttaatataaatacaaatgatataacaactattactaatggactaaataatagcattaacaataataatattaatattaatagcagtattaataatagcaatagtaataataataataataataataatattaataatatcaataatagtaataatggtaataatatgacaattcatcaaattcatcaagaaaatattttattgggagggaggagggattaa

SEQ ID NO: 2129 - DNA, 1044 bp, Cryptosporidium hominis
atgtcaacaataaacccaaacgaagtagtcaatgaaaataatgaaaatcaaaataatttaaatgaaacagtatataatgggccattaaaactggagcatcttcttccaagtggattaacaaaaagggatctagaaatactccgtgaaaatggatatcatacaatagaatgtcttgcttatgctcctaaaaaagctttattatcggttaaaggaattagtgaacaaaaatgtgataaaataaaatctgcatgtaaagaattagtagcaatgggattttgcagtggaactgaatatttggaagctagaaccaatctaatcaaatttacaacgggttctagccaattagatagacttttacaaggtggaatagaaacaggaagtattacagaaatttttggtgaatttagaacaggaaaaactcaattatgtcacactctggcagtaacttgccagcttcctgttgaacataaaggaggtgaaggaaagtgtttatggattgatactgaaggtacttttaggcctgaaagaattgttcaaattgctgatagatttaacttgaatgcttcagattgcttagataatattgcctatgccagaggatttaatactgaacatcaaatggatttattacaatcagctgtagctatgatgacagaatccagatttgcattaatgattgttgatagcgcaactgcgctttatagatcagaatataatggaagaggagaattagcaactagacaaagtcatttgggccagtttctaagagctcttcaaaaaattgcggatacttttggtgtcgcagttgttatcactaatcaagtaatgtcaaaagttgatgctatggccgccatgttccaaaatgataaagtgcctattggaggtaatattattgctcatgcttcacaaactagattattcctcaaaaaaggacgtggagagacaagaatttgcaaaatctacgattccccgaatctacccgaaggggatgccacattttctattacagaagggggtataaacgaccctaaagatgaaaagtaa

SEQ ID NO: 2130 - DNA, 816 bp, Cryptosporidium hominis
atgaatatgataaattcattcacaagtttaaataaatcattatttaataatccaatttgttcagaaatagatgagatctttacatcaagatatggttatattaatgacaatccagaattttattataaatcagaaaaatattgtgataaaattagcaaatataatcaagtattacatgatcatattacaaatgggattcaaatttatccatatgatttcaaattcagaaattcattatatggttatacaagccttttatattttgattctcctgatataatttcagattggtattttaaaaaatcaaaaaatattgtattaatgaataaaccatggattattcttacctttgcatttaattcacgagaatttacttatttaaaatatccattaaatataaattatttaaaaaaacaattatgtaaacgtttaactatttgtttggataaaaacaatccaaaactaagtaataattccattttctggcatttatttgatttagggattggaagtgatgaatgttgtaatatttgtaacaatcctggtactttaattacttgcgactattgttatgattcatttcataaatattgcttatataataatgaaattccaaataatttgaaaagatcacgactttcttataattataataaagttgaggaaaagattaaatgtagaaattgtatggaaaatgagttgatatcagtttattggcttaaaactacctataaacgaagaaggtacaactattttttaagacataaattacattctattccattatatattaataggataaaccctcttatataa

SEQ ID NO: 2131 - DNA, 639 bp, Cryptosporidium hominis
atggattggaacaaaaagatatctcaaagtgataaagaattacacaaacaattacaagatagttatttattaaagatagaagaaattaagaaggaagcacataaagaaaaggaaattttgaaaactatattaccatatttaaataattggaaagataaacgattagaaataagaaaggaagagcttatggatgaattaaaggtacaaagattaagatgtattaaaaagattaaggaacttaagatttctagagctaaaattagacgtaatgaagctattgaaaagaaattacatgaagaagaacaaagaagaaaagaagaagaagctaagagagaggaagaagaagcaagattacttgaagaagctaaccgacaaaaagaggaaaaacgattgaagatgcaaaggcaattagaaatgcagagaagaagagaggaggaaattgaggctaaattaatggctgcaaattctaagagtagtggtggtagtagtaataataattcaagtaataataatagtggtggatttaatgatagaggtgatgcaattagcttcacaagaggagaaactagtggaaataacaactctaatagaagttttggaaataactctagatcaaataatggtaattcttcagggtaa

SEQ ID NO: 2132 - DNA, 351 bp, Cryptosporidium hominis
atggatgtatctgaagctaatcattacaataatagtaataaatttgaaccacaaataatgaataatgcatcttcaacgtcttcctcttcatcactaaaggaattatgtggattgttgttatcttcattttgcggtattttagacgattttggtttggaaacacaagcagatgaacagatgttattaatcgcaatagagactggagactttgattcagttgttgaatatgtaaaattatttagaaataagatttcttcaatattactactaaataatattagtagagatttcagaacagatatagatataataaaagatgttgataatttacaggacggagtatatgagcaa

SEQ ID NO: 2133 - DNA, 582 bp, Cryptosporidium hominis
atgaagaacttgaacatatacgtacaattacttaaatattataagaatcaagtaaaaagtgattatatactttcccctgcaattgaacaaattattaaagttgagccctgtagaattccttcaaataacaaggaaatatctaaaaataataatcaaaatcaccacaggaatactaatattggaagcatattatcaaaattattatttaatcattcttcaagtaatacaagaaaccttcacaaaaataagtctaagaaaataccattaataagtacaagttataataataattcaccacaatcattatcgccatgttcaaaatctcattgcaataataagcaagaaaatactaaatataattcctcattaactattactactcctgttaaatttaaaaaattatataatgatgaacactcgatacaaagtactggaactgattattgtaataacgatttatttttcaataatcaaagaatatgtaaagaaaatttattttcatcaggtgaagaaggatttatagaaaatcttaatctattaagtagtcctccatcaataacatctgcaaaaagtcttaaataa

SEQ ID NO: 2134 - DNA, 1203 bp, Cryptosporidium hominis
atggaaattaattctggtttaagacaaagaaataatatggaaaaactttgtgataatgaggaaaaaatatttacaaataatgaattaatacattcttccaatgaagctacgataaattctaattctaacaatgaaagcaatttgaataataataataataataatgtatcatctgaatattattcaacaattagtatgaagaaagaaaaagaaagaaacgaacagaatcattttcatcttaaaaataataaagttattaataatattgaaaaatggattccattttatactccaaattatttaattctaatatatatttttgtaggtattacatttattacaattggaattttttttcaaattttttcaaacaatacgattgaatgtattattaattatgaagattcaccaggaaatgggaaagttatagatacaatagtagagattaaaagcgaacattgtaacccttcaatgattaatggtaatgagttaaaatatttaaaaggagacttttttatatattatcaattaagaaatttttatcaaaataataaaagtttcatttttagtagaagtgatagacaactatctggagaattaatatatgatgaagaaactctatcagactgttatccagttattaaagataaacagggaaaaatattttacccatgtggtgttgcaactcttactatttttaatgatacttttacaattttagatggtcaaaatgatccaatcgaaattgatgattctattgaaactataacttttaaatctgatcgaattaattataaaaatatacctgaacatgaattacttaatcataaatttaatgattggttaccaaaagatatattccctggtagaattgagaatcctcattttattgtatggatgaaattgtctgcattctcaacttttaataaaatttatggtaaattaaattcaaaaaaaaataaattgattttacctcttaaaatacatgttaaaaatagatatcctgtacatttttttaatggttcaaaacatattgttatttcacaaagcactatttttggtggaaaacatccttattttggtatactttatattatctctggtatattattcattctactttctatatattatataataagaaataaattcaacactaatattcttggagattttagatttttgtattggaataatacttga

SEQ ID NO: 2135 - DNA, 314 bp, Cryptosporidium hominis
atgagtgtatgtattaatggaaagtgtggaaatccaaaaaatttatggtcaagttgtcattcaaatagaacacgtcatttaggtgaagatgaagaagttaatgtaaatactggaaacaataatgaaatacaaattgagtggattgatttgaataatgaaccaaaagataataaagatagtaaaggcaacatttattataatgtggatggttttgttgacaatacaataactaactctacagaattatcaaaccaggaatctaaatctcatgaagtttctaataataatatgtgtgtagaagatcatatttgtgc

SEQ ID NO: 2136 - DNA, 264 bp, Cryptosporidium hominis
atgtggaatatttggattggtcaattatctggagaatttgttaatgaaagatgtactataggaaaagcatcttcaaaaggagattacattgttggatggttctctccatttgcaattgattctgaaactattggttcagtgaaattaaaaatgcaatggaattcaccagaagatccaaatgaaaatacttgttcattgactaatgagacagaaaagaaaattattgaatatgataaagaaactaattacgtggtggtaatttaa

SEQ ID NO: 2137 - DNA, 147 bp, Cryptosporidium hominis
ttatttaatttaaacaattatttccatttaaaaaatcagaattttaatttaaatactgaaaaaattattaattcacaattaattactcttaataattctttaaatattttgaaatttattattaatagcttaattagctctttaaag

SEQ ID NO: 2138 - DNA, 1689 bp, Cryptosporidium hominis
atgcctgaaattgatacagaaaatgaaaatgataataataataataagaaaatttggaaacctccagaaacttttttaagaaatacaacaaaatattgggtacatccaaataatgtagtttctgcaaaagttggaattatcagatacgttccatatttaatttttggtatttcgaattcagagttggagactttgttagatccttatatgtgcgttgaaggacataatgttgtagatccaaaaacaattgaagaaagtcaagcaattacatccgtatatttagataatatgaatgcagaatgttattataatagaatttcaagatttgaagatgctcaattatttagattaagatggtatggatcaaattcaggttcaaaagaaaaagaaatctttatggagagaaaaacacatcatgaaagttggacaggtgaaaaaagtgcaaaggaacgcttttcactaccacagaaatatgtttttggatatttaaaaggaaaatttaatgttgatagtttaattaaagaaggaatttttcatacaagaaaaaatcaagaaaaagaaaatgttgagaaatctattaatttagctaaagaaatacaaaattatattaataataataaacttcaaccttttgttagaacatcatatttacgtgcagcttttcaaaatcaagataataaccaagttcgattttcgattgatacaaatttatgtatggtaaatgaatatatttctgatggacatcaaaatgaaccatggtgtagattagctgaggaagtattatcaaaaaatgaagtaacacgttttccatttgcaattttagaggtaaaattacaatcagagcaaccaatttgggtttcagaaatgcttaaaagatgtaatgctacacttgtttataaatttagtaaatttcaacatggtatggctattttacatgaagataaagtttcaatatttccacattggattgaagattttcatcaaattaatgatattgatatactttcatcagcaagcatttcagaattaagttatacaaaaagtaatgatgatgaagataatgttattaataattttcaaagaaagaaacaagttttaacaaatttacaattccaaggtgaaaattatgatgaagataatagaatatctaaattaattgatattttattaaattcttatttaaatttgactaattttgatttggatggattaaagcttgaattaaatagaaatatgaatcattctcaacgcttctacagtaataataataataataatgggagtaataatgaatttatggatcagtatattaatagtattcactcaaagaaaataaataaattggatccaaaaagtttatttgcagcagaaagagtaatgttgtattgggtacgtaaaactatatatatttcaacttttgttatattattaatttcaaagactaagaaaaatacacatataacaagaatttcaacatttattgaattatcttttattccaatgattattactacattaatttttggtctaattgtttatattaaacgtattaattcaatagaaagaagaatggtaaaatcattagagaatgaaaaagaaagaatcgattatccaaaaagttcattatatatatttactacttcttgcctaattttagcattttcactaatgttaaatataaataaatga

SEQ ID NO: 2139 - DNA, 621 bp, Cryptosporidium hominis
  misc_feature (72)..(72): n is a, c, g, or t
atgatactaataaatgataaatctaataattatgaaagatgtaagatgtggaacaaattagaaaacataganatatataataagagtttaataatacccataaaaaataataaaaattatcatcttctaccttttaaatctttatttcgtcttggaattaatgaaaatattttacaattattaaagtgttatgagatctcaaacaaaaaaagtatggatgaatctgaaaataattgtgatattaaatatttcatgaatagttttactgatattattaattattatccatttaaatctgtaaagagaattattattgactatccaataagtacaaaagaattaaatatattaagcaattgttttccgtgcttgaaagatattgtaattacacgtctctttcatgaaacaaatacttataataatcattatgaagaattcactcgagaaaatagaagattaagttttggatcagaaattggttcaggtgatgatatatcatctagatatggaaatttacctattgatgatgaaaatgaatttcattttgaaaatgaaatagtcgcttgttgggaagctatttataattttctacaagttatacctccaaatcagcttagaatc

SEQ ID NO: 2140 - DNA, 273 bp, Cryptosporidium hominis
atgactttcattatctttaaaaaaaaaaaaaaaaaatcatgccgacttccccctcgttataaatctatttctttcaattcaattttgatattttccccacactctgcaaaattaccgcccacacttttaggcgggaagtgtggatgtatagtcaggaaatgcacaaagtggtcagaaaaaggagtaagagaaatgtttattagatttgttttaatttactgcagatttattaaaaaaaaagaaaatgtggaagatcagaaggtatttaattga

SEQ ID NO: 2141 - DNA, 393 bp, Cryptosporidium hominis
atatatatttcaccaacacttatttcttataaattacttgtagaatgtgcaataaaaattcaatcattacttgaagatgaacatgaacttttacaatatgaatcagctctagcaattacaaatatacttagtaaatcatttgataaaatttcacaagattctgaaaatgattcaatttctataagaatttataataatggtcttggatggagtttattaaaaagtctttgttttactgataataatttattgagagctgctggtttagaaggactttgtaatttttgtaataaagattatgttgttttaaatcattttatttcaagtaaatccaatggtattgaagatttaaaattatttattgctttttcacaagaacaaggacctcgaggg

SEQ ID NO: 2142 - DNA, 1944 bp, Cryptosporidium hominis
atggaccaaagaacaaaattcagaaatggattaaactatattaatgttaataataaatataatgaaatatccagaaatatgaatggtaatgaatatatgaatagctattatgcagatgattatatagatttaccacaaaatagtagaaaaagaacttattatgaaagtagaagaacaggaattaaacatagaaagaatgaaataaacaatacatactctggaaatagaaatattattaataattcaaattctggtattaatacttctagaataaatttaatgccagaatatgaatatgaaacactatatgttgcatccacagaaaaacaattagacaatataaattatagtaatgatggtaatggttactatcaaaaaagatattatggaaataataataacaatataaatatgaatatgaatataaatactaataattgtgataataataatgataacaatcacgatataacaaattatggattaaaacctggatataatattatgttacatagtaaaaatgttaataataatattaatggtaattattatcataagtattatgataatagtgaaattaagaaaagaagaggattaagtagtgcaagtggaatgttaaaatataaagatataggaattaatgaatatagatcatatgattctcgtggttcttcaattacatattataataattctaataaaaaagttagatattcagatgattcattagattattctcaagataatgaattatctagagaatatcgtaatagaaataataataataataataacaacagtaataataataatatgaatattattaataataataataatacaaattcagatgaaatagaacattttcaatggtatgttggacaatatttaacttcaagatatcgtatattagatattataggagaaggtacttttggaagagtttttgaatgtgaagatttaaaaagaaaaagaaaagttgcaataaaggtaataagagatgtacaaagatatacatcagcagcaaaaattgaagcagaaattcttagagatattaatatggaagataaatttggtgaatattcatattgcgttatgttatataatgcatttttatttaataactcaaatatgtgtcttgtatttgaaaaacttggaccaagtttatttgattttttagatggtaattgttcaagaggattctttcttgctgatattcagaatatttcagaacaatttttattagctttatcttttttaagaaagatgaaattaactcatactgatcttaaacttgagaatatattatttactgataataattatatatgggtaaatgctccaagacatcctggtgcattaattagaagaccagtacgtcctgaaattagattgatcgattttggtgcagcaacttatgaacatgattatcatggtagtgttattaatacaagacaatatagagctcctgaagtaattttagatttaggatgggatatgtctagtgatatgtggggttttggttgtattttaatggaactttatacaggtgtattactatttaaaactcatgaacatatggaacatttagctatggttgaaagaattattgaaccatttcctgattacatgcttaaaaaagcttataatagtagtaaatctgggaaaaaatatgttaatagattaaaaatcagtaataatattaaccaccaccaaaatgaagagtataaatatgttttaaattggccagaaggaagttcaagcaatacttctattaaaagagtgaatgactgtagacctcttgagaatttagtacataaaaagcatattatgttagccaaatttattagatatattttgagaccagatcctaatttaagacctacccctgaaatggctctaagacatgaatttttcagatataaatttgaagaagaaatttaa

SEQ ID NO: 2143 - DNA, 349 bp, Cryptosporidium hominis
atgtcgaagaattattttgataaattgaatagtggaggattacattcagcaatgccattttcttcaaatattggtataaatttgcttcaaaaaatgggttggacagaaggaaaaggccttggaaaagaagaagtaggaatgcaagaatgtattcaaataaaaaaaaagagtgataatttaggacttggtgcaaaagttacaagagaatcttctcaagattggtcagattggtggaaagatgcatataataatgttgcaaataaattgtcaacaaatattaatgattctagatatgaagatttaaattcagatgacctttctactgatagtgaggatgaaagccaatcaa

SEQ ID NO: 2144 - DNA, 312 bp, Cryptosporidium hominis
atgaactctaattcaattagggatagtcaaaaagaagctgaaaaaagagctgaaattgaaagacttaaaaaattagaagctgaaaggaagaaaagagaagaagctgagagaaaaagaatcgaggaggaaaaaagaagacaaagagaagaagctgagagaaaaatgaaagctgatataaaacgtaaagaaattatggattccttgtttgcttgtcaagttggtgataatggaaacaattcagaaaagaagccaagtctttttggtgatgaatcatcaaatactaattcaagaaggaatctatttgatgattag

SEQ ID NO: 2145 - DNA, 852 bp, Cryptosporidium hominis
atgagaaaatcactagcatctttagttggtaatattggtaatagtattggattggggggaactccatcagtacgaataagagatttaaatgaagaaaataacgaaataaatgattttgaaataagttcaaaaagaggaacatatggtttagcatcaccatcaaaaaaaatgcatatatctccgtcacgtccaatagggcttcctccgccattgccatacaatactattaataacagagaaagtgggaattcaagaaacactgataataattatgcaacagtgatatcatcatcagtagaaaatacgagaatattgactccattcaatattagaaatggaattaattcaattaaaagttataaagaagttgatgatgatggttatggtggcggtagtatatttggagaaagtgttgtaagaggaattaatgataatttaggtaataatatagatggaagaactccgcaaacaacaaaatcacaagtaagaataaaatcattaggtatgacaccaagtcgatttgaaagttcaataggtaatttaagtaataataataataaattaaatgttagtacatcatcaatatttactccattaagtacgaagacaagatttcttccaatattaccaacatctccacgaaaagaaatctatgagaatttgaaatcaaatttatcaacaacacagaatgaaaatatgttacattcaactaaactaaataatgaaattaaactagattcatcattttctgaatctttaatttcttcaacaatggtttctacatctaactttgaaagtaataactatttatctgaatcgtcagaaatattaagaaaaagattgaatgagaaa

SEQ ID NO: 2146 - DNA, 624 bp, Cryptosporidium hominis
atgaagaaggtttctacaatattttcggcaattattatatcgttaatcgcaataggggttggattagttaaatttaattacttaaatattagtgaatatggatttttagaaaaattaataacccctcaaaatgaaatacccgatgatgtaggcccaaaaactatgacaattcaatattgtgatacatgtggtacacgtaatttatatcaacaagtacaaagttatttaagttcaagagtaactgatccagattttcaattaatagcagttaaatataaaccatcaccattatatcaaggattgagttatgcaataacagcaagccaagttggcttgggattaagtgcatttttattcccatcattatttactccaacagatcaacagggtcaaccacagggtggcccaagaactcatttaatgatgttgatattttttggaggaaatattttaagaggtttatttactaattcaaatgcatttgaaatttatttaggtaaagatttagtttactcagcaattcagaataatagttctggttatgccacaccaccaacattagagcaagtcgttacaatattaaatgagcatggaattagtgtattagaaactttgactgaataa

SEQ ID NO: 2147 - DNA, 651 bp, Cryptosporidium hominis
atgattgatttatttttaacaaataactttattaaaccaataaatatagagaagatatcgatacattttaatcaaatttctttattattaatgcatggtataaataaatatacaaaagattggaataaagaaagtgtagaatcaatacgtgatataatatcaaatttagtttcaagtaaagatttaaatttttatttagaaaatggagtgaatggaatattaaaggatagattgtcattatttatggatgaatatttaaaatatagcaatgatgatgtattggaagaagcaaaagaattattttcatattcaggaatatggttagatacgcattcaataccattgttatggagattagcaatgtttagaattgaggatataccattatttataagtaattcagatttatttagtcgtatttttaagaataatatgtcattatcatcaaatagatcatttagaataaaattgaataagaatagcaatatttcaacagaagatcactctttgagggataagtatgaaatttcaacaagtattccactatattgtcctttagctattggatacttttggattgataaatttatgtggcaaatgtatagatttccaggatctaatttacaaactatttcacctatttcagaatag

SEQ ID NO: 2148 - DNA, 486 bp, Cryptosporidium hominis
atgacaaattcaaataacgaaaataataataaaagtaaaacagaggaaattgaagaaaaaacaatccaaacaacaaataacacaagaactgctgatatatggaacttgtacggtatgatcgatgctgatcctctttcctcaacagagtctgatgatattaattatgtaagtatggtagcaattggagcagcaacttcagctgctttatggaaagcttatttctatagaccagaagaaatggatgactttactacttattcaatgtatattgttactgttttaactattgttggtgcgttttatgttatttcatcaataagaaaaagagaaaaagaggaacagctaagatcttcagaagcaaatcaaacatcaagttctgataaaaattctagtgattctgagaaaagtaaggaaacaactgtaaataatgaagacaataaaatatcttctaacaatattagacgaagaaaaaacagagccgattaa

SEQ ID NO: 2149 - DNA, 1218 bp, Cryptosporidium hominis
atgattgttcctttacttcataaagcaagaagagcaattctacttagcggaactcctgctttaaataatccaacagagttatatgaacaaataaatgcaatagtaaaaccaaatcctcaattttactcggaaaagaagaataaaacaaaaagcaataaggaagaattaggtacaagaaagaaaactaaatcaagaataaaaaaattaacttcagataatgatttggattctaattcagatatagattcagaaaattcggataatataagtttacttaaagcttttaatggaaaaagattgattaaaaataatccagaaattcaaaaacagccacatgtcgtttctccaaaatttccaagttatttagattttgctcaaaggtatagcgatactagaataaacaaatttagccataggaaagaattctatggtagcagaaatacggaggagttacatttgttcataagagaatcagtaatgataagacgtttaaaaaaacaggttttacacgaacttcctccgaaacaaagaagcaaaattccattagaaattaaagataaagtcggaattaaaatgattaaggagcttcttgcagatcctaattgtcaagtagagctatcaaattttgatgaagatgaatcatcttcatcaatgtgcaatcttcacaaacttacttgtgaaattaagattaaccctgtacaagaatatattgaatatttactagaatataacgatgaaaaatacgtaatatttggccatcaccacgtaatgcttgatgctattgaatcagtattattaaaaaaaagaaaaacagcatgcaattcaggcgggccatttttatttattagaatagatggtaaaactccaggaaataagagggaagagtatgtgaaggaatttcaaaataatgaaaattgtaaagttgccttactttcaattacagcttgtggccaaggtttgaatttgacaagtgccggtactgtaatatttgctgaattatattgggtaccaggtacaatgttacaggctgaagatagatgtcatagaataggtactcaatattcatgcattaatatacattatcttattgctgaggaaactttggatgataagatgtggggaactttatgtagaaagcagaagattatggcatcaacattagatggaatagatcaaagaaagaatgatattcaacattttcattttaaacaaggttaa

SEQ ID NO: 2150 - DNA, 1257 bp, Cryptosporidium hominis
atggatttgttccacccaaaacaatattctagaaatgcattaatttcattaggtggaaattctggtggtagtaatgaagctaattggtttattaatgtaaaaacaggttcaaatacagttaataatgttttggatggatttggtgatggaggaggagatatgttaatatcgaaaggaatgtttgaaataaatgattcagaaagtatatcaaaaggtttttcaccagatttctataaatcttatgagttagatgcaattttaccattaaatgctttattaacaataacagtatttcataagaataaaaataataatataacaacattatatggtagaacatatatagatatagaagatcgcttctttcatccaatatatcaaaaattaatattaaattcagaatcattacaaccaattgaaataagacaattatatggtgtttttggaaatgattcaaattgtggaaataatttaatacaaaattcagtaggaagtttgagatgttggattcaggtattaccaccagaaatagcaataataagaccaatatatccattaaatcctccaacagtggaaacatgtcaagttagggttgtaatatataggttaaaaaatatacctatttcaaaattagtaaataatacaggtatattagcatttggtgaaccatcaatatcgttaatggtgaaaggattaatgtcaccaaataataatacaatattagagcaagatacagatacacattggaatagtagtgatggtacagcaatatttaattggagatttgtatttaatataccagtaccatgccattttccaatattacgtttacaagtatggaatagaggattattagtatttggagatgcaatatcagaatgttcatttgatttatcaagttatttaatgagatcaagaaaattgaatagtaaagtaaatattagtagaactttaataaatatgtgccatccagctagaccaaatgaaaagagaggagagatggaaattgagatatcaatattacctttgtcattagcagaatcatcaccagttggaataggtagagaggagccaaataaagatccatatttaccagatgtaacagaccatagaaattatataacaacaagtgcatttggtaaaggattcttttcagctacttcaaatgtgaaatggggagcaaagttgatgacttggttaattacagcagtagtaataataacaatattatcattattaataaaactatttaaatag

SEQ ID NO: 2151 - DNA, 2604 bp, Cryptosporidium hominis
atgtttgatacaaaaaatgtaacatcatttccttgtgttgcatatttagggcgcttattggtttcagcaagcctttcaagaataccaaatccaactcccattaaaacttcagctcaacctgttgagattccaaaaacggatccatatttattttgggctgatatttatgaaattagtggattaggactcccttctgaggtatatattgaattaagtgtggggtcatggacttattgggtgattcccaactttcaaaagaaaatctctgattcatttcctttgtgtgataagcttggaagagttcctgatcagagttttgctttgccagaaatagatatgagctcagatttactcattcgagtatatacaaaagatgaatcccatagtaaacctttgtttcattcatatattcgaatctctgctaatgaaatgttacgatattcttctgatagaccaagatggtatccattattatctgcagcccattatggtattatggtaggacaagatataccttatgatgaagctgctgctttatcacatattaagcattatggaatgttattaggatctttcatacttcgaaaaaatgatccagaaaaacaatttgaatattttattccatcattatcaaatattcaaagacctccaagaattaaatataacttatgtagatggatctgcagagcatatatttttcaagctataagacttcctgttgttgaatccactttaccagattctttagttatggttactttaggaggtggtacagttttaacagaaattatcccaaagacagtaaatccagattggcatgaagctttagtttttgatgcagcacttcctgatgatctttctattgcacagtggttaaatattgcaattttacatgaggatattgttttaggttctgctgcaatttctcctttatatattggattcatgaaaaagagtagaccagaatggtttgtattacaaacaccaagaacaccagaatgtaaagcaaggatattatgtgcatttgaacttgttaaaataggtgatatgatgggtaatgtcttattttcttcattatctaatcagtttgagttgaaaaatattgaaaatgatccaaattatgatttaattaataattttaaggcttggtcaattccagatgtaactccaaagtatgttccatgcgatgtacatttatttctaattggaataagattaagaaatcaaaatgatacaaataattcaatattttctatgtcatcttcatcaaaaccaataatacaatttgagtttggtagagatccagaaaaaccagaaaatagattatgggtacaacaagcaacacaaccagtacatggtggtgattctgggaattataattatttaaaaagtttatgtttaaaatgtcatataccagcctctccaatctttcaaacttatattgaaataagaattcttgagccagcaaatgtatttggtacaaaatgtaaagaatttggaacagcttatttacatttaaatcatcatcttccatggattgaagaatatcatcaaagatcattaaaaacagaatttcaatatttacctccaaaattagtaaataagaaatggttaagtagtggtcgaaaatttttaagtaaatattatagaggaccatggaaattatggaaaaataagcctagagaaatattatctccaaaaataagtattagaggtgctaattcagcatcatcaattataaaatcttcttcaagatcatcactaatatcactacctagtggtgaaattattgaaaatacttcaataaatgatgatagttttgattttgataatttacgtaaagaaatgggtgattttaatgaaattaattcaaataaaggaatacaaagaaatggtggaggagttaatgataatgatgatgaattatattgtactcaaggagaattaaataatcgtaatcttcaacaaaataataatgaaaaaaaatatgatgatcaatttgatgatttttttgatgtattttatgatcaatcatcatcagtattagcagatactggtcaatttactaataataaaaatggtttattagtttcagaaaataataaatttgatttaggtatacctaatgtaatacaggatttattatttggtaatgataatataaataaaagtgaatcaagtcaaaataataatattaacattaataatttaaatcaattaaaagaattaaaaccttttgatttgatgaatactgctgaaatattatcaaattatcttcatattggagaggatgaatcatttattaatgatccaacattaaatattccaatacatgatttagaagcattaaattcttgtatatcatcaatggaggcttatattaaacctttgaaaaataatcaaaagaatattaaggattatgaagatttagaaaatattaatccatatttaaatatggcaaaaagtattaattggggtgtcaaatctcaattatatgattattctaatacaaaaagattgtatggtacaaataaagaacaattggatttatttttttcttatggattaagaaaaagttcagtattatatatgatgcagatatag

SEQ ID NO: 2152 - DNA, 1032 bp, Cryptosporidium hominis
atgatatcaaatccattacttgatttaaatttgtctaataatgacattaaaaaatctgaaagcagcaataaaagactgacaaaaagtcaaaaaaagatgattgctcgcgaaaataggaaattgaaactgaaatcacagcgagttgaagagagaaaaagacaaagaagtcaggcttcatcccaaagaaaagaatttttaaattctatgactgaaaatgaaagaagatcttatatattaagagaacgctttatagaagagcataaaagattctttctttcaaaattctctatttctcatttctctgattataaatttgaaaaaacaggtaatcctcatatctgttttaattttagttttgaaaataaaatgactgagaaggaaatgaattctttaatacgacaaatttctcttgctaatagctatatgatgaggtcattaaagatagttgatacagaaaatccagattcagacgcaatgaaaacattgttggagctaggtccaaattcagaaacttcaaagtcgtactataataggttcaattggaaaggttgggtagattttcacatatcttcaatcaaattaaatgatacatttcaccaaatcggaattcaaaagtattctatgaataaatggttcatgaaattacatgaaaaaccattttgggaagtatttcctttaagtcaaatagtagttctttctcctgattcatccgaagagcttgaagaatttgaaccagataaggtttatattattggagggctagttgatagaactgttaccaagtacgaatctttaaatcaagccttggagaagaagtgtgtatgcaaaaaactacctgttaaatcattaattagtggaagagctaattgcattctaaatgtaaatactgtagttgaaatactagtcaacagatatcatcaaaaagattggaagacttctattttacaagctattcctgttagaaaagctcaaaatcatagcagaagagctgcaaaaaaacaaaaacttttaaattcatcaactaattgttaa

SEQ ID NO: 2153 - DNA, 2394 bp, Cryptosporidium hominis
atgagtatgatacaaaatggagggctgtggaaaaacagcgaagatgaaattcttaaagcagccgtaatgaagtacggccttaataattggtctagagtagcgtctctgttaattatgaaatctgcaaagcaatgcaaatcaagatggtatgaatggctagaccctagagtaaaaaagactgaatggtcaagagcagaggaagaaaaattacttcatttagctaaactgtttccttgtcaatggaggactattgcccctttggttggaagaacagctcatcaatgtttagagcactatgagttattactagatagagcaactggccaaaaaataccaaaagaacttgatcctaggctattaaaacctggagaaatagatccaaatcctgaaacaaagccaagtaagcctgattctatagatatggatgaggaggaaattgaaatgttagcagaagcgagagctaggttagctaatactaatggccgaaaggcaaagaggaaggcaagagagagatatttagaagaagctagaagaattgctatgcttcagaaaagaagagaattaaaggctgcaggaatgctttcacatgcttcaattatgagatatagaaagaagaaatataaaggagttgattatttaaatgaaataccctttgaagaagcaccagaagaaggtccattcaaaatggaccaagaccctaaaaaaacggaaaaaaagatttcatatgcagagcttgaaggattaaataccaagatgaaaagtagccaatcaaaaaataaaagtaattcccaagtatctggaaaagaaggccaaaacaaaaaacatgtaagctttaagtttgaggaaccaaatagaatagttgtaaagaaaagaaaattggaccttccaaaacctcagttgtcattaaatgatgtaaaaatgatttccaatttgaattttgaaattgaaaatagttctgattcagtatataaatcaacagaaagcgcatcaatgcattcaaaagttctgaactcaattattgatccacaaagaagtacaattcttgaagaatctagagcaatattgtgggaaatatcgcaaccaagcccttttaatccagtagaaatggataaatttcctgtccctggtaatgaatcaaatagggaagtacaggatgaaaaacttatcagagaaattaacctaggtcaaatttctagaagaataaagaattttaatgaattgggttctaatagaagtagcatttctacaatactaggtcatataactttgagtgatagatttagtttaaatacaggttcagttattggagatcaaggcagtatttcttctatggatccaataggaagaaaagccaggtttgaaatgtacaaaatgcaagcaaaaacattgctttatgatcttcctcctgcaaaaaataaagtagaagttgacttggattatcttaaaaaacagttcttagataaacaaaaaaaatttatagaaagagaaaatagaaagaaattagatcaaatggacattcaacgagaaatccaaattcaagaagaggagaggaaaaggctccaatgggaaaaagaaacacaagttattaaacttggattaccaagaccatatttgcttaaagaaaatatattttcaagaatagatcaagaacagagtgaagaaggcataaataatgatggaggttcatataataaacaaatttttgaacttattcaaagagaaataatttacttattttacagagatatgagaaatcatcctcaacaaatacccgaatttatcttagatttatatggaaatgaattattccaaaatatgacaaaagatttcagcaatcttgaagactctaatcttattgtttttgatgaatctttaactactaaagaaatagaaaatgcctccaaattaattaacgatgaaattcttaatttaacttcaaataataccaataaaaatttaaataaagatttggaagatattatttcaaacccaatttacgatcctaaatacatctatgtaccttataagaaagaattcatgcctttaaaggatctttctgaacctcataaagaatctgcattcaagaatatgataatgcatctaaatcttgaaaatgatgaagttaaacaagaaaattctcagtttattgatgagcttgaagataacctctcaatgataatttctgaatcattaactctggaaaaagagataaatgaggtaactttaagtaatactgaattgaaagctgatattaatgctctaatgcttttggaaaaacaagatcaaacatcttatataaatagaatacaagagttaaaacaacttattaactacgaaaaaaatataaataaatctcttcaaaatttttattataatttaagcttacaatcctaa

SEQ ID NO: 2154 - DNA, 2625 bp, Cryptosporidium hominis
atggcaagtaaaaaaagagaaagagtggagttaaagaaggacaatatttctttgggtgaaggagaagatgatttagagattacaaaggttaataactcaggtgcagaagatattattttcagtaaccatgaaattgaaaaatgtatttctgagaacgtattagtttcatacaactgtgagaattgtgtgagaatgagaaatagaacaatgaacattttgaatgattctgagaagtctctaatgattcagacattgtggtcaaatttaatcaataattttacttttaagttcattccaagacttctttccaaaccatatagtttggaagaaacaaatgaaaaatttaaaaagatagttgaaagacttacattcatgaatgttgaaaaggagactaataggataaatctgacaaaggataaattacttgaaggagatcatcacaataagacttatattttgccatgtctatatccaggaatatactcgacaaatattccatgtttggctccagttggttctgatcatactggaatagttctgattgatgaattaaataaacttttacattctaaagagctggttttatgccaaaagtttattgttagaagtcacttccagatcggtaatatatatcaacgcgagctaaagtctttaaattggggagttaatgggacagtatatcgaacaggagaagatgaagatactcccaattctaataatgaagaaataccaaatgctcatttcaatataaaatattcaagcccagaactctatttgcctttatctaatactcctttgacattcattaaagaacctggagatttaagaagaatgatagatgatattctgaatttaatggaatctcactatagtcaaagtagtatgaatgaagaaagtagtccttttctccttgctattgatgttgagcaccattcaaatcaaagttataaaggatttgtttcattaatacaactaagcacaagaacacatgattacatcattgatccttttaatttgttcaatgaaattcaaatgcttaatgaactaacagctaatccaaagattctgaaagttctccatggatcagattacgatataatctggttacaaagggatttttctgtctatattgtaaatatgtttgatactggacaagcagctagaattcttaatacccctggaggatattcgcttaagaatttattgagtatatattgttccctagatattgataagcgattccaattagcagactggagagaaagacctctaagtaatgaattaatagagtatgctagaggcgatacacactatttactttatatttatgatattatgaagaaccttttgttattacataggcataaaaatactgaacctcctgtattggcttcagatgcttttatggaggtaaatgacaacttaattatacttaagccagatatcatagaaaggatggactttggtagttataataattttttaattgaaggagaaaatggaagtaaattagtaaaagtcacagatttggacccatcagcactgttaactgtacttcacaatagtcgccagatctgtctaaaagaatactttgaaaagccattggatgtttggagtctttgctatggagttagaactaagatatccaaatcgagttacaaaactcccatagatagtgcaatcgttacgttagtaagctattatttgtttatttggagggattctattgcaagacttttggatgttagtcctagttatgttctcaaagagtcaatgataataaaaatatgtcaaaaacagccaatgaatagtgtagaaattcttggattatatccaaatatcccagtaaatattaaaaagcattctgatcatattttaaatattgttacaacagtaaaaaatttcattacaacaaaatctgaagatgatatctttgactttaattcctatatttctcacatttactctaacattgcaaattccagcaataatgtcagtagtgtaaataagtatatggtaaacaaaaattacaaagttatttctacgtataacagtagtgattctgtttgtttagaagtaacaaatgattctaatcaaagctcttcaataaaagagaatgaagtttcaagttcagaaacacatttgaatgacaatcaaccacatgatactcccactattagtggagtcaggaggaggtctgttacaattaaaaagaactctcctggctttaatgacaaacttgcagataatctttttggtaactcttatagaagctttggaaatgaattaaattcaagtaattcacccctaaacactactgttggtaaaatttcaagcagaatcatccaggatattaataatactttaaatggagaggtaccaaacgactttagaaataaaaaattaaaagaaattaaagaaaatagtccagtaccagtaagcaattcagaaattcctgaagaaacaaatactaaaaaagaaatgacattcgaggagtactatttaaaaaaaactaaagaagaattactcgaagatgaatgctttactcctttagtttcagtcagggataaatataatgaaaacgacgactatctttacaaaaaacagaaaactccaaaaaataaa

SEQ ID NO: 2155 - DNA, 1788 bp, Cryptosporidium hominis
atgttgcaaaatgtattagagaatgaatctgagcaggcagataaaactttgtcttcatgtccaatttcacaagaaggaaaaaatcctagctccttatattctatctcactattattaataataggtttggcattgaaggggaatggtgagaacgagactttaggctctggagtggctatagatgatcaatacaagaaggagattttgtctttattgcttgaatcccgtccagctattgtggaatcagctgaatctacgaaaccatttggtgggagatttggggcaacagggtttggctcgagaggaggtagaggtggtcaaagaggccgagttttttccggacagataggtggtaccggtaggagaagcataataagacaaccaaacgaaaacttgtgggatatgccttgttctgaaatgactagtatgacattgggggatattagggaagcagaaaataagatgaaggcagaagacttgactttagatcaatatgtagagagacaaaaggagtctaatgataggaagtcatcatctttttctcaatctaatcagaagaagaattttgtttcaattcctatttctggtgaaactccaataaatgttagtaatacattttctttaaataatggttctgccaaagattatcagatccacatttcaagcaatgttaatggaaattttcataataattcaggtcaatctaataatcaacacggtcgacaccacaataaccataacaaccaacaacataatagggatagttttatgaatagacttggtcaaagtggtacgctaaattctcataataatacaaacaaccatcagaacagtactactaatcaagctaataattctgttaatttgaaaagcggattgattggaggcgaaaagacacagtcttcatcagttttttctacgaatattagtaataggaagtcatcatcaatctcagagacttttttaaatggcccggctaatctttcattgtttgatgtgaatacccctatttttgatgatgacaataatgatgctgtagtagattttagacctccaatgattaagaatgcaaatacagttagaaatggtttcgaggaaagcggcaaaagtaagggtatttcagaacaattagttcgaggacaaactcaatttgaaaatggtatacaggtctctgcttctaattttagttggttaaatagaaatggaaatactgaggaagttgataagagtattagtaacaacatttcagacaactcaacttcatttcctgctctctcaaagaattcacaatttagtcaatctcaagttaaggtacagaacaataaccactctcttatgtcatcagaacaaagtattcttcagaagctccatgctgctggaatagcatctaaattagtggataagaatataatcgacaatattgataatcgcaatttaaatcataataattattttgaatcaaaatttaaacagaatatttcaaataccaatgagtatccacctctctcatctgcttcaaatatggtttcttcttctctttcttatgattctaacaacttaaagtttaataaccagttaaaatctaataatgctggcagacttttaatgtctattataggcgcaggacaacaaaataataacaataataaaaactatgtttctaactttaacatccgtaacaacactcatcgtattcatactcacaatactcacaactctcacaacagtaaccatcataataatgtaagccatcacagtggccatataggtaacttttcaagatactaa

SEQ ID NO: 2156 - DNA, 591 bp, Cryptosporidium hominis
  misc_feature (588)..(588): n is a, c, g, or t
atgatttgctcaatgctatatgatattccaaactttgttaagcaactttcaaatcacaatcaaggtgatgataatagtgaatatgactgtttaagttttgaaagttccgaatttcaaaataaagaaaatgaaataaaccaaaatataaatttaaatacaaataaatataaatatttaatttttaaagaaagatatcataatgggaactattatgataaatatgggagattttgtggattcttcaataatggaattttccatagtttccattaccattaccaacaatatttaaattcaaataactttttaaatgaaataaataaaaatgagacttatttaactctaaaagaatctgaaaatacttttaatcatcaagttcaggattataatctagggtattactcccaagaaaatgagatcaagccagaacttgaagagtatgaacacaaaattgattataatgaaaaaaacaaaaatacaaagattatttcagattttcaaggaagtcatttaaaagaatgtaaacaaatatctaaaatacaagaaatcttaatttcagagattaaggaatatcaaaatagaatctgntaa

SEQ ID NO: 2157 - DNA, 3447 bp, Cryptosporidium hominis
atgtctatttcaaacaatgataatgagataaaggaaagtaggttgtttcctgtaggttttaagaaggaattttgcacctttttagaaaagcctcaaaaaataatatctgagaaggatgtaattttgaataaattgaacgaacctttggacgaagacatcaaagctttagaactacatatgtttggattagtaacctcacattggagaagctctagaaaatatatcttgcatggcaataagcagaagaataatatagaagaaggagtttcgagtccaagtaatgatggcgttaggaagatttttgatattcttaaattgtcgatgaattttgcagaaaatgaggattcttcatcattaaatcagctgtgggaaagaatcaaaaatctagatagtggaatgcttactttagtagtatctctatttaatcaaatgtgtatgatcacgaactatgcagaatctgctcaaagaatacgtcagtgcagacaatttgagcgtgaaatcccctcaattttaagtgaatcccaaattttttcaaaaaataatcaaagtccagattcagatataatatttgctcattctcttaaagttactattaagaagcttctccaggctggttttagcaaagaacatatctataagttaatttgtgaacaggaagttgatttggttgtaacagctcatccaacgcaggctcaaagaatatctgtgataaaatgttgccaaaagataggggagataatgatatacctagatagagatgacttaactccatttgagattaataatgcaaagtatgagctccaaagagccatggctatgttatggaatgtagatactttaagaagagcaagaccaactcctttagatgaagttcagaatactataaatactattgaggagacagtttttagtactctaccaacatttcttagaaaaattgatgaaattttgaatgaatttggaatggatccattgccaccaacaaaaacactattcaagtattcatcttgggttggtggagatagagatggaaacccatatgttacagcaaaagtaaccagattatcagtaataaatatgagacttagagcatgcaacctatttctacacaagattgaagatctaatgtatgatatcccaattatttcttcacatgaaaagttaagagaatacgtagataatcttccagatatagaattctatattaggcctgtatcttcttgtgatactttgaataattcaggatgtactactagcgatgcaacagtaggattacgtccttttatgggattcattcctgagtatgaactttacagaaggattttacatcacgtacgtattcgtcttattgcaagtagagactattatttagatgcattaaattttggacactctgttaattctgagactagaagagcattagcataccactcaacagaacagattcttgagccgctaattctcatgtataatgctttggaagattatgatcatgaaattaaaaccaattttgaagatggtcatcttcctggaacaaatatttcagttccatggattagtgaatctgggtcagtttctgcaaagcttggaagagggctgcttttggatgtaatcagacaaatttctgcatttggactttccttcatgagattggatattcgtcaggaagcatctaaacacgagaaggcaatggatgagatttgtaattatcttgaaatcggcaattattctgagttttctgaagaggaaaaacaagaattcctcctaaattgtcttaaatccaaaagacctctaatcccttacagactaaattggtcaaaggaaaccactgagattctagatactttctatgagtgctctcatctcggtgccgaggctttgggatcatatatcatttcaatgtgtatgaaaccttctgatatactttgcgttcatgttttccaaaaagaatacttctccacaattagtgctgatagtgaattccatgcagaaatccatgatcttaataagtttattaaaagaagaagctcaagtatttccaacaattgcaattcaaatggggtggtcagtgttgaagcatctaatgtcaataataatgattcaagacaaaatggaggtatttctccaagcattaatgattctccaaaatcttcagctgctattttatcttctattgcatcaaagagaatgagagttgtacctctattagaaaccgttgaagcacttaacaatgcagaaaagactttagaaacacttttatcaaatgaatggtatttaaattatgttaagacagtagacggaggtatagtagaagtaatgattggatactcagacagcagtaaagatggagggcgattaacttcaggatggcaactttataatgctcaagaaagactttcaaatattgctagaaggtttggcgtagaaatggtattcttccatggaagaggaggtagcattggaagaggaggtggacctcaacatttagccatattaagtcagcctccaaatacaattacatccttgatgagaatcacagttcaaggagaagcaatcactcaatcctttggtctttcagaaatagcattcaaaacttgggagatttactgttcagcaattttggaatccagaattactgctttagatattccaaataacaatcaatgtgaaccaaatggtaaccttggatatggaacaaaagttaaagaatcttggagagaattacttgatcaaatgagtgatatttcaatgaaagagtacagaaagattgtttttggagaaggaaactcagatttcacttctgatgaatttgttgcttattttagaagtgttacgcctgaaaaagagattagtgaacttaacttaggaagtagaccttcaaagagaaaatctggtggtattgaaactttaagagcaatcccatgggtatttgcttggacacaaattaggtctcatttaccagtatggttgggattaagtgcagcattggaagaaatgaagaagcagaacaaactaaatttagtcacagaaatgtacgaaaattggccatttgtgaaaagctttttcgacttagtatccatgattttattaaaagctgatgttcatatctttgagttatataatcgtatcttagctcctcctaatttgcaaaaaattggagatcttctaatatcaaaactaaaggatactattaaactggttatggaagtaactagggaaaaacaactcttggattctgattttgtcactagaaaagctattttacttagattttcttggttagctccttgtcaccttgtccaaattgaatgcatcaatcgcaggagaaaaattctatgctcttcagtaaatagtagcgaaatcaatgacatagaattaagtaaaatcgaaaatgctctcaaaatttcaattcagtcaatatctgcgggtatgaagtttacgggataa

SEQ ID NO: 2158 - DNA, 537 bp, Cryptosporidium hominis
atgttgcagagaaaagaacatgttggtggaattagtgtagggggagcttcatcaggagcagcttctagaagacgaagattgaggaatgaaatttctgatgaacagaagcaggagattaaagaagcatttgagctttttgataccgaaaaaactggaagaatagactaccatgaattaaaagtagcaatgagagctttgggatttgaggtaaaaaaagcacaagttctggaaataatgcgtgagtatgacaaatcaggaagtggacaagtggagtataaggattttgtcgaaattatgacacaaaagatattggagagggatcctcgtgaagaaattctaaaggcttttaagttgtttgatgatgataatacaggaaaaatttctcttaaaaatcttcgtagagtagccagagagcttggagagagcatttctgatgatgaactacaggcaatgattgaagaattcgacaaagatatggatggtgaaatcaatgaagaggagttcatatcaataatgaaacaaactagcttgtattaa

SEQ ID NO: 2159 - DNA, 1968 bp, Cryptosporidium hominis
atgatgattcttcaatttacaaaggttcatattcttattctctccgtgctctgtgttcctttatttaacatcgatctatacaattattatcctcattttgaacaatcgtttttacaatccaatccaaagaaatttaaccccccacaaggttcatttaattacttgttacctactaatacgcctggtacctctcgtcggcttgattcacagaggtctggatccgtttcaacagatagtgttcatcgaagaactagtactaatagtcaaagaaggtcaagtaatgttgctagtggaactctctctgatgagcctactccaccccatcctattccatttactcttccagatccagattacggtaatagtgatttccagacttcagttgaaagaagcagggaattaaggaaatcttcttctgatctgcatgtagttccgcctgaagtcttacttccagagccagattacgaagccaattatccagaagaagagtcaagaaaatcacccaatacaaagagtgccattagaagaacgttatctagacgtgctggttttaatctctctaatttattagccaaccaagcttcatatattgctagaagatcattttctaaagatgacaagagtaaagaaaccattgaagaaaaagtagctagaagaagatctttaagtttatcaagagaaacatttctttcaatagatgaaagtcaattcattggaaaacctttgagcatacaaattccgtataatttaatatctgcatgcaaatatgaactttctgatttgttaaagttgattaaaaaattaaacttggaggtcagagagcttaaagtaattaaagatctaattggaaattgtaattgtagaacaaaaaactgtgcgatgtgtcaagaaaactttgagttatacaattctcacaaatcaagatacgttcagcatagatcttccatacagtcaaagattgattttttactcgaaaattgcctatcaggtcaatcaaatagatacgaatctacatcttacatagcctttttcgaggaattgttttctttaatatatgagcaaatcattagaaagaatagacttcacgtaaaaaacttgtttcacagatgtgaaatagctgttatcacagataagattcttaaaaagcaaattaaatgtagtaagtgtaaaaagaagcgtgaagtttgtaagaagcactccagtttgttacaaaaattaagagaaatagaatctgttaagaatcagaataaactagaaattgaacagacaatggatatgattaattcaaagatagaaggtttaccaaaaagaatggttcaagatctttgtagattagaagagcaagacgaagagttcctcaaatctcatctgaaagttagagaatgtatgaaaaaattaagtattacatcggtcaatatgtcagccctagaaaaaattttcaaaaagaataagtcttcaaaaaagaagaatcaaaaaagaaaatcttctttggggagcattgctacaaggcctagctcatctagacctggttttattggagagacttcagctagcattggagaaaatattcagataactcctgaattgcctccttcaacatcatctaggccatcatccgtaagacagccaagtcattctgataaaggagtgtcgtacaaaactagcaaaacgggtcgaaaatcaagtaccagagcaacctcaatttctagaagaactccttctggtgcttctagaagaacaacctcttctccaggtgcaaaaggccatagtgtttctcaatctccttatccatctcttcaaactggtgcaatgagattatctcctatggggccattttcagctcctgaatcaggagcaattcccaaagtacgaagtagtgagggcacaagagctcaacaaagttctttacatggagctactaaaaaaaaatcggattataaaaatatgggtaaagcttcgaggagttag

SEQ ID NO: 2160 - DNA, 5769 bp, Cryptosporidium hominis
atgaaaataataataataataataataatattaattgctttaatatttactcaaactaatttacacgtaaatgatttaattatttttcaggaaagctatataaagttaaaattactttccaatacgaatgataatgtttctgaaggtggaagtgacgagggaacatctgaagagctattaggggcaactggaggatattgcgaagaatgtgagaaagagggaaacaaaggactctgttctcattctatgaatgatgagaattctgcttcttgctctcaaataaataaagagttattaggtgtagaaatagatagtgattctgatgaaatttctgaagtaaatcagactcaaaagaaacaatcacttaaagatatccaggggatttcagtagccgatatagaactctttggaatctcagctgagttggttttaaaagatttgattaaagttcataaggcaattgctaagaattttgttactgaggaaaacatcttaatgctttatgatctgtgtaatcaaattaaggaagcaataatgtttttatctgattctattgatgaattttctaggcagcataaaaggaatcaagctattttatttaaaattattcaaaaaaatcaaggcttttcaacttatagaatattcaatcttcgaaatgaaaataagcaactccttgttaaagctggcatactcaaaattagacttaaaaaccttaagttggcgttttcaaagtattgcatgcctgaaaaagaaagaattttatttttaatgagacaaactatcgttggaaaatacaaaagtactaaactatatagggatgaaataaggaagatcttcaatgatcaatatcttccattcttacaaggtatttacgtttgtaaatcttatccaaataccaagtgtacaaaaaaaaatccatgtaaaaaatgcaagaaattaatttccgaatttaaatcaggtgaatttgaaaaagaacttagaaaagtcgataaaattgaaagaaaattcgctaaggtttccaaatttggaagcacggattttcaagaacaatttaatgagtattcaagtcttgaaaaagaacttcgaaatcttgagtctagtgcaagttctagtgatatttcacagattgaatctatacccgatgatgaatcggaaaatgaacaagtgaaatcaacaaaaaaaacaaaaaaacgtaaaggcccattaatttctgtcaccaagattaataatatgattaataaaaatcacaagtctcgtacagtaaaaagattagaggagagagagaggagcaaacttaaaattttagatgatttgcacccaaaaaagaatcttaatatattcaaaagtggaataaaaaaagaaaaagggaaaaagaaaatgacgatcagctctccagttatatcaggcccacaagatttttcccaggaaaatattaacaatcaagattctagtgacaataattccaatactcaagataatgaaggtactgctagtagcagcatagatgttataactagtggtaatgctccaacatctgatgatgataatgaatcagaaactcgatcacaaaataccccaactataactacaagtagtcaaagcatcgaaagcattgttgaagaagtcatagacacaaactctaatgagacccaaactaagaatagtaaaatagacccaatcactaaggaactacttagaaaaattgcctcccagaaagaaaagagggaaagaagaaatcaagctagaaatagtaagatagtttctactcagagttgtgttgcttctggagagaccaactctgaaaccagttcgagctcagatcaaaggccatttactgatagtgactttgattcatcagtcagctcatttgatagttctgactatgagtttgatactgactcagattcacctatgaatgctcaattcgcatctccttcaggagaatctacaattactaatagagacccagaaaatagaataaatgaaccttcatcttcggtagaggaaagttctatttcagagcccccagtttctgagtctagtcaattacaaactgtagagggttcatcgcaaagtactcaaaatgaacagcttccaagccaagaaggtccaaatactgaagatgcgagccatatctcagctcaaacttcttcaaatgatcaatctcaattaccttcatcgtctaaaaaacagggtgataaaggaagaaaaacagaaattgctcacactccccattttaaacgacctagaaaaaaagtgagatttgattttgaattaaatcaagaatattcacttgaagatattcaaagaaaagacagaaatgcctcaaaacaattgggacctaaagagccaagttcaagcagcaaatatccagtaagcagtctgaaaaaagttttaactagaaccctgaaaaaatatttaggtaaaaatactgaaatggaatgtactgctcaaaattctgaaaattttgtagagaagcacaaggatggagctggtgaagatcaggttggagaaagttcaactttagaagaaaatttaggatatgagcaaggaactcaatcgttcattattcctcctccgccttcgtttcctgcacctcctcctccctccattcctagcgggactccatcccgtactccgattccaaaggatggaaacttaactttagatccaaaaatgagtacattggggcaccaaggatcttctaaatcatcagaaccaaaaagtaagagaaagcctttaaccaagaaagaattggaagatttactaaagaaacacaaaactggtgctaacagaaatctgaatggaggaaattctttgtctcaagataaaagtttaggagataaaaaaagaactccatcgcctattattcctcctccgccttcatttcctgcccctcctccgccttcgtttcatgcccctcctcctccctccattcctagcgggactacatcccgtactccgattccaaaggatggagacttaaatccggacccaaaaatgggtaaaacaaaccaccaaggttcttctcaatcatcagaaccaaaaagtaagagaaaacctttaactaggaaaggtttggaagatttaataaagaaacacaaagctagtgctaacagaaattcgactggaggaaattctttgtctcgagataaaagtctaggagatgaaaaaagaactccatcccctaatattcctcctccgccttcatttcctgcccctcctcctcccttcactcttagcggaactccatcccatactttgacgcaaaaagatgaaaacttgacttcagatccaaaaatgagtacattgggccaccaaggatcttctaaatcatcagaaccaaaaagtaagagaaagcctttaaccaagaaagaattggaagatttactaaagaaacacaaaactagaattaacggaaatttgactggaggaaatttttcgtctcgagataaaagtttagatgagaaaagaactccatcgcctaatattccttccccaccttcatttcctgcccctcctcctccctacatttctagtgggactccatctcgtactcctatgccaaagaatggagacttaacttcagatccaaaaatgagtacattgggccaccaaggatcttctcaatcatcagaaccaaaaagtaagagaaagcctttaactaggaaaggtttggaagatttaataaagaaacacaaaactagagctaggaagaacctgaatagaaaaaattcatcagatctagatgatgaaaaggaagaagaggaagaagatgaggaaaatatgactagcactggcccatttgaccaaagacctccttctcctcctcatcctccaccttcatccggttcatttgctccaccgtcgcctcctcattctccaccacctcctccacctcctccacctcctccacctccttcttcaccgccatctcctccgccgtctcctcctacttatacctctctttctaacggaattccatcccatatctcgactcaaaaggatcaaaatttgaatctgagctcagcagttggtaaaacaaatcaccaagattctcctcaattaaaaccaaaaagtaagagaaagcctttaactaggaaaggtttggaagatttaataaagaaacacaaaacaggaactagtcaaagtgcaattagaagaaactcttcgtctcgagctggaggtttcggaaatgaaaaaagaactcctccttctcctcctccttctcctttttatgcatccatttctgatgaaactgtaccctatattcccgtacaaagggatgaaaacttgacttcagaatcaacagtgagtgcagtagaagaattatattctaaagtggtgaagccacgtagcaaaaataagcctttaactaagaaaggtttgcacgaattactaaggaagcacagaactggggataacagaaactctaatggaataaattcatcatatctagaagatgaagatttaataaatgagcacagaactccatccccttctatctccccctcttctactccttctcctccgccgccgccactacctcctcgtccttctccatcaccaccgccactacctcctcgtccttctccatcaccaccgccaactcctcattcttacacttccccttctagcggaactccatctcgtactccgatgccaaaggatgaagacttaaatccaaacccagcagttgataaaacaaaacaccgaggttcttctaaattaccaaaaccaaaaagtaaaaaaaagcctttaactaggagaggcttggaatatttactaaggaaacacaaatctagagctaggaagaacctgaatagaagaatttcatcagatctagatgacgaagaggaagaaaatgtagaaaatatgactaatattggcccatttagccaagggcctcctcctcatcttccaccttcatccaattcttattcaaatggcgagcccaaaaaaagttcttctagtgaatctttagttagttcaaacatgaatttgacaaaaaagaaagccaaatctttacaacctgaaagaactaatactttaaatatgagaagcagcgactcatctttgcatatgggtgctttaatgaatgcgggttatgaagaaacaaaattttcgagctattttttaaataaactagaagaaaaaggtgaaaaacgatccaaattaaaaaaattaactagtcgtatttctaatttaaaatttagaactcaccggaaaggaagctataaaaggaggaaaaataaaagcaataaaaattctacatcaagttcaagaaagagtaaaggaatacctagtcctccaaaatctcctacttctgatgtggtacacacgactgaaggagagaaaggcaaatcgagacttgaaagcgaattacagcttggcacacaacgaacatcactgaattcaaaagtgaatagttcaaatggttcaataaatagccaagcaagtaatttaagacagctaagaactagaaattctggctcgagaagaaaacaaaaatcacataaaaagaattcgataaaaaaccgaaatttgtccaaatataaatcctccagtagctctaatactaataaatctaagagacataagaccgctctttcgaaacatactgcaaatgaaagaagattgagtagagcaaattcagcaaaaaatatgagatttggaactaactcaaacaccgagagcaataacccaaacgacagtaatgacctacaatttgctccaattctaagctcctcagatgacagattaatttaa

SEQ ID NO: 2161 - DNA, 2283 bp, Cryptosporidium hominis
atgattggtcacaatttatggttatatcttattgttattttttttataatactatgtgaaaatatagatgacaaattattatcttccaaattatccttatcgaagaactttcaaagtatcacccgagtctctctattaaaagcagctgcaaattacgatagttcggattcaggttcagtcgactcacttgatactatttcgttaggaagtgacaataaagatgttttatcaatatcaagttcctcagaccaatcagattcttcttctgtagcatcagacgattttaaatctaaacataaaaagaaaaaattatttggtatcacaggaaatctttttaagagtaaatcttctccagaaatctcaagcccaagtactaaaaaaggacttaaaagtcaattacttaagatgtttaaaagaagaaataaaggtggaaaaaatggaaaatctcaggaaaatattgctagctcagaggaagaattgagaaataaaaagtatagttcttctgaagatcttaaaaaagaagttgatactgatgatgaggatgatgatgaagaagaagctgttcaaaaacctccaaatcctaatttagagaaaatctctgaaggtgacaatttgaaatttgatactggtattatgcaattatatctggagtcacaagttgtttctagtgattctcaaataaataaagcaaaagaaatattacaaaataacaaagaggtctataagactgttaaaaaagaacataatagacaaataaaagattctaaatgtaaagaaactttacttgaatccgttttcattctttcaaaccaaatttatttggcgaaaagtttttgtcaaatggcagcgattaaaattacaaatgaaacagggttttgcagaaataggtgcagaataattagctcaaagagctgtaagacatgtaaaaaagcttttggaagaaaagaaaaatgtaaagctatttcaaatactatagataatatgtttagtgtcttggaaagaataattaaaaattgcctaattaaaaattctgtccaaatggaagatctttctgcctttatattatacaagagtcatacaccatataaatgtacaaaggaacaatatcggatacttaagggtaaacttgaagctaaagcatatcaaatagctctaaaagtttctattattaacaatgttgttaagcaaaaaaatatttgtaatagttgtactagacaggaatgcttgagttgtacatcaatggcttactgtccacaatgtccgggacttgaagatctttcctcatgcagtaattgccttgctgctcagaatttacaaagtacactcatcttagaacgaaatcaattaattaaagaggctcgaagaatttttagtaaaattctttcttgcgagagttttttggctctcacaagcaaagaaacatataatattatggatgctccaactgagtcagaagtaggaaagattttggaagaaaaaattaatttggttctttcacgtttcctagctcattctattatggatcattctcattttaaagctgatggtgctgaaaaaactaaaacatatcaaaagttacctgatgatattaaaaatgcaattttgagtggtgttaagctgaagacatcaagccaacaaaagattccatatgaacaataccctactcaactgagtgaagcattcaaaaagcataagaaaagaaaagaaaagtatggtccttcgggaagtgagtataaaattccatcaatacctccacctgaatctactgatgaggaaaaaaagctagctattatgctcttcgaaaatggtatttgtacataccttatgattattttattgaaccaagaactcaggaattgtaatgctgaaattgataataagtcaagccaacatgatggctgtgagaattgcagatttgatgggtgtagaatgaaaaggtgtagcaatattccagaaataaggtctctaattataaaaagagaaaatttatctgaacaaattcagagatgtaatgaattagggtttgtttctcaggcagaactaaaagctaagattgatgaaatgaagaattctggattactttctgctggtactaccagtggtgcaaccagcagtagtgcaaccagtagcagtgcaatcggcagtagtgcaactagtagcagtgcagccagcagtgcctcaatagtggctcaagtagaaaaagaacctgaagaagatgaagatgaagacggggatggaaatgaagatggagatgatgcaaaggatgaaataacaaggttgtag

SEQ ID NO: 2162 - DNA, 1716 bp, Cryptosporidium hominis
atgaaactctttttttcaatcttagcatttgtatttgtgatacttcaggtatctaattatcatccaacaactccatatttttccttactgcaaacttctcctgcctcttctattgagccacatgtttcatctactaatggttcaacagtagattcaggtgagtcagataagaaagctgagaaggccaagaagaataagaaacaaaaggagaagaaggagaagaaggagaagaaggccaagaagggtaagaaggccaagaagtcagaggttaaggaggaaggagctcaggatggagttaaggaaggaggtcaggaaggacctcaggaaggacctgtcgaggagaccgagggcaagaagggcaagaaagataagaaagccaagaaagagaaaaaggccaagaaagagaaaaaagccaagaaagagaaaaaggtagagactcaggagggtgctactgctactactgctgctactgctgctgagcaagaagctgctcctgttgagcaaagaactgtttctgttggcgaggaaactgttactgccgaggataaaaaggctaagaaagagaaaaaacaaaagaaggaaaagaaacaaaaggaaactaaggctgaaaaggaagcaagaaaacagagggaaaaggaggagaagttgagagaaaagcaacagaaggaggaagagaagagactaaggaagttgaaacaagctgaggaaaagaaatcaggtaaagcaaagaagggatatgatacttttgctgagaagtcatccttagaggaaccagctctggtagatgacacttgcaagcctaaagcaggaactcacttggccacagtgcaattagatgtcttaactaaggcatcacaaatgagattcagccatccagaaagttttactcatggttactcttcttcaattataggtcttgatgataacttggaatctttgattgctaatgaaatggagcaaatttcaaagttgtcttctgaattggcagtttacaatgtcagagttactagagatacaaaggagctccttttacagttggataaaactattaaattggacgagcaatataaggatgaagttatttcagtagttaatgggcttgatgttgatagaaagtgttccaaagaattagtcaggggggttggttctttgttagtcaatttacaaggtaaaaatgatgccttatacgcaaagtcattgctcctcacaaagttaataaataaagaaaacgaaaccaatcaacctgaaacagaggaaatcctacaacttaatgatgctttggtctcgcaccaaaaagttattagtactagattaggatacatttcagacttgagcgccgcgatgttggtttgccagaagagagattatattccaaaacaaattgtatgcgctcctactagtaattacctccccaatcctagagaatgtactactgatgatctagtcaatttaatggagaaaatgatattcaatgttatgatgagatttacagaaaactcatatctccaaagttgttccgatagagtctctacctgtaaagatctctgctctaatggagatacttcatgcttggaatgtttcacctcatcactttgtgaaagaattcatcttttcagaaagcactcatatggcaaggatctcgtcaatactgctaacaaagcttacgaatgcgaaacatatctttacttgcaatttaaaaaaaatgaaagccaataa

SEQ ID NO: 2163 - DNA, 1584 bp, Cryptosporidium hominis
atgataagtagtcttgaaaatgggcctactgaggaggatcttgaattattattaggtgggtataataaggaagaggaaatattatttgttgatttgagggaagaatcagatgaattagataaagttgattaccaggaaaattccaattttttgaatccagttagctatataaaaaggattggagatgaacaaaatcaagatgcacctgataaattgaaaaagcgtagagttaagtcaaagaaaacaagaccaaggaggaaaaaaagtaaattgaaagatgattctgataaactttcaatagactctgatgaatttgttgtaccagacgatgaggtgattccacctgactgggagtataactttgaaaagccaatagtttgtcaaaatgttacattttataataaagttgacaatattttaactgagaagcttgaaaatgatgttgatcattttaaaattaatgaagaggagcttgaatgtaatgatagtagtttggacgaagattttttaaatagttgcgaaattaatgaagacggatttaaaggtagaaaacgtaaaaatggaatgattgggattgatattgataaagaatatattgatgataaagacaatactgcattaattgttgaaagccatttactgaaagatgacatagatgatgaagaccaggtaatttttgtagataggaatttgaactcttttattaagcaggttgataaaaataagacaatagatgaagttaggacatatgattctgaaccaattattgttgaaagcgatgaattcattataaatacagagattttcaattatgggatttttaatatatactttaaaatgatggatattattgaagattttgaaaattataacaagtttcaatgtttttcagaaggttcatttaaacttgaagaaaaagatatttccactcttttgatagtattcaaatcaattgatattgaattcagcagtttcagcaataatagtaacattaatagtagctgtagcagtggcaatattagtaataataatattggaagttttgacttgattcaaagttaccttgacttattttacaataatatcttaaattcattaaaagagactcaaaattttaatttaacatttttaaaggaattacactttgaaatgattggttttattgagtcaaagtttgatgagattgttcaattgaacccatctgaatggaattacaaggtattgtttttgtttttaagaatacttggactaactttatttgttgagcacttgctaatacatacaataaagattgaaaaaacttcagagccaaagatatcaaatttgaatgaagaattttcagttttttttgtcaatgaaaatattttgaacaaaaataatgtatccaagattcttagacaaatcttgaaaaaaatgttggatcatttattaaatttgacgttaaaagaaaacttgaatggtaatatgagtagtattcattgtattttgattttgactttattcattaattttaaagtaagtggggacttgattttcactcatatttcagaaaagtatattaaagatttaaatataacttttgat

SEQ ID NO: 2164 - DNA, 588 bp, Cryptosporidium hominis
atggcaaaattatacttttactattcagcaatgaatgctggaaaatcaacggttcttcttcaatcttcattcaactaccaagaaagaggaatgaaaactattctctttacaattagcaaagattgccgatttaaagaaggctcaatttgctctagaattggtctctcagaaaaagcgcacacattcactcctgatttaaaactacttgatattattaatcaagaaaataataaggaaaaaattgattgtgttctagttgatgaaagccaattcctaacaaaattccaagttagagaattatgcattgttgttgataagctagatattccagtactatgctatggtttgagaacagactttaggggaaatttatttgaaggaagtaaatacttattagcatgggctgataaacttactgaaatcaaaactatttgtcgctgtggcaaaaaagctaccatgactatcagattaaatagtaatggggaacctgttttttctggcgaacaaattcttattggtgataattctatttatacttctgtatgcagaaaacatcatataatcagttgtgaagaatacaatttctaa

SEQ ID NO: 2165 - DNA, 297 bp, Cryptosporidium hominis
atgtgtccatcttcaacaaatttgttctggactttggttaataacaattcttctaataataactatttgtcacgtttaagtgatcatgataatgactacaagagtagtcagaataataacaaaaattctcatgtacaaatatttaatgagtcccaatcatcatcatcatcatcatcatcaatgaatagttctcataatctttcaaatgatattctaatatcagaatccttgaagcctatacaaactcagaaactacaatctattttaaagaatgcaacttttaatgaaacaaggtaa

SEQ ID NO: 2166 - DNA, 1248 bp, Cryptosporidium hominis
atgcaagtttgggcaagtggaccagatcatgaacaagttgagaaagttcttaaagaagatgaatatgttaaaaaagaatttcttagaaagtatatatatgatgatgttgatttttcttggaaagttaaaagtattggaaaaaagttatctagacctgaacaagtttcaaggatgaatcgttatagttttctatttaaaggtaccgagactgttaatttaaaagatccttctttaagtctgggaatttttgaagattggagatctattcataatcaagaagaacttccaatagaaggaatttctaaggagcaaatttctaagcttcaatctactatgcttaaaagggtttatcttggaagaatattagagaatcaaagctctactgatcttggagataaatctctatggtggttgaagtatactttaaataagaggccaatcttaggtccaacaactatggataatgaattagcctttataatgtgtaatattgctcaagtaaaaaaaaatgatatagtttttgatccattttgtggaactggtggtatccttatttcagcttctcattttggagctacatgttttggatctgatcttgatcttagagtaattaatggatggttttgttcttatgttaatccacatatgattaaagataaatctattcaagaagaccattcaaaatctatttattctaattttgattattataagcttgaaagacctggtattattagaatggatatttctcagagaacaattagatcttcatggatagatgccattgtttgcgatcctccttatggaattagagcaacttctagaaccactaattctaattcaaatcaacctactaatgtttattcaggtaataactatatccatacatttattcaggattacaattataggaaatcttcatcatcatcatcatcttcttcttcttctatatcaaatactcatccatctacaggaaagaatacttttgggtcgcatcagccaattgatgaaatgatctttgatctattatcatttgcatctaagactttggttattcatggacatcttgtctttcttttacctcttatggtatcagatgccaatattgtaattcctaatcttattgaaaattggaagcatatattttctattgattttccttacatgcaaacattaggaggaggtctcggtagattattagtacatatgaaactaatcaacaaaagtgaagaattatttgggatctaa

SEQ ID NO: 2167 - DNA, 717 bp, Cryptosporidium hominis
atgagatttgttgaacttgttaaagttaaaaggaaaattaatcaactccaaaaagtcttggtagaaatcttaagaaataatgaaattgaagaagaaacacaacaagatgaaaataataatgatattgataatgtagaaggaaatccaaaagaatgtttggatttaagtttttcagaaaatgatacagttagagataaaattttgaaaattaaatcaaaaatattagtttacaaaagatatgaagattacataagattacttccattttttaaagaaaggaaatatattcctttattttcaaatacagaattggattctgagatgattaaaagaagagaagaatatattaatgatgttcaagaacttaaggaagagcttagaagaaagaagattaagacttcagaaactaataatatgtcattgaaagattcatttcttgctcaggatgatagtgatgatttagaatgtgatcagaatattaataaggaatatgatactttgaaaagaccaataaaaaagattgaatatatgattggaggcaatcaaacaagaaacagtagtaatacaaagaaaagctctaataagataaatgttaagaaagacaaagataaatacaaaaacaaatcaaactctaacaactacccaatatctgaatcagaaacaaagacgaagattaagccatcaaatagtcatgttatcttttcagattctgattaa

SEQ ID NO: 2168 - DNA, 1518 bp, Cryptosporidium hominis
atggatgagataaaagtaaccccaacaatgaaattccactgcaaaagtggaagaaaaactccaaaagtaattgtagatttctcatcaccaaatattgccaaagaaatgcatgtgggacacttaagatctacaatcattggtgatacaacatctagaattcttgaatatttaggatttgaagtattaagagttaatcatgttggagattggggtactcaatttggtatgcttattgaatatttaaaggaagaatatcccacttttgttgaaaatttaccagaaatatcagatttacaagaattctataagaactcaaagaaaaggtttgatactgatccacaatttaagttaaggagccaacagaatgttgttaagttacaagggggtgatcaagatgctttgattgcttggaaaaagatttgtgaggttagccgagttgaatttcagaaaatttacgatcgacttggagttcgtcttgaggaatttggtgaaagttattataatgatatgatccccggggtggttaaaatgttggatgaaaaaggtattcttaagcttgataatggagctcagtgtgtttatactaaaattaatgaaatacctttaatggctgttaaaagtgatggaggatatggatatgattcaacagatttagctgcaattcaccatagattaatcactctagatgctgattgggttgtctacactactgatatgggccaagaagaacattttatgaaactttttgacgttgctgaaactatgggatggcatgatccttctaatacaagactatttttcattggatttggagttattcaaggagaagatggaaaaaagtttaaaacaagaagtggtgatgttgtcaaattaactgaacttattgacgaaggtgttgctagagcaaagaaagaattagttgacagaagaaatcaaagaagatctgaccaaacaattaaatcaaatacagatgttgaagttgatcatccagatattgatgattctaacttggatttaatggcaaatactattggccatgcagctattaaatactttgatttgaagcaaaatagacttactaattacagattttcatttgatcgaatgttagatccaaaaggtaatactgcagtttatttactatatgcatatgcaagaatttgtgcaatctttagaaaagttgaatttattcaatctgatgataatatggtaattaaacagaaagtttcaaactttaagcttaagatttctaataatgttgaacgaaaattgtctattcagttactcagattccctgaagtttttgatggaattttgaatgatttcttccccaatagacttgctgattattgttatgaattgtccgagagttttgcacaattttatactgagtgcagaattattggattagaagaacagcaacttgaacaaagtaggcttttactttgtttcttaacaaaacaaattcttttaaaaggacttgatttattgggagttgaaactttggagaagatttaa

SEQ ID NO: 2169 - DNA, 2133 bp, Cryptosporidium hominis
  misc_feature (589)..(589): n is a, c, g, or t
atgaaaaacttttcgaaagaagagacacgaaagccttttacaaatagacaagttattgatattaagtcgaggcatgatcagagtggaagacatttaaagacaaatggagaatttggatatgaaagtgggatttggtcaaaatttgttggattaatgaaaaactcactaaatatttcaattttaaacagaccttcaaatcaattgaataaagttatggataatacgagttcaaaaaaccatttgaaagaaataataatgaagaagaatacggagaaatttaacgataaatcagcaaagttaggaattggattaagagaacagaaagaagttaatattgggattaaatcaaagggggaaaagagcccagtttcgccaaaaagtacaaagatatctcctagtttatctcccgttgtttcttttccctattcaatatcatccccatcatcttcttcctcctcatcattttcatctccttcaagtttgaatgaaaatattggaatttcttttgcagaacaaatattgaattttaattcaagtgaatattccaaggttattaattgtcaagctcctgttactccaacaacattanatgggagttcaacaacaacatctccaacatttacaaatttacgtttttcaagtccttcaaataataatggatctgcaaaatataatgaaactccaaatagtaaggaaattgattcttcaactttaaaggaagaatatttttcaaataaaaagaatcatgcagtagatttttctgcagatgataatcatctaaattacataatggaaagaataaatcaaagtggtttagtagaatccaatgataagtctgccgtaaaattagatattcctttattaaatcaatatatctcacaagacttaattgcagaagtaggcagttgcttggaagaaaataataaaaggatatcaagtaacaaatatactttattaggtagaggattgaataatttaccaaaacattcatccacagtatcttattctccatcttctttatcatcaggaaaaaacgacaaagtttgttatacctggaaagaggcaaaacaactcataagtaaattaaagagttcaacaaaactgtataaatttaatggggtcccattttctgattgggctcacgagaaaataccaactttaggtgcttccccaacaagttgtagggttcaggaaatgttcaaatctagaatttatttggaaaaaaataataatgaagtttatactactttatttataaaaaagataccaagaaatatttggtctaaacaatgggaaatgcatgagatttgggatggtgattatgttactgatggggaagactttgtgatggaggctgcagctttagcttttctgcaaaatcatagtgttggaattgctccaagactatatgctattctggaacattgtgaagatcattttaatgatgttaatagtaataaagaaagtaaaattcaatacagaaatatcgcaaatagaaatgcttgcgattatttactatctaaagatactacacatataatattagtttcagaacattatggtgaagacttattggattatttggataaatgtgaaaagaaaaatagaaatctaacagataaggagaaaaaagaattacaatataaattggcattagcattaaataatcttcatttaaaaggattatgccaccttgatttcactcctgaaaatattttaattggcccaaatggtatcaatatttgtgattttgcaaaatctactccaattattaccaaaaatcctagacatactcattattcaagaaaaagtccaaaaaatcatttatctgaaaattttaattctaataatactagctttaactttatcaatccgcctcctgaagcttattgtgaatttgaaagttgtgaaccgactgttggaaaaggagcttatatgccaccagaatgttggaagatcttttggagattagaggaaaataaaattcaatttccacttgaagaattaatggatattgatacatataatagaagaagcaattattcatattttaatgaattctccagaattcataataaaagtccaattaaatgccaagatagatctatgttttattttaatacaaggattgct

SEQ ID NO: 2170 - DNA, 486 bp, Cryptosporidium hominis
atgttcaacatgcaattcgaaggtacttttaactatcaaaagcccaatcattctgttaaagaaacggtaaagttatttgacattaaatcaaatgactttaataatacaatctcaacaataaatagtgactctaatcactttgaacaagaattgaaaacatcaaaaaaaaaatcaaactatcaaaacaatacaaaaaagattaaaaaagtcctagatcctcttcaaagtagtttatatgtcattgaccaagaacattttgaaatcttcgatccagtatacccttcaatgactgaaatctttcaacagagaattaagaaaaaaaaatatccaaaaacaagttccaaaacaaacaacattaataataagacactctctaatttcagtcaaaacaaatataacaataaccacattattaacaattattttaattacctttggcaagttggagatgaattttcagagattcattgttttcctttgttttaa

SEQ ID NO: 2171 - DNA, 2433 bp, Cryptosporidium hominis
atgagcgcatcagaagtaaaggatactaggctttctttgattacggcttttcatggagcttggttttgcaaagaagctacaataactaaagttggaagccagatactctcattctgcaaggggtatcgatcaattggtgaacgtagggttccttttaacttcaccttgtctcataatacttcaggactaattcacgatattgatggcccattagacgataggtctgatcctagtacaacgggatatcctttgctagaattctataaatcaaattactttttctcattatacgaggatattgactaccagacaagacaaactactggtgcaagactagtagtctactcgttaaatgcatcatctttaacaccttttagtgcatcttctaacttcgatacttgtacaaatttgctccatgataagattctaaaggttaattctgatggtacctttgatgttggactcacatggaaaaatgcctattatatagcagaaccaaaagttaagcgtccaaaatggacagataaaatgaaaaatccattttctgaaagacaatggaccgtcactgattatggaaatcagaatctctatgtacctgactggggagaaggtctctcagaatttaagaatccgcgtgtatatgcttggagctttgacatgccaaattcgatcaattctgaaccatttgagcttgatttcagttttcgtgagacacattctgtcttttcattaagactacttccaaacgaaatggctatggttgttaatgcttttgaaaatgagcctttgaaacttggttactctttttgttttggccgtccatctaaggctattctatgtaatttggctccttcagaacctattggttcatataatcttgaaactatttcagaagttattcttactcctcctgatgaatttgttagaggaatacaaattattattacatcatgttctccaatagtttctaaatgcactttattatacttttctatgccttccaatcagctgaatgagcctcactggtcctccttacaactttgtgctcaagatcttgtattggatggactctcttggtctccggaaggagaaagaagaatttgtgtgtctactcaagcagatcctgctccagcaaatgaccctctcaaatttgaagatttctctggactatttggtacatctaactacgttcttattcctttaaatggttcaaactgggtattcacttctacttatgttgggagtaaattagtacctgttgcaattaatattattacaggacaagtttgcagaattaaacttgtcgtaagtgatgagtcattgtatgagggtgatctagaaattttttctgtaagctttggacctaataattcttcagtttatgcaactcttaatctatcttcacctactatgccatctttggtcatgattgtacaaatgtgcctaaatccagtacgtaatattattcacgctcaaatcgtcaaatctctgagctcttttggaaagaattctaatgcttttgcttcatctcttgtaaaaaaaattccacaatctccattgtttaataacacattcaatcttgcaaaagtcttggacaatattgaattcttcacttttaaggacaaacatttagttattagaagtaaggacctatctaaatgttctcctgacctcaaaaaaagtccactttttctatttcttcatggaggtccacactcagtaacaaccacaaactacaactttttccttgttttcctagtaagtatcggatatacagtacttgctccaaattacactggatctattggttttggggacaattataccaaatcacttattggacactgttttgaaacagatattaatgagattatgtctctatcaaataatattagaagcgttaaagaactgaatttggatccaaacaaatgttttgcttatggtggatcatatggaggagctttaattttctcattagtcacaaatcatcccaattttcttacatgtgctgtatctagtaatggatttactaatgcgatatcttttattggaactactgatattccagattacgtattttctgagtttgttcctgagacttcagtgccagataagaaaagaattacaattcttagagatacagacactttagttaagcttcatacgaattcgccaatatctatggtagataaggttgttactccattattgatagctgttggaggtaaagataaaagggtaccagcatcacaatctattgaattttataaagctttgaagcagcttggtaagagcgaggttaaaatgctttactatcctgactcaggtcactcaattagtaggtcaaaagaaccattagacttattcttgaatttagcgaattggtttggtcttcattctgggattcctttcgtttttagcggagatttataa

SEQ ID NO: 2172 - DNA, 4095 bp, Cryptosporidium hominis
atgaatgtgactttagggtccatactgttccctgaacgtcgaaaggtagtggtagatactagaaaggggcttcataacaagagaaagaagcaggtaaatgctcagaaaaaccaggaacaaacttccaagcaatttactacgcggcttcttttggatgacgaaacaattgctccaaatgattttttgaccccatttccaagtgatgaggtaagaaacacagagcaattttgggagtatttagagcgtgtgttttatcctgtagatgagagatggattagtatattggatctttcagcaaggccacagaatttggagccaagtgaaacatgtatagggttacattttgcttataggtgggcattggtagatttatttgatactagcgaactttttaaattggttgggaatagaaataagatttttaagaataccttagagaaatgtaagaatttatcatctgatactaaagcaaatagtagtagcggtagtaatagatcagacagaaaggaccaagttttggatcaatcagaggatttccaaccacataatttggaaagttcagatttagtagaagaacagaaggttttaagttatttggagtttcttgatcttccaatacttgagctcataggaatagacccagcagtattgggaggagtgaatacaaatgcgaacaatttggtaaaacaatcagatagtacaaatcagaaaaaggggtctttaaataatccatattttgaggaatggaaatttctctataaaagattatgttatattgagaaggaggttgactctatgcttttaaagctaacagatagtgttagtgagaatatccataaggacaactctaggaagttacttcaaagacatcaaacaaagaaatgtagagaattcctattaaaagtgatgcattatcatagtatgagacaatttgtggattctctggaggaggttttatactttgatgagaatactgggcagtatttgacaacttgggatgatggcgaggctgttagagccgcatggatgagtcaggatcagcttttacagcttcttttatttaggccaaactctacagaaagtaaatattctgtttccatcccaagtgagtacattccttatgcaagatctttagacactcactggcttaaatacttattagactctggtttaacaatgattagcgatgattccaatcattctcaagatgatgataggcttggggatactttgaatctagatacactttctaagcctaaagatggttgtattgaactttcaaggcatcctctttgtcattattgtagaagaagttgcaagagacttaactattctaggtgcccatcaaaacttaaacctttaaatcttggaattaatccttcaggtcttaaccaaacgacacaagctcaaaatccaaactcaaattctattttaaataataataactctttaaagctaccaggaacttcaacatctactagcgcatccaatatttactattcaagatctcttattccatggagagttccaaagtctcaaagtaatatagaaaatagtgaccattctgagccaattcatataaacagcaataattataaccaaaatcaactccgatttggaagtaaatcaggaaaatctattaagcccaataatagatcgtcaattggagggaattcttgtgtttctggagcatcttacttgcttaacgtgaataaatcccatgtatgtaatatatgcactgattttgagtcaagtctgaatgaatctgtgtctgctcctcaggaagaaatcttagttagtagagcctactctcccaataattgttggagaatgtactgttcagaatgcattatgcataatttctcctcaataattaagcaaaagtattcaaatggagtggttttgaggtattattgccctttttgtaatggtgcttgtaattgtgagaggtgtctcagaaatcaacaaattcgaaaaattaaaaactacttgaagtcacgtttctgcggatatacattccagtgttcgatatccagctgtgtaattcaaaacgagctcagctggtatgactttctcaaagattttggcggagactcattatttccgaatattaatgataatagcacttataaggaaaacaataatctattaggaaataatgaaacaacattagtgaacgatttaggtgaaattgatgaatctatggttaatcccagcaacttagcagtggtctcttatattaacaatgcaaacaggaggctttccgtcgcagaaaacacacacctgggctttatttggcttcaagctaataatattccattccaaaagcctactccttcttcatcaggagtgaatgcaaatatcaatgattcaaattccaaaaaaacaaccacactatccagtgctctatcaggaagctgtgtatccgaccccactaaactagtatctaagaataagtcgagaagtaataggtcctcaattaacggaactcaaaagaacaaaagaaattcaaacgtccaaagcaactttgaagatggtgattctggtcattcgaataataacaaatctcaacaatctacacaatctgctacatctaattcctccatgttttcaagtatgagcaggcccgcctttaacattaaagtaggaggcgcccaaaacataccgccatcaattcatataccgcgcgaagtattaaatgagccaacgcatgcatcaggagcttcggtactttggagtttaaggtcgattttaatcaataatgtgaataagtaccataaggaatgtttgaataatttggagcgttgggagagtatccaggagttatataataggaagagggtagaactggagagctactttgaggagcagctttcaaagctaaacttaatggacgactggattcgttcaatatcatttacagaaactaataagaggtttataatgaggaagatgccattattgtgttgggctgcagacattccatccgcaaaagcttttaattttgacgactaccctcagttgttgccaaacaataacgttgtggagatgattaaacatattcagaattttgtaaacaatggtatcatttcggaagatctaccaactcatcaaattttgggtcttagtgagattagcgaaggtgatgggattattggagtatcacaaaaaactactccaagtcttaaactaattgacaaattaccaggaatggttactaaaaactctcctagttcagttatggagtttctaatgaactcaatctctgaaatacaaaatattgtagtaaagacaaatcataacacttccaaagatgagtcatcaaaagcaaataagatccaaagaagctcgaaaaaagataaatctaactctaaaaattctgttcaaaataagcttccaaactgtgatgttgtaaacccagatgaagtaaagatttcaaattgtaataatgatttgatttcctcctcctcttccattgctgaggctgatggaagtcatttttacagtaactcacctattaatgctgaatttttatctaaaaaccacggtatgcttgaaacagccacttccactggtcaaaacgatccttccttaattaccatgtcatcagttggagatgggatccaaaaccctgatagtagtcacttgcctaacttcagccttgttgaatgtcaaaactcctctaataataatccctttttccatgggggtagcaactcatatgtgttaaatgaaggctctatcgatgcattccagtcttattctagtaagactatcccgagccaggatcctggaactgttgatggtgcccaaaataaatctaggaaaagaaagtcctctttggaactaacttctggagaaatattaactcctgaacgcaaaagggagcttgccttgaaaagaaaacgcgacagggaaaccatccgaagagcaatgaaaaaaaacagtcatctttcctcatcaagtcctacttctcctaatgctattggagcaatgggtttcagtggcatggaggaaattaatagtttgaatggggatggaacaacttttagtattagcagcaatggcagcagttatggctctccccaactgtaa

SEQ ID NO: 2173 - DNA, 3168 bp, Cryptosporidium hominis
atgcatacgaaaaggaaaaggaagtctgataccgaccagccatctgaacctaataagttcatggcagttgatgggcaaattacttctaatgtctttaatgattggaatactgaaatttctgttattacagaaaggtaccaggatgaacttgcaactaaagttagtcgtttgtatgaaggaatagggaaagatttagaagctaccatatttgattattctcaaaacgaggatgaatatatattaggtttattgaagaatactgatatagaaaataacattgagagcataatagactgccttgaaaattacaaagagtctttgaattcaaaaaaacgaaatcatgaaggtggctctatattggagggtcttagaaaaaatcttttgaagagttattccagaattacatcttacaaatttgttaaagatggtgaatttgttattaaagattggacttacttcttaccaatcttactttcaagctctgtttctgatattgagatctccattattctagacaagcttccaaaagtcattaggtttcttattaaaactattagaaagtttcagtttataactggtaaatgcgtttctgttgaagctattgatactattaatatgtataggaacattctgaatgagtttaccaaggctaatcaaatgtatcataatattcaaaatatctcaatcgaaagatcaataatagaaattcatgatccacttaccttatatattaagaatattattaattactctgataaaactaagttatcttcaagctttattccattaagatttggtaaagatcatactgaaggagcaggatcttctaaaactagttttaaattagatctattatccaattctggtgatatattgtatatgatctatggaaataacatctcttctctcggtgtttttggaactaactatttaagtagaaaaatgaatttggataatctatggcaattatgtatcttcaaaaaccaatctattggtcttatacttagtaatcacaaagaaagggatgataagtctcaagactttgaaattgaaaatcttgatagctttatagggagcttgggatatggttattcatcacttgattctcttaagcctatgaatccaaggccagagctaaacaaaagaatatcaaataatatactaagactacaaattagcaagaaggtttataagagatataacaaagaagtgaaccctaatacaaaagcaatacctcctctatctcttaatccacttattcagaagtttactggcttcaattcagtaattgaagatgaacaaaagtttggatttagagattattctaaatttccttcgattcctaacaaagaaccagagagagctgagcttatcttttctaatggagcaaagttacaagaaaaggttcctcttgggttcatatctacaataagacagcaaaaacatggtaaaagagaactggagttagttattttagatacaaaagaatgtagtaattatatagcaaatcaacataaagcttcaaaagctagaaatctaagatttgaagagtatggattgttttggaaaactattccagaaaagaatggtaattacaactttaaaatgattccattacgtacttgtagtgcctcaattcatcattcaaccaagtttaaatctcatttatattattccagatttttattggaacagcttgtaaactcaaattggaagaagagaatcattacaaagaacaagaaatactacaagctttcttctttagttaatggaggttttttaagcaaatcacaaagggaaactgttaataagatcacaaaaattatattaaataatggcttatgggagaattatagtgacattgtaccaaaattattaacaggtaccgataaaagaattagtggtaacgaaattgaggaatgggaggattttgatgaaaataatgaatttgatcaagaaatgtatagattatcatctgaatgtaggaatagttcaagttcgaaatcctcagagttttatggaaagtatttaaaattaagttcaaagaattataagctagtttcaaaaagatgtcaaaaaatgttggctaaatatatattcaaagagtatccaagatttttgacccaatatttcaagattagaaaggaatggaaagagtataatagaagtgagactcaaaagagaaataaacaaaatgttaataattcttctagattacagttggatattattggatattctggagaaaagaacttaaaagcacagttctctaactttgagaatctaaatattaagcatgaaccaaatgaattaaagacggaaaattctaaagatccacaagttcttcatttgattaaacttgaaaagaagcaagaacagaatgcattaacagttttaccaaagtttgattcaaagttaccattgaatcagatatataaactagagaatttcatatctatagagttattcaataaaattaagatggaatggacaaaaagtacaattagcatatatagtggtcaactaagtcacttttcaaggatattattaaataatttgaataattcttcaattttgaacataaaagttaaatcattcttcttaaagcttataatttacattgattggcttatatatctgattaatcattcaaataaatcatttggtggagctagagcgattcagaaatgtctacaggcgtctttagattctcaaacaaacaatcagaattcaaaatatcagagtaatttaagaattccaatagaattttgcaattggattattgattcatttttatcaaaataccagacagagaatcttcagacaagattcagcttttctacagctggagaaagtaaactttttgcaactattctatggctatctaactttgtcaatgctcattcacataatattaattacacagattacaacggtgatgactttgatattcctgtatttcttccttcttcagagccttctccaatagaattttcagatctcttacttcaagatttgaaggataaatttaccaaaaagtttagaagtattgctcatgcaatgggcttcagatcaacagttcctcctccaagaagatttaaatcaaagaattatatgatacctccaaacattaccagcgtaattttgaacgagttccctagattataa

SEQ ID NO: 2174 - DNA, 354 bp, Cryptosporidium hominis
atgtcaaggaagattgaattggttagagagttgtgtgatgagattaagtatctcagaaggttatgtcgtgagaacaatatagaatataaaagagaaatgacttctcatttggaggatgaggaatcaataataaattcatttgagtttgatagtatgactgaaaccttgttacttttaaataatgtatcaaaatataatagtatttttttggatgagaatagtgagaggaaggaattaaataatgagaaattaagacaaataaagagtataatagatattaagggcgagattaaggtgagttataataataatataaagattttattaaaattcatatataaatttaacttttaa

SEQ ID NO: 2175 - DNA, 534 bp, Cryptosporidium hominis
atggaaacaggatgtgaggtacaatctgggcgaattttagatattgggtgcggaaatggactatttttgattgatctaatacgtaatattaattttagcagtgctgttggaatagattatataccatcagctatagaacttgcaaaaaaaattgttcaagaagaggaactttctgacaaaatctcattatatcctgtagatttggtatcaggaaaggatgtttcaaaaaataatgataacgaacagattttagaattggggaaatttgaagttgttgttgataaaggtacttatgatatttttgtgatgaaggatgaaaaacatatctacaaagacagcgtctcaagatatctaaagaatggaagtatcttattcatttcatcatgtaattcaactcctgaagaattatgcagtgtatttgatgatcaaacaaattttgaaaaactttctgaattgccacacaaatcttatagttataatggaattgaaggacaagttctagcttctgtagcattcaaatatattaagaattag

SEQ ID NO: 2176 - DNA, 522 bp, Cryptosporidium hominis
atgaattcaataaaattattaaacttaaaggtagttcaaaatttaagtaaattcaataccccatacaaagtttttaatttcaggaaatctattagcacattaaaattcttatgtgatagcaatcctaagtttgttcctccattagcacataatttattgaaattaaaaaagaatagaatttatacgaattcctcggatatctctcaattcagctcaaaaactgaagggttattttttgaaattgaaaaaaaattgagcgatcttcttgataatggcttgctttccgatattgaccttcatgatgaatttatgaatatttctttcaatcttaatggagaaaaaaacaccattgtcatttcaaaacaacctgcaactaatcaaatttggtactcatctcctttaagaaagccagattactttgaattcaactctgattggaggtcaaatcgaacaaacaaaactctttttgaagttttaaatgatgacttatttaaggctactggaatacatgtcaatttataa

SEQ ID NO: 2177 - DNA, 1316 bp, Cryptosporidium hominis
atgagacaattctacaaaatccttaataattatttcaattgttcagaattaaatcaatatgaaaatttatttaatgaaaaaagattagctacttctatattaaaaactgtacctttaatatttgtattcttagatataatgataatgggatatgaaagttttgcatttactaatttaataggcttaagtatgggtactataaacgttggtcccaatgatttagaaaaatggtattttgaagatttagtcaagttatgttttacaggatttgtaatttcaatggttcatttaacttatttatcaatatttgatgttataatggatatattttattgccatgagcttaaaagggtagtatctaatgaagaaatagggccacagaaccaggatgaatcctttatgaatggaagaaaccttaatgttacatcattaattagagaaagtaggcaagatattggtaataattctcaaatattgaatgatttaattagagatgaacagttattacttgagaaagcaattaatcctttaagtatttcctggttaaagtactttgtatcaagtacttctttattaaaaaatcttcaatttgtgaatttaacaaataatgaagatttaaatgaattaaatctcagaaacgaattatttttttcagtgaacaactcagatatatattacaataagtatgttatagctccaagagtaataccaataaaattatcagaaaaatcaaaatggtcaatatatagactagtatttatatattcatttttattgataatatatcaatttctagacattctcttaaaattttcaataatatatttactaattcaaatgtctttttggccatggaattttttaattacaataactttacaattaatttttatgggcatgtgtttttcattccacaattctccaataactaatttaattattggactttttattaacatatttggagttcttcccttattattaacgtctcaaaacagaattaaacataacgtttgtattacatgttccttgctttcacttagatctatggaatttcttatttctatacttattattatcattattcctttcaacgcaaatggtgatgatatgcaatggttgcatgcaaacaccggtaattttaatgtgtccacatatttgcatgcaataaaaaattatgtttggaaaaatgacgtggcaaaaaatatagtatcaaatgtaaatggagaaaaaagtgagataaatattgatcaatttttatgggtaattattgcagttttttttattcacgaaatgttattatttttagtacaaaa

SEQ ID NO: 2178 - DNA, 1437 bp, Cryptosporidium hominis
atgagaatagctttatgcttgaataagataataacatcattacaagaaaaaaatcagaatcgtggttcgtttggaagagtaaatcaagaaaaaggagatcatatcgaattattaccatatgtaagaattttatataataaagaacttttatttcagtcttgtattgtgaaaaagaacatttgtataattcttgagatagaagtccaccatccactaagcagaattattattgaaatctacgacttagatgattcagatccatctttaatcaacagtaatgatgatatgatcggctatataataataccggtaggagcacattcaaatagaaaaccacttgagagcagattaataatagcttcggatgatgatgctaggatattatatattagaaagtcccaacaaaaaaaagttcataatgaaaatttaatggctcagaaattacttagatttccaataaaaagctgtgaaaggcaattgaataagaatgaaccagaacaagatagatttagcgaatttaaggatgaagaagatatgttaggagatgatccagtaagaaattttagtaaagaaagtctggatgggtatattatgaatgaattaccaaatagtatatattttgagctggcaaatcagatggtcaaagatgctatcgaatttagccatagtgctgaaataaagtataaatcaattagaatacttcaagagcctcattgtagctttgtaattcaggttttctcagaaattaaatggtcaagactttcgattattccacgcgagattattgctctttatcttccggaacctgaagctgggcaaaactttaaatacaataacaatagtaagaattacagcttatacgataaaaaaataaataatgatattaatcttgaaattaatataaagtcgataattaactcaataatattattaaaagaaatatatgattctgaatgtgtctttccatacaaagaatatatttggaagcttttaaattgggaatcacaattgcactctttgtttgctttaagtattatatggtatttatcgtttaatccaaaatatattttctcgtttgtattttcacttggactaataatattattcataagttttgacaaaaggaatcttgctttaaatttagaaagttcagtttccaaaaatttaaaaactttaaattctttagaacatgatgatgaattattagaagataatgttttatactctccaattaaaaataataaccacacaaaacttcaatctttaagtcccaattcaataattattgacagttatgaagcaaagaagtcagtagaaagtgttgactttacaattctggagaatcttctaacatcacaaattttttcacgagaaactattaaatatatcaacaaattgtcttatatacttgagaaatcagtgatattttattcatga

SEQ ID NO: 2179 - DNA, 2469 bp, Cryptosporidium hominis
atggtaccgaatattaaaattgagacagaatttattaaaaagttaccagatgaatctttatcattcttaaatacatcaagtactgttgaatacgaagaatccagttttgatacaaataactgtaaaatggtacttttggtacttcctgctacattaatttctcattggattgaagtatttaataaatggtactatccaataagaatcattttgtttcatggaaaaggtgaaagtgaaagaagaactttgtttgatcaacttagagaggtggagaaagtaagtactgagcttttggttattacaacttatgaaactttaagacgtaatttacaaactttgagacaaattagttggttttatgtaattttagatgaaggacataaaattagaaatcctgattctggaattactttagcagtaaaatcattaggtacttgtaataggcttttattatctggatcaccaatacaaaatgatttaaaggagttatggagccttattgattttgtttatccaggaaaacttgggacattacctgtttttgaacaacaatttgtacttcctattaaacaagcagaattgaggaatgctgcaaaagttcaaactatgagagctttaaattgtactcgaattctacaagaacttattaaagcatgcatattaagaaggagaaaacatgaactacaagatatattaaagctaccatctcaagcagaacatgtattgttttgtaatttaactcctgtacaatatgatgtttattgtaattgtttggatcttctccaagctaaacaattagttaagaacaagatgtatgggatttcaaagtattttgctttattaaacattttaagagaagcatgtaatcatccagagctattaaaattagttagaagacaaaacaaaaatggagaaattgattcagattttgatttttatgaagatcaagaagacgagaatgacttaaatactgaattaagttggaatagaactttaagaaatagaagatttgatgacaattcagatgagaatagtttatatttaagaaatattaatgtaaatggaagagatagtggaaaatatcaggcattaatgtcaatattgaaactttggagagataagaaagaacacagggtacttatttttactcaaggagtaagaactttaaagcttctttctgctcttttagagaaagatcttgggttgataccaaataaagatgttttaactttagatggctctactcctttaagtacaagattttcattagtaaaaagatttaatcaaaatcaatccattttcttatttattttaacatctagagttggaggagttggtttaaatattactggagcaaatagagtaattttatatgatccttggtggaaccctatgacagatgttcaagctaaagaaagatgttggagaataggacaaaagaaagaagtaatagtttatagactaatcactagagacacaatagaagagaagatttttcaaagacaactttttaaggagtttattgcaaaacaaatacttaaagatccaaaaagtcaatcaagcttaaattggacaaattttaatgagttagttaaaaaacctagaaaaccaaagaattatgtttctgatccaaagttagtttctaactacataagaaatattaaaaatatttggggagggaaaacaagacaaagaaaagacggaaatacacactctagctattttgatgactttgatatgtacgataagggaggatatgatgattttgacaatcgtagatcaaaaaattcaggcaagaaagaaataataaatgatgaactaaatctttttggagagataacttttgatgctaaatctgagcataacgctataatgagtattttaggtgacaataatgacgataacttggtttctaatagtattggtagttcaaacaatagtaattgctcagcaaattctcataccgaaagaaacacacacttgtacagcggttatttaagtgatgatctggcagaagccacaaatgaaattattaaaacttcggttgagttgataaaacaatcagaaattgaaagaagcaattatgattatagtgtacccacatggactggtaaatccggtcaggcgggcgcgccaagttcatttattttgcgtaatttaaagcgccaacgagttatacagggaggaggcgggttcggttccttggaaggtagtgaggatggtaagagatataatacaggtggatgggatgaggagtcgataagaagaaggttgacggagtattttatgaagagggagagattggggataaggacaagtacagatgatttattgagtagctttggggagttaatacctgattcaaatcatggcttatttaggaagatcttaaaacagatttgcacattaaataagtcaaataacgtgactagtaaggagaactattgggttttgaagaagaagggataa

SEQ ID NO: 2180 - DNA, 1485 bp, Cryptosporidium hominis
atggatagagaattctttgttttattggtaatagccatactgatgggtttgagaataagttgttataaatgcgataatcaagctgtgaaaaatgtaaaaccaataataagtgaattatttgatatgttactggaaaatattgaagctaaaagaaaagaagaaattcaatttaatgaaacttttctcaagaatggaaaggacttgaatcattacatggataataataataagccaacaaaattaactaaaattacaaatacaatatatgaagcaaatcaagacaaagtcgaaattattgatagagaaatatcaatcttagatggtcaaatgagcctaaaactaggaattgttgttaatttgctctatggaaaccaatcagttttggtacttaaacaatggaatgaaagttactctaagattagtaaaaattatagtctattgtgttcttcatccaacataaatagtaactttataacgaatccttcagaatatagagaaattcataataccaataagaattatttattatttgagatgaaacaagaaatatcaaatgtaaacgaaaagacatttttattatgcctttcagatagtatcaccagtaatcattcaatatatattacaaaactttcattttcttctaataatgaactaaaagaaactaatcattataaagaaaagaaccttaatcaatttgaggaattagaatctaaaagtgatctagtaggaaatcatgaaattcttgaattaaatcagcaagaaaatgatgatcagattctgatcagaacaaaagtgccaagtggtcagagttgctcagatttcaaacttatattactaagtaatcagaaaaacccaattacaaatggcgaactacttcctgaaacaaaaactacaaactatgagaatatttgcttttggagtttgaaactcgaaaatactcaattcaaggattcaaatctactggaaattgtgcaaagacacaaaaacagtggggctacatttactgtagccaaagtgaatccaacccctataaactataaatatggtaaaaggagtcaattcatgctttctaagtcattcttattcaaaatactccttttggttctaaacctgattcctgttacactgcttacactcggattctatttaattattgccgaaatttggacaatcatatcctcaaaaatcttagaaaataagaaatgtcttagcaattctatattcaaatctagtaaatgtcaacaaagaactaatgtttctaataaaactttaagcaatagagaaaatgataccaatattaactggattgacaaaagaaaagaaacaaaaccaattcaattctccaactttaacattgttaccagcaaaaaccttaattccgaagaatctggattctcatcaggagaaaatgaaccagttgtcaaaagtgacccctacagatattttgactctgattgctcaattagcactcacacaggtatttag

SEQ ID NO: 2181 - DNA, 1596 bp, Cryptosporidium hominis
  misc_feature (1388)..(1388): n is a, c, g, or t
atgacagaagaaaatgaaaagaaaacttttgttaataatttactaattcaaattaatattaaagcatggtttttttggatagtatactcgtttttggtcttcataatatacttttcagcagattatttatatatatttaaaaattcaattcttggaattgtagaaattaactacttattttacagttttaagtcgaactttttgaaactaaaaaaagaaaatcatataaataatgttttaattaatattaaaggtttaaatgagtatgatcttgaaattcttaaaggacgtatattttcaaaaagtgacgaatattctagagaaatagtatataaccataggaaacctaaatttgataatgaaaataaccgtattcttcttaaagctactctaaatggtaaatatttaaatagtgatttaaatgagattcaaaatcctatagaaagcaactttgaatcatacttggaatctcagaatattaaggaggagcaaaatactcagtatttatattcaatatttgtttcttttaaaaattgcggtaaaaacagttctgaaaatacaataaatttgtataatagtaaagtatcactattttgtttgaataatgaaattaccaagagtgacttttttatcattttaaacgatctttatgatatttggtttttaaaatttactgaaaatgaacctgaaatgactaaatatacttctcttcagatttacatgtataacttatttgacttggaaattaattatgaaaatttaccagattttaataaaagccgatcatttttaatatttgataactttctttcacaaattaatcaattattatatatagacattaaaaaccagaaaaaatatatcaccaaagatagtatagactttcaagataatcagaagacctataatagattgattcaaaaccttaatgaaaacaattattatcactttgaccaaaatacatttaaattatctattttcaaccatttttcaaaattcaatgatactgatcattacagttttactagtaaaaatagtgactttttatttactcattctattataactaatgatacaaatactctcttattcccgactattatttggataaatgtaatcagatcatttattcttccaaaggattataaactcaatttcaaaagcagaattaataatgtgacattcaaaaatcacattagagaagaaaatcaaaatctttttctttctgactggcagatatcagctattcaacttattcattccaattatctaatcaatcatattattttcaatattgataggtttttcttaactctaaacttatacaataaattcaagcttccaaatcatattttatatgccattaaatatatgaataaaataatctntaatattcacactatcagccacaactatttacctactattctacaaaattctaataatttactttttaatcccgagtttcataataaaaaaaccttcaacacagatcttgtcatggcagtatattcccccatagccattcccattatgtttttaattataatttctatgttcagaatgattagacattcgagtatgaaatttgaataa

SEQ ID NO: 2182 - DNA, 336 bp, Cryptosporidium hominis
atggaggaggtacagaaggttcagaagagctctagagtttggtgtgattccgatgatgaaaatgttgaaattgatatttctgatcatttaaagttaagaaaattaagaaaagtggatggagaaaagtcaatagatggaaaagaatgctctaaaagattaagagagtttcaccaaaataaagtttttaagacaaaaggtaatgaatggatttacaaagcaagaaaagaaatatttgaatcagttgatactgatcatttagatcaagaaagtgtaaataatattaaatctgattctttaagtaatttagaaacctttaataaggtaaaaactggttag

SEQ ID NO: 2183 - DNA, 810 bp, Cryptosporidium hominis
atgatgtttttaggtccgcgtgcaagaattggagtatttgatttattagaaggaaagatcaactttttacctggaattgcaggaagaaaagataaaagatattggaatctgaccattcaaaaaagcgaaggacttgataaatcttatattggattatctacatctaatggtacaattttagtcttggatgaacaaactaaacaacttgttcgttcttttaaaatgaatgatagtgttactggcttagcttttcatccattagaaaatgacaagattatatcgactagtaacactggtgaaatttatatttgggatattaatactggaagatgcagagaaagaatcgtagattatggttctttatgtataactagtattgtttcatcttataaaagcaaggttcaaagaagagctatttcttcttcctatattatgacaggatctacaactggattcgtgaatatttattcattggatgataatattcaaaaaactcaagataaatctgagaatccaaatattaattctatatttaagactccgaagttcactattgataacatatgtactagcattactagtatggcaatacatcccagaaatgaaattgctgcaatctcatcaaaatggacaaaggattctttaaagttaattaacttatacaccggacatgtatacagtaattggcctacagcaagaactcctttaaaatacgtaacttcaatggatttttcagaatatggtgggtatttagcaactggtaacgataaaggtgatgtattactatatagaattaatgactatatttaa

SEQ ID NO: 2184 - DNA, 2598 bp, Cryptosporidium hominis
atgtataatcagcaaaaaatattaatttcccacccaaattctctgaatgaaaggaatcaatcgttttctcctccatcaacaactctaactccttcatccacaccttctagcactcccacaccatcttcatcatcggttcctactccaaatattgcacagatcgcatctttagccgcatctcatatgacaagtcaacaaatggcatctccttttatgttccaacagggaataaatcaatcattcaacaacggaatgatgaatactgctttatataatgatccagcattattacagctttactttacaaacttattccaaggaaaccatggatttatgcccccaatgtatccatacggttctagttacgctccttatgttccaggagctaaaaatggaatccctgttacagaaaatacatcaactccacaaatagtattcaaagataattcggagaatataaagaatttagcaacaaactctatagtttctccaaaatctaacgattcggaaaagttagtcaaaaataatggtaatgataacttggtacaagtaattttgtcaactcctgaaagaactaaacaagaaaatattatatcgacagacaaaatagaaatcgcagtaagtgctgaaaatggaaatgtttatgacacatcaatgaaaaaaagacgaaaagaatgctcaatagactcagtaaacagtgctgttgagacagtagcaacagaaactaactcaaatatggatgaatgcagtgcaaaaaagaagtccataaatgaagtagtagaaaccaggtcctttgaaaattcaccagaggatgaagcagataatgtaggagaagaggatgataattcagaaaacgtagaaactttaggagagaatcgtatagaaagtttacaaagctctccacaatatttaaacttgaaatcagaggaaaataaatcaagctcaaatagcttcaattcctcaatcggaggaggaaattccatttcaaccaattctcatgaagacgaactttttctgtctaatgatagaaaaacctcttttgataaaattatgagaattcactccagcttgattggatcgctttcttggacagtaccaacagacaaggatgacatcattctaaaatctgccaaagaaaacaatggaaattctaatggtgaaacatccaacaatagtaatgcaacaagtatcaataataatagctcatcttctactaacaaacatgatgaatccaacaaatctataagccaaagtggacaagacgagtacaatccatttatccaaagggactataattcagcaaatgtcacatgtttctcacccagaatgcttccagattggcaactcaactggcttagagatgtaaccagatccctctctagtgtaccaaaaagtccaatgacaggaatccactttgacagaacaaagcccgcatgggcagtctcctactatgaatgtgaaaccagaaaatactacttcttcttcatccctgatctctcagaatataccattgagataactttagcagccgctattggttgcaggcaaaatgttgtcgcaagaggtgctcataagagaaagaagcctggagtccttacatttaacctttacagtggacagtttgaaaaatctaacccagaagcccccactgtaattgaaagtggctcagaacacgcaggaatatgcaatcaaagattcaggaagtctgcagtacttggaaacagcaacggatgtaataatttaaagaatcagtgtagcaacttccccatatcacacacaaacacaggggctgtttcatccattatcaacaatcccattgctcctgaattctccacaaataacatccaagtccacccaaacaaccaccatttccttaatatctttgcacccaacagaaatcatattaacctaatcgacccttcaatgtctgcactcaataactttcaagttacaggtcaaatgcatgctcatccacatgcagggcccgctcaaatattgttcccgcacatggcaataaatggccagcattctgcacatccagctacaatggcttcactaatgcatggaaatcctcatgctatgatgatggatgcttttcaacaaaatgcattgagaaatgcatctttgctttatgcagcagcgttatcatcttctactgcctcaactcataatcctattccttctgttgcaattccttcaaatgttagctctgccattggagtagctacacattcggcgggaaatatagaggcaaatattacaaatggtggaaacccagtaattttgccttcaccattaaccacagcttcaactgctcctacagcgcctagcactccaactgctacacctacatccaataaaactcatatggagacaacaaataaactttctgtggctggtgtttgtaataataatattgaaaatacaaatgctaatgatacagaagatgttgcatgcaagacttctatggaatttacgtgtgctccagcaactcaaaaagttgcgcaagttttatcttctaccaatgaaaatactggtaatggcagtataatgctagatacagtggctttagataagtcgattcagggcgaaaagtag

SEQ ID NO: 2185 - DNA, 2268 bp, Cryptosporidium hominis
atggaggtatttgagatatttattactagatatatcaactatattaatatatggtcaatagaattgacaagtgagaatttttacgaagaatttagagatggaatattactagtgaacttattaaaacaatggtcaagtttatatgggtataataatactgaaggtgatttattgatttataaaagaccattaaacagatctcaagcacttaataatattaatttatgtctaaattttatattaaatcctccagaaaagagtaaattacctgaatatttaaatggaaataatgaattaatagcagctgaagaaatatatgatatgaataaagggagtgtgattagatttattagcacaatatttcatcattatttaattccatatttacgaataaattcaaaaataattatagaaaacgtgaacaagtatttgatgttgcatggtttatcattgacaaatgaaacaaaagagaatttttataaaatgattatgaagaagaatcttaatcatacagaagatgagaacttattggaaagagcagaaagttggggacaatatttgagtttaaatatagaagaaatggaaaatagagataaagtaaaaagtaatcatcttaatgaaagagaagaagagcaagaaaaagggtatattgattttaatagttataactacattaaaatgggacaaaagaataatgttaaaaataatcatgtcaaacattttgaaccaaaatatattaatccattacaatgcgatattacttcaaatggatttatgttaattatggtacttttatatcaaatggggtggattgatactgcaatcttatgtcaaatgtattacgttccaaaaacattgcaagaatttaaatggaatcatgaaattgtttactattcttttcagactattcataaatatttgagtatacagaaagaattatcaattgtcaatcataatacttcaaatacaaaatttgataatagttttttaaataatgaaaatgaaggtgatgatgaagtgatggctaatattacagattctgaaataccatttatactcgtaccactttcaagtttatatatggagaatttttctccatatgtattattgctacaaattgatatattatataatttattaacacaacaaattgacagtaattatgatgttacatcatacagttctaatagattagcagtttacggtccatatcaaccaataaatcttgaattattggatgaattaacatataaagatgattatccattgaattggacaatgagtaattgcgaagttaatccttctgaagatttaatcgacgaaatacaagaggaagagcatgaaatagaacaaattgatgattacgactatgaaaatagtgaaaatgatgtatcattacatgcaaatatggtcaaaagtaaaaacttcaatattaataatacttcaaaatctagtagtgataatttggcaagaatagaggcaataatcaatgaatctaatatgattaatgctaatagtaaaaaaaagttggtagaaaataataacattcatcatgaaagttatcttaataataataatattgatgataatgatgatgatgattatgttgttggttcaatgtatgaatatttacaagataaagaaaaagaaattgttactgataatacagtaaataatttatatgaagataatattgaagaagtatcagaatatgatataggatatacttacgattttaaaaatcgtaatcatccaagtgaaaaaaagataaataataaacagaatgttaatactcctaacgatcaaaacaattataacaaaaatcgttatcatttaaatggaaaagtaaatcaagctgtgggagaaactggaatagatgaaatgtttactggattagaaaaagaacttgagattttgaagatatatgacgaaaataactttattgaaaagtcatcaaagaatgaaaataacccggaaaatgtaaatgaaaaaaatgaaataaataacactaaaagtattaaacaaatatttcaagaaaaaatggcaagtaacaccagagaatttcaagaaaagttctcagatgtattgaataaagaagaaagttatcaacaaactaaagttaaaccatcaatttcaagaacagctttagaagaacaacaaagaaaaattcttggaatggtaaacgatgataatgattatgcttctaaagtatttgatattacaagaaaacaaagtgatggtgttattgaaaaaatttcaacagcaatc

SEQ ID NO: 2186 - DNA, 2862 bp, Cryptosporidium hominis
atgcctacaaaaaagttatacttatgtgataattaccatttttcagtaacaactccaaattcatttatatatccagaattagagataaaaattatcgaaagtacattaactcaaggatttacaatttttttgagatgcggaaatttggcaacaccttataattatgatactagaattgatattccaagtggaattaataaaggagctatatttggtagaaaacttcctttgtgtaatttcccacttttagataataatgcttataatattgatatttatattggcgatgttgatatagaatttacaagaagacattattgtccttgttcttcacaatacgtaattttaagtattggatgtttggtagaatataataataatgaaattatgactctttctccatcttcagaatatagtttaactggtccaattaataataaaaaagataatataaaagattcaggtaaaagtatgattaatagcaataatttaccattaaataacttgaagatattttcaactccagtttgtatattagagaatgactttgttacaatatgtaatgcagtattacaattttcgatccagattggtgaaatagataataatagaaaagatatgaataatgaattaattgataatatttcacataatttttgcatttacttatcaccatattatgggaatgatgaattattggataaaataaataagaataaccaattaccacttgataaaaaaggaaataattcgaacattaaagattcattagcatcaataccattaataaatgaccatttaaattcaccattttcaccaaatatatgtattgatttaaagaatgaattatcagataatttaataaagaatgagaatcttcctccacaacttagaagtaatgttgattcaatatcaatgaaactggtaagaaatgatagtggtgacaataataaaaatgatccaaagatgatcaaagtaaatttaattttaaataatatcaaaccatcaaaatatttcatttatccatttcttttccaatataatacaagatcaaacatagatatgggaatatctgagaatagtaatataaatagttttaatatgaaattcttttatgatttgaattatacacaattaacaggagatccattcatagtaaaatggttaacaacaagagtagatccaaattataaattggaaactatgccaagaatgatagagagtgaaaatttggatatgaatgttaaattgaatgaaccattttatattgtaataccaaaagcaaaaacaaatattctttcttttgaaagtaataatttgtttttatatataagtaatgaattattgtatttatttgatagatataattgctcacttataattgattatattggattacttggaagatttccagtatataatgagaatgattataatttaataaaagattatgaattaaaagagacgaaaatctttaatacagcttcagaacccaaaataattgataattcaataataaaggtagcaaatatttcaataccattatcaacaattaataataatcttccatttgcttttaagatgaatattaagacagatattaaatcaacggagaatattccaataaaatcaataaatattagattgaagcatcagatgataccaaaaatgtgtaaagcatcaacatgctcaggacatggagattgttctttagtagaatattcgggaaatattaatatttattgttcgtgttatcctggatggggtggattttattgttcatatccatatttatcaagtcaatcaatattagcttatccaataacattagtgggaacgaattttgttgcaattccaacaattctggtatgtatatttaagaagaaatggctagtagcctttttagcttttattgcaggattaatatcatcaatatttcatgctgcagaagttggtttacttgttgatcatgaagatatgcttttaaaaggtgatttaatttcagctcagcttattatttcttttgtatttatattactttgcagatttaattataaagttgagatttcattattattcgcacagataattgttttagttcttcttactttattaacttcaagactagtaacaacagtaattccattaatgaattgttttacaattatactttcaagaataatttattggtataatacgacaaaattatatagtgaaaagatcccatcaaatatttcatgtacaattcccatagagttgacaaatacattaaatactccaagcaatttaatttcaaaaaataacaataattcaaataatagcgaagaattgaaagaatctccacaaaattcttcaaattgcattaacgcttgtaaagattgtcagaaagattcttctgcatctcagtttaatattgcttcagttgatgatattgctcagaatccaaattctggtcggaatttaaattcaacggttcgtaatgcaaatcatttttttgctcgcttacaatattccatcattaacggttataagaaacttattttcatttttgatcgtgaatattattcacctagacatattttaattggatttattatgggcaccattggttgtattacttggtttcttgaaactgtggacacttattggtttttccactcaatatggcatattatggcatttcttgcaagtacatttattattcacggatgtgtcccaccaaaaattcatttattcccaagtaagagccatgattttaccttcaaccgaaaaattggtcaaacaaacatcagtaataataaagccggcttagagaagcctgttgaatttgctgatggtgtaattaatgttgaacttaaatag

SEQ ID NO: 2187 - DNA, 1503 bp, Cryptosporidium hominis
atggctattatagacttagctagcctttgttcaccaatacatacattcaaacgtggtttaatatttgcacaaaaccaaaattctccaagcaaagatcaaggatttgaaatagcaaataattctcaaagcagaattcattcaaatagtaattcatctttaggagctcaaggagatatttcaaattatgcagcattaaatgtttctcatttaaaaactaaaggtgaatattcaattcccagaaggaatattgaatataattcaaatccaaattcttcatcattagagactgcaagatctgagttaggagcaggagcaggggcagtaataggaacaggagcaataataggaacaggagcaggaataggaacaggagcaggaataggaacaggagcaggaataggaacaggagcaggaataggaacaggagcaggaataggagctggaacaattctaggtccaagcacaagcctaggtttagtatctggattagggcaaaaatctgaatcatcctccaattatgaatcaaataagagtgaaacaaaattaggatgtcatttaaagactaatcaagaaagtgcagttttagttaaacaaatacctaataatcaaactcaaagaggaggtttaaatctaatgaaaattacccagaatattcaaagttatggatatagatacaattatgataatttaaatatctttgctaatcataataatttgaatactaatacttatcaaaaaaatactattgcaatatttgatcttgatgatacattaattccaacagattggattagagacacttatacgaagattagacaaaatcctgcattgagttatttattctcaaattcttctaataatgtctatcaatatataaggatgcagattgatcagcaagtcaattaccaattaataccaagtattgttcgaatattaagttatgctaaaaatatgttcttagatgtagcaattgttacaaatgcaagatctactgggtggcttaaagttattgatactatgtttccagaattaagtaatgctttaaacgaattaggaattcagatcattcgaactaatcctattggtcaagaaccagatattgaagatggagaaaaatactttaattattggatgttggccaaaaaatttgaatttgagaagattgtaactagatggacttcaaatatagataatattaaattagatttgattagtattggtgataatgattttgaagaatgtgctgcagttcatttagctgttgttgataaagctgttagatattcaaaaattattagatgttcttcaggactttctccaaaagcttttattactcaacttcaagcaatctcaaatgcaatagaaattgaaagaaaaagaaactcatcacattcatggattaattatagtaacactgtttcttctattattattgaaagtggtcaaccatttaattctgagacaatgaatatatttgaagattattctactgaagatgaataa

SEQ ID NO: 2188 - DNA, 873 bp, Cryptosporidium hominis
atgacttttgattttttggattcaggcattgaagcaatcaaccactatggaataagaaatgagaatttgaaaaattcaggatttttaagattagatttttttggaaatgataaagatgaagaagattttgtggaaagaatatatgaagaaacttttcaatatgcaaagattgaaaatccatgtaaatttgtaagtgaatataataaaggagagatcagaaagatgatgaatagaggtactacaacattgggattcatttatcaaggaggagtaatattagcagttgatagtagagcatcacaaggaaattatattgcaagtcaagaagtgaaaaagattattcagattaatgatttcttattaggaacaatggcaggaggtgcagcagattgttcatattgggaaagagtactttcaaagttatgtagactttatgaacttagaaatggagaaagaattagtgtagcgggagcttcgaagatgatcaccaatatattcttccattatagagcttatgatctttctgcaggaattatgattgcaggatttgataaagatggccctcatctgtattatgtagataatgaaggatctagagtaaaagattgtaaattttctgttggatcgggttctttatatgcttatggtgttttagacagtgggtatagatatgatttaactgatgaagaagctattgatcttggaaagagagctattgtaattgcaacaaacagagatggtggttcaggaggtcttgttagagtttatcaaataaataaaagtggtgttattaagcatgtaccaggagaagatgtctctgaacttcattatgcatactccaaaaaacaaggtactgatccaacaaagatgtaa

SEQ ID NO: 2189 - DNA, 390 bp, Cryptosporidium hominis
atgtataatcttccatcaagttggacaacttatgaagaaacattattctctagaatgattgaaggtatttactcagcaagtcttcaacttggagagattcctgttatacgatatttagcaaattctccattatgtagaaatattgcatttgcagtagaaagaagactattagattctaatctaatagacttagtatcgggagaatttgttaacactagatcagaaagctacgatgataagagaaatgaaagtactattctattaatacttgatagaagagaagaccctgttactcctcttttaactcagtggacttaccatgcaatgattcatgaattattagaaattaagaataatagattatgtttagataatggagagttctctaac

SEQ ID NO: 2190 - DNA, 1212 bp, Cryptosporidium hominis
atggacggaggcaacaaaggattttctaattactctgctgtaaattatgatagaagaaggttatcggtgagccagagtgatcctgttaatgattctgacattaatgatatacctagaggaagagcagtatttaatgcttcttataaagattctcctcaatttaaaccttcagaatttattacgccaagcgggattcataatggtattttaaatgacttcaataatcaaaaaacggatagttttgagcttggtaattccagaagaagattatcagtaacaggaatgctttctcaaagagcccaagaaacatttgaatcaaaagctgaagaagtaattggtaatgattctggtaattctgaattacaaaggggaattgggtatgtttgtagaaaaggactaaaacctgagagtcctaatcaagatgatttttttatattgaaaactgaaaattggggattatttggtgtatttgatggacatggaccatttggacatgatgtaagtaactttattcaaaaagatatgccagcattaattttaaaagacaaacaatggaagactcatccacaagatgtacttcactatgcatttattaaagcaaatcaaagattgcaagagcatgttttagagacaaatcaatttgattgtagcctttctggaactactgcgacagtcattcttcatttacctttagaaaatcgaattattgcagctcatgttggcgattctagatccgtacttgcaaggtggtcgagatcaggaagagttttagaagctgtagatcttaccaatgatcacaaacctaactcagaatctgaaaaaagaagaattattgcagcaggaggtcaagtaaaaagaatagaaggagatatcccttaccgtgtatttattaaaggaaaaatgtatcctgggcttgcaatgagcagagctattggtgatactcttggatatcaagctggtattattcctgaacctgatataaatacttttcagatacaaccagaaaaggatgcttttattttaatttgttcagatggtgtttgggagttcatttcttctcaagaagctgtagatatcgttgcagaaggaggttcttctgatgcacagctttctgctgagaaacttgcaagggaggcttggaggagatggattcaagaagaaggaaatgttgttgatgatattactgttcaggttatttatcttcaatcttaa

SEQ ID NO: 2191 - DNA, 963 bp, Cryptosporidium hominis
atgataaatttcaaaatgtttaaaaaatcatcagattataaaatccaggtactaatacaattagtattaatttgtttttttatgcttttgggacaaatcaaaggagataagacaaatacaaaatttacaggttggataagtgaaggtttaatttcatcagttaataatgaaacagcactatcagaatgtaaaatgttattaccctatggagttgaccagaaagaaattattaaggtagcattttattgtaaagatgatgagattatttcgtatattggagtcaataaccaagttgtagatcattctagtgctaattatattgatgaaatccagaatcttaagattggatgttcaaatggttattcttttatctcatttggaggatctaaattaagtcattataataatactagtccaggatacccaatagtggtttcgtctattactgctggtttcactccaggaggatcttcaagaatcccctctcttgtattattggaaggttatttctcacaaattcattcattctctattagaagaagagttagttctttggaatcaactaattctagaaaatggtcaggagaaaagtttattggaggttgttttgccttattaccaatttctcaacctggaaatttaatatattcaatagcaggtattggatttatatcaaagggaaatgcaccaagtactttaacttattcaagtaagggtatatatttaaagaatatgatatatacagttgggaaagtatttccagaatgtcaaactctagaaggccctgaaaataatcacaagaagaaaaaccctgttgtatattattccataatgtgcccaaatggccactttaataagttcagaacttacaagaaatattcttttggtacagcaaatttagcttctatagaggtaagtttaagagataaaaaaatctttaatattatgaattgtgaatattaa

SEQ ID NO: 2192 - DNA, 2352 bp, Cryptosporidium hominis
atgatttgtacaggtattaataaagatggtcaaataacaagttttggtattggatacaaagaaatgatagaaccaactccattgtttattgatgctgtaaagatggtaaaaccagaaatcattgcttacccaatatctttacaaagaaatcaaacaatcaataccgccatatcatataacccaaatgatatgcaaatctccttcttatccagtaaagcaacaggttgtaactattcatactcacctggaaaagaaactacaagcaaaaacactattcaagttcatgcccagtgcaagtatgactctaatggaaatccacaatatattaataaactaattctattcattgatagctatacccaagaacttaaacgtattgctggtatatgtagtaataatcttaagaattcaaagaagagtgataaaaatgaaaatacagaagatgatgaaaaattaaatattgaaattgaacgtaaacttaaacaagaagatcaaagtaaattgattaatatgtttgatcatgacaagtggccgttgaataaatgggcgccatctccatttagagtacagcatgcatccccatataaacaaatgcatgcagaaaatggcggggaattatatcagaatagtttggatttgtcatttgcatttgggcaatcaatttcaaataatataatggttgtatcatctcaatcaagtccctttaattctatttatttaggatataatacagagagtactaatccagtaatgttgacaacaagattgagtgatttgaattcaaataagaagactttattaatgcagtactcaagctttttggttccaagcacaattacttactgggaaatcccaagtgttgatggtaatgtagtttatactgattcaatttgcgttgaattagaacaaagaaatggtaatataattggtattggttttgaaggttctatgtcatcggtaccttatgatactttagatgaaaatgttagtgtaataaagtcatcaagtaatgaggaaggtaataatggtttgcttggtggaaaattggaggttttaggaaaacagaataatggattgataatagaaaacaagattaacaaagataaatgtgagaaattggcatataacacgccattaatggattttttgaaggatttaaatcagcagaactctacagaggctgagattggaagtccatttacagtaacttgtccaaattgtacagaaattgaatacatcaaagcacatcatataattgatgggccaattattggacttgaatggaaatgtacaggaactaacaatgttgagacagtttctttaggtggaagatctccatctcaattgacaactcagctatttaataaagttcagccaaaaatgattgagctagcttttagtgtaaaggtaagaaagaatgaaaataagtcaaaatctcatgaaaaagaaagtattattccaggtcctgcatttttctcaatagatgggtatgctagctctgggaagattcaacaattactttactatagaataaaagatgcttctcttggtccaacaataacatgggaaagtgatgagaaattaaaacacgaaaagcatgtattgagaacagtttgtggttcactttcaccatctcagggaatactttcacttggttttggatttgaatatcttcctttaaaatgttctgatgaggaagttaagccaaatatgattccagtagataataagtacacaggaaatgttccaagcgtaattgtaaatggtccaagaatttcacaaaaagtggactcaattcatccacattgtagtcaattccaaggtggatctgcaagaacaaggctcagtaattggattatttcattttcttgtttagatgatgatattaaaggagaggttccattttctaagcttacagtcttaagatcaaatacaaattctaaaggctttgctggacccattaaagttttgtctttccagtgtccagatgagaaaacttcagtttctgttggtgaaaatgactctgaattgaatcaaatgacttcacaaagctttgatctctcaaaggttggatcaacattagttgtggacttttccccactaaatgtagttccttcgcaggttaaacttaaccctccatattcttcagaatctgcctctaccaaatctacaacattgacaaatgtatcaggatttaatgagatttcaacttctagtgattcaatttatggagtttgttttgagctaactagtgatggaaaaattgcaggcattacttttgcaaacaagccatccaagaagaagaaaagtagttcaagcactttaaagaaattgggaaaaatcttttcataa

SEQ ID NO: 2193 - DNA, 738 bp, Cryptosporidium hominis
atgagcgatatggacaaaattctgccttcaaaagagcatatagaggaaggtttagctccaaatgaaggggaattagctattatttatcatgatacaacagctggctctactaaacatattgttacaaaatctcctaatatatctcctgcaaaacaggaagaatccagtctattaggtaataattccttccaaaattatattaatcatagtttatacagtcctgtatataccagtaatcaaattggaggagaatacgcattccctaaagtaaaattctcaagtttaatttttccatggtcagcatttctagctgtaattatttcatacgtactttcaagtttctcatggtattatctcttttataatgatgactatagattggttttggcaccttttgttacttcatctattatatgtttttttgaatctcctgtaatgctcgcaaaatacttatttagaaagatgagaaaatcttttatatggagattaattcctatgggaagtatggtgtttcactcccttctcttattaattgcatcagtccccatcaatttattatattgcagttatattcttaataagggagatccaagtcaaatatttaacttaccattacattatttaattttggcgggaatccaagctttgtatataattccatgcattttatttttgatagcacattccagatttgaatcacaaatattaaaagatagaactgaatatgaccactggtaa

SEQ ID NO: 2194 - DNA, 396 bp, Cryptosporidium hominis
atggctcaagttagtagtggtgtatttgatagaggatctaaagaggccttagaagcttctaataaaacaaaaatagaagaattaagagccaataaagaaagagaacaggctttgcaatcgcagggccaaataattaaagatggtgaaaaggttaaaattggaaaacaaggtccagtcacattagacgatcctgatgaaaataaaaaaggcaaaacaattcctccaaaacttgcattagttgataatgaagaacagtttattaataaagagacaaatcaatccatatttagtcatcctttagtaattatttttatctttatacttgttgtatgcatgtttgcaggaggaagccttattttcttcaagaaatttgggaaaaagaaaagaaagaagtag

SEQ ID NO: 2195 - DNA, 591 bp, Cryptosporidium hominis
atgtattacacaataatatttttgattctatttgaactattttcatcatattttcttgaacatataataaaacttttgaaaattcacaaattaatcaatggtgaaacaaaccaaataattaactcagaaatttctcagttagaagaagaattaaaggaacttaataaaccatcaactttcactgaatatgttaaaaaaagtcgtcaacttaatatattaaaacaaactttaaataataatgtaacaaaagaaatcaaccaaactaatcataaaaattttaattttaccaaaaaaataatgggtggaatttacttaattctaaaaatcattaatttccttcctccaaaaattagacaactcctgactttctatattgttaaattatgcgttgataaccataatataatcattccttttaatcaaaagttatattctccattctttcaatctaaagaaaaggctaaacatattaattctttcttaagttatggccttatttgtaccctaactgatttaataaaagtattaatcaagcattcattatattttaatatgaattatattcagaaattttcatcaaagtttatataa

SEQ ID NO: 2196 - DNA, 549 bp, Cryptosporidium hominis
atgaacccatcaactcagaattcttctgcaagtttaagagcagatgggcagactgtctcttttggtcaaagaaaggtttgggataatgagagagatctcccggatgttgtcaagcttttggatagagaatataaggatgttattccatttacagatattcaaaatagaatgatggagtggaactttataccaagagaacacattgctgaagcttgtgatacacttaaatccttatgtgattcacaaggtaatataagtctccatatattaatagatcagcttacaggatttcccgaggcatctgaaaaagatgatatggatgcaaatattgatacattggaggcttacaaaatatttgatcataacaataagggttgtattgatcttgaaagtttaagaaagatatcaaatgaacttggtgaagagcttgatgatgaaacccttaccgggatgctcaatcttgcaactcaagatgtatttagaaagcagcaaaacattattagcagggatgacttcttctcacttgttaagagtaaagtattaaactaa

SEQ ID NO: 2197 - DNA, 1662 bp, Cryptosporidium hominis
atgaaaacattgactaaaagcgaacaaaagtgggatgctacaataacaatgaatagtaattcaacagatatggttatatattcagaagaaaaaaaagacatgggagaactggccccaaataagttctggaactctataaaccaaggtgtaaatttgattgttgggctttatgaaggcattcaatcagcatgcatggctactggagtacatgaatcagaaatgttaaatgaaattagtatatttgataataagttaggaaaggctaaaagaattgcaaaaaatactgattttggcaatagaatgaattcaaatgaaatttctacttctaattccacaagagtgtcatccgtgataaattttaatgatttacttacatcgccaagtggtataacatcaaagacttcaagtattaatgatttaagctatttatatagtcaattaggtattggaggaggatttgaatcatcaggattacttcaaagtcttagtaatgatccaacaatacaactaccgcatatggatgtacctaatttatcagcacatacaaaaatgtatgcatttcgttcacatatttgtctctcaatattatgttctcaaaatattgataaaattattgagactaacttagtttctggtgattttaaattaaaaggtcctggttttagggttgaaaatgtatatataccaattagaaatgaaaaacaaaatattgaaattaagctaacaacatttacaaatcttggaaaaagagttgatcttggagttgatattcctatttctgctatacataaaagtgatgaaaattttactttttggttatcactaacatctgataaagatcaatcttgccaaaaatataatgatattctacctgaagctgtttttcgtcttaaattagataatgaaaactataaagcaggagttattcatcctaggatacttgttaatgttaaaagagttatgactggaattattgaagatttacaaatctcatctttaaaagtttttgatcataatattttaccttcttctggatattattcttctaataacaatcaaaaatcttcctctacattaatttatgttggattatataacgattcattagatatggaaatttctcagattctcaattctaatccttcatttctttctaattatattattgaaagaattaattctgctggacattataaaattaatgatattgatgtcttaatttcttatggatcaggaaaatattccaatgcattatttgttcaagatgaaacttcacgtcaacctttaattgattatcttaataatactaatgaaaatattgaatggttaacaagtgagcctagtaatgcaacagaaatggttccacctggagttttacctgatttctctggtactccagctccatgggaagttgaaactgatcgtagaaaagctatggaattagcttgtcatagagttgctttgagagaacatattgctatacagtatttaattgatactggatgtactaatttaccaaatccaaaattctctcaatggctgaatccaccatattttagaattggtcctcaatttgagccagatcctatgagttataattggggcccaaattatactaatattcaattaattcctttagaacagcctaaaaagattaattaa

SEQ ID NO: 2198 - DNA, 3780 bp, Cryptosporidium hominis
atgataccagagaaaatattggaagaagatttgttagaacatgatttacaaggttcaaatgcattagttctaccaacttcgaaaattgagagaaagagaatacatcaagaaaataaccattcagaatctgatcagaatagtaggaggtcatgcaaagagaaaaaaatgagtaatagaaagaaaaggaagttaaaacaattagaagagaaaaaaagactaaataagatacatgaagatttgacaaatgatttaaagaagtatactttaagtgatcaggagcttcagcttatgatgggcattacaaatacaagaataaataacaaacaaaagcaaatacttagaagtagatatttagcagcaaagttggaattaccagattttcttaaattaaaagattgttcttctaaatcaaagaattatatttccgaatctgaatctgaatctgaatctaaacatgaatttaaacctgaatctgaacctgaaaactctaaagttgatgatttagttcatcttgctgattatgataaagaattgaaatccgagaatgaaaattttgattccgaatcaaaattagaattgaagaaaaatgagcaattaaaagaagaaaatcaaaagaaagaaagtaaaggtcgttatataagaaaatacacgtcacttgtaataaagaatgataatgatagaccaatcattaatagaactcctgaaatagagtttcaacgttcagaattacctgttagagtttatgagtttgagattttggatgctattgagaataatgatgttgttattgtaacaggagcaacaggaagtggtaaatcaactcaagtacctcaattattatatgaatcaggatattgtcaattaaagaaaggacaaaacaataatcatgtaaatgaaagtgaaaaaagatatatgataggtttaacacaaccaagaaggattgcagcaacatcattaagtaatagaattggcgaagaattgaatgactcaaaagttgttggatatcaaatacgttatgataaaaaaaattgtacaaatgaaacagtaattaaagtaatgacagatggtgttttattacaagaaatacaaaaagatttattatgttcaaagtatagtgttatattaatagatgaagcacatgaaagaacagtaaataccgatattttgattggattattatctagaattgtaatatttaggagagaggagtatattaggaagactaaacaaggattagaagatatattaccaccattaaaacttataataatgtcagcaactttaagagttactgatttttcagaaaatcccaaattgttttcaaaacctcctcctgttattaatatagagactccaaactttcctgttacccttcacttcagtaaaaacactccaaaagattatatatcagcagcttataagaagattcaacaaattcataataggcttcctcctggttctattttagtttttgtaacaggaaagaaggaagttaacctattggtaaatttgatcaataataaggggaaaaataaagccaaaagaaattgtctattaaacaatacaacaaattctaagatgaatatgcttttggactttacggagaataacctcgaagaggaggagttggaggaattagaagaggaggaggaggaggaggaggaggaggaggaggaagaagaagaagaagaagaagaagaagaagaagaagaagaagatgatgatgatgaattggaagaagagcaattagatgaattagaacaagaggaattagaagaagaggaaaaagaacaacaaaaagaacaagaaaatgaggtaagtgagggaagcaaaaacgtttgggaaagttttggcaagaaggatatcaggaagcgaaaaataaggcttcacaaagatgtggattcatctgtatggaaaggtggaggagttattgaggaagatgatagtgaggaagaaaaagattcagtgaaaaaagaagagagaaataaaaataagaaaccagaaaatattaagattcaacttatagcaattcccttatatgcatccatgagctttgatgaacaaaaaaaagcattcaaattgcctgaatctaataatataagacacgtaatcatttcaacaaatgtttctgaaacttcaattactattccaaatgtaaggtatgtaatagatacaggtaaagaaaaaagaagagaatatactaaaggatcagactcttctcactttactgtagaatggatttcaaaagcttcagcaagccaaagatctggaagagctggaagagttggaccaggtcattgctatagactttactcttcaccaatctacgaaaatatatttccaaaatttgctccaattgatattttgtcaatacctcttgattctgtattgttatacatgcattctttgggaataccagatattgtggatttcccatttcccactccacctgaaaagtcacaaatagatcaagcttatcagcttctaactattcttggatcagttgaaagcaggaaatccaaatatatattaactaaccagggaatttccatttccagttttccattaccaccaagatatgcaaagatattacttttaacaacagcctatataagaaagaatttaataaatgatgacttaaaatcttctatagaacttttacaacaagtttgtatattagtttcatatttatcaataggaaatttaagagatgaaagtttttcatcagatactcaaaaagaacataatcaaggaataaagaatgttgatcatcagaatttgaatgatgattttgaatcatttccctcaaatttaggaaatgatattgaaatcaatttatggttttgtattaaatatttggaatattatggctcaggaagaaaacatgaaagatctctttctgataaattttgtaagaaatttgaattaaattcaagaggattatctgaaatcagattaatgtcaattcaactttttaatataactaaaaagaaatatttggataaattaattaattctgaagctaatttaaatattaaatggcctccaagtcttccaaattatactcaaaagaatctactacgtactttctttatctctagctttattgatcatattgctgttagaaatgatggtaatttggtctctaaggtttcatatcaaattcctaatgaatcaccaaacagttattccgcttttattcatcccagaagtgtattaaaaagttccaagccaaaattactcatttatagccaaataatatcatccactgataaaaacagacataatttatgtgattgcttattaataacaactgatgatatttctaaagctacatctcttaaacactcacttgtggattgctctaaaattttaagctttccaactccttattataatattgaaagtgattctataattggatattgtactccaaaatatagaaataattcagttgttattgatctaccttcatcagaaattcaacttgaaaccaataataatattgtttttgaagtatttgctagagctatattaaatggccaagtttttaaagaatttaagaatcagagaattttaaagggtcttaaatccaaaaataataattctaaccaatttaaacttttggttaatactcttgaacaaaatttaatttttaataaatctcgattaatttctaaattccaaactaagagagattttctactaaagaatattctacaattatatgaaatttcagttcacaatgatattaggagcttttggcctccaattaaataa

SEQ ID NO: 2199 - DNA, 1356 bp, Cryptosporidium hominis
atgaactcatgtaatagtgtgggtttatgctcagcagaatctgaatctccaatattgcaacataattatgatagtgtagatacaaatggaaatacatcatttggaagaacaaatatgtcaagaagagatgatttttgttgtatgagtgatcgaaatgtagaagataatgaaaataattcatttatacctcaagattgttgtagttcaaatccaagaatagtagaagatagtaatcaagattcggtttcatctccaggaggtaatgctcaaatagtaacagttccactagtacaagaagtaaatgtaagggatagaataatagaagttcctgaagtacatataacacagaaaattcgtcaaaaagtcatagtaaaagatgtaattagaaaggttccaaaacaagaaattcaatatgtagataaatttgttgaagtaccagaagtaaggattgtagataaatttgtatctaaacctgtaacgaaatatgttgaaaggcatgtaccgaaagtagaagtacgtgaaatagttaaggaaataccaaaaattgagatacaatatgttgagaagattgtagaagtaccagaaataagagttgtagataaaattgttgaaataccaacaattaaacatgtaattaaagaagtaccaaaaattgaaataaaagaaatacaagtcgaaaaaatagttaaagtaccaaaaattgaaataaaacaaatagaaaaagaaagaaaagtattgggtccagtagaatatattgatatacctatagaaaagattatattaaagccaaatcctcaaattattgaaaagattgttcaagtaccaataccaaaagaagttgaaattgaggtacctgtatataatccagatattagagatactgttgaaatagaagttgataattattatactgttgaaaaagaagttgaagttcctatacctgggagaattattcctgtaccagttgaagtagaagttgagaagattgttgaagtacctgtacaagttccacaagaacatattagaattgtacaaaaacaagtacctcaatatattgaacacattagaactgttgagattcctcaataccaagatgagtttgttgaggttccacaatatgttccaatggtacatcatactattattaaacctgttgtatctcaagaatataaggaacttcctcctgttgttgaacaaggagatgttagatatgtcaaggagcctccacagtatttagaaactgaatatgttcatggcgagcctattgaattagactgcaatactcctcttccagctcctccatctcctagatatactacaattaaggttaacagtgcaaataatagggatagttag

SEQ ID NO: 2200 - DNA, 720 bp, Cryptosporidium hominis
atggatttggaaaatatatctcagagtcaagaagtgggttcgatagaaaaagagaatgtttccaaagaaccagtgatcaatggatttatactagaaaccaatgaaaatgaaccatttgatttggataaatgtatcgaaaaacttctttcttgtaagcctttatcatccaataatattaaacaattatgttcaaaacttaaagagattctaattaatgaatcaaatgtacaaaaggtgagatgcccagtaactattgcaggagatatacatggacaattctttgacttattagagctattcagaattggtgggatgcctcctgatgttaattatttatttcttggtgattatgttgatagaggatatcatagtattgaatgtatatgtttaatcatggcacttaaaataagatacaaagacaaagtaactattttaagaggcaaccatgaatgtaggcatatttcacagatatacggattttatgatgaatgtttaagaaaatatggtaatgcgtcaatatggcatgaattgactgatatgtttgattacctacctcttggcgctttggttgaacatcatatgttttgtgatcatggtggtctttctcctggagctttaacaattgatgaaattgattctattaatagatttcaggaaataccacatgagggtccaatgtgtgatttactttggtctgatcctgatgagaaaacagggtaa

SEQ ID NO: 2201 - DNA, 204 bp, Cryptosporidium hominis
atggatggatatacatggtcgcatgatgataatgtagttactgtttttagtgctccaaattactgttatagatgtggaaatcaagcagcattgatggaattggatgagaatgagaacaaacgatttcttacttttgatactgccccaagaagaggtgaattttcaaaaaatatgatgtctttaatgcctcaatattttacttaa

SEQ ID NO: 2202 - DNA, 339 bp, Cryptosporidium hominis
  misc_feature (20)..(20): n is a, c, g, or t
  misc_feature (32)..(32): n is a, c, g, or t
  misc_feature (40)..(40): n is a, c, g, or t
catgaaccaaaagataaagnatctgcaaagcntacatctnataagaataataaaacacctataggtaataccaataatcatagtaataatataataaaaggaggaagcggtaatgctaattataatacaggaaatccgtatgtaaatcaagaaagatttcattataataaaagtacaaattccggagcaaatacagctttcacaaactatggaagaccggaacattcaagttattcaaataattatagtaattattatagaggcggccatattgacaacggagatggtggatctcgaagttataaaaaaggacctgttcaaaactacggtggtagatat

SEQ ID NO: 2203 - DNA, 717 bp, Cryptosporidium hominis
atgacgaatgaattattggattcagatgagataaataaggtttggaatcaaaaccatgaagataaaactactttttctgttatattttcactaactcaaggcatgttttgtatagtaaatatgatttttgggtattttatattatttaaccactttaatcaacttcttgaaaatagatatattttgaaaactctactttttacaatgtttggtgaaatttttacttcaattatatccgcattttgtatgattttggtacgatttatttttggaattagatcttcaacatatttcttatcagttataagtttattaagtacattattacaatctgtattttattattcttgctttgtggccagtgttataattcttcatttatggtatttccaaattaataccaatcctggtaattttctttataattttataattaatacaaatactactttggatttaaaacgtcatttgttgatttatttctttattgaagcttttatttctctcatagaagttttatccagtattccaattctagttagtattataaattatggtttaactaaagaaattgaaaaaattaaaggaaaacctatagtcgaattttataatgttaaccggcccattacatacactaattaccaaaactatgaaagagcatttgagaatttaaataatcaattttctagacctgaagctcattatgtgcagatataa

SEQ ID NO: 2204 - DNA, 651 bp, Cryptosporidium hominis
atggcgagaaagagaagatatggatctgcgattggcggagaacatggtacagaaagtccatatttggaatcaatcaatttaccagatgaaaattattataggaatatgaccgaatctccgatggaactagatcagccacatatgtcaacaaatcctataaaacacggattatcaagagcaaatatgaataatatgattatgcaagatagatataataaaaatatggaagcaagagcagtccccaaagttcgaagaaaaagaacattaattccacaagaatctgttgatgaaagaaatgaaattaatcattcaagaatattccaccaaaatgaaaatgttgatatattccaagatgatttatcatcaagaaattatccaacaaatcattccattaataataactctaaaaatacattcatgtataatacaagaagcaaagcaatgtctatgagacaagttggtgctaatattctagataaatctacagaaaattctctcagaaaaagagctgaaaaaggatcttcaaatctacctcctctccctagaacggaagattattggccaaaaattaataaggatacaactcaagaccatgaggaatatttgaaagattcggtacctaccaagaattctgaatataacaatcaatga

SEQ ID NO: 2205 - DNA, 1482 bp, Cryptosporidium hominis
atggttggtggtgatactcctcttagagatattaatcttcttcaagaaaatcaaggcgatgatgttgttgaactaattgagacaaaaactagtgagattggtgttgggccatctccaaaagttgatattactataaagaagaaagaattaagtgaaagtagtaaaagagaagaagcaaagcaaagaactacaggaagtattttaagaaaaagcattgatgcttctgatgataattattctaaacaagtacgattttcttcaagtagatctaaagttcaacaaaaagaagaaactcttccagaatttgaggaattgaagtttgatccaggtgaaattccgttaattgattatcaagaacatgaagatagatttgataccatagattttgatcaagaaaatgggtccaatgttaaaatagactataataaaatgctggatacaatgactgttgacagcaatatctgtttgaggcttgttcagctatcaaaagaggaaatcagattattcgaaaaatccattaaccaaaaaaatgataatgagggagatcagtctggttcttcatgtaattatattgatgatgaattaatgattaaagcaattagtggtattcataagtatttcttgaataaagcttttgagcatgaaagcgagaaggagttggaattacatgatataatgtcatggattcctgaagttaaatataacgaagataaatatcaaacagtgaattcggaaagagatgaattgataagtaaaattggtcttttgaatttgaatataaatagattaaataaagctttagaggaagcagaagagttgaattcaagattattctcatctagaattgataagaatcaggaagataatcaagaaagtattaatgttatacgagaagactttgaatatattctcaaatctacaagtattcttttgaatgaattagaatcgactaagactcctattaatcagaattttgaatcaccaaaagctaattctagaaaagaagagggagaacaagaaaatagcgatgttgataaaagtgatacaagcaatttatgctctcctactcctgtaatatcttttgaagataatggtgttgcagaaattgatccaaataatatacaagaaaataaaaaacctgatattgatattgatgagctattaagtgaatgtcaccagtcacagtttattcaaatggaaagtattgcagttttaaatgattgcatgtctcttctagatgatgctgaaataggaatgcaaaacttccaaagattactggcaaaaaaggcatttgacactattgaagaagatgaacaacaacatgttggatactctaatggtgattcaatggaagtggttgaagacacattactgagaatacaaaaaggagcatcaataactccaagattcagtttagaggaaagccttaattatagaaggagtagtgttggatctagaaagagcattgggggaaacatatag

(The sequence listing continues in the following parts.)

We claim:

1. An isolated nucleic acid molecule encoding the polypeptide set forth as SEQ. ID. NO:8.

2. The isolated nucleic acid molecule of claim 1, wherein said nucleic acid molecule is set forth as SEQ. ID. NO. 7.

* * * * *